United States Patent 7,868,149 (PLANT GENOME SEQUENCE AND USES THEREOF) - sequence listing, part 87

SEQ ID NO: 45751 - DNA, 7302 bp, Oryza sativa
ctcaaattcctaattaggggaaagggggagaaatcctatactttcaaaaggaaagcaaatgaaagaggtttcctcctaagggcgcaaatgatctccctccaaacggcagttatggccttcttgctgctaaaagaacacagggatacgaaaaaatgcaggaatatgatgaaaaatggaggattaggaaacagaggaattttataggattggatattcggaacacagaaatagaaagtggagaattcaaacaccctatagcagccaatgatgagacacaaacaaaaaggttggaggggatgtttggaatcctttgaaattcctgtgttcactggaatgctacagtattccttcaaaatcccttcggacttcggttaatcactgtgagtgagggattggaggggatttattccacacctattttggtatggattgattcctacgatgcaaacaagtgaacagtagcaaatccaaaaagaatcatcaatcctacaaaaaaaaatcctatgtaaaccctttcatccgaacaggccctaagaaagtcgtcgccggagctcgtgctgccaccgggatccgcagcgcacgcccgccgcaacttcagctctcgccggcagagctcgcgccacgtcgggaatcaacgcaggccaccacacgagctcctcgcaggctcacactacagccgccgccgccgccgccgccgaaggtcctgccgcttgagctcccgcacgagccatggtccgtggagttgtgtgcgagtcgagatcaccagtgactgagatgaaaggttacaggataatgctatgtaaatgaagatattagttgctagagtaaaggttaattaattagaattcctcctatccgtccaaacaccagggtcatgtatatatatcacatgttttttaatcatattctaacgttttgtattcatgtgttttattttaattagaattcctcctatccgtccaaacaccagggtcatgtatatatatcacatgttttttaatcatattctaacgttttgtattcatgtgttttattttctactccctccgtctcaaaatataagcatttttatacttcgacagtcttcgatatgctactttgaccaacgatataagtaagatgtttcaaataaaaagagttgcgctagtttgttcaatgataaacctagtaacattaattttaattttatatgattgatcttttttatttttgttctattaatagtcaaagttataaatatttgacttggcactataataaaaatgattatattttggaatggggggagtagcgttctgagctagaaaatagacaatatgttacttcatttgtatggtttcgataaaatatcactcaccgtaatacattggataaaatgagactaattgtctttagttaattagcatgtgacccatgcagatttgtgtggctagtatttttatattttctcacataatggcacatatattttcacattttattttaaaactagcaaaaatactcgtgtgttgcaatgcgatgtaaatgtttggagctgaaaaagaaaatattgtcgaaatggaaaaagtccaaatgccccccccccctaactttggatgaaatccatctagcaccctgaattctaaaaccggacatttaaccctctaaactttgtaaaatcagtcatattaccatctaagatggttttggatggtggttttgcatattttaaaagcttaaacgaacaactttaaataactaatataacgtatttacgtatcattagtggtaagtcatcaatttatacttatgcggtaatatcatactattattatgttggtacttgtttgtaagtgagagctaacaagtggtaaaaataaagatttaagtggagattttaatacatatattcagtgtgtatgtcatgtgatcaaactcatctaatttatatacaaattagataaaaaaaccattatacaaaaccaccttagggaataatatgatggttttgcaaagtttagggagggtggatgtccgattggtgctagacggatttctatgtaaagtgtatggggtatttggactttttccttttctaaataagccaattgatactcaaattggagcattaatttaaattaaataagttatgggctattttttcaagaaaaacatttcaacttaaatatttaaggtttagtttgatttagattattaccgtggagtgcttacttcgtccctatattttagaacatagagtggctaattaatggtagagataaattaaatatttaaatgaatagcaaaataacatgtgttgcaacgaaggaaggcaggtttaattatgtatgcgtactatatacttcataatatcaaataggaagccccaatggttgcctgtgatcaattagttgatatatgttctgcttttagccgattcatatattgctttatatatttctcttgtgacaagtggatgtatgattgtttgtgaggagaggtaaggagaaaatcaagaagataggtaagactaggcgagccattagtacataattaattgagtattaattattttaaattttaaaaaatgaatttgtatggtttttagagtagcttttatatataaatttttacaaaagacaaatcgtttagtagttcggacaacgtacacgtggaaaatgaggtaaatcttctctcaatcttcaagtgaagaacacgggggatgaaaaagttttaaactacttttattcagactctctacaattatgcgataagttaatttatgtattcaattttaaacatccgcagtgaaacagtgcttaaatattgctgctgagaattatctgatcaaagcaatttataactgtaaaatacttgtgggaaagaagaaagatatccagaagctcatgcaaaatgtgagagggacaatgcatagaacccgactttatctgcactttgctctgaggattgttctctgaaaccaaaaaccactggtgcaaaatagtagtactactcaaccagccaaacctttaccaaagtgaaaagtcaccatgacgttcgcctgttcttgcagcagtgcacgtacccctgctctgagcgcatcaggctcctctaccttcaaaggtgtgagcctttctcactaacatgtaggcccatatgggcccgatgaaccccaggtccacctgttagtgacaaaggtatggtgtctttgaaagcagatgatcttaatccgctctgaacacgcgctcggctggttggcctgcgaaagacatgcttctcttatctcccttttctctgatcgttgtcgctgactctcttaggtctcaacctaggtaggagtctagaagaggagacacggactcatattggaggccgggggctgctgttgtcgtgtggacagcgaatcgccaaattcaggtggcgaccgacgttcgagttgtgttgtcccagaggaatttagattgagtgatttgagtcgaacacgtcgtgcgtgagggactgtagtgttggaacaaaaattaggatgaagaacacaacgtgacacatacggatgaaggcgacggaggaaactcctggtagaaacaagtgggtccaaagatgcaggcgcagcggtaacgcggaaaaggacaacttaccagagccatggtaaaagatggctgctacagtacgagatataccgttagaatgatacactttaataaacctttatcttttctctatctacctgagtaaccacacataaaataaaacgaagcagcagcgctcccccttgctccctcgctcatccacatcaattgcaaggaagggtggaggcatcagaagaggaagggtgaagaagagccaatggcaggtccatcaccaggcgaccaaaaagcaatgacatgtgtcccctctctcctcgacttgataccaagtatctgggcaatgacatgtgtcccctctcttcttgacttgataccaagtacctggacgtactagaccttggtatcgagtgtctggtaccaccatggtacccaagtatcaagcatgatacttataggtatcacctatgatatcgctaggtatcatgatactactggagtatcactgggatattcaaaaggatatccatgtatcaagagaaaactcaagacaaatcaacataaagtaatttcaattctaaaaaatcatatgtttatcaagagagggctcaataaaaaccaataagggaaatcgattccagaaaaaagtcatcataactatagaaacacccataaaatatgtagaaaaccccacatcaaaccctaaaacaagccaatgcaggagcttgagggtcacgagcccagatcttggtctaaagatctgcaccacaaagaggccttgtccttgatgatggtgacctcgtcgacgatggcgacatcttggaacgtggtgagcaactccacctccgtcatgtgctcgggcacctaccccactaacagcttcgcgatctcctcctctaatccgttcacacctccaccagcagcaacaacggcgatggagacggtagcttcctcgacgcccgacgcgccaccccgcacggccagctgccatcgtggcctccgtgctcatgagggtgttagtcagagagagtggaggggaaggggaagagataaaggagaggataagattgaataggtggtgtgaggagtgagggcaagatatttactagtagtagttatcccatgtctatgggacttcgttccctagattttctgatggtaaaaacatcttcaatttttataatagcagaggatagagatatattaagggaaaaaaatatgaattatccccctgaactattacggtcgattgaattacccccccaaaaaaaactcaaataccatacgttttataccctcaattattcaaaccagataaataacccccctgagcactattttaggttgttttgacctaagcttgcacatgtgacgccaatgtggcaatccagtcagcaaagaaaatagaaaaaaagcatgggcccacatgtaatctcccccagtcaagccatccctcccttgctctatctctctctgcagtctacacctaaggcaggagaatacgagaaggcggctgaggaggggcttggagcgatggctccagatccacctccagctgtggacgcagtggcggcagaggaaaaatcgcgtggcgccgtcccagcggatttggcagtgagctcagggagccatagtgatgtcggcttcgtcatcgtcgtcgcccttggagacgtacctgcgtggcgccccaccgacgcatgtggggatgacgtcaaaggcgggaagcgaggtggtggcggcggcgcaggggcgtggggaggggggcgtggagacgccgttactgctggcgaacatcctcgattggtcgaagatccttggcatggagtatgacggcaggggagcacgggcgcggacgcggcgcggtgactgttggatgagcgcggcgacgaggagttccgctggggtaggggctaggtcccgcacacgagctcctcctttgccgggagcgcatcgacgcatccttctccgcccgcaagggcgccggccgcacgctcaagggccgtgacctctgccatatgcgcaacgccatctgggagaagaccggcttctaggactaatgcctctactccaccactgccgctgtcgtgatcctctccatcaaagaggacctagttgccgcagtcgccccagttgtgcccgccgctgcgcctggagctttggcccgcctccccagccactcgtgtgagcttcggcctctgccaccgctgccgcaaccttcgtgcgagcgcgagctccgactcagtcggctgcccccgctcgttgcaggctgcggcaaggggagggagtgcccggagcttcggcgcctaccgtcgggccagccaccctagccactcttgtgagtttcagctccgccaccgctgctgcaaccttcatgtgagcgcgagctccgactttgctggtcgccgccgctcgttgcagcaagggagggagaagagagagagagaggagggaggagagtcttaaaggtggggtccacaccattttttaaaaagaaattaactggactgtcacgtaggactaaaaccactctagattgagccgggggttatttgtccggtttgtatagttaaagggggtaattcaatgtaccatgatagttcatggggtaattcgtacttttttctatattaaaataacaacataattttaaattatgtacaaatgatcaaactaaccggtgtgtatctcctatgctcacgagatgaccaaaacacttctttgtttaaccaaaactgattgatcgatctcacctgcgcgttcgtgcaagtgcctcccaagagtttgttcgtcgccgccaaggagaaggcccgaaaggatgaccaaagtcctgctcggtcctccacgcgctcatcgagccattatcacctccgccaaggttcacaaaaccaatcggttttcgtgtaaaccggccggttttcgtgaaaccgctagttattggtttgtgggagttaatctgtagtagtctattttcgtatggcgttgacccaaagtcattggtctttactgatttttgctaaactagtgaggagcgtttttcacttcgaagacaaaaaggtaaaccctgacctccgctcttttatcggcaacaggcaaatcaacgaatgaggatatccagatagagcatgaaccatagtggcatagtgccaagatttgcactagcaagcctagaacagtaggtaccaggcaaacgaagcaatcggttagcgtccaggatcacctccagcctccaggtacggcgttctcctggagaccagaatggatgtgtacgaaagagatgataatattatagctgtttggttggaggtagtttttagaagggattggaagtttagaggaataaggttattaagtgttttgtttggttgagagacatgagaattttgttagaatggagatggtgaattgaggaaggaactccctccttttcaatatctgggtaggggcaggtaattgggagggaataccttctttactttatctaagcaaaatctcagccatccgtttttattaatgacctaatctccaactaaactccctatcaatttccatcacctctaccaaacaatatattgagattaaaaatcaaattctcattttagtcccatcatcaaattttttgtctaaactacaatctcattatatcgagttaccaaacaaaccgagaatatgagaagccgccgccgcaaagaagccacgagaccaaggatcggcgcgcactccaattattaatagacgattgcag

SEQ ID NO: 45752 - DNA, 1116 bp, Oryza sativa
  unsure (1)..(1116): unsure at all n locations
ggaagatcttatcaataaagtgataccctccattacttattaccatttgaggtgttccgaaatggaggaagatgatttcgtggaatatccaacgggcgtgcttggtgtcagcgacttagcacggcattgcttctacccactctaacacatagtcgatgggcaccaagatatactcacaatcatgggactttgggaaaggtccccatagatcaaataactccacttgaaagttgtaggtcaagggaatcgcatcttgagtggtgatatctccatgcttctggcatttccaacatattcgaatgaattctttagtatcttcgtatatggttggctagaagaatccactctaccatatctttgcatgtgtgcaaaatgcatcataatgccctccatatggtgcatcatgaaatttttccagagaatgatctggttaccttcagcagctagtacacatctcctaaggaagctgtatgcacactctgtaaaggtatgactcatcccacaagtatcgtctgttctcgtagatgagcctcctttcgttctccctttgtcatatgaatcctgcaaacatgaaattcacagtatttgcataccatgcattggaatctgttacatatagtagcatgtcatcccgtaggaagtcatttatcggcggttcctgtatgtcagtcttgacaaacgatcagccaccatattttctactcatttcttatcttttatttccatatcaaattcatggagtataaggacctagtttagcattggctttcccctggtctgccaagtgaatccagcctaaagctatataacatacctgaaagtggatgtttaccaatgacggacagagatgtcactacctgctgcctacctctacaacccatggagcacgcaacaaacaaagataacctttaacctagatactatctctacattattgattactactctagactcacgtaagaacttctctatccagagtcttattactagagcacttaatataaaccttaagcaatgcacccgcaatgaatagaatatatcttacttaaacaagaaaattaaatacctaaaagaaatctcgnnnnnnnnnnnnnnnnnnnnnnnnnnnnnnnnnnn

SEQ ID NO: 45753 - DNA, 2661 bp, Oryza sativa
  unsure (1)..(2661): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgtcactctacccttggattatgttaacccctgcttagaatatgattatcacaagtaatatataaattattagtcaagttctctgtcacgaccggaaataacccaacgggcgttccttacgtgcgtgcattattccttgtcccaggaggcaaggtacaccaaaagttgatacagttcagagtttaacaagcggaagcgtaaatagataatttattacatgggcagcgaaggcccagcacacacaaagacaaacgagaaacagcggaagactagggcgacgaccacaggcgcttgacggcaggcacgagctagacaccaaagccttcatcttccagggactcctcttctgggtttgggaaaaattgagcaagactgagtacaaccaccgtactcaacaagacacacccacaagtgcagaataaatgcaagggagtacaagggagttataatataaagggttagggtttgcagtaaacagcattaaaagacacttagttgctcaaagctattttgtaaatacggtcctagagctatacaatattattaaacaaagccgtgaacccacacgaacttgccttaacccaaggcctacgaagattcagaccgaactggcaacccgaccctgggtcccagctcgtcccaagccaacccaggccaaccattccacattttagttgttaaacaggttttaagaattaaaacactaacttgggtacattgctcggcttgcccataaccgagggcgcgactattcgaatagattatactctgatcagaggtgtacatctttacccacaggacacatcttcctcacgtgtagccacgtgccacataccaccacggtatacggacggaagacgtgacatagtttccaacccatcctagccatagacaagagtaccgacccaatcccacctacggctggaacccccgggacaggtaggcaggactgagcccctagcagcaggacaccggccctgtgccatgacatctcgactaccgggccgcagctcatgtagccttcatttgccctagagatgtccatcgacccccgacttcgtccatctccatccgtgtacttttgtttataaccaggctgagccacaaactaagccttaccaactagacatgtggaagtacggtagtgctttgcaacagaggcccgaagaccggtccttatatcgccgaggtgctactatcaaaaccatgcaccccgagcccagcctaaaaccattgtgggaattttgaatagagggggcggggtgaatccaattccacaataatcaaaccattccatagtgtccaggtgatgagaaaattcccaaagtctagagatgtaaaaccacctaatgttgcctaattaaccagcgaagcatctacctaaattcataccagtggtaccaagagtagagtgtccacttgttggggttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaagttttaattaaaaaaaaggtttattgcgtcagccgaggggagggggcgcgcggaccgggtccacgggggtggttcccatgcggcagcctcacggtccacggtggactgggcgcacccgggctcgcaccggccggcgccgtgggtcccacgcgtcagccgcacccgagggcgcgggcggctgacggccgggccccacgcggcagccgctcggtgcgcccgaaggcggccacgccggcgcaaaggcgggaggcggcgcgcccgcgcccctatggtcgccggcggcggccataggcacggcggagcggcggccgacagaggggagggaaagggggaaatgaagcggcggtccacggctcacccctgttcgacggcgacgacggaaacggcgaccggagcggaggaaggcggcggcgcggctcgggtggacggggtccacggtgctccggcggtcggcgaccgaaacggagaggtggacgaggtcggcgaggacgcggcgaagcccaaggaggcggcgcccaggtgggaggtggt

SEQ ID NO: 45754 - DNA, 3474 bp, Oryza sativa
  unsure (1)..(3474): unsure at all n locations
nnnnnnnnnnnnnnnnnnnnnnnnnnnnnnnnnnatccaatggctaaaaacattggttttactggtttaagtaaaaaccaatgattggattttcttttccataagaattttaaagatttaatctatctcattagagcgtcacctgatatcttagaagtatttatagaaatgtcacgtgaactagaatacttcatagaattttactatataactaggaagataacatgtgcattcacgcgggcatcgtattatttagtttcgaaaacagatataacaaaataagttaaaaactaaagtatggtattttccctttttaattgaatgttcgttgtttatttttcttaagaaatcttgacaaaattttagctaacaaattaatttttttttaccatcatgctggaatataaatatcttagatagcgcttctctatgacatgagggaccctacgctatttttaagaaaacacatagtcaacatgagttttaaaataataatttattggaaaaaaattgtaaactttaatcatattgtcataagaaaggctactgattttgtattgccaccttagtagcttatatgtgcaagatgtggagaaacctatggagctactttaaaggacatgaattttttgagttcgttgattcataattgaaatatggttaggagctaaaataattttttttctatagccaggggagtagaatgacttaatactatcttgtgggtgaagtgctccactaaatagttctatatacaaaagctgcaacgcaatctcgtgggtaagtactgcactaaaatagttttgtgcaaaaaggactgcaaaagttattttcaaaggcggcccatgagcgtaatgcaagtggctcgccacaaaggaggctacacatttgagccacatgtgtaaagaatgctcgcgaaaatcatttgggtaacattacaatgaaaataattgttcatgcaattaaaaataagtgtcttaaaattatcattttatacattggttgttgataatccctatttgaaaatagtgatacgtacaaatatttttgtccatattattccttaccaacagccgatggcaattgatagttcctttcggtatgtagcaacattggctaggtatttttacaacttactattgtatccctttgttaagatgcccttgctattttcttatatgctagattttctccaccttggatgcatgtgacactatatatatttcaaataaaaggcctcgtggagttcaaattgatttcggattgtaggagactactcactgtttatgcagagtgcgtgagacttcacgtggcctagcaggaatataatttcctagcaaaaaaacaattccataaaaataatttttattgtggtgtggactttttatgattgccatcatgagttaaatatttttactctaaatatgatttatatacttcaaatgatcactctttataattttcctttagctaatgtgcattggccatttagtaagtatacataccctatacacacaaaatttttgtatacacaccgtgcacaccaactacaatcacaaaaaactgtaaaaaaaaactatgcatgtactttcaacagtacaacaaaaactgaaaaaggatgaagaaaataagatgatcttaagagataaaaaacgaatctggacatttgtttagaaatatttatatgatattgaatgaactatttattaggagataatatatgaaaagttggctagatatagtaagttgatgggctttttaggcccataaaaaagtatttaattttaatttttatggggattaaaaaaagagaggaacggtagttggagggatcgttgcgcaccaaggctgatgtccggacggagattttctttccttgtgaagtaaatctaacgtccaaaattaaaggatccaccaatttaaatgagaatcaattgtcttgtcagatttttactattttgttatagtgacacatgacgatttgagagtatttataggatgccacatgatagcctaggaacgtttgtagtaaatttaatggacttttaatataatagatagataatatatacatggttaaaattaaataacactatgatatctactacaattataaatgggagtacctatacatctttcgaaagatttttattatcgtatcacacagatttttaatctttagattaaaatccgatagatataataaaaagaaaaaagcaattaagaaacaccataatggacactaaattaccatatcctcaagaaaaagaccaaatccaatacaaaatttaaaatttacatgcgaagattcaaaaattatagtgtaacaaaagttacagtataagtttcataaattacactgtaacttacaagaaaatgcactgtaaatttgagtgagaaaatcgagtgagagataagaaaaaatctttcgagtgagatatagcaaaatcgattataaattcgaaagttattcaacaaaaaaaaactatcgaattacaatactgcatatgaactctttattcccagcaatttctggttccataacgaaatgcggtgattcttcgagccctctacttatatatatgatgtgtcccctctgtccatgatcatattcaaatccaaagtagaagatagctagaggcagtgtcatggcgtccactcaaagcaacgagcacggggctggcttgctcgatgctgagctctagctctacgtgaacaccttggccgtcatcaaatccgtggccctcaaggccgccatggacctcggcatcgccgacgccatccaccaccacggcggcgccgccaccctgtcccagatagtcaccagggtcacgtcgctgcacccgtccaagatcccgtgcctgcgccgcctgatgcgcgtgctcaccctcaccggcgtcttcgcagtcgagacgacggagccggtagacggcgcggcggccgacgagctgccggccgccgtctacgcgctcacgccggcgtcccgcctcctcctcgtcggctccgggaaccaccaccagcaggcgtcgctcatgtcaatgctgctccacccgagcttcatcgcctccttcctccggatcagcgactggctccagcgcgagctgccgggcccgtgcatcttcgagcacacccatggccggagcatgtgggagatggccgacgacgacgcggccttcaacaaggtcgtcaacaataggatggtctccgacagccgcttggtgatggacgtcgtcgtcagggagcacggcgaggtgtcccgcgggatcagctcactggtggacgtcgccgggggccacggcacggcggcgcgggccatcgccgaggcgttcccggaggtgagatgcaccgtgctggacctcccccacgtcgtcgccggggctcccgttggcgccggccccggcgtggagtacgtcgccggcgacatgttcgagagcgtcccaccggcaaacgctgtcttcctcaaggtataatgtt

SEQ ID NO: 45755 - DNA, 2818 bp, Oryza sativa
tgcaggggaaaggcgtgcaaaggcaagtttgcgggaaatcttggtacaaaggcaaaggcattcattctaatccaagtacagtgtgggggaaatctcgcaggcttccagtcacgtacgcaaatgagattcccatatctatgctacaacatgatttgggaaccacacaagaaaagacaaagtgatcgggactaagatgtggtcggccgaaccacccatgagcaatggtttgcacaattcctcactgaacctcccagaatttttagtttaaatggttcttactattgaaaaatatctggaaaatcaaactcaagattacaataaactaggacgtcttaactagggtatatgattttccttgaaatgacttgcatactctttattcttcacataatacttgttccttgtgaacataaatttataggaatatatcttatctaagtaattgatgaataaaagatggcctgataaaatgaactttgctcttatgtgttgagtattttggaatttttatgaagaaaaaggtataactttacaaacttctcaatgatgcattattcctaccaaagtcgtatgttgatcatattgacataccttacacatgagctgcatcttattacattgagtttagtcaaattgttgagaatattgtaagattctttttatgatttcaagatcaagatcacggacacaccacaaccatatgctatatttctacactggaagttagcaacctttgcccatccaccaaataatgcctccgtatacctatgatcctctctccaactatccatccaaaatgagacttgtgctaaagaaatgagaaaaaaatagatatatgctcacaaagatatcctcgagcgtgaaaaataaaagagaaagagaaagcaagcacccatttctcgaagtgttgctgaaatatttgtatgcaggatgttatatatgaaaatacacctgccatgtgaagaaacatacctccggccaatcaatcatgagcacagggattgaagacccacaaataacagcaaaccgacataattgaggccaattcagtgtgtcatgagagcccatatgtcagcctcacagaagaaagttggtggctagtgacagtggaagtggttcgggcgtcacgtgaagcttcctcattggttccctatgacggtaatggatgaaatggacttaaccacgttcgttagtaactgttattaggcatcaataaaagaaggaatgagcttcaatctcaacacacaactcaagtggagatctctaactttcattcaaggctactctctagcagagtgttagaaaatatggagagagtgagggcaaattccaacagcagtctctcaactcttgtacctcggcagatgtatgttttataaaaatgagtactcgatatttgttctgggtttttaaattttcttgtttaagtaaaatatattctcatcattgcagcttcatcgcttaatattttatataaagtgctccaatactcaggctgtataaagaaggaaattcttgcaccaggctagctatattagtaatagataatgtagatgtagtgtttatgttaaggattgcctttgtttgttgcgtgctccacaggttttagatgtaggtggtaggttacggcagccttatttgtcctttatagtcttccacggttgggtgtgtcatagagctataaaccggattgacatggcagaccaggagaaacccggtgcccaaaccaaatgtgagagttttaccttaacttaattaaaaaatcgtaacccatagcaaatcgtctctaccatacgcctatcatttagttgttatccttggaagaacttgttccttagattttacacacacattcactgttactcaatacccttggaatactctaaggtgaaatgctacaacagtatccgtgcgcttgtagatttatttcagattgcaacaaataccaacatgcccaaggccacgcgcgtcgaggaagagctctcggatgacaagctgctggtgtagcagggacaacaaggtggcatcctcctcatcgtcatcatcattctcgcctgacgccaagctcctcaggatgttgaagttgctttgcgccacaatctcctgcttttctagcaccccgtcatcacaaagcaagcaagcaatcactcgaacactttctggtagattaaccacccaaccgaccaaaaaaaactaaacaacgcaaacaaaaatcaccgaagctgtggctaggtcagatcacaactcgctagagccaacgacaatcaatcgcaatgatgacggcttggattggatattatagcgtggagtctatttcgagaaaatgaagtagaggaggaagagatagaagtagaagaaggccatgttcagtcctagtcttggacgaacatcgtattctcctcccaccatgccctatgcaggaggatgtgatcccagctgtcgcctcgggtatcatgaaatgggggaataatttaccactaggttcctctattggctccatcgctttccgcgagagaagaagcaaaggtgggtgtgctcaaatgtgaggtaggaagggaaggttgtggtggggtttgggaaggtggttgtctctggcgccagcgagtgatggagcgtttgagaggaagagaaaaaaaggggtggggggtttatatatagacggaaggcagggctgcaggtagtagctgttggaagccggtgttactcctgctttcctagctcgctgaggtggctgaactcggagcccaccaccagcgctggcaagcatgcaggagacaagtggaatagaagaggggaaggcaagaagtggaagaaggcg

SEQ ID NO: 45756 - DNA, 878 bp, Oryza sativa
tgagggttattgttggatcgaacacaagtaaccaagcctaccataagggaggtgaatggtagggaaaaccaaaaacccaaaaacttttagcggaaataaaacttaccctcaaatcgatggaaatcttgatgttgtccgatcgccgtcggtcacaacgctcctaagccgctggtctgaccttcgtagcctatccggtcagaccgctgcactcccttcagttagaccgtcgtactcccaccggttagactgccgccttgctgtcggtcaaaccgttgggatccagaaaatacgtatcgacgaaactcttgaaagtatatcaactttgttgcatcaatatgtatttacaaaatgcatctaaagcactcctctctaaactcaccaactaggattgaaagcttgaagcaaaccctaacttttctctcccaaaagtcaatatccttctagcctcacccctcatctatttataaaaaaaaaccctactcaaagtaggtctagaactcctattcacaatagaactttatggagagacctacggatcggacattcaatccaggagaaaaaaatcggacgcccgtcccagccatcggatcgagggattaaatcccgaccattggtagcgcgtcgttactgttcgatgcaaacttctcctgggcatctacatgcatccatgcaacttttcccgcgcacagaattgcatgtgtgacagggatagttaatgttttgtaagcaaactttaaactatttttttctcttaaattattaatccaaatcatgatccaattacaccattaaattcgttgcaattaaatctttaaaacaagaccacacatggatatattctgacgaaaaaaattttagcttattattgaattattttt

SEQ ID NO: 45757 - DNA, 4535 bp, Oryza sativa
tctatacacagtgaaacattgtgagtacactaggtgaaatattttatgtggaacaacaaataaaacgaattcccttaatagagtatttccaaaatatgtgggtgatttgttgcaacgtggtgcgtggtggggacacgtggcaggagcggcgcagtggtggggatacatgcacgggcgcaggcgcacgcgggaagcgcggcgcgtggagggatcgcccgattgtttggcgcacggatcgggagttcgggttcaagtattttcggatattttatcaaatatcggacgcccgcccatccttggcgtctggcacatccgtcaggatgcgcatcgtatgccgtttacatgttggcttgtggcgcttgcatggcgtatgtcacattcatgtatttttctactttctctctcttttcctttttctaaaatatgtgttcaatatataattctattacaccattttattcgtcataattagatctttataacaagatctcacatggatatattttgataaaaaatatttattaaaaaatcaaacttatgttgcaccgtctaaaaaaagtttcatcacttgtgcagatgtgtcaacccagttcataaaatgttctagagatgcaacatataaaaagtattgactgcaacagtaattatcactacatgaaacattatgtcccaattagtaaaacattgaaaaaaaatcgtgtgatacaatacatttgcaaatatttgattttgttaaaatatttttgtatttagcttgcatcaaattgtaatcgttgaaacataaaaaaaatgtttgctgaaacatataaaaaataatgtgcaacattgctaatgcattagtgaaacattaataaatacttattggaacatatattaacaatgtgtgcaacatttaaaaagtaaaaaaaagtgatcagagtatagtcgtgtgatatcttgttataaaaatttaattataacaaatccaacgatataattagtttgaaatacagataaatagtttgagagaaaaaaaaatcattttaagtttaaaatatgttttgcgtgcatgctcagacttaccatgcacctgctgctggtttgaattgaggcgtctgattttttttcttccgtttaggacggctgatggtacggaactttatacctcagtttccaaacctatacaatttccgaaacttccacagccgcaaccaaccgcatcggagtcgatctccggcgcttgctcctgctttggcctatcgcacgtgggccgacgtggtgctgctcctgcggctcgccctccagccagctgccaccgaagcccaccgagctttcacacatgcatggcacaacacacgtgcatgctgtactacatcctactgctcctgttgatcgatcccatcgaccaagcagcatacgcatgcatgctacagtacctcgccgtactgtagcaccacatactcctctctagtatcttccaatttccttcggcaacaacgacacttctacacacacattgtgaaacccgttacgaagatctttttcacacggtgtccatctatcatgtgacatctcgtatccaagttcgtcacccggtatccttgaccgtcaagaccttaactcctccctgagtctagtcccgatccccatcgttgggcgaagttaacctctaagaatcctgactctagtcaccttctcacatggtatcctaaccacactagatctcttctcccttagtatagtcccggtcctcaccattgaccaaggctgaccttaagtcacctgcacacaattagacaaaacaactatttctggacacagagatcacaacctgacccacattagtcacacgcactcacaccaacattcacacatactctcaaactaattctttaattaaatcatttgcaaagccaattattctcacaaatattaatcatgacaatgattttacagttatcaagtggacttattcttttatagcacaggctgaatctgagtggtgggagtatcacggctaaacgtacgttttatttgttttctcaaatttgttttgaatttctatttaaatttgtaagtacaaaacttatatgtacaaagtttctctgcgcatatatacaaaattgtctatgtataaattattctatatgtaaacttttctttcgctgacacgccgctcaattcatttcaattctatatctgcaaaatttatataagcgtaaaaagtttctatgcccaattatcagtgcagagaatgtgtatatatggataaacctttttaggctcaagagttttatagttttgtaactgagtgtggctgagacccgcacggtcgagcatgctttagactaaccttatataatgagcttgtaataccccgagcaaattacatccacggcgcatcaacttggcagatgggcgcaatttagtacaataacttaaaaaatgagcgttctagtgcaacaacttgacacataggtgtattttagtataagaactttataaattatcatataaatgcaacaacttgcatgataagtacgattttgatacaacaaattaaaaagttacataacaacttaattatttggagcgtttttttatataaatttaatttttaagtacttatttttagtatatttatatttttaccctaataattaatactgaaagtcaattaaactagatttagaaattattatatttcggttgatatatgagaaggtgaagaaaaaaaattcttaaaggtaattggatgtaaatttcactactatgtgcataattcttaaagattaagttcaatattataaggtaatatctgtatgattactttgtaataggatattgacatcgtgagaaaaaactcgtctagcatatgcttagccaagttgataccaaggtactagaacgcacctacttgttaatttgttgcactcgaatgttcaattctcaagttcttgcactatatcgcacccacctgcaaagttgttgtaccatgggtgtaatttactcaaaattcaacttttgaaccgttctttgaatagacgatcagaatctgtggatgtgtagagctcgtcgagttaggaaaaaatagactataagttgatcggagtccggaggaatttatgttgattgaattaatgtgggccgttgatcttcattaggctctctctatttaacaaacagaggaaaaaaaaaagggcaggggataggggattgctagcagctacccgtagcctttgtcgtcctcatcctcgcgtctgttttgaataagacgaacggtcaaatatgtgctaaaaagtcaacgctgttacacaagtgaccatgtgactcctcctccccccacccctctgaacttagggcatgcagatgactgctgttttgcaccatcttttttatgtagtatttgctacgtctttcgttaatggcaggtggatataggccctgatatcagtgagatgtccaaggtaaatagggatcccgagaaattacaaatgacaaataagaaagtggcacgtatacataaagtagttcgactcacacataattatttggttgcgtcacaatttcagaacacaactgagcttgcacacgcttattccaagcctcagcagcaacaaattaacagacatgctccacacactacaacagaaacatcatataacacttttgtagaggcgctttggaaattgcctcttagatcatcagttttatagtgtatagacactttacagaggcactataaaaattgcctagaaaatttttactctagatatactttagaaatattttcagtatattttattagattttatcttgtagagatattctttcggcagtttaaattgtgcctgatatgtaaaggcattttcttgagacactttaaactttgtaaagacacttcttagaataaaaatatgtactaaatgactaatataagtaactcaaggcaaaaacatacaagtaatgagtggggttgagttggttagtgccttgaagataagtatgatttgtgcaattgatcataagtttaaggattgggaaaaacagggaaaatattttattttatactagtttttcatatggttgtagtacaatttaatgtctctagaaagacattttacaaaatgcctcttttacagatacaattcacataaggtacttattaggtattttttaaaatgcctctatagtattgcaaaggtatttgaaaagtgtctctacactgacacttggcaataatcattgtcttttttaagggtaaacctcaatgattgacctggagcctagaactggcatgatcttgtagtcactaaacccggcttcgacgaaaaccttcttccactcttgctcgtctcgctccacaccattgataagcatgatgtatgcatcaaacaaggtctgcatctctaaatgcttttgatcaggtggccctactccgaccaccatgtctacgactattacctttcctccagcatctctagatggaatggctttcttgcagttctttagtatcttgacacattcatcatcgccccagtcatgcataatccact

SEQ ID NO: 45758 - DNA, 876 bp, Oryza sativa
  unsure (1)..(876): unsure at all n locations
nnnnnnnnnnnnnnnnnnnnnnnnnnnnnnnnnnnnnnnnnnnnnagctaagtctgaaaatatctagcataccacttagtctactttgcacctttactaaaattagaccataactcgtttagtaaaaccctttgatcagcatgttaaaaataatgcactctaccactatatgaaattacttaatctaattcaaaatataaccacatgaaatgacatatataagttaaacagtacatagagatgcaatttttttatttttatttcatttttttgatatttttttcacacttaggagaacataggaaccaaccgtataaaaaataaactcaaacggacaaaatatgtgacatgtagaattttccgaaactctatcaaaacggacaaaatatgccatctattaaaataggcgtaactttctcatacggactcggaatcaggcaaataatatatgtacggacatctacagaaaaagttatatccgattctcctccgctttgccgggttcggcgatattaaaacctccaaattccgcttgcaagattgtgttttcgaggagagaagtttttcggtggagctttggaaaattccacatgccacatattttgtccgtttgagtttattttttacgtggttggttcctgtgagttcctaagtgtgaaaaaaatatcaaaaaaataaaataaaaataaaaaagttgcacatctctctcctctgcactagttcagagagaggagaggagaggaaaaattctacatatcacatattacatccatttgagttcaatttttctatggttggttcttgtgtgtccctaagcgtgaaaaaaatatcaaacaaataaaacaaaaataaaaaatttcgggggggggggggggt

SEQ ID NO: 45759 - DNA, 2038 bp, Oryza sativa
  unsure (1)..(2038): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnntggacagaaagctcgtggctcgttagctggctcggctcgtgacaggctcggcttggttcggctcatttgaattttctaacgagccgagctggcattttagctctttagagataacgagccagctcgagctggctcgcgagccttaacgagttaggactccatcacagcccaaaagcccaatacaacaaaaaggcccaagcccaagacactgcaaaccctatcctcactcctcactcaattccccactctccccagcagccgccgccactctgcctctcccccagccactgccgctccacctctcccccagccgccgccgccgctccgcctctcccccagccgccaccgcctccgccgccgctaggagatcgagtgcccgccgccgctcgtctctgcctctcccccgcaagcgcccgccgccgccggtctcctcctctccctcgccagcgcccgccgccgacgggaaatcgagcgcccaccgccgccggtctttgcctatcccccaacacccgccgccgccaggagatcgagcgcccaccgccgctgatctccgcctctcccccagcaatccagcgcccgctgccaccggcgctcgcccccagcacccgacgctgccggcgaggggtaccgagctcgtctcctccaagtgccggcggagctgcgtcgagttcatcccctccaccgtcgagctcctccctgtggtcgccggcgagctcgagctattttcctccgccgtcaagatcctcccctcctccccgtgcttgccggctacgtctcttgcccctagcttgcgagcgctaaacgcgctgtctaacgcttgtgacaagacccgccccactatgggtttaggttggtaggaaacaagccgagccgaggtagctcggtttctaacgagccagccgagttagctcgttattctaccgagccagaccgagccgagccgagctagctcgacatccacaccctaacgacaacataatatttgctatcatcataacaataattagtcaaaaatacgatcactcgtatcgagtagtaaacatgatccacaataatatagataagctacatgttagcataataaatagtacgtactactgcaatctgcatataagaatggagatgaatttatatacatcattgtcactatcaaagtatcccacagtcaaagtttaacttcgatatgatcacaagacaaaatcatgtcttagtgccgtttaacgaactaagattatttcagtagctctaaatcatgccatgcaggtaggtaataaatatttacttccgtactgcactagtaataatattaataatatttttactagcaatacagttatacaataaacactgggcgtgctatatatatatagtagtcttacagactattataccatgtatttgtattcatgtagctctttttataagctgttaggaaaaaaatgttcacagtttaaagaatatagaaattacaagtataccactactggagaaaccatctttcgtgggttggccaaaatcaacaatagtcccggttcaactaaaaaccgtttagtcccgatttaaaagtgcaaagggactatatgatgtttagtcttggatggtaaatctttagtcccggttctatttgtttctgacgatgtcagggcgccaaggatatttagagataactagagacttgacttcctcatccgacttagattccctcatcatcttctctcgctgagatttttagtcccgagaccagatcgagatctccattctccactggatttttcacattttgatccttttgaaaaacttatttcgcaagtagatctctagaaaaacttatcccaaaaatggtcctttttggggcgccagagtggctggcgccatcgttcaacaggacggcgccagcctctttggcgccgtcccaccgccgacgtggcggggcgatgctaaggtggctaggggga

SEQ ID NO: 45760 - DNA, 1060 bp, Oryza sativa
ggcggccgcgctgggaagacgccgggagaaccggtggcgatcgccgggcgggggctgcagcggccaggctggggactaaagatgggtacctttaatcccggattcgcggtcccggttgtataaccgggactacatatgggggtaacgaaccgggattaaaaacactttctaccattctactactctaccttcccatcatgttggactgtacaacaataatttatataattcaagataaaaattgctaagcaccgtgctacttgttgtggactctcaattagtatccttgttaatgaataaccaatttttgaagtgttaattgccaaatcgtgtctatcacgactcattattaatcttagttattatttataactaatttcataaatcgaagttaacaattacaaagcatgactcagcttggagggccaattttattgcttcaattacgtaatttttctagaaaaatcgaaataacataaatatgaagtcattccggtcttatattctgaatttaattattgtattaatttgatcatagcgaaaattcgagatcagtaattgacagtttgtaattagtatggtgtttttgtttaacctaagccataatttgtaatttctaaatagtacagaatgttatttatttacctcgtgactctctcattatgtttgctatatatattcagtggattatgcatgactggggcgatgatgaatgtgtcaagatactaaagaactgcaagaaagccattccatctagagatgctggaggaaaggtaatagtcgtagacatggtggtcggagtagggccacctgatcaaaagcatttagagatgcagaccttgtttgatgcatacatcatgcttatcaatggtgtggagcgagacgagcaagagtgaaagaaagttttcgtcgaagccgggtttagtgactacaagatcatgccagttttaggctccaggtcaatcattaaggtttacccttataaaaaccaatgattatggccaagtgtcagtgtaaaggcacttttcaaatacatttgcaatactatagaggcatttta

SEQ ID NO: 45761 - DNA, 3620 bp, Oryza sativa
ccccacctatcggcgaccccggggaaaggaggaagccggccggcctggatgggcctcggcctgcggccggcccagcagggaggagggggaggaaggagggaatgggccggcggcccattcgaaaaaaggaggaaaaagagaagaaaaagaaaaggaaaaaagaaaaaggattttccctggaattaaaatattgcttgctcaattttaattggttaaaaattatttctagagctctgaaaattccactaaaaatcctgttaatgaatttcgacatgtagaactcaagaaaaattccacatgtcaaatccgattattatttgcattactttcttagggttttctcttgatttcacctgcattttcttggggtcgttttagaaattaaattttaggcttgggaggagaactttggggtgtgacaaacctaccccccttaaacagaatctcggccccgagattcggaggagctggtgaagaggtgcggatgggcggctttcaactcatcttccctttcccaggttgcttcctcttctgaatgatgactccactgaactcggcaaaatcgggtgaccttgtttctggttctcctttcactggtatcaagtatacgaaccggcttttccacgtatgttagatcctcctggatatcaatgtgttccgaatcagcctgttcttcaggtaccctttagcacttctttaattgggacacgtggaacacgtcatggatgccgatcatgttggatggaagttctaactgataagcaacttccccccttcgttccaggattttgtatggtcccacgaatcgtggtgccaacttgcctttcgtctgaaaacggtgtactccccggagcggagtgacacgaagatacacgtaatctcctgcctcaaaagtgagcttccttcgacggttatccgcgtagctcttctgtcgagactgggcaatcctcaacctttccctgatgattctgactttctcttctgcttccgctaatacctctgttccgaacagttgacgctcgcctgtctgatcccagaagagaggtgtgcggcacttccggccgtataaagcttcaaacggtgccatctgtagactggcctggtagctgttgttgtacgagaattccgcatatggcaaatttttgtcccaagctccaccaaaatcaagagcgcaagctctcaacatatcttccaagatttgattgacccgctcggtctgaccatcagtttgcgggtgataggccgtgctgaaatttaaacgggtccccaatttttcctgcagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactacccagatcgaatcgtgacctgacgatgtccggggcagtcccgttataatgtccattccaatctcctcccatttccattccgggatttgaagaggttggagtaaacctgctggtctttggtgctctgccttcactcattggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcagctctgctatttcagaatcatttacttgagctgctctgacttgatccacgagcgtaggccgtgcctccagagcggctacaaaaccatgttcaacaattcccacgttgagatgctcaaactcctgccgcaattcctcacacatgccctcgatgcatagggcagtgcagtaacttttccggcttaatgcgtctgccaccacattggctttacccgggtggtagtgaatactcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaggtcatgagttggataattcccttcgtgtggacgcaactgccgcgaggcatacgcaaccaccctgccctcttgcattaggacacatccaagtccgtggcgggatgcatcgcaatagacttggaagtctttcatctggtcgggcagaatcaaaactggtgcggatactaatttcttcttgagctcctcaatactcttatcgcactcagctgtccatttaaacttctcatctttcttaagtaactaagtcatgggtcgggcgattctggagaagttttcaatgaatcggcggtaatatcccgcaagtccaagaaaacttcgaatctgcgacacggtcttcggtggggtccttttggtaactgactctacgttcgacggatcaactgccacaccctgagctgtaatgacatggcccagaaatttgacttccgtcaaccagaagtcacacttgctgaacttggcgtatagctggtgctccttcaacttctcgagtaccaaacggagatgttgctcatgttcttcttcggattttgagtagataagaatgtcgtcgatgaacaccacaacaaacttgtccagaaattccatgaatactttgttcatcagattcatgaagaatgcgggtgcgttggtaagtccgaaagacataaccgtgcactcatatagcccgtaccgagtggtgaaggccgtctttggaatatcctcttcctgaattctcaactggtggtagcctgatcgcaggtctatcttagaaaacacttcagctcctttcagttgatcaaacaaatcatcgattcgcagcaagggatatttgttcttgatggtgacctcgttgagtgcgcaataatcaacgcacatcctcttcgtcttatcctttttctccacaaaaatgaccggagcaccccaaggtgaagtacttggtcgaatgtaccctttctgcagctgctcatcaacctgcttcttgacctctgctaattcgttggctgccattctgtacggtctcttgtaaattggagcggttcccggtgccaagtcaatccggaattcaatctctctcttgggtggcatggtagtgaggtcttcggggaacacttctggatactcgcagactatgggtatatattccaatttcctcaagtttttctccacggtgtcgactgggatttccgtctcaatctgattcaaagagaccccttgctttggtgagactagtgatttgtacaccacggtttctcccttctcgttggtcaaggtgactgtgtgattcgcacaatcgatgacccccttaaacttggtcagccaatccatcccaagaatgacatctaggtctttggattcgagaagaatgaggttggctagaaatggtgatctttggatttctatt

SEQ ID NO: 45762 - DNA, 9952 bp, Oryza sativa
gaaacgtacccagtacaaccgctggtgctgcttgtgcctcctccgcagatgcgtggttgacacgagcctggataaaccttggcccagcacgcctaggcttcgggcatttgtcagcgaagtggccaagctcaccacagtgaagcaggaccctggttttgctccagtctccttcttggcttgcgcgggcgggcctgactgtgccggtgccattggtgggcgtggagctgcaccgcggttgggctgacctccatggtggttctgactgccactggcgccctgaggaaagttgctaggattgaacgggcggtactggcggacgatcatggtggtaggtccaccctgctgtccgggagtgaagcgcggcctctggtgacttccctgaggtgccctgaactgtgcggccttcctcttcctgtccatcttgttgcgttgatcctcctgacggattgccttgtccaccagcctctcaaaatcagcgtagtccccagatatcagttggttggtcagctcgtcatccagacccgccatgaacttttcctgcttctcggcgtcggtgcggacatcctctggtgcatatcgcgcgaggcgattgaactcatggaggtactctgtcacagtcctgttgccctgatggagcgcccggaattccctcttcttttgtgccacgaccccatctggcacctacgccttcctgaagctacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatagggttggtggtgctggaaaaggtgggtggcctgacacgcaggaactcaggcaacttggactgagggggagggggaccaaactgttgatgctgctgttcggcgtgctgcagcatccgctggtgcatctgctggtgctgctgctgcatctgctgcatcatggctgccatcatctgggtctgatgtgccattacttgggctagcgtcggattctcgggaagtggtggcggaccattgccagaatcgctgtggggatgcgccccatcagtgcgctcttcgccgttgctgccctcgcctgtcgcgcggctaccattcctggtgtagaccatctggaggaaaagcatacggggagaagaagaaaaacagatgctcagaaactaagctttattacataggaatttaaactgcaattgttctgatctgaattaaaacacttaaagagcaagcaaaaatccttattaagacagccatatcataggcacatgatatcgaccgtcgactgaccccaaacaagcaacctaaacacacaaactaacaagcagaagctagacagtcgataaactaatggaaaacgagcctaatgctcggaacggctccttcggtcggtggagtcgaaggcgtcctcctgctcgtcacccggtacctctgagcgactcccggagcctggcaggtaagtctcgccgctgcctgactgtgagccactggagctgctgctactgagatcgcggctgccactgggagtagcagacaaccaacttccggtgccactggctggacctctggcggctgatgctggagcgaaggagagagcggacgcgggagctggagctggagctgcaggaactgcgggcggaactggaggtgctgcgggagctgctgatggaggtgggttcctgggcgcaagctggatgcgcacgggtgccgtcgtcgtcttgcgggcgtagtgcggatccggactcctcctggcgcgggaagaccctttaactgagcattctccctcttcaggcgcgctatctcgtccttcagagtgacgatcctcatgagcttcccatcgttcaaggccttggtcgccttgtgcaggtccgagtgcatcctatccaatcccctcatcacagcacacatgtgactaaaggtggtgtcgttctcgccggctgtcggacggaaggtactgatatcatcaccactggctcgacgagggtgaaatcggtacgccgtgtcgtggaagatgtagttgtggcgctcccgtagtctagccatcatcaggtatgctgcctcctgacaggcgtgatctgttgagcctccggatgcctcaaccaccatgttagctaggcaggtacccacgtagccgtggacctccaagcgaacacggtgaggaagctcgccactgagcggtggaatcgtcgtgtactctggcgcgttggggtagcccaccaccagtgtcatgcgtgccaactctgccacaaagttgatcatgccttctccgcggtggttgggtgggtgaccggccatctagagaagacaaaggggtaggatcaatgcatgctcaaatccaaatttaaataaagcaataaaagactcaaataagggaatcgaataagagcgaaatttttatgcatagatcattttgcatgagagcgaataaaaaagacagactcacataacgataaaataatgagaaattagatacatactaataataacaaataaagcataaataccttgcaacccatgttcctgagctaggacctaatgcatttcacccatcaaatcccaactgactgacgaataaatcccaatagttttactaaaaccctagactgactcgttttgaaaaatctcacttaaacgagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccaaaaattcccgaatagaatttcaagcagaatgtgcattaaaatccccgtccaggaccggccggggtacacaaacgacaatgttgacattcagatccacgtcttacaaacatcataaaagtcttacataaatgcagcggaagaaaaaaaaagacaacaggagctaagccttgactaaaactgcagcgggaacaccactccacaggcatcctcgacggcacggacaaagcctactcctcgaagaaaccttcatctgacccgaactcgaactctggggttgggaaaagtagagcaagactgagtactacccactgtactcagcaagtcataccggaataggggtatgatgcagggaatcatcaaagaagagctgaagtggttcatttgcataaagcgagcatttataaacagaaattgaaagatttaaacagttgtaataattaattaatattaatcatccgctgtccaacgctatcccacgaagtcacacagatcccaaacaaccctttgagcatgttgatcccgtttaaagctattgtttcttttcaactattgcatttattttcgaatgtcattgggtggaattaacctattcattgttatagcccttttgttcttgattactttattccttgataccttgggttattataacttgactagttgggctatgtatattggttcaactagatattagatataattgcttagctctgcttagaaacattagcacactattgggataacttatgactcactattatttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttattttttgtatagcatggttcattgcggggcaccagactgagaagtggcggagataagcccacgggggtcgctggggagtccatgccttgtttataagggggtgattatgatccaggaatggtgcgctgcggtggattgtgttgtgcgaggggtattgtcacagctcctttccgaggtaccgtggtggtattgaggcacatggtgacatgatgtggggctgtgtattgtgggtacagtggtacacctctgatcagagtaaaactattcgaatagccgtgcccgcggttatgggcgggtctaacaatgtctttcgtgattagtctcacacctctcatcacaataaaagatgctataactggtaataatttgattagctcctggtttggaatggtatattcctggtttggagatagaactgtgcagccgggatggttgttcagaatggttgggcctatacaacagggtatgttgtatagcgttggattaatattgtttaattattacttaactgttgtcatgcccggaatttctatccaaaattccaaacgcttacatgtgtgtgaaccctcgtccaggaatcagccgaggcacacaataacaaattgataatatagtacaaatattactctaattaataagcgaataaaatgtcattacagaggtagatagttcctctcaatcaataaagatctaagcagcggaaaataagataaacggcgcagacgactccactccacaggcagcttgaccaggcctacacctaatcctccacaccatcagcatcactgtagaactcttcctctgatgaatgattgcaacgtgagtatatgacatactcagcaagccacgcagcaaatatgcaagcgcacaaggataccaaaggatggcatagtagggtttcatttgcaaaagcagcatttaacaaatatttcagaatttaataaaacagttaagtattaattaaacaatattaatccaacgctacacaacataccctgttgtataggcccaaccattctgaacaaccatcccggctgcacagttctatcttcaaaccaggaatatactattccaaaccaggagctaatcaaattattaccagttatagcatcaataattatgatgagaggtgtgagactaatcacgaaaaacattgttagacctgcccataaccgcgggcacggctattcgaatagttttactctgatcagaggtgtaccactgtacccacaagacacagccccacaacatgtcaccatgtgcctcaataccaccacggtacctcggaaaggagctgtgacattaccccttgcataacacaacccaccacagcgcaccgttcccggatcataatcacccccttataaacaaggcatggactccccagcgacccctgtgggcttatctccgccacttctcagtctggtgctctgcaatgaaccatgctatacaaaaggtaaagccgttgcccacgctggcttgtggttggcacggttaatgtttcacaaccgaaactcgtgaaccggtccttaattgccatgagcacgactctcaaaaccatgtgctcacaacccaccattatcaggttttagttggcaagtaattaattaaccaatcacgattgaccatcgtgaactatcattaagccatcattaaataataatgaatcataagttatcccaatagtgtgctaatgtttctaagcatggctaagcaatcacacctaatatctagctgaaccaatatataaagcccaactagtcaaattataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaattcttctcctgcgaaaacggactctccggaaacgtcggaatctaaacagaaaagagcaaaaaaaaaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaaagggatttattgcgtcagcggctagggtttgcggtggaccgggcgcacggcagcggttcacgggaacgaacggccgagatcgatcctatccaaaacgaacggccgagatcgatcgggtctacggcggctcacggcagacggccacgatgacgtcagcgacgacgtcaccaccggcggcggctcggcggctcggtcgcgcaagctcgccggcgaacgacggcgcgaggacgcgaacggagggcaccaggacgtagagcgcgacgtggcgaactcaccgatgaccaaaacgtcggcggaagatgaacggacggcggcggcgtcgaggaagaagcggcgacggtcttcggcttgaggacggcgacggtgctccggcgatcttcagtgacggcgaagggacggaggaggacggcaacgatttggcgaccacgatggcgacctccccgagcgacggcgacggctggaacggcggcggcgcacggctggagctgcggtgacgacggcagctcgaggttgcacggcgctagggcgcttccgacggcgagagacgaaggcgagggtggcagcgaagagaggagacaccgggggtccttataaaggggctagggcgcggcggcaaaggcccacggcgaccggcgacgcgaaggaaacctcgaggttcggaggaaagagaccgatccgattcgacctcgaatccacgaacttccaaagcgagatagacgatgattccaaaagagaaaaggtagaggagatccggaagattgtttccccccaattgatttcaccggaaacggaaagacgcggccgaatttggaaggagacgatggcggcgcggcgctagggtttcgggcggcggcggccggaggtagacgacgggcctgacaggtgggcccacctgtcagcggcagcgagcgcgcgcgagggcggctgcagctggacttgggccgaggaggagagagagcggttttgggccgactttcggcccaaagacaaaagaagacttttaaaaacatttttcaatttaaattattcatgaaatgcaattccatttattaaaaatacttccttagctcaaataaatcccagaaaaatctaggaattatagaattaagcaaagtatttaataaaattttatttggccccattttatattggaatttattaattaaaattagatcttctcttctaggcttttaaaatagattctaataattccatttaaacaacaatttatataattaggatttttagggtgtgacacatagatccaaatataatgcgtattcaacagaaatattttgctttgcttattagtttcattctttgacaatccagatcacctcacgctctctttcacagtagaggactcatccctctagctgctcatgatcaattaaaatctctcgaactatatcactctctctccctctctcttccccagtataaaccatgctaccactgccaaatatacatactccttccttccctaaatgtttgacgccgttgactttttaaacatgtttaatcgttcgtcttattcaaaaacttttgtgaaatatataaaactatatatatacattaaagtatatttaacaatgaatcaaatgataggaaaagaattaataattacttaaatttttcgaataagacgaacagtcaaatatgtttaaaaaaatcaacggcgtcaaatattttaggatggagggagtatttcattgtcaaccaatgtaaaacaaacctctataatacccaagcaatatatatttcatttgccccatcctcctatccctagtgcttcttatctattaatctcaagtcggcttgtttgccgctgccgattggatcacgtgtccttttccccctagcagataaatgctcgatggaaatcatccaacaaaaaaatcacatatatatcattggttgagtggagggccaaataatcgtgcgacacatgccgaaatagcgaagtcgttgtgcttctagatttttagtcatgcacgcacggtcggtctcacgcggtcatgctgcccttctagattacaaatcatgattcacgcgcctacacacgcatgagccaaggcctgctgcaacctgcaagagcagctcgatcacctaacaaactactccctccggtatttcaatgtatgacgccgttgacttttcgataaacgtttaacctttcgtcttattcaaaaaaattaatgtaattatcatttattttattgtgacttcatttatcatcaaatattctttaagcatgacataagtatttttatatttgcataaaaaaattaaataagacgaatggtcaaacgttgattaaaaagtcaacggcgtcatacattaaaatacggagagagtactatgaattttatccactctggtccatgggttgaacctagcttttccgtgaggaaagaaaaaagaagagaaatctttgatagttgtaaataaagaaacaaaccaccagaaaaataaataaagatcaattagccaacgtgagaaaattttgatcaaagcatatgaaggatatattgaggatgtccccatcaggagaaaaagagatagcaatacatgcaccagataagcttatgaactgctaacattctggttgacctgaggtgtttgccatttgctttaccctataacaaacccaacgtttttcagctgagcagtgatgcattccatctctaacactcaatgatgccgatcgcgataaaaagctttaccaatcgataaaatgatcttactagcacgacaccaaaatgatcttactagcacaacactacataattaaatacatatatatagcaattgttataaaattgtacttatcaatgagggaataatgggatgcataaacgaccgagatgtgtcgatgggggttcggtatgattgcgatgacaaccttctactctaaaatatcaacatgaattcataataaaaggggtagcgcacgagacctaaaagtggatggatacggagacaaaggatttagacaggttcaggccctctcaatgagaggtaatactctactcctgtttggggatttgaatccgccgggtgtatattgatctgacgatcaggttgtgtcatctgccacctacagggcctcctgcccaccttatataggatagaaacattaactaatatggtatcagtttcctaaatctactttacaatattatcaaatcaggactttaggccgttccataatatacaaggaaacgtaatacccaagtcatgatctgttacatattccatagatataagttatcccctataactagtcggataaccatgccgtgtgggtatggggtacctataatctccacagtagcccctgagaccttcacagtcgaaaagataatcttctcttgaaccagattactctaaagccgagtgcttcaatcatctttgcaatggtctcccgagtacttttaccaaatctgaagactgtggagggctgaaaaaaattgaatatagacttaggtgcatcgactagatgcacctaataggtgtagcccacgactatgtgattagttgaacaaactaaacatatagtcaaggagtaaataatccaaccaaccgagcggtttttataattatagtcaaccaagtaacttaatattaatagcatatgcggtgtgaatccacgaataacatgatccaagtgatatatctactgcttggaaaatgaccaaatatataatcagcctaagccataatattggtcaataaaaatgcacacttacatggcaaaaagcaacaatattgtatcctatcaattgcttgataaaacaaaacagccgcctgactatataaaaaagtcagcgggcagttatttaaagctttactg

SEQ ID NO: 45763 - DNA, 5401 bp, Oryza sativa
gttgagtaactgcggtataaaaggatttgaaggtatggggcatataatcacgtgcacttttgcctaagcaaaaaatgcctaagtccctaaaagaacgtgacaggccacacctaaaaatatgggctgcagacatattaggcctagacctaaagtatgtctaccgatacccttaaatatgacgtatagaacacgacaattaatatgaccccgagtgataaatatcttgggtgatgtagatcatgcatatctcatctgagtggcttctgatccgagtaattatccctcatggagaataccaaagtagatgtgataattgaatcccgactagcacaagcactcagctaatggccctcgtggggaataatgaatagttcaatcgttgggcatgagaaatcgactcgtaatcatgaatccatgatgaatgtatccggaacaagtccaaattaaaaatataatcctcgtgcttatgttgatgagctcctaagcatgtagcatatccttctgctgtagtaacaattgtccattggtagtaactgacgcagttggcatgaagatgaaatgaccactatgaagatgatatcacccatcaaagctgatgaagatgtttgtagtggtaaagacaacggcaccaatcaaaggtcatgaagtcgcatagccatggaggcgaagaaacctgtctgcagcaaataagtcagccagcagtgaagatgaaggcgctcagcaacggcgacagagttgtgtagccatgatagcgaaataatcagtcgataacagacgaggcacccggtgaagaagacaaagacgccaatcagtagaggcataataagccagccgtgaaagtgaagacaccatggacgatggcggaggcaagccggtggtgaagacgcagacgctcaacaatggaaatggcgaaatccatcaatcataaagatgaacaaaaaagacggcgacggcaaacgcatccgacggtaatgataattagcggcaacagagatggatatgatgacgaagttgcccatcaacggcagcagagtaggctatgttgaagaggcttgacaggatattgataaagatgatgatatcgttgatccagtagtgtagcaatcaatgataacgatgaggtctcccataggcatttgcgtagtaggccaaccgtgaagacgaaataacaagtcagcgatgaaagttgatgatgacagaagcaaccgaaggcgaagacattgtcacccattagcaatggcggagacgttaaggccgatgaagtagaagtgctggtgatgatgtcagtgacaataatccgtcaatctgttgagaagatatcgaagctcgagcaatttccttgatgcgagcgtgtgcataacgaagattgatgcaatgccccttgatttataaagatggcagtagaacttggtgttatagctgttgtagatgcttcacttggaggaaagtagaggctgttgtacaattcattgaaactgagctgattggttgataactgtaaactcctggatatgtagattaaatctcgaactaccagctaaagtaaaatgtcggctctgaagcgaagacgaagataataactcccagagttgactcgttgattgattgattgcttcatcttgacataaaacttgtcgaattttgagtcttatatttgtatagcccccgactctttggtcagtcaagaaacaactgaacatagagtcgagaactgtagcttcttgtcgtcgagtagaattcttgaaaattggagaaccacttgtagtagtagattaacacgacgtcaaatttggtagtgcaagccgagatgtcgaggctcttgtagacgtcgtggttggtgaaataacgaagctcgtgaagtagaggcattatagtttgccggtgccaaagataataaagatgaagtcgctccaccatggtgacaaaattgcatagccgtgatgaagtaaacacgagtcggcggcaacagaagcaaaccggtagcgtagacgcgtagttgtgaagataaaaacaccagtcagcggcggcataaccagtcggcgacggaagaagtagaatgatgacaaaagcgaagacgtccttgaacggcggcaaaataggctagccatgaaagtgaagacaccataggcggcagtgaaggcaaaccggcgatgacgatgacgccagttaatgatgacgaagacgtgcaaccgtggaggtgaactagccagtcggcgtcaggcaaggcggccagaaataaagacgatgacgtccatcagtagtggtagtggtataaaccagctgtagaggcaagggcactagtcagcagtagacgagacgaccggcggtgaaaacgataaggccaatcaacactggcagaatcaggcagccgtggaagtgaagaaaccagtcagcagtagacatagacagtttgcgttgaagatgatgatgcctattagcgatggcggcgacgtagccagccgttaacacgatagcaccagttggcattatacgaggcggccggtcagtgaagatgtagacgttgaacaacggcggcataataggccaggcatgcaggcagagacaccagtcggtggcgacgaaggcaagccaatggtgaagtgatatatgcccaacaacggtggtatgaccaaccaaccgtgaaggcgagcacaccagtcggcggcggcgaaggcaaaccagtgttgaagacgtagacgcccaacaacagcgggacaataggccagccgtgcaggcggagacactagtcggcgacggcgaaggcaagctggtcggtgaagacgtaaacacccaacaacagcggcataataggccagccgtgcaggcggagacaccagtcggcggcgacgaaggcaagccggtcggtgaagatgtagatgcccaacaacagcggcataataggccagccgtgcaggcggagacaccagtcggcgacgacgaaggcaagccagcgatgaagacgtagacgcccaacaacggtggtgtgaccaaccaaccgtataagcgaaaactccagtcggtggtggcgaaggcaagccgacggtaaagacgtagacgcccaacaacggtggtgtgaccaaccaaccgtatagtcgaagacatcagtcggcggcggacgaagcggccagtcggtgaagacaacgatgtccaacaacagcggtgtgagttgtgaccacccaaccatataggcgaggacaccagtcggcggcgacgacggcaagctgatggtgatgttctgactgatccattcttggagcgtaagagataagcttaaagccatgaatccgttttatgcatatctagatctggatcctgcagaacaaacatataggatgagtagtatctaatgtaaatataatactcgaggaaaattcaagtattttaaaatatttataaatatatatttctcctgttgtcaattttgatttccccgagtagatgacttcttacgtttaaacacttagcccaactagtcatagcccccaagcaccgggagtcagcctaggcacttcccaaacatgcatatgagcgacatgagttcgtcattaatggaacaaagtttcacgaatcagaatttactactcgagtacttttgcaattgttaagagcataagataaatttatctcatctctatgcttttgatttattccgagtaatacttagcaccttgcgttactcggtccatccaacgagcccccgggtgctaggaatcggcccaaaggcaactatccgtcgacaaaccaaatggaaagcatagaaagatagaactccataactcgataggtactttatctttacttggattatatcgcaagtaatcaagataggcattatgaacaatgttgaaaaatatgatataatatctgtagcccccggctcacttgtcaacgttgatgtagtgaggcagaggaaaaggaaaataccatatataaaaaataaaacaatgatgacttagctttttagtattcccgctggtgatgacagaactagccgatgtgggaataaagtcgtccatcaatggcaatgaaagcaccaaccatggaagcaactgagtcatccgtcaaccgtataggcgaagtccgccaaccgtataggcgaaaataccagtcagtggcgacgaaggcggtcgatggtgaaatatgatgatgcccatcagcagcagcataacaagccagccatgaaagcgaggacaccagtcagcggcagacgaggcggccggtcggtgaaaacataggtgcccaacaacggtggtgtgaccatccaaccgtgtaggcgagtacaccagtcggcggctgatgaggcggctggtcggtgaagacgtaggtgccaaccgaccgtgtaggcgaggacaccagtcggcagcagataaggcggccggttggtgaagacgtagacgcccaacaacgatggtgtgaccaaccaaccgtgtaagcagaaacaccagtcggcggcggcgaaggcaggccggcagtggagacatagacgcccaataacggtggtgtgaccaaccaaccgtgtaggcgaaaaaccagttgacgacgacgacggcggccaatggtgaagacaatgccgccatcggcaacggtggcggagtacgccaaccgtggaggcgaaggcaccaatccatggctgcgaatgccacatatgtacgtgcatacgaaaataacagatcaaaaagtaattagagatctgtgaattaaatgactagaaaaatcaatagtttaatctggtttacataaaaaaaattaaaacgatagacctggtgaaggtttatgatcttgatgcacgtatgttgtgacacgtcctattttggaacttgcatgtagatggataatttatccgtaaccaatgtccggttcactgatccaatggtaacctcaatgattggaaacgcatactgtgtagcagtagtctaagcgctgtcgctgtgcgatcaggagcatacacacgtgtagataatttcttccagatttcttgacatgtggtgtgcctgttacatgtatttcatcatcggggttgatctatggtgtaaattccagattagtctgttgttgctggactccgcttcggacttcagttggagaaactcgatctcaccaaggaaattaaatcgatgagatgacaaacattgaaagcttttttcccgtagtaggatgttcgcagccattgacattagctcgtaatcaatcttgacgggttgctccgttcgaagatgtcgaggaatctgacgatgaccggatgaggttgaagtgaccttgagcccccccaactggtttgagtcccagtcagagagagtctgctagagtattcggcgacgaggaggcaaaaaatctaccaaagcgaagatgaagtgagcgacttacgaagttgattccatcgcacttttcgacaggaaactcg

SEQ ID NO: 45764 - DNA, 4898 bp, Oryza sativa
  unsure (1)..(4898): unsure at all n locations
nnnnnnnnnnnnnnnnnnnnnnnnnnnnnnnnnnnnnnnnnnnnnnnnnnnnnnnnnnnnnnnnnnnaggatgttcgcagccattgacattagctcgtaatcaatcttgacgggttgctccgttcgaagatgtcgaggaatctgacgatgaccggatgaggttgaagtgaccttgagcccccccaactggtttgagtcccagtcagagagagtctgctagagtattcggcgacgaggaggcaaaaaatctaccaaagcgaagatgaagtgagcgacttacgaagttgattccatcgcacttttcgacaggaaactcggcgtcacccctacctggcgcgccaactctcgaaacatgaattcggcaataataaaaggggtagcgcacgagacctaaaagtagatggatgcggagacaaaggatttagacaggtttaggccctctcaatgagaggtaataccctactcctgtttagggatttgaatccaccgggtgtgtattgatctgacgatcaggttgtgtcatctaccccctagagggcctcctgcctaccttatataggacggggggcaggattataagatagaaaccttaaccaatacggtatcggtttcctaaatctactttacaatattatcaaaccaggactttaggccgttccataatatacaaggaaacgtaatacccaagtcatgatttgttacatattccatagatataagttatcccctataactaatcgataaccatgacgtgtggatatggggtacccataatctctacactaatctccacaccttaagtgtttgccatttgcgttaccctataacaaacccaacgtttttcagctttgctgtgatgcatgccatctctaacactcaatgatgccgatcgcgttaaaaagctttaccaatcgataagatgatcttactagcgcgaaaccaaaatgatcttactagcacaacactacataattaaatacatatatatatcaattgttattatattgtacttatcaatgagggaataatgggatgcataaacgaccgagatgtgtctatgggggtggggtatgattgcgatgacaaccttctactctaaaatatcaacatcaacctacagggattcttttccatttgatggttaatatctagcactactctttttaatatcatcttgatatattttttagtgcaaaacttctacatcaaatcctttcaaaagcttgaaattaaaaagaactcattagataacacacgggctataaaaaaagcatgcacgactactttctagtattaaagctaactataaaggtagcccgtgcatttgcgcgggcttgtattttagattgcgtttgaaaaacttatatagatggaatatcaaccgaatgacacctgtcatttttccaaagcattatttcgccataaattttcttcatcctcgttacttagatactatttgttagcttttataatatataatattttaatacatcgctataaataatttataattatctatgatcaattttgggaggtgaatttttcttaaagataattaaagggtgttgcgatttcgcataagatgtatccataatactgacatacttataataaacataggtttttaactgtaaatttattacataaataatctgacaacataaacttacactaccacataaacaatttattacgtaaataatctaacaacataaacttacaataccatagaaacatggataggtaccacttgggaatccgtcataggtgttcgatttcccattcggcatctaggaagcggcaaagatgagggaaatcaaaggtgcgggttccaaaaccgggaccttagagaggttttaggaatcaaaaaaaggcatcgagcagctcccattcaccccgccgagaacacatcgaagaacatccaagaacgaatgaacatgaacatcaagaatattcttcccaactactgggaaccatcaaaactactcatccccatcaagaacacaattacaaaaaacacatcaagaacaaatagatagcacaaagagccaccgctcgacaccaccgccattgccgccgcctcctctcgtgcgccgccgcctgccaccacctcccctcccgccagatctagcggagcggaagacgctgccgccgctgccgggccgagagagaggagtgcgtgtgtgcgagagaaagaggaatgcgctcgagagagagagagcgcgcgttagatagagagtgagaggagagcgagactatcggtcttatccgtgcgagagagaggggcaccgagccctctcaaccttatccgctcaagaccaccgatcggctcggctcgacttttaattatccaacacttatagtaaattaaaggtgttagttttttttaaaaaaaaatacatctagctatataatagaaaactgacacctacagtctattaaaggtggcagtttttttttttttgtattttcaacccgcatagatgggaaatggtatatatgtgccggttttattacttccagcacctataacaccgagctctatgtgccttttttaagtagtgtgatcaaatcatatatgtatgatatagttactatataaataatctaacaacataagcatattagaatacatttatgatttaaatgctatagttgcctaaatgttttttacgtaaatctctgtgtcttttttagcagtgtgatcaaatcatatatgtatgatttagttactatataaataatctaacagcataagcatattagaatacttttatgatttaaatgctatagttgcttaaatgttttttacgtaaattctgctttcttttagaagaaggaaaataggagagataaatagataatagaatgaaaagagaagaatgggaataggagcgtgcagagttcatatgtatacgtgcatccgcaagaatatataggggcccaatttagagttagattaggatggatggattactcttttttctacatcttatctaatggtcaaaaaggatgggcccacctatttaaatgaaaattaagggttagatgtttctttaccacatggcagcttaggagcacttgtagagtgccatgtggcgacatatgagcatttgtagaaagtttaatggacttttagtatataataatagatagatagatttcagcccatgcatgctgttatcactttgtatctaaaaaccaaacaaagataaaagaaaggtgaggatcaaaacactcaatttggaactacgaaatatacttatattcaatagataaagaagaagctgcaaactcttccttttctttggagtatgacaccagattgcagtagttctatcctggtagacatgaatatacactcgacttcatgaaatagtagttcccatcaaataataatttttggatagacattaattcaaatagtagttttcattttggacaatcgtcaatacaacatagtatttgccagcaaagccgagtatacagggccagtacttacccatagaaaaatgaaaccataatcagtacgtacacaatcgcatgaatttgatagaaataaaacaatcataggaaaacaaaccatccatgacacctacagttcgtgatatacccggctgaaccttgtgataactccgcatcagactcataggatggaaaccatccaaacctaaagaacaaaatacactcaaattctaacaaccgtaatgctagtaaataaataccgccacttattcttccaataaacttttaaaccgaaaatctagaattttgaataaaccggtgaaaaaacttggccccactactttaattgtaatatttgaaccacataaccaaacttagcaaataataatgccttgcatatgtactgaaaattatctgcagctttcatattaagtgaaaaatctaattttatttccaaccatctcagatttaagtaaaagaaatcagctgcaccgctagaaaaatatcgacgagacctacgacttttgcgtacagcacaaaacataacttctaatggattaataccactatttcagtctacctagaaaattaaaatcgatctatggcaacaaaattaaaagtaaaattagaagtagcaaggaactagttttagtttacccttgcggccattataattcggtaaatctttcattctcctcaaccttccctttttctgctcctctgtttttgtcagcagcagtgcgtagagcagtcgacagacgactagccaatcagctgggaaggcagcagccagcaggccatgctgggtaacaacaggcagcacagcagatcagcagagcaacatactagcgtctggcctcgccacctgtgaacaccgtcacagctaatttgatcaaatggaacaaatagtgctgttgagattataggcataaaatgatttaatctatttcataaataaatcatgacattacagatgaaaactagcatgaacgcatcattagatctacacatgtaaactacacagtataacatgaacagatcaaatatgcgcaacatattgaatacgtaccgaggtagcggaaagaccggctgctcggtcgaaacttttcgcaggcgtctacgaaggcacgcagcacgcgagcgaagaggaagacgagccgtcgcggacaaacagggagcagtcgcgcaaagcgcttcccaaaaatcttattgccgccttctcccggtgcaggacgtcgaaggcagaggttccggagacctgcactcccgatcgcaggtgcacgccggcaagcgggatggagtaatctacgagcgacggcgcagcacagagtaggaggcaaaccctagattgattttgcgtgtgttgcgtgaagacggcggnnnnnnnnnnnnnnnnnnnnnnnnnnnnnnnnnnnnnnnnnnnnnnnnnnnnn

SEQ ID NO: 45765 - DNA, 1611 bp, Oryza sativa
  unsure (1)..(1611): unsure at all n locations
nnnnnnnnnnnnnnnnnnnnnnnnnnnnnnnnnnnnnnnctctgatcagagtaaaactattcgaatagccgtgcccgcggttatgggcggtcaaccagattcaccgtgattagtctcaccttagtgtaatcttttgaatttggatagccgccgataaatgacttcctacgggatgacatgctactatatgtaacagattccaatgcatggtatgcaaatactgtgaatttcatgtttgcaggattcatatgacaaagggagaacgaaaggaggctcatctacgagaacagacgatacttgtgggatgagtcatacctttacagagtgtgcatacagcttccttaggagatgtgtactagctgctgaaggtaaccagatcattctctggaaaaatttcatgatgcaccatatggagggcattnnnnnnnnnnnnnnnnnnnnnnnnnnnnnnnnnnnnnnnnnnnnagagtggattcttctagccaaccatatacgaagatactaaagaattcattcgaatatgttggaaatgccagaagcatggagatatcaccactcaagatgcgattcccttgacctacaactttcaagtggagttatttgatctatggggacctttcccaaagtcccatgattgtgagtatatcttggtgcccatcgactatgtgttagagtgggtagaagcagtgccgtgctaagtcgctgacaccaagcacgcccgttggatattccacgaaatcatcttcctccatttctgaacacctcaaatggtaataagtaatggagggtatcactttattgataagatcttccaaaaccttttacaagagttagaggcacaacacatcattgcaatttcatatcacccccaaacaaatggtcaaagtagaaacctccaacaaataaatcaagaacatactgtaaaagaccatgcaaggaatggggaaggcatgaaagaacaagctaccaaatgcactctaccaagaacacccttcagcatgtcaccttcctagctcatctgtagaaaaatgtgctattttcgtatcgcgctggaacacagagcacactaggccatgcggatgtggaattgaaaaggcggacgacacaaacaaatgctgctgtcggagctacaagagtagagggaaaagaccaattacaatgacaaaatatatgaagaaagaacaaagagatggcatggtaagataataaaagggaaggagttcatggcaagagataaagtgatgctgttcaattctatgtgaaactcttcgggcacgaaaaacttcgaagcaaatggatgggaccattcaccatcattgacacctctgcacatggagtagttatgcttcaagacggctgacacaatctttaatgcaaatggtcatcgtttaaaagttttcctagaattaattgctcgaaaaccaaaataaaaaattacacgtggtaaatttagtcaattttgacgcatttaccaagaccagttatcatgactcctgagctgaggaagaagggagccctccatggttcggccgaaccccttgttcgttcgacccatgggttgggccgcccctacacagccttcgtgcacgtagtccccaggaggcctccttc

SEQ ID NO: 45766 - DNA, 1788 bp, Oryza sativa
ggcgcgcggcctttcgagccgcgcgctaccagcagagcttccggcgctaccatcagcgctacgtccgggcccgatcactatgcgtcgacgacctcgtcctacgccgtgtccaaacacgtgctggactgagcaaactctcaccaatgtggaagggtccgtatcgagtgatcggcgtcccccggccgggctccgttcggctggccacgggcgacggcacagaactgcctaacccgtggaacatcgaacaccttcgtcgcttctacccctagtgggggtcgggtgtcaggtcttgggctcgggccaaccccgcacccccccgggcgtgcagggttggccgggggcttatcttttttctctttcgtatttcaataaaagcattttcgatttcctaaaggctgtgtctgtgcttttgtttccttttgaagaatcttgacttgaaataggtcactcgtgctcaatcctaccctagggggctcgggtcggctaaaatcgccaaaaggggcccagaaccgagccgtgccccgggacgtggtgaactccgggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaagggggcccgaaggcctcggaagaagaaggaaaagctattaagattggcggaggcctgggggctcactccgacgtgcctgggtagccggcctcgccgtcactgtcgtccgcaccgtcgtcaccgcactccttgtcggagttgaaggcaaacgcgaagccgaggggccgctcattattgtcggtcggttttcccttgctgatgcgcgcgacttgcgaccgccgggattctgcccgaagagagagagagcagggaggagaggcccccgagccgaacggtggcccaaggcccccgacggccggagctggccctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggagatgtggcccctgacgaagaagatcagccccgccgaaaggtgcagcggcccgtctacttcgttagcgaggccctccgggacgctgagacccgataccttcaggcccagaagatgctttacgctatcctgataacttcgaggaagttgcgccattatttccaggcgcatcgggtcacggtggttacgtcttatcccctcggccaaatcttgtataaccgagagggtactggactggtggtgaaatgggcaatcgaactctctgaattcgatttgcgctttgaaccaagccacgcgatcaagagccaggccctcgccgactttgtggtggagtggaccccagctcctgagctcgtctccgcccccgaggccagctcgagcccatcgcagctgcctcacaccgccctctgggtgatgtagttcgacggcacctgtaggaaccggccccacctgtcaccaggccttagaagtggcgtcacgcccgaccgcttccctcggggagggcgatcgccctg

SEQ ID NO: 45767 - DNA, 2037 bp, Oryza sativa
  unsure (1)..(2037): unsure at all n locations
ttagccgatgattccaaaagagaaaaggtagaggagatctcgggaaacatttcccctctattgatttcaccggagaaggaaagacgcggccgaatttggaaagagacagcggcggcgcacgctagggtttcgggcggcggcggcggcgcgaggaagacgaagactgacaggtgggacccacctgtcagcgacagcgagcgcgcgcgcgcggctgcggactggactgggccgacttgggccgggaagagagagagagaaggttttgggccgactttcggcccaaagccaaaagagacttttaaaaacatttttcaatttaaattattcattaaatgcaattccatttattaaaaatacttccttagctcaaataaatcccagaaaaatctaggaattatagaataaagcaaagtatttaatgaaattttatctggccccattttatattggaatttattaattaaaattagatcttctgttctagacttttaaaatcatttctaaaaattccaattaaacaacaatttatacatttaggatttttagggtgtgacacgggggttccggccgtaggtggggttgggtcggtacttttgtctatggctaggatgggttggaaactatgtcatgtcttccgtctgtatgccgtggtggtatgtggcacgtggttacacgtgaggaagatgtgtcttgtgggtaaagatgtacacctctgatcagagtataacctattcgaatagccgcgccctcggttatgggcaagccgagcaatgtacctatgttagtgttttagttcttgaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaatagtattgtatagctctaggatcgtgtttacaaaatagctttgagcaactaagtgtcttttaatgctgtttactgcaaaccctaaccctttgtattataacccccttgtactcccttgcatttattctgcacttatgggtgtgtcttgttgggtactgtggttgtaatcagtcttgctcaatttttcccaaacccagaagaggagcgcctggatgatgaaggctttggtgtttagctcgtgcctgccgtcaagcgcctgtggtcgtcgcccatgtaataaagtaactatttacgctgtttcccgtttgtctttgtgtgtgctgggccttcgccgcccatgtaataaagtaactatttacgcttccgcttgataaactccgaaatgtatcaactttttgtgtaccttgtctcctgggacaaggaataatacactcacgtaaggaacacccgttgggttatttccggtcggacgaaaccgaggagcggccggggcggagggtgatgctacgacgtcgacgaaggagacggcgacgtcggccggcgctttggcgcggcgaccgggacgactggaggcggtacagtggcggcaacgccactgtttgccggcgaggatgcgcctccggtgatatccgcgcgaaacggaggcaacgccgggggaagaggatgcagctgaggcgccgaggatggtgatggcacggccggccggcacgtgggcgaggcggcagaggcggctggaggtggccggcggcacaggagagagatgagggcgacggggagaggtgctgcggccacggggagacacgggaggaggctaaaacgagagaacggaaggagagggttccattttatagcagaggggaatgaacgggccacgggagaggcgtggaacggtggcggaaatggcgcccggcggccatggaaggtggccaggaatggcgcgggcgttccgggcaatggagggtgccattcaagggggaaattgggggaaatcaaagaggatggaagggggattaattccccccaatcaattttggaannnnnnnnnnnnnnnnnnnnnnnnnnnnnnnnnnnnnnnnnnnnnnnnnnnnnnnn

SEQ ID NO: 45768 - DNA, 4873 bp, Oryza sativa
  unsure (1)..(4873): unsure at all n locations
tcgaattttaattaattctattattccttttagagaatgattttttttttcaagatgaatttatcaggacatgacatcctcgcaccacgacttctaatggtcgaggtacgactacgactggtcctcgaccaacaacgtagcgatcctcctaccacgacttctaatggttgagatacgactacgactggtcttcgaccagaaacgtagagatcctcacaccaggacttctaatggtcgaggtacgactacgactggtctttgaccagaaacgtagcgatcctcgcaccacgacttctaattgtcgaggtacgactacgactggtcttcgaccagcaacgtagcgatctccacaccacggcttctaatggtccatgtacgactacgactggtcttcgacctactacgttgcggtcctcgcacctcaatttcaaacggttgagagactcctactcctggttctcgaactcgtaggtcgtagcaatctctcgtacctccacttcaagtggtcgagttatgactataactggtcttcgacctgcggtgtagtgattctctcactacttctgtgatttgttgactacaactatacacctggccattgcccaatgtggtggtcgtcttagcatctacgtaaatttctgaaagtcagacattataacagtctagtcagatttcaaggctttgtcgcagtctctatgcccactcgattactcgagaacggttgatggagctcaacaaagaatatggaatgaagcgatggtgtacccgccgagatggaatttcttgacttcaatccaaattctcgattatagcaagatgggggacttagtcgcaaactccataccttctgagtaggcattgggacctagacaaacccaatatagtgcctgtggaggtcgataaggggaatatagcgatatctctgatctcaccgagaatggtcaggtgagcacgacaatagttattccaaagtcttcggttcaggacatgaactcgttcatttgcattgaagtcaggagctactgtcagggttatggatactatatacctaacactaattgactaagctcggcaaggcccaccacataacatgttttatacggaaacaaacctcgtatatagaaggagttatggataaggaaggacaaatagagttctacatggaaacgacaaggactactcggattgtatccatattggtctctctagttctacttggacaagggggcatgtatgggtataaatacaagcccccctaggaggagaggggacaagccaaaagacatacagatcaacatagatcaatagaagccaacacacgccaagataagtcgctggatatcgatatcagagataagtctagacaaacacaatatggtgtctgcggaggccaacaagagggatctagcgctatctctgatttcgccgagtgcggattcgagggaagactaccatgtcgtccactacgagttggttatccatgccgccaagttgatgacagctagataagttatcccaatttaatgtattggtgtgattatgatgaataaaagcaacaccggtttcggccaacaggagtagggctattacctgtcagataaggggctcgaacctatatagaaatccttgtctccatctcttttatcttaatctcgcatataccctgataccaacgatccacatactatgcaaaatactgtagtcgtgatatcaaacgtcgacaacctcggctccggtctcctagcgccacccccagatctgcgactggagcatggggtcgacgcgaccggtgttcgcgaccaccgccgatgcctagctcattgagctcatcgccaatgtctcacgtgggtagagagaggggggacagggagacgtanagagggtaacggngaagggggagctcgagctcgctgacactccaaacgncggggggggcggggggggagaacgacgggggacggggagctcgccggcactaggggggagacgaggaggtagaactcgatcttatcgccagcaccgttctcgtagtggaaggagagaagagagtgaaaaggaagacatattgggtaggagataggtggcatccgacatgtggtaccaattatttgtttttaattttttttgcctgattggatcaccacgtcagcataatttaagaaaaaccacccttgtttgaatggaaggggtaaattaaacatcatttacccggttttagagtttgggtgtgcactttagacaaagcaaagagttcgacagtgtaaaatggacttatcccaattaaaaggaataatataaattattaaaaggtaaaatacatcaagaagaattgaaatctggcttggagtatttttcttgaattctccatgctctaaattggtccctaaatttttatttgaattttcagagcaacaaaaataattttaatacaacaacaaccaatatcagagtttatattaacatgaaaaacataaaataattctctccttctctttgggccataacattttcggcccaaagtcctcctctccccagccgatgagcgaagtctgtatttgtccacccacctcctcctctttctctccctccctcttgggccatctccagctgtcggcccatctctcccctctccccctcggcctgtcctggtctagttgaccggccaccttcccatccccttcccctcacgcgctggcagatggggcccacgtgccaggcgcgtcccctacctcaagtccgccgttcttctccctcccgaccaaaccctaccgtcgccggcacgccgacctccctccccggatgattacactccgaattgaataaaaaatcattctctctcctcctcatcatcaattcccccatatttacccttcttgattcagcctttaatcatcgaattcaatctctggtgaaccactgccattgatggcctcccctcatctccttgcatatatatgttggggcaaatgagtagcccaaccgtatggaaaaataagttttgatcacatggagcaaaattgccgttgtagatttatatataacgggcacatctaccgagatttctaagactggcagcatgggtacaaattattggcaagtctgttatgttaccacaataattaattgggcaaaaaccaaagtataagatgctatagggccttctcattctaccaccctcagtctttcacacatagaagtcacaaaaatattgaaaaaaatattttttaccggttttacatgattataccgaaaatgctcacaccccggcgaccagcggggtggagaaaaatcggacgcaggttttgtcccctgccactgcatgcagacatgcaacgaatcttttattacatgcccccctctcttatttcttcaaaagattttttctcgtaaactatttatctaatttacgatctaattgtaccactaaattcgttacaattaaatctttacaacaagaccacacattagttttttattgatttttttaatgttgcatgtggtctcttctgatgtttcaaccagtagttttacaacgtttcagctagtgtactcatgatgtttcactatgtacgaatcaaatgtcgcagtggatttttatattatgaaacgtattgttgcaacaaatcacccacatattttggaaaccctctattaaatgaatttggtttattttttgttccaccaaaaaggtttcacctagattactcacaatgtttcactatgcatcgatctaatgttgcagtgaactgaaatattccagtgcaacaaaaaagccacatattttagaaaccccctgtcgacgggggatacccgtagaccagatatagagggtattggggtacgctggtacgagcatctacgtaatacgacatcgagcaagcagaaaacaaaaattatactggttcaggccccttaataggtaatagccctaatccagttgatatgggattatatgatggaaaccacagattacaaaggaaatagtggaactcgatgataccgacgagatcgtaatcgagttgattcaactagatcacccggcaattctgctcctgtaagctctggcttcgtaggctgtagtggatgtgttggctctgagattcaatgccttaggtcctcccggggggtcccttttataccgcaggtcaactggtctccaggttggactcggagacatcggacccgacacgatacaatgatgacccagttctatccgagtaggactctttccatctgtagactccatgctggactttcttaacttttgctgagaacgtccgtatatgcgcaaacatactatatcaaaatgtgacgtatatcgaagggtggagggtataccttacctgtaactcggacagtagcccccgacttctacttaaatgatcttgtgagaccgatcgcgacttctgatgttgtcatcgttctcgatgtggaaaccgagagacaaggagtgatcgacaacgtcgggtgaagctcaacggtcatgagtgaatttaaattgaagtccgaaaaactgtcgcgcataatggaccccgaaattttcggcggccatctctctcctttccttggaattcgcaccgtcggaagtacgtctatttaagggagttttggggatcccatttgaagtccgcctgttgaaggaactctccagcttccaagcatccctcgtcttctttgctcccgcaaaaaccctagctagctcatctcgatcctttctccggcgatccccggcggtaagtcaacctccaccagtgcgtcactgaagaaactgcaggaggatggcgcccttcccggtcgcgggaccacagaaagagaagtaggaggtactgaaccccagcctgtcctgggtcgcatggttgcgatcgaagacttt

SEQ ID NO: 45769 - DNA, 5295 bp, Oryza sativa
  unsure (1)..(5295): unsure at all n locations
nnnnnnnnnnnnnnnnnnnnnnnnnnnnnnnnnnnnnnnnnnnnnnnnnnnnnnactttgttctctgtggttttcttcctccgccgtctaaatttattctattggtgttgaatttctatggtctttccttgctccatttgaaccccaattccatcgcctttctgagtatcttttctcatctgtgtgaggcctacattggggtagagccgtttcttgaccttttccgcttctactatgagttgcgctagatagaacctaaaaaagtgtccgggtgtgttggtttctgacatcgggatggcctgaagtcacgatacatccccttccagtgcccctcatcttgcagcaaatggcgggggaggtggttctatcttcagatagaggattcggatccggtcttcattgttcctgaagaacaaccaaacaagattccatcctggaccaccaaacccgctttgatctcctcccttcagtctttcatcgatgtcattaatgaccttcgagaacaggggttgtcggggtatgaagtcactgccgacttcattggtaggtggattcagccgcttcacgctcgagcccatccagcctttgattattctaggccggaggacgcgacccgggtttctcctcggggtattttcctttttagttaaattgacccccttatgcgcgtgttcttcccgacttattggattctggtctggatctacaggcttggacagtgcaaccgtggagcgccgcgtcagtcaactggtgatcagtggcccgacaacggcgagcaacgtccccgtccccctttgcgagaagggggcggccgagcgtgatgctgccatcaatgtaagtgtactcagcggtccttttccttttttcttccgggattgcattgtgacttcatgacacgtaggctctccctctgactgatatcatcgggccgctcgtggaccatcaggtggcggcgttgctgaaggagaaagttgccaaggaggcgtctgacgctgctgctgccgctgccacaacgagtggcggcaatgttccgaaaaaggggaggaaattctcctctatggtcggacatcgtcggaagacacccaccccctcggtaagtttccctgttcttttattacgtagtcgaaagatttgcacctcacatcgcatcggttgtactctaggcctcggacgcgtctcctccacctccgcgacggcagcggctagtgatgcttagcgagaagtaagtggatgattttgagatcttgtcacttcatcaaactgttgcagcctgtctcagttccatcttttcgcagggcggcacgggcgaaggtggcgcaagacgggtctggagggacctccagcgcgtctcctgccatggcctcgacggatgtcgtggtcgtgcccaggagtcgcgaggcgacacctagcggcccaatcagcgatcttgccgctggtcggggttcgccagctgccgttctcacctgggaggagctccaggtcgagatggggcgccttctcgaggctagtgctcgcggaggcaagggcggcggcagcgtcgtcggcgaatgagcgcgccgaccggctggcgcgcgacttagcggaggtttgcgaggacctccagaagatgcaggagctggtggctggcaatgagcgacaacggcaggggctcgagcaccgtatgtcagagctcgagaaccgcttgtcggagatccgcggctccctgcgtgtcacctacaccggcctgcaccagctcgccggggaatacggcgtcaaggccaccatcccggcgaaccccgacgagttctcgttgacgtcctcacttgaggagctggcagcggcgatggaggcgatcccctccaaacacgcggccagggtcggagaggagacgtccaacgggatctataccggggcgtgccatgtccttgcgtgtgtgaggctggcatcctgaactcgatctgcagaagatcttggatcagggggcggccagcgatgtgcgcaaggacgagatggaggaggtcggtgacctgggagagtccgtcctccctctttttgaagagtagggtcttagctctcttgtactctttggccatgctttgtaaaacttttattggttccaaccgcctttgtgtgcgcagtcatcaccttagcgttttcagcattttgatcttgagaactttgttgtcgtttgtagagatgttgatgtcgaggatgtccagtagcacgggcagtctgagttgccggtagtcgttccattacttgcgttcgagccacatgtgccggagggcgatgtagctcaaaattcgcccatcgaaacgagcatggcgacgactcccttaggttggttgtctttgttatcatttcctttgcccttccgtctggatcgacttgatttgttgtgttctcgggagagaagagcaacttgacttagtcgtttccatgctgagcagatctcgagagtgcacttgctgaccaggatcatcgcatccagtactggaggacgaagtttgaggtcgcggaactcaagaggactatgctggaagtgagaaaggaccaggccgtagagacactccggggtcgtgaggtgtggttcaactcgtatctgaagagttgctgcacatccatgtcgagagtctgtaaagagctccgagtaccccgcggggatcccgaggaatcggcggccggatatatctcgtggctgaatggcgctagcacccagctcgaaggcatcggtcaacgtatcgacgaagccttgaagcaggagtgtcgtcggtcgagccgatatgccggggggcatgtgttggcttgtatacgagatcatcgtcggcgagctttatttgttatctctttctaagaatgtgaatgttgtgtcctcgttgatataagaaaacaagaaaagaaagcgaactcctgatgtctcatcgaaattatggcactgtcgtttaggccatatttcgagggggagaattgagagactagttaagagtgtaattcttcctccattggagttctcagatttacaacaatacatactcaacagcgttccaagcaaatcggtgcccaaaacaccgtatgagctatggataggaagagtaccctcactagctcacctccgagtgtgggggagtcctgcagaggctaaagtatttaacccaaaccttgggaaattagatcccaagacaataagttgccatttttttggctatcctaaaagatcaaagggttatgatttctactgtccaaacatttatacaaagtttgtagaaacgagacacgctgtcttcttggaagacgaaatgattagggggagctcggttgttcgagaaattgatcttgaggagagggggtgtctgtacctgctccgtcgattcaagagcctttcttctctctacttgctgatgttgtgcctgcaatgcatgacgttgcggtaccaacacctgttgttacctctcctgtggcaacaatgaatgaaagtgaggaacctgttctacaggattcaaccgaaattattgccacaccagaggaggagctgcaacagcctcaaacagataatgtgccggaacagcaggcccctagaaggtctgaaagagttagaagatcggctattcgtgatgactatcaagtttatagtatagaagagtcgcatatggaggctgatcccacctcatatgaagaggccatgagaagcgctcgctcatctgaatggttggaagcaatgtaagatgaaatgaaataatgaaactaaacgatgtttgggatttgaaagaaattcctaaaggagccaaaacagtaggttgtaaatgagtctacaaaaccaaatatgactccagagggaatatagaaaatttgaaggcgcgacttgtggcaaaaggcttcacgcaacgagaaaggattgattacaatgagacattttctctagtctattgtaaagattccttcaggataataatggcactggtggcacattatgatttggaattacatcagatggatgtaaaaacggcatttctaaatggagatttagaggaaaaagtatacatggcacaaacaaaaggttttgtcatgaaagggaacaaaaatatgggatgccgtctaaagagatccatttatggattaaagcaagcttcgagacagtggtacttgaagtttgatgggactataaagaaatttgggtttcaagagaatgtcgaggacaactgtatttattcaaaatttaagaatggaatattcattttcctaattctgtatgtggatgacattctaccatctagtagtgatgtcagtccactgcaggaaacaaagaaatccttgtcctcaaactttgacatgaaagacctcggtgaggcttcatatgttttgggcatacagattcactgagatagaacaaagtatgcattgggactttatcaaaagacatatatagaaaaggtgttgaagaaattcaacatgtacagatgcagtgcttcacctgctcttatagtcaaagcggaaaagtatggggcatgacaatgtcccacaaatcagtatgagctcaatgaaatgaaaacaaaaccatatgcgtcagccgtgggaagcctacagtacgcgcaagtgtgcacacgccctgatttagcatttggtaccaggttacttggtagatttcagagtaatctaggctcagagcactggaaattggtaaagaaagtcttgcgctatttgcaaggaactaaaggcctcaagctgtcttacagaagatcagaatcgctccagatagtggggtattctgattctgactttgcaaaagataatacaaagtcaacatcgggatacgtgttcaccctggcaggaggagctatttcatgaaaaagctcaaaacagattatcactgcagggtctactatgtatgccaagtttatagcatgctatgaggccactaggcaggtgaactggctaaagaagttcatacccggtttaaaggtggttgatagtattgagaaaccactaaagttatactgcgataacgaacccgcagttttgtacgctcacaacaatcagtcaagtggtgctgccaaacagattgacataaagtactatgttgtgaaggacaaagtctgggatcaaacaattagtctcgagcacattagaacagaaaggatgctcgcggatccgctcacgaaaggcctatcactcaacgtgttcaagaaacatgtagtcggcatgggtttaagggaagccttatgaatcctggactacagggcccaaaagttaaagtatctatatttgaatagagatgtgtatagtggatgtcgaatccattggtgattgaccgtgacgatg

SEQ ID NO: 45770 - DNA, 2465 bp, Oryza sativa
gtattgtacatgtatagatgtaaatagattgattattaaagtgataaagctgaaaaaaacatctgatgagatttttttaatcccctgctttaggcattactctgctacgctcccttatttctttattagtaatctgcattgggacctggtctggaagcctcctggttggactccactccaaatgatccaacggtccatctctgtttcaactcccatctcctaaaggtccctgatatttcagatgacgaggcatatcgctgtttgagaggcttgctgctttcacctattaagatatttatgtgtcggattctatttccattgctagtatttattaagataagctgatatatacttttagtctacaaagagattaccctcatataagagttgagacgacagatgctctagcaatttttctgttacctttctcttctttatccttcctcatgcatcaaacttcaatttaataaacactaagagtcgatgttaattaagctgttgttaacatatttttaattatagagttattagaaaaaaaacaagattacttagagactctatacttacatagttgagctacgataaagactctaaccactaactataaaatatttttattactattttttccttatttttcaccgtcatctaaccatatttccattttatagagggtaagagtcgttgttgacagtagtaagggcattttgtctttccttttctcttttataagtgagcaaatatttctaactagaaaagctaagagcccctatatatgacgtacatgccctttaagcttaacattgatgtttctctcatctcccctctctcttccatgtcgccaaacttgacttctttagttaacaaccataaaatctattaattgatttgtagatgcccttacctccattcctagcacttgtcgtaattatgggcaataccagagcattatgttttaaatttaggagagaacattccgaaaataataaccataatatcctatgaaattctcgaataaaattgcatctaaaattagacatttggcaaaaattaatgtatttggtgttgtatgtattatttattgtgttgcttcattaggtcaatatagtgaaacaaaacaagcatgtccgccgcaagtttctcgtcatttggatcattttgcatgacatccaaacggataccaattacttaagcaaaaagtaacaatataggttgtgttatcatatatcactttataaaaatttataacaaaattagacacacaacataaaaaataaagcttgcgcgattttgttctttacggttaaattaacagtttaatcccatgtcgacttactttattttataaaaaacgaaggctattttctatcatattcttactcatgcaagtcatccaaggccatctccacacccaaggtcatctttgctggtgttctgaattttaatgaaattaattgagacattgaaaacaagataaggttttcttaaaaaaaaatcaaaccaacaccttgaaaatgcaccagtcaagcacaagtggcagccaatagctagcatgtggtctggcaacgagcaacttgccaacgatgcaaaagctcagtgacgactcatggcttagcacatcctggcgaagcattatatggcagcaggagaacaaccagcgatgtacatagtgtagatggatggccaaagggtgctcaccagcaaccatcgcacatgaaaaaacgctataggaccgaaattatcttcaatattagaagctctaactgctcgatcggaaggatgaagaaatctatcagcggaggcattgtatttggttgtgacagcattgtttatattgggaggaaaagtgcttgatggatatttttttattatgaacaaggggatcagtccttcctagatcttgcacttgttggaattaatgaatgggccttagcccactcgaagattaattctttggaaaatcacaaaagtccacctcatgggatggcatgcatgtggagtttagtatcccccttgcttattctaggagagggggacctccttaaaagggagaatgccctcctagccacttgaagcatgtgtagtagagagaagagggggaacacgcgcgcgcttgctcgcctcgcctcgcctgcgatcggggccacctcgatacgtgttcaatatgttgcacatatttgatctgttcttgttatactgtgtagatctaatgatgtgttcatgctagtcttcatctgtaatgtcatgatttatttatggaatagattaaatcattatatgcctataatctcaacaatccaaaaaccttattataggcactgtgattctactatgactggttttgccgatgcactgaggccggataaatttaccggtgtgcattttaagagatggcagatcagggtcactctgtggctgacagctatgaaatgcttctgcaaatttaccggtgtgcattttaagag

SEQ ID NO: 45771 - DNA, 950 bp, Oryza sativa
catgactacaagatggctgacaaccgttctgtagtcgaacaggctcatgagatataaaccatggctaaggaatttgaactccttaagtgtgtcttacccgacaaatgggaggtcgggtgcattattgcgaaactaacttcattttggagaagtttcggtactgcactcaaacataagagacaggaatactccgttgaggggtgataacgtctcttgatattgaggagaaagctcgggaaaaagatgccgcgtctaagggcgatggtgggcagtccagtgccaatattgtgcacaaggcccagaacaagagcaagggaaaatacaaagctcagcagaccaccaacttcaagaagcagaagaagaacaataacaatcctaatcaagatgagaggacttgctttgtgtgtggccaacttggtcatctggctaggaagtatccacagcgcaaggggatgaaggcacctgcagggcagacttctaagtatgctaatgtgaccattggcaagactggagatggaagcgggtatggtaatttacctactgtttttttagttaatcagtctacttattggtgggttgatactggggccaatgtacatgtttgtgctgacatctcattgttttcttcttatcaggtcgcacggggttccaccgtcctattggggaatgggtcacatgcttctgttcatggtgttggcacggtagatctaaagtttacttcgggaaagatcgtacagctgaagaacgtgcaacatgtcccttctatcaacaggaatcttgttagtggctcccgtctgactagagacggatttaagttagtttttgagtctaataaagtagtcgtgtctaaacatggatattttattagtaaaggttatgagtgcagaggcctattccgcttttccctttctgatttctacaataagtctgtgaaccatatttgtggcagt

SEQ ID NO: 45772 - DNA, 2288 bp, Oryza sativa
cgtgggctatcaaacccaacataaaacatggtccaaaaccttcaagagattttgaaaaacttgcaaagaaacccggtgtaagtgttgtgacaagtgaaacaactcgtgattaaaattttgacttaggtttttcaactcacacaaagatgaagcattttgagcactagtattttaccaataatatgcatgtggtatccctcttaatagtacgacattcctacgacacaatgtaaggtaaaaggtacaatatactatttgatcattgccgcattgcatcgtgatgtcgcattcatggggtatgcatctcattacaacatgtcgaggacataacaaccttcacatttgcttgaataaaagtgttagtcctctctaatcgcattgtaatcaatcatcaaaatcattaagggcctagatgcactttcaggcccttaccaccacgcgatgaggcgtgggaacgacgacgacgaacgggcgtggcggagtcagacgggaacgacggagacgaacgaatgacattgcgccggtgatctttggacgaaggcgagacacgaccggcgcaacgcttgacgacgcggaggcatggacgaagatgacgacggggccgtagcaaccttgacgaaacgcaggcgacgaacggatacggcttgacggcggaacgaacgccactacaaccgggaacgatgagaggacgacgacgacgacgacgaacatcggcggggttcagccgaaggggaggcgagggcgagggcaaccttgccgcggtgatgccggaggagacggcgacgtcggctggcgcacgggcacggcgttaggggctgccggaggagacatcgacgaggaggaaggatagtgtcacgtcccaaaacgaccctaaaatatatcctttaaattatgcctagaataattaaaatccatgtgtgaaagcctccaaaaattaaaatgtgcaaagtaaaagtcaaataaggcttggaggatttttgtatatttcctaaaagcctaaaatgtgtaaataaattttagtggaattttcagagcacaaataataattaagaagaaataaacaaagttgaaaaagttttaaaaaaaagaaaaaccctaaaagtcccccttcccttccatgggacggtccggcccatctccctctccccccacctctctctctctcctctcccccgcggctcattcggcctccctccccgcgcgcgcgccgctgacgggcgggcccacccgccaccctcgctgacgtgtggggcccatccgtcatccccgtcctcccaccgctcccgccgccccgcccgcgccaagcgccgccgctgccgcctaatccgccgcatcccgccgtccccgcgtgcaacaaagtggggggaaatactccccgtgatcccctctccctttccccccatttttcccactctctctcgcgttcaaatgggcggatttgcccctgcaaatctcgccggcgccattgatggcggccggacctcccgcgccagtttcctgcccctccggccgctctctcccccttccaaccctatttaaaccctccccgcacttccttcgcatgtttctaccctttgtcgcgccttctcatcgctggaatcgagctcacgccgtcactctctctctccaccgtcgccgccgagctccggtccgccgccgtcatcgccccggaccgcctcccacctcggcgccgcctacttcggcttcaccacatcctcgccgacctcgtccacctctccgtttcggtcgccgaccgccggagtgccgccgtccccactgacccgagccacgccgccgcctccctccgcttcggccgcctcctccgtcgccgccgtcgccccggggtgagccgtggaccgtcgcctcctttccccttttcctccgctctctcggccgctgctccgccgcgtctatggccgccgccggcgaccatagtggcgcgggcgtgccgcctctcgccgaccgcgccggcatggccgccctcgggcgcgccgagtggctgccgtgtggggcctggccgtcagccgcccgcgccctcgggtgcggctgacgtgtggggcccacggcaccggccggtgtgagcccgggtgcacccggtccaccgtggaccgtgaggctgccacgtgggccccactcccatggacccggtccgcgcgccccctcccctcggctgacgcgataaaccctttttaaattaaaatttaaatgaagaaattcgcaaatatttattttaagagtatataaacttcaaatggccataacttggccatttgaactcggaattggac

SEQ ID NO: 45773 - DNA, 1135 bp, Oryza sativa
tgttttatctagccatgcctatttacctttgttatgaccttattattgttattgttattattaccttgttcaccctagaataaacaaaaccccaactagtggacactctactcatggtaccactagtatgaatttaggtagatgcttcgccgcttaattaggtaacattaggtggttttacaactctagactttgggaatattcatatcacctagacactatggaatggttggattattgtggaattggattcacacctccccctctattcaaaaccctcaaaatggttttaggctgggctcggggtgcatggttttgatagtagcacctcggtcatataaggaccggtcttcgggcctctgttgcaaagtactaccatacttccacatgtctagtgggtaaggcttagtttgtggctcagtctggttataaacaaaagtacacggatggagatggacaaagtcgggggtcgatggacatctctagggcaaatgaaggctacacgagctgcggcccggtagtcgagatgtgatggcacagggccggtgtcctgctgctaggggctcagtcctgcctacctgtcccggggtgtcacgcccggaatttctatccaaaattccaaacgcttacatgtgtgtgaaccctcgtacaggaatcagccgaggcacacaataacaaattgataatatagtacaattattactctaattaataagcgaataaaatgtcattatagaggtagatagttcctctcaatcaataaagatctaagcagcggaaaataagataaacggcgcagacgactccactccacaggcagcttgaccaggcctacacctaatcctccacaccatcagcttcactgtagaactcttcctctgatgaatgattgcaacgtgagtatatgacatactcagcaagccacgcagcaaatatgcaagcgcacaagataacaaaggatggcatagtagggtttcatttgcataaacaacatttaataaacatttcagaatttaataaaacagttaagtattaattaaacagtattaatccaacgctacacaacataccctgttgcatgggcccaaccattctgaacaaccatcccggctgcacagttctatcttcaaaccag

SEQ ID NO: 45774 - DNA, 1329 bp, Oryza sativa
gtcgcttgggctctcaccatccaacatcacaaaccgctcaaactgccccttgagaatgtccaccttgaactcgctaacactatccgtaacttcatgcaaactccgaagcgtgtcccaaatcactttggcactctcaatgccgtccacacggttgaaatcacttccactcaaggcgctaagaattgcattagcggcttgagcgttcttgtgctcgttcttgtcgtcctccttggtgggttccacgggattctgcaaaacatagcctttttcgactattctccaaatcaaagggttaatagatttcaaatgcatcttcatcttatgtttccaagcggcatagtccgtaccattgaagtacggagctttgccgctataggtgctcacataagatgcagatgtggagggatagtcataaggaaacgtagctcccttatcaccatccttgccattccccgtttgacccgacatgatctctccaagcggttaagcctaattaggagattaggctctgataccaattgaaagggtcaattaggcctaaaggggggtgaataggctaatttaaaactttatgcggaagctaaaactgaaataaggtcggaaagtctgatccacagtcagactatccgaaaatatcagatagtctgatgttggattagactgtctgatccaccaatgaagcacaacaagtagatatatcacacaaacaagagtaaagcacaaacaacgactagatctatagcggcacaattaagcaaagctaaaaggaggatgaagggagatcaccaatgatgaagttcacgaagttgtccccggagttcaaatccttgaggggattctactctccgttgaggagctcactaagagccgagtctttgctaaccctttcctcaagaggttgcactaagcactcttccttccaataaggggtatctctttccttgcggaggcgagatccggccttcacaaacttctcccagccaaccacacgtagatcggtggctcgggagtgacacctagccatctaggagttctcaacctccaagagtaacaaacaccacacaactcttggtcaaaccttagcgctcaagatcgagtgaaacacacactaggccctcaaacaccaaatccacaaccaccaagatccaccacacaaagaacaaggagggatttgagagagggagagagagctcaaagatccaaagcaccttagtaccaagctcaacccaaagtgaatgagaatgaaatgagttgggtaaccctagaaaagggttaggtggggggtatttatagaccccccaaaaatgtggccgtgtgaggggaatcttt

SEQ ID NO: 45775 - DNA, 821 bp, Oryza sativa
  unsure (1)..(821): unsure at all n locations
nnnnnnnnnnnnnnnnnnnnnnnnnnnnnnnnnnnnnnnnnnnnnnnnnnnnnnntgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccttagtgtaatcttttgaatttggatagtttaggtggatggctgggcctgtcgcaacgtgggatagcgttggacagcggatgattaatattaattaattattacaactgtttaaatctttcaatttctgtttataaatgctcgctttatgcaaatgaaccacttcagctcttctttgatgattccctgcatcatacccctattccggtatgacttgctgagtacagtgggtagtactcagtcttgctctacttttcccaaccccagagtttgagttcggggtcaaatgaaggtttcttcgaagagtaggctttgtccgtgccgtcgaggatgcctgtggagtggtgttcccgctgcagttttagtcaaggcttagctcctgttgtctttttttttcttccgctgcatttatgtaagacttttatgatgtttgtaagacgtggatctgaatgtcaacattgtcgtttgtgtaccccggccggtcctggacggggattttaatgcacattctgcttgaaattctattcgggaatttttgggcgtgaca

SEQ ID NO: 45776 - DNA, 1620 bp, Oryza sativa
atgtaatccaacgttataactccggagtttcttaatttcctgatagatttcatattatccttagaactattcactttaacaattaccgtttgattgtcacagtttataaggatagccggcaccggtttttcaacaataggcagatccattaatagaacatgcagccattctacctcaacagtagcagtatccagtgccgtcagctctgcttccatggttgacctcgtcaaaatggtctgtttgcaagacctccatgaaacagcaccaccacccagtgtgaagacatatccactagtggctttgatctcatccacatcagatatccagttagaatcactataaccctccagtaccgcaggatacatagtatagtgaagccccaattccacagtatctttcagatagcgcattactcgctcaagcgcacgctagtgatcatatcccggattagaggtaaatcggctcaacttgctcacagcaaaagagatatcaggcctagttgcactagccaggtacatcatcgagccaatgatttgggagtattccagttgattcctagcaattctcttgttcttgcgaagcaacaaactaggatcagaaggtgttggagaaggcttactatcaatgtagccaaaaccaattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcatcaacatacaagcataaaataacttcctcacccccaccatggcgatagtacacacatttatctgcctcattgactgcgaagactgcagatgtcaatgttttgtcaaatttctcatgccattgcttaggagcttgtttcagaccataaaaagacttcaacaatttgcacaccttgccttcttgaccttcaactacaaacccatcaggctaatccatatagatctcctcatccagctctccattaagaaaagctgtcttaacgtccatttgatgaacgagaagaccatgtgaggctgctagggaaagtagcacacgaattgtggtcaatctagcaacaagtgagtaagtgtcaaagaaatcttcgtcttctttatgagtatagcccttagcaacaagccgaaccttgtacatttcaatagtaccgtcaggcctaagcttctttttgaacacccacttgcatcccacaggtttacacccatagggtcgctctgtcacctcccaagtcccgttagcgataatagaatccatttcactacggacagcctccttccagtagtctgcatcaggagatgcatatgcttctgaaattgacttaggagtgtcatccacaaggtacacagtgaaatcatcaccaaaagacttagctgtcctttgtctcttactccttcgaggagcttcactgttatcttgctcagtgacatgttcatttgtatgttcagtttgttctggtggtgtgattgaactgggaattatttcagatggttggctcgaactattatgtgtatccttcattggaaaaaagct

SEQ ID NO: 45777 - DNA, 8504 bp, Oryza sativa
ctctataaacctccgataatatcctgcgaggcctaggaaactgcgaatctctgaaacggtctttggttgtttccagttggttacggattctacattactaggatcgacggcaactcctcctgctgagatgacgtgaccaaggaacttcacttcagacaaccaaaattcacacttgctaaacttagcatacagttgatgctctcgtagcttctccaatgcaaggcgaaggtgttcttcatgctcttctttggttcgggagtagataagaatatcatcaataaagactaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaattctgggtagcgggtacttattcttgatagtcacatcttttagtgcacgatagtccacacacatcctctgggtatgatctttcttttccacaaaaataaccagagctccccatggagattaactcggtctgatgtaccctttctgaagcaaatcgtccacttgcctcttgacttctgccaactcgttggctgccattcgataaggtctcttatggatcggagttgttcctggtaccaaatctattctgaactctatatcccttttaggcggcataccaggtaaatcatctgagaacacatcgggatactcccggactataggaatctcttccaaagttatttggttcagtattgaccttaaagactcagaagacaatgcatgaacagttacaactcgaccatcattgctggtgagagttacttttctgttagcacagtctatcacacccttatgcctggctaaccagtccatccctaggataacatcaaggtctttggactctaacaagataagattggccagaaatggtactccttgaatttctattctgacagaggggctacgttgcaaagagagtgcttgattacttggggtactaaccatcaaaggacatctaagatcttctacttccatcccatgatttcccgcaaaactcatagataagaatgaatgtgtagcaccagaatcgaaaagcactgttgcaggaactgagttaacaagaaacgtacccaaaatcacatctggagcaccttgagcttctgcagcagcaacatgattgacacgggcctttgatgctgatacggtagagttgctctgggcagggacaaccttcacgcatcggggcttcggacacttgtcagcgtaatgtcctgggtctccacagttgaaacacaccacgggcttgctgccttgctccctcttggcaggttgttgctgtgtcgaggctgcaacaggacgtggaacttgattgcggatgttgttgccagcattgttgttgaagaactgacgctgcggacgaacaacagacgaataacctccctgtggcatggactggggtcctaaagtaagatgcggcctctgattattcccctgttgtgtcttgaattgagcaatccggcgtttcttctgctccatgcgattgtacttgtcctcctgacgaatagccttatccactaacttctggaaatcatgataatccccagtcatgagtgggtaagaaagctcatcattaagtccttccaagaacttctcctggtgctcttcatcagtgcgcacatcttccggagcataacgagccagacgattgaactcgtgtagatactccgtaacagagcgggatccctgggtgagcgacctaaattccttcttcttgagagacaccactcccgatggtatatgcatcttccggaaagcagcggtgaactcaagccaagtgataggttcagcagtagtcctattcaggcggaagtgatcccaccattcagaggcagggccatgcaactggtgtgatgcaaatgagaccttctcctgatcagtgcactgaagcaaatccaacttcttctctatggcatgcagccaatcgccagcttcaacaggattagtggtactagagaaagtaggcggcctcacacgaagaaattctgctaacttgttctggggaggtgcatggttatttccctggttctgctggttctggagttgctgcatcatcatgttcataagctgtgcctgttgagccaggacttgggcaagtgtgggattctctccattgttgttgttgttattgttgttgttggggccattcccgttgctgcgagtgaccaccatctggcatggacagggcacaagaagagaaaccgggggaaactacttaggacagagaattaatttgacttttattggtcttaagtgagtttcattattacaaactgaagactctcacaccactaagctcaccaactacctaacactcgaaagcaaacaaacgcatgcacttacatcccatcactgatgtaatcacatgcgagacacacacaaccaaacttaaaacaagcaaactaatacaacgatctaagacaacggcttgacaaggcattctagttcttccgagcatcggagttgattgaaggctcgttcggctcgtcttcatcatcttaagttgctccccactcaatcttggaatgggtgcgcttcgattcttcttcttcatcatcacttacgttgacgaccggaggatccgctagggctggggtaacttctttttccaccacacggacctttggtgccaattgatagcgagggacaaatagagctctcttccttgcggtaagacaaatcctggccttctgcggtggtgcttctcccttcaacgcggctagttccttctccaatcgatccactttgtcctctagcttgcaaatcttacctcgattccgatcttcacgatcttgagctgctaacacagtctctgcacgggtttcatccatagcccacagcatctcaaccaaatgccttgtggtagcatcattctcaattccctcagtctcaaggtagctgccacggtcacttccctggggttgacgagaatggtagcgatactcagtgtcggccaactgatcactgtagcgatcgcggagctcgcctatggcgatccttgctacctcctgacatgcatggatgtagtttcttcctccagcttcgaacatcactgaggggatatcttcactattactgttcaaagtgactttgactcggcacttctcttcatgacgatcatgaggaatctaggcataaaaaggggcagtcccaaatcctgtggcaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagtaaataaagtaaaccaagcttgcaagataagttgaaacagttggaaataaggtcacaaattttgtacttttgaacaacaggttccaacagagataaaagaaagttataaaatcaacatgctaaatttattttcttgcagcaagattaaataaaacaatattgtaaaacttttgctggtaaaatgagccattagtacagtaatagatgtacagtactaataacactggaataaattttgaatgaggaccattaaaagagattatgaagtgcatgtgccattagtttggtttaattaaaagagaaggggaggagaacagttctacttttccaatatttttagagggcttctatgggtaaccatttggcataacctagggtcaaggaggctctgataccaacttgtcacgcccggaatttctatccaaaattccaaacgcttacatgtgtgtgaaccctcgtccaggaatcagccgagacacacaataacaaattgataatagagtacaattattactctaattaataagcgaataaaatgtcattacagaggtagatagttcctctcaatcaataaagatctaagcagcggaaaataagataaacggcgcagacgactccactccacaggcagattgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcatagtagggtttcattttcataaacagcatttaataaacatttcagaatttaataaaacagttaagtattaattaaacagtattaatccaacgctacacaacataccctgttgcataggcccaaccattctgaacaaccatcccggctgcacagttctatcttcaaaccaggaatataccattccaaaccaggagctaatcaaattattaccaattatagcatctgttattatgatgagaggtgtgaaactaatcacgaaagacattgttagacccacccataaccgcgggcacggctattcgaatagttttactctgatcagaggtgtaccactgtacccacaagacacagccccacatcatgtcaccatgtgcctcaataccaccacggtacctcggaaaggagctgtgacaatacccctcgcacaacacaatccactacagcgcacctttcctggatcataatcacccccttataaacaaggcatggactccccagcgacccctgtgggcttatctccgccacttctcagtctggtgctctgcaatgaaccacgctatacaaaaggtaaagccgttgcccacgctggcttgtggttggcacggttaatgtttcacaaccgaaactcgtgaaccggtccttaattgccatgagcacgactctcaaaaccatgtgctcacaacccaccattatcaggttttagttggcaagtaattaattaaccaatcacgattgaccatcgtgaactatcattaagccatcattaaataataatgaatcataagttatcccaatagtgtgctaatatttctaagcatggctaagcaatcacacctaatatctagctgaaccaatatataaagcccaactagtcaaattataataacccaaggtatcaaggaataaagtaatcaagaacaaaaagggctataacaaacaataggttaattccacccaatgacattcgaaaataaatgcaatagttgaatagaaacaatagatttaaacgggatcaacatgctcaaagggttgtttgggatctgtgtgacttgccttgctggccttggaactcttcaaattcttctcctgcgaaaacggactctccggaaacgtcggaatctaaatagaaaagagcaaaaaaaaaccaaaacagcacataaacaagcatgaacagtacatgtggatatttttaacatgtagatctcaattttagaaaaatttagagacttgaaccaactaaatccgagctaagatgaattagttatgaatttttaaagattaaatcgaattaaaacacttatatggattttaattgaattatgacgcaataatgaattatttttcaaaaagaaaaaggggtttgttgcgtcagcggctagggtttgcggtggaccgggcgcacggcagcggttcacgggaacgaacggtcgatatcgatcctattcaaaacggacggacgagatcgagcggtccacggtcggaccacgagggacgacgaccatgacgctagcgacgacgttaccaccggcggcggctcgggcgatcgggcgcgcatgctcgacggcgaacgacggcgcgaggacgcgaacggaggacaccaaaacgatgcggacatcgcggcgaactcaccggtgaccaaagcgacgacggaggagcaacggacgacgtcggcaacgaggtctaatcggcggagaagatcgggtcgacgggggcgacggtgctccggcggttgacagcgatggcggaggggcggacgaggacggcgaccgacggcgaccacgatggcgatcttcccgaacgacgacgacgactggagcgacggtgacacacggctggagcggcggcgacaacggcggcgctaggtcacacggcgctagggcgctaccgacggcgagaggcgaaagcaagggtggcgacgggtagaggagacaccggggatccttttataggggcaaggaggcggcggcgaaggcccacggcgaccggcgacgcgaaggaaacctcggtgtcggtgacatgggaccgggagtatcatgacttagagacttgaggcagacacgatcacccacgtggcctaaccccctcgggggggttgggcccgagggtgatacggccgcccttctctttgtctccccgaggggtcggaccgctcccgtctcggccccgagggccgaggcgccctgaccccttgtgggttttgcgccgcgtatatggggtaggtgagcatagcggggctcacctaaccatatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggccagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggtaaccatacaagtctccgtctgtttatgaaaagataggataagtccccacaaaaaagagagagatggtgcatgtggtatccccttgaggtataaaaggaggaccttgcccacttagaagggggatttttcggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacagactaggagcttaaaatctcacccagggcccccggccgaaccggcaaagggggacctgcacggtctcccggtgaggagccccacgctccgtcatctggcgcgccaggtagggggctctgcgggtgtttttctaagctctcgcattctttcgtgtgcgccaagcttttcctgttcagcccaatggccgaacaagcaaaggcgcacaacctctctccgagtgttagcggtgacaacggggagccgaacccacgccgtcgagctcgtactccatcgccccctccacgccaaagtcctaggcgggaggaggcgctcgagagggtcgaaggatccgcgacttcaacatccacgggtgatggggaagggcggcgagatggggagcgtcgcctcctcgtctacggcgacggcagcacgcctcagggcgcgctccaagctgcgggcgcgctcctacgtcacccgcccattgtccctgacccggagtctccagcccaacgttggctggacgacgtggccaacttggtcatgacggtacggcagcgcctaggtgctggtgggcggtcctccgccaccaagacctctggcgctgctaccaccggctccatatcgtcaaggcggagggcgcggcgagcggcggctgttgctcgccatttggccgccactccttcgtcagcgcctccgacctaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcagctgtagagcctttgtggcgagccttcggaacatccgttggcccccaaggttccagcccaccatcgccgaaaaatatgacgggagcgtcaaccccgccgagtttctccaggtctacacgaccgggatcgaggccgccgggggtgacgacagggtcatggcgaatttctttcccatggccctgaaggaacaggcacggggttggctaatgaacttgccacccgcgtccgtccactcttgggaggatttgtgccaacagttcaccatgaactttcaaggcacatatccgcgcccaggtgaagaagcggacttacatgcagtccagcaaagggatgatgagtcacttcgctcatacattcagcggttctgtc

SEQ ID NO: 45778 - DNA, 2496 bp, Oryza sativa
acgctccgtcactcgggctcggagagagagagaccgatccgaatcgacctcgaatcaaacactttccaagcgattttagccgatgattccaaaagagaaaaggtagaggagatctcgggaaacatttcccctctattgatttcaccggagaaggaaagacgcggccgaatttggaaagagacagcggcggcgcacgctagggtttcgggcggcggcggcggcgcgaggaagacgaagactgacaggtgggacccacctgtcagcgacagcgagcgcgcgcgcgcggctgcggactggactgggccgacttgggccgggaagagagagagagaaggttttgggccaactttcggcccaaagccaaaagagacttttaaaaacatttttcaatttaaattattcattaaatgcaattccatttattaaaaatacttccttagctcaaataaatcccataaaaatctaggaattatagaataaagcaaagtatttaatgaaattttatctggccccattttatattggaatttattaattaaaattagatcttctctcctagacttttaaaatcatttctaaaaattccaattaaacaacaatttatacatttaggatttttagggtgtgacaaacctaccccccttaaacagaatctcgtcctcgagattcggaagaactggtgaacagatgcggatgagctgacttcaattcatcttctcgttcccaagttgattcttcttccgagtgattactccattggactttacaaaaacggataactcgatttctggttcttctctcatctatttccaagatacggattggtttctcaacataggtcagatcctcttggacttctatctgttcaagattagcttcttcggtaggtacccttaaacacttcttcaattgcgacacatggaacacattatggactcctgccaaagattgaggtaactccaactaataagcaacctctcctcttctactgacaatcttataaggtcccacaaaacgcggtgccaattttcctttggtgtgaaaacgatgaactcctcgaagaggcgtgacacgaagatacacataatctctttcgtcgaaactcaaatctctgcggcgattgtcggcataactcttatgacgagactgggccacacgcaatctttcttgaatgattttcaccttttcttctgcttccctcaggatatccgtcccgaaaacctgacgttctcccgtttgatcccacaaaagtggagtgcggcactttcgaccatacagtgcttcgtacggagccatctgaagactagcttgataactgttgttgtacgagaattccgcataaggtagattcttatcccaacttccaccgaagtctaaagcacaagctctcaacatgtcttccaaaatctgattcaccctttcggtttgtccgtctgtctgcggatgataagcagtactaaagttcagcttagaacccatctcttcctgaagcttcttccaaaaatttgaggtaaactgactgcctcgattagacactattttcttagggacgccatgcaaacacacaatccttgccatatacaattccgccaaccgacttccggaataggttgtctttactgggatgaaatgagccactttggtaagtctgtcgactatcacccaaatagagtcatggcctgatgacgttctgggtagaccagtgatgaaatccataccgatttcctcccatttccattcaggaatcttcaaaggctgcaacaaaccggcaggtttctgatgttctgccttgactcgctgacaaacatcacatactgctacgtactctgcgatttcacgcttcatacttgcccaccaaaatctttccttgagatcctggtacattttggtactaccagggtgaatggaatataaagtatcatgagcttctttcagaattgcatcttttaaatctttgttgtcaggaacacagattctctcgcccaaccatactgttccttgctcatcctccaagaaaccgatagctcttcctcttctcatattctttttgatttcttgaatatcaggatcattaatttgggcttctctaatttgatcaattagagtgggcttcgcttctaaggctgcaacgaaacctctactgacaattcccaaatttaatctttcaaattccttgcataattccaatggcaactgtcgtccttccgtagcattgcaatagcctttcctcctaagagcgtctgctacaacattaacctttcctgggtggtaatgaattcccatgtcataatccttaattaattccaaccatctcctttgtctcatgttcagatccggctgagtaaagatatactttaaactcttgtgatcggtatacacctctgtacgagtaccgaaaagataatgacgccaaatcttcaacgcacgaactactgcagctaattcaagatcatgagtagggtagttcttctcatgcggacgtaactgacgagatgc

SEQ ID NO: 45779 - DNA, 710 bp, Oryza sativa
gattatgataggtatttaagtgtaaacagaggattgcaaaacacaggaatggtcgtttgattggagcgcaggaaaaacacaggaatcggataagagagatgaactcaaaggaaattttccaagaggttgaagctcttgctatatttcctccaaaatccacatgcaatgtgccattccataggaatttcataggatttaaaaatcttcaatcttttaaatcaaagggccaaataggaaaattttctataggatttaaatcctataaaattcctacctaaatcctttgattcaaagggagctattttttttctcccttcttttagatgtgataggctgatagccattgattagaataggatcacatggatcctagtactcagattgtcagatgggcaagtttgctggaccagccaggaaggacagtgctctgtttgtggttccacaattctagtacttctgatttttttagaaaataaaataaaagataaaataacaagaaaaagggagaaaagaagtactcctacttgtagtgcactgcacgaaattgcaacatctagatgtatagtgtgtagtcaaggatgaacatgccaactagtagcaaggaaggaatctttgcatttgcacctgtttctgatgacatatgcatgtgaaaactggagtgtgtgtctagctatacatgaataacagatactaccatttttctcccgtca

SEQ ID NO: 45780 - DNA, 2471 bp, Oryza sativa
  unsure (1)..(2471): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaccaaagtaatttgaaacatagtagttcaaatactagagctgaattacaggctaaaggagggaaaatacttgaaatgcaattaagttttacaagttacagcaatgtcagatagtagtacatagttgcagctcctagctctgcaaagggaacaatgttcctgagaacgaaatactaaagcaatgtccaacattgtgctgtttacatgatccttcttcggatttacttggaaaataaattgaatagcagcatcagtcaggtcagtaaagagtcccttgttttctcagcaagaaaatgttacagtccacttgttgcttccagtttccactatacccccttcgaactgaatcatgtgatgtccaattccatgagatcttgtttgtgtaccagatcattcagaggttgagctatgaagaaatgaagaaacaggcagcctaatccactagggcttgcagtacaattctactgtttttatcatggaaaagcccccaagaaacaatacaagtctgtacagaatgacatgttttaaatgtctaagaatttactacatagaacaataaacccatgctgatgctgtggtaataactagcgttttcgctggtgcgctgcagaaatttaccagtggccactccgaccatcgacggtagcaggcagtttgttcgccacatatggcttcggtggaccggtttggctggaatcgatcctttcaacatcacctgtttcactcttgcaggtctggtttcttctggggtatgagctccccataggaacactgctgtttggagcaattgctgggtaccgaacaacccttcgctgctcatattgttgctcagcaccggatgtctaacagataccgtatactcaacaccgaaccaactgctatacacaggtcttgcagcagcacctggaagataggtaacgtgcaaaatctatcttgagtcacacaatgtatgaaagatataatggaggatacaagtttaattgcaggttaaagtcaaatggtaaggacagatgctaaccttgagggattctgcttgcaccgactgaagcagaatcgtgtgattttagattgttgtttatgattaaacacctggaaagatccttagtgacactggatgtgctttgtggccggtaatatgaatagacaacacaaggcctgtcgatacaatagtagatagtcaagaatcaagtatatattcaactggagctacaagttccatcggttaatccatgtcatataaaataaaataaaataaatatcttaccttggtaatgagttatgttgtctctcaggtggagctgctgttgatcccttggcataatgttcttcaaggtatgcaaactgttttttaaaatggtctactgcactgtaaacataatagagtaattgatcttagttctttgaattatctcaagtttttgtcgtgcctaatcgatttcgagcaacaaatagagcaattaaaataagtaatcactacttaatacggtgcatcaacaaaacagtcaattcgcataaatatttgttatttaattgttaacctggacatatagcatgttcaacaacatacaactggcctggcagttcaacaataagatcactaaattgtctcagaaattataataggaacaactcagttgaagattttaaagcaatggaataaaaataaacttggcatgactacacaccttgggtacatgaaaccagtggactcagttccctcaaggaactccctcagcatctttggatgatactccagaatttctctatatatgagttcccttatatcttccttagtaattctccgcctctcgaactcaaactctagctttgtgataggttgagcagaaggctctctatcaacattggctatgttcttgaaataaggatcagcaagcgcctgaaaatgtggctgctacattagctgctgacacttgagataacacaccaaaaaaaaaaaaagatgcaaggttgatgctaatactgacaatacctcctcagcacttggccgatcttttggatcaaaagctaacattctctctaacaaccgcattgcaagtggatctgcatttgggaacttctgtgtaaatggtataggttttttccgcctcatactgttcaagtaacgtcttgccttctcatttctaatctgttgcataagtgaatgtagatataagcattataggatttt

SEQ ID NO: 45781 - DNA, 3277 bp, Oryza sativa
tcctgcagcccaacatagaagcccatgcaaaaaataaaaggagaatacatgtgtacacttcccggcgaaaaaaaattccccagcgagaatacatgtgtacacagcattccttgtatgaaagaagacaagtcataaaaacaaaaacagttttatttgcttggcaatgtctagatgttaaatcagttttttttaaaaaaaaaaatcatgatacgcatatgaaacccaacctatcatatgatcattgtataaaaactaggtaacccaatttggaccattcgtgaaggaaaaggtattttaaacggttatatggtcaggacataaggcggggaggctctttgtgtagttcactagttcaggttgtaaaatatgtcaaattatttgcaggcatcaataatactagacacaagtggcatgaactacaattacatatgactttatgtgacattaattagttggttcacaaaattcaaaaatagcataatcaaaatggaagttgccaggaacatagtagcaaaattaggcatgaaaagtaacataaagaggcataaatggcaatgaaacactagctatcaaatgcataagaaaacattactaaccaataaaaacattccattcatctgtcaataattcctaagcaagaaggcatgttgtctaactggtagaagctgcccttcagataaaaaaaatactttacagtatgtttggataaaaatcctaaagaaatgttatccacgtttgcttcgctgccccaggttaataaaggtaaaaagaacaacaatgtatttctttttgcagaatatcatgatccaatataaaattaaagatgtgattacaaccttggagaaaaaagatccacacagctctggtgctcggtaccaccttgttgcaatataatcctaaaaacagaaaaatcaattagctgatgatataaatcttaagagtaatgagctgcatagtgtgtagtgggcgtgaaatgacgtaccgtccagaagatggcggttggagtatcactaaaagctacccttgcaaggccgaaatcacatattttgagcttacaatcagcattcgccaagatattttttggtttgagatctcgatgaaatacatttgctgcaaaaagctatcaaaagatgcatcagtcaggaattagagtcacaaataggatggactgataaataggaatcacacaaacatagaacactgagtacagaaaaaagattaatctgttagtagtcctcgtcttattattcctttcctgaatggtgcgtttgtatttttcagcctttcatataacaaaagtactaaattggtcaaactgacttcttagaataatttagaaaaaaagaggggatgggggatgagcacatgcattatttacagcatcattagaagcaaagcaagatagatgtttctatcatggtataaaatgaatagggaaatcctattcaatcacaatcaggttaataaaaaaacctaaagaacagaactaacttagtcacaaaagggtgcttcatgtgaagggtatgtctatcaggaacaacgaatgctggaatgtgtcaaatatatgtaaacacttgtgcttgcctttgttcttctgcttttgaaaacaaactaagttgtctgaccaaagccaacaaacaaccagggtaagaagatgaagaaaccagagaatatgaaattccttgtttattacagcccaaacctcggtttgcaccatggcagatgtgtatcagataacaaatccagttcaattggaagatgttagctagttgttcgacttttcacaaagggcagcaagcatagcctcttccctaggaaaagtatttgttatattgtattgccagaaggtaagaaccatggtcaatagcatgtacagatagaagatgaggttgcagttacatgcattatactttcaggatgccatgaataattttttggatggttaaactacccaatgcctcaggctgtaccatcctggcacaaattcagtgtatccacaacttgggaagcaaaggaagacaacaagattctgttgatgcccgctatggaagcttgctaacacttcagattttataaactctacatcaaagggcgccagggggcatctagtcatcccacaagaatgatccacatttcaggagaattttggggtactgctggtttatttgtactaaagcaaccacagttccataagattgttttcattatatagtttgtgcagataaactgtaggttcccaaaaaagcacaaatgctgaaggaacaatcccagaataatctgctagtagaaaaatagtttggttgttatctggcaacagttataacatggtggcaattgtccttagcaaatttatttatttaaatagaacattcttcacagcaggctactgaaagaaatgcaaaagaaccatctttcatgtgaaaataaatcaattacctgtgtgtatatatttcagtcctcggagcaactgatacaagaaaaactggtagtgttcaggagtcaagtcatcgttggcctttataacttggtgcaaatcagactccatgagttcaaaaacaacgtagatatccttgaattctctccttgatggaggaagtagaatatgcttaatttccacgatatccggatgtcgcaggagtctaagcaacttgatctcgcgaagtatccgtgttgcatcggacacatgctcaaagatgtcattgattttcttgatagcaactttatcaccggtgtgagtgtccaaagcagagcaaaccacaccataactcccttttcctataacctcttctatcttgtacctgtttccctcaccgtactcggtgaaaaaatccatctcagaaggtgtctgaatcataaaaagacaaaatggatcagaatcagactagttcttttagtatgacaaaagaatttttttagtatgagaaaaaaaatcctttgttcaattaggtcaaccatcctaaaggcattagctaaatcatactgtatgaaagcggtttcatcggaaacaacataccatgtcaatcatgtatgatgcaaaacagcaagcgttactttttttatggggataaataacatcaagtgatattcttttttatttcaaaaactgcttaggggtcagaaccgcatgattcaacgatgtgtatggatgggggccatacgtacgcatatctccaagtccaggataacaagatgcaaatttatgtactgcataaatcagataaaaatatgaacatacaagacaataacttgaggtcaattaacagtcgccaaggaaagt

SEQ ID NO: 45782 - DNA, 7043 bp, Oryza sativa
tgttggaaaaagcactcgcgctcacgaatctgtaaaacaacaataccgatttttctgacccccttaatttgaaaacccaaaaaaaaaaagcacatcaactccaaattgaatggatccaactaaaaataaacagccacagcaagaacaagatggatcagccaaaaataaaacacacagcttcaactcaccgagatctcgaaccaagaagacgagctccgaccacacagccgctagcaaatcgaagaagaaatcagcagcagcagcacaggtagaaacaactcctaggagatcccaagaaccatcagagatgtggatctcctctctctctcctccggggaaagtgagcaagaaaggcaggatcttttaaggcagcagcagtccagcaagaacaagaaaagagagccgcacagctcactgatcctcacgcgcacaaggcaaaaagaaagggaagggaagaacaagctagctagctggaagagacctggaagaagaggaggatgcggccaagaaatccagctgtgatctaggcaaagctcatggaggagagaggagaggagaggaggtggtagctggggagtcgagactggagagagagatcgttgtggcctctgcttttccgattgattgatttatgctggtaattgcaggttgatttcgctttcgtttcttggaaaaaaaatttttctcttggtgttgtttggtctggaggtgagagagctcccactagaataagggattggagcacatggagccatctggtttctgacgttctgtccacatcttgtgtttcttttgattatttactcttcttttttctattatattaaaaaatataaaaagaattggtactctactttgttttctaaaacaagaaatatgtgatataattattatatatatatatattgaaaaatctaaaaacaaccgttgaataaaaatgaacgtctttgtctatatcattaaaagtaaaatttttacgctaagatttaactatgagttttactacgagaagaaaaggtttatgtttgtaacgtagacaaatcatagccgtttatttttatatctatccttatatatgcggtttgcttgacatatttttccggtttcttaagcaaactaatttaagtgtagaacttaaatttaattttatgagaaactaatttggtgttgtttttctataaatgttgtgacttagggcatgttcatattgtagccaaaataaacattaccaagttttggcaatattgctaaaattttggtaagatttcttatgtattgatcaaatttggcaacaaactaaatgtatttttttttgcaattttggcaactttgccaaaaaatggtatggttgaaaatggtatcaaagtgaacagacccttagaaaacttataattacttataatatgtgacagagagagcaatttggcttaatatatttttacgccgaggcaaaaaataatttattcataacaaaaagtccaaaacgggatgtctttatctactagagaaaatacgcgtaggaataatgagaaaggaccatgtccaggcttcctgtttaaggaaaaatggaagagatgaagcaatatgaatttcaacctttcctgaaaagatataaatttctatcattgctgaggtgtgacagcgtttgtgcagcatatagctatagaaagcatctgctcttcaattatttcccgttcctgtgtactgagaatgtaggcaacggaccgcaaattgaatgaacatttgtgtagcccctatagttcctggcaagaattcaagtgaatttactagtatttacatagagacagctaagctggagtgctggactagttatgcaaggaaatatctttatctattttaacgagtattaagcaatgccctctttttgtttatgtgatcaggcaagtagtaattccatgcttgatcattgttttttttttctaaacatgtatccatgtaaagaccattaaagaataattacacgataatattgttcgtggaaaacctaggacctgttcactttgatgccattttcaatcttaccaaatttttataaagttgcaaaaaaaaagtgggtacatttagtttgctaccaaatttttgtaactatataagaaatccttactaaaattttggcaactatgctaaaattttgtcattggcaaagtttgatatggtttttttggcatcaaaatgaacaggctactaataacgtcatataatccgtcagttttgttttttaacaatattatgggtgtcatttattttgctataacttgtttcattattagagaattttaaacgtttcgttcaaaaaaaaattaaacgtgacttatattttctatattttacactaaattttaaataagatgtatgattaaacattatatatcaaaagttaacagtaccctatattaaaaagagagagatagtatctcacgtatattgatgagatgagatttccagatttgaccgtacacgttctaaacaaacatccttttaagaacggatgagagtatcagaccaaattaatgtttgttggcccatgcacagttgcatactccattatcaactttagaaacaagacaaggaaatatcaaccttccaagttccaagtaaagagtgttttgccaggtaagaaacagcaaaaggttgagtaaccaccctttttcctcttggtttcagttgattgcttgattcagttggatgtccaaaagacaaactgttgtgtacaattataaacaggtcaccaaattctgtgcaaatctgatgtctgaggttaacatgacaaaactggtaatcagatgcaacaattagcagtggacagtgtcagccatctcaggttcacaaggcaatattttccaaagcagtgatccatgaaacatcatcaactaattttgcccacttcagcactaagaaacatgtggagcaaataatatcacttttttttgtagaaatggtactttgaagatactctttcatcaaagcaaacactccacttttaagagacttggacaaagttgagtgggattgcatatgatcctgattgctcactaattataaaaatggctacagatgccattgccagccatgtgctgccaactaaggcaaaagagtcgtccaatttataacgatcaccagtgaactagatttctcttgccgaggacgttaataatcttggttcttgaaggaccctgggttaacaagacaactaaaatgatgacaatctagaaaattaacaattttagaacatgtaccgatggttcattctcctaactgattactgttgactacatataataggatgccacataatttcctctttcacaggaatcagcacatcgggtcaccctcacctccatagttgacccacttagagatcacgacaaaaccaaagaagacttgtttctgatacgtctgtcacagagtttgcatcttcagtggtcacttgctagcatttaccttgtgattcgcatcaaataaggtcgatttgcccactctcaacaaggcccttgatggacttgtaccggaggacatacaaatcatcagcaactaagtccacaacctcctcccctctacgtgaaattagagcaccacagtgttaagtagagcttgaaaaggcgcaacagcaaaaaacaagagaacttcggcacttacatatcatctagctggaatgctcctacgtcactcttggttttgcagaagacaaaggtgtcaagctgaggctctggaactgaacaaggcaaaaaaaaaaaaatcgaatcatatagtttctagaggtcaattacagtattacatcactcaaaaatacatatgtcccacatcagcgtatcttcagaaataggaaggaattttgagcaataaaaggcatgtaaataaacagtctataaataattcccaaatcttcttaaaatagaaaagaaccttttgctggaactttctttactcttttaactaaaagtgcagctcaggttcctgttctagtaaaaagcacatggaatgtatttcagctccaagatacataccatatattaaccagttggaccatcctgatcacactatttcattaaaaaaagttatgcaccggattgttagttactacacactgattaattcctaactgtatgcaacacggctctttggtggattgaagattgcaaccactatacaaggtaaaatatatctgcatggatctttggcacaactgatgatcagtaaaaactggtgattatgttagacaaggaacattatcgcgctgtgtacggttgacatttctcactctgtactccctgaaactgtgtatggttgacattcctgcatactgttgtgtcatgcatttccgtttcaaagaactaactataacagcattttactttctattcatctatgcatgcggataaatagtactaactctaggaggacttaaatattttcagggcaaaccagtaagacaccattttctcgtcagttaactgtatcaaagaatataccactttgttagtaaaaattagcagtcattagtactccctaaaaattataataaaaggattgatatatgcgaagctgattcagttctagaactgtttaaattgagcatatccgagactacaagatgaatgagtatacaaagaggtctttattgcatcctgtggttaaataatgttatttatgagtatgatatgaactcaaattttgggtgcaccaaatttgatacttaaaatttgatcatactccaaatttgatcatgctatctgatcaaatctctgccaaatagtgaccaaaactccaaccaacatctatttggcagagattgatcagatagcatgagaaatgtcgtgttttctgctttgaaatggtgaattttgtactcatcatttgcattaagcagattatgtatcgctcaaaactacaaccaccaaaatagtattgcatcccaaataaacgcactaattataggatcaaaaggaatacccatgtcatcctccgtgctcgacaatgattgcctcgtgacggagtcatacccgtatggaagcttcgacagcactgactgctcgagatgcttctccatcatctccgtacaacttgcaacaaatcaaacccaacaaatgatcatcaaaaccacctgaatccagtcaatcaactaaccagcgtaatcacaacgagtagacggtctagtcgcctgaaaaatacctcttcgcaaatcgctgctcctgctgcgacagccggctcaagagatcttcagacttggagatgtgcatcatgtacttctcaatctacatccatccgtcaaagtaacaggcaatgccaatgccaccagttcagttcagtgatcgatccaatgcgggtggagttacagagaatggaaaattgaatttaaccttttgtaggcggaggcggaggtaggatcggaggaggaagagcgtgcgatcgagatccatctggtagagcgacaccaccaggtcgtcgacgccgctctcgccgaagtcatccagcgtctcctcctgaccaaaatcacatcacatgacagtcgataagaattccggaacaatttgagctagaacacgacgaattgggcacgaatcaagaatcgaagggaaggggaggagagggaaaccgacgaggagctggatctgctcgcggacgcgggagacgaggggagagtcgaagcgaaggatctccggagacgccttctcgttgcgccacgctcgcttgagaagctccacgtcagtgctcgccgccgccgccgccgcggcggccgcggccgagtcgtcgtcttcccaggaggacatctgctttcgctaaaccagtaactggcactctcccggatggtggcctcgccggccagcaaggggcggctacgccgtttgtgtcggtcggtcaggtcgacgcggcggtggcggcggcgtcggcggcgaggtcgccggcgggaggggaggaagcggagcgcgacggcgtggtggtgggggggtggtgggccgagccaaggagatggacgtgtttgggccttggtccatttgcagagtacgcctctctgcagcgaaagcgtatttgatactggacttcctcaaagcctgatgtagctgaccggctggctgagctccaaacatgaccagagcatgaataccaagaacccatcaatggctccatccaaacgacatatttacaaataaaaaatagtttataaataatttttttatatatgtgttgttattgatctaaaggcattggctaaaaataaattacgatgaaaaaaaactaaaatcaactccaaatttaaaattgaaaatttaaatcttggcttataagtataagtataagcggaaagatgaggatgcaagatttttttttttttactaaaacatagagattccattaacctatgtactagttacctccgtactcgaataactgcccatattaactgtaagtctaaaatatctcactttaatgatcatattatatggtgagtgcaatttgtatggttatatttaccacgcaacatactccatttaactgaaaaaaaaaacaaatcctagcacatatatactctctttggaacgctttggaacggagggtgtacttcaataatataacatcttttttaagtttttataatttctttataaaacatttaaagtttaaactagaacaatagtagcgctaagagagtatgtgattatgttgtcaggatagagagtttgaaactttggaaactttggatggctagaaagttagacaaggtaaacccaggttgtcattatcctgatccatattttagtatcttacaatactatgaagccaaaatgatactgatcccacctatgatatcctaattttcataatatctcgatcttactattcatttttcacatgatcctataaaatctgaagtagtatcttggtactacgattctaccaaatattatttaaaataaggtggattgaaaataatgtgaataaatatgctcaagtttacataaaaaccaatttttttttcaaaatcaatattacatgctttaatttatacattttactagaaaaaa

SEQ ID NO: 45783 - DNA, 10102 bp, Oryza sativa
aaattcaccgtgagaatttgcttggatttgtttatttttacaaaatcatgagcggcaattaggagtatgatcgtctcaagttagcatgcgagtttttttaaagagatttcttatacgactctctttctatattccaaaagcgaacgtccttaaaatctaactcaaacacggatatggatttccaaaagcgagtgaatttaaaaaccgactcaaacatggatgacgtaccaaagtaccggcaaaaacatcttcagtttttataatagtagacatataaaaataatgtactttccaaatctgatagcatcccgatcctacggtagatttcaatactatgatactacaaatcagaaaacgatcctacctagcatctcgatactgattaccttgggtaaaccatgcaatgttggtttcaatgtttcaatgtttctaaagattagctttggaggagtactttagaaacattgaaaccaaccttcaatattttcaatgttaaaatctctaggataatcataaaacttgaatgatctttaaaaataactccatcaaatatagaattacgatggttgcttatcatagtccttctccagtattaggcaatcgctctttaagatgattttgttgattcttagtgagcttgccatgttgatagccgctgcattgcttgaacttccacttgtattgtaactcaagaaactaaatgatttcctcttgcttcttttcaaaattacctcacgaatcttcgcaacgggacaccattgttaacttcaacaaacgcgagcaatggtctggaataagagaaaaaccgatgattttatcatacccagtaactcagatgataaggaaaaaagcttctcttggatggaagtgacaactaaccacagccaaatgttttcaatacttatcctcctcctacaaaatcaaatagaaaaaaaccagggaaaaatcacgtgacacgtattttcatcaatgcttcccattgtttaccaaatctaaaatcagctaaggtcaagatttcaaagtttttcattgaagtttttttctaagcattgacttttaaatcgctaactatatactcctatatatttacacatttaacaacatattattattgttgttactactttgggcagtgtttagctcctttaaacttccaaaaattccgtcacaccaaatgtttaaacacatgtatagagcattaaaatgtggacgaaagaaactaattgcatagtttgcatgtaaattgagagacggatcttttgatcctaattacgccatgatttgacaatgtgatgctacaataaacatttgctaatgacggattaattaggcttaataaattcgcctcgcaatttataggtggaatctgtaatttgttttgttattagtctatgtttaatactttaaatgtgtatctgtatatttaaaaaaattttggcacacgaactggccttgtgctgcgttcgggaggagggggcacgtaaaacggagcacccattattgcatgatcaattaagtattagctatttttttttcaaaaatggattaatttgattttttaagtaacttttgtatagaaactttttataaaaaacataacgtttagcagtttgaaaaacgtgcacgtggaaaacgagctagatgggttgggaagttgagggagatggtcgaggtggcagtgccaagcaagcagccaagttggcaaccgaaaatatcaaaggcttcccgcgaccaccaaccccaccaccacacacatccatcctcacgacgccctccaccgcttcgcgaatcttcctccccaaccacacgaaaaccaaaaaaaactcaccttcaccctcgccgtcgcggcgccccccaaaaaaattcacccctttttccccacgctccggtggctccacgccgccccgcccgccgccgcgaccacccgttccaccggcgaatccgcggatttaatctcccacagctccccgtgagatcacaaagaccgggcgggcgtgggctgtgggctgggatggtgggcgacctctcctccctcctcgccgccgcctcctccgcctcccccgtcgtcctcgcgccatcaaaggtgcgccgcttttcttgctctctgctaccccggttggggctgattgatgattgggggaattcttggttttgtaggagctccatggcgtgcacttgccgatgccgctccaggggaagaggccgccgctgcagccgcaggacgctgccgtccacatcgaggccgccgccgccgccgccgccgccgccttccaggggcaggtgatggtgcccggccacgcgcatgccggcgctcccgccgccttccaggccttcgctgtgcccgacatggccgcgctcatcgacgtccaaggttcgtgttgcctcttcgattcctcttcttccttcgttaagtgcatgcacaagcacaccgttggctaatttgctagagattttgttgttcaattgaatttggaatttgccagtcgcagctatggatccgaattgtgagattaggcatgctttttttcccctaaagttagagacagtaatttgctttgcagaaaggagtagaaacaaaattctttgcttgttcatgcgcgcgccttggcttgtggtttacaaatgagacctgaagccattgctttacacatcggttgctttcttctgtgtgcttgcacatagtacaagattgtgtagtgagctttgcaatggtcttttctagtaggatggtttttcatggtatgttacacataattcaggtcaagattaaaatttcctactctcactaagtggtttgtcccgttcgattcatgatttaatctgtcaaattttcagttttacaagtgtggattagaattcattttcagttttgcattttatgctgattctaacctcgatgtatctgtgcagcagactctcaccctgactcagttcaacttagccttgggattgccgagcaatgctcaaggcaggagaaaatcctgaaatttctaaggtcagggtccgatgtgaaagaacttgatgtatctttactgactgaacttacggggcatcaaactctgccaatcaacttgggtactcaaccatacatccctgatgataagttatcagctcttccaatcagcatggccagtcaaccatatatccctgacgataagttatctatctatgagtttgaattggatgagccccagcagtatctaccagaaaatcaacttgtcatccctgatcctcttgtggagtttttccagtcccatggttctgcccttaccatagatcaaaacaggagaatcctcttcaatggaaatggagatgatatgagatatttactttcgattgtcttggcattcaatatgtctaaacgagaaataagcagttgcaagacagcatatctagttccatattttgaaaggtaatactgtgaagcatcatgctccttgtagaccttctcattcatcttattcatttgttcattgaggtttaatacttgagtgatatgcaaactccgtggtaaccgtgttctcttgagcactgtaaggtagaccaatgattctaattttgccactcaggctgttttccattagataaaagctgtgttaggcacctatggtcatcttttagctgtattagcaaagatgtcgcattaagatcttccttggtctgctggacatgttgacaccgtttcaactggccatgaatagtgcatagcatatttgttcgcggttggaatgaataattccatgtctggatcaatactcccaacagaattctaaagactgctgcatcacttcacgcacaagacgctttccctgtagaaatacagaagaaagatgttaaaattatttcttaacactattgctgttctagacgacatgtttccttgtgcttcacaatgatctgttaaaaggggcattgcattgcctctgtaatcaatgttgaatcatgtgttttttttcttgtcttagtgaccccatcctcattattgatgcctcttttttttggcttttgtctaattgtcttataaatgtcttttttgataaacaggaaaaggcgatcccgagcaagcagccatgcatccaattcaaaattagcaagcacagcagttgatgcttcaaaaaggtacattgcagtcacttgtgtattttctgaacaccaaccattagcataacttctatactgttttcctgccatagtcatgataaaggttaaatactcaatggattgggttgaagtagtgcaattcttattcttcaaactgctagtgtagactttgtagttacttcgaaaagatacacaatcacttgcagcatagactagacacaagtagtggcaggcttttttgtttgaacaaaataaaagatcagacacatagaacagacatgtgggaattactggactaaactacgatgatattgctctttttacctgtttctaaaactgcatccaaggttatttttacatattaatgtgattttttttaaatactcagcactgcaaatgggaagtcaaaatcttcatcaaggaagaagcagaagagtaaaaatattaaagaacgtgacctgtacccgaagaactatttccatgctagtgaagcatttttatctatgctcctggacaaggacaatagcagctcaacaattcattcactgaaaaaagctggtcctgagatcagtgaactgctgacaaaatgctctattggcatcgctggaactggcttggctgttcttctctcagttgtgtgcaagatggctaccggtatgaagagtcctattgctgctacgcggctggtgaacactggtgttggacttgggctcttttggctctcctgggcagtaaacggattgcgagacacaattactagcatatttagaagcccaggtgacatgaacttgaaggacgaagaggttgcagtcagaatacaaaagagcatgaacgacattctcttcagagctatcactatattggcaatcactgcttttaagtttgcgtaagtggttacatactaatttaccttttccccgacccacctgtaatatataatccaccattttggttcaggagtacagcactagtgcttctgtaggattaagtgccaattgagcaaatgatccccggtaattttgtagaaaatgagaaaccgttgtgaactgtacagaattttgctggcagcttggtgtatatgaaagatgggtttttttcttatctgtagatgaacaatccaatgcccaatgatttatctatccagcagacaggttccatattttagctacttatcctcgtttgttcctgatctatcgatgtttgattgaaatgtcagtcctggtgtaattttaagagattcatgcgctaaattttctgatatgttagaaacaccctgatttgcagaatgctcgtaatttgaaatggttaaagcctgctctcttcttaaaaaaaaaaagcttctagctatgaatctggatagagttttttttttaaaaattttttttgggaaggagggtgcccatgcaacatggttgctatagtctttcttcaccaatcacatggaactagcaatgagtacatccgacgttgataattgtcattgataccatttcgaatttatgatcatagtcaactgattacttcaaaaacgaatttatgatcagtcaactactataaaaaaaatgatctgctggagttccaatcagtgtcttaggataataatgtaattttaagtagctgtacacttgatctatcatatgagagcatataaggaagaagactcaaaggagcttcactgttggtaatgttgacaacagacaacttggcatccgcagctgctttgtcaaaacagttgaatgtctcggcattccgaataactgtggctatgtaggcgacaggaacttctgtcgcagcgctactgaattcgttgctggtttcttctttgtttgcgacattattagttcctcgattattcccccttctcaatagcatagaaagcactctaataaggtgcggcacacagaccggatcatatattatatctgcaccaaggctgtcaaaagatatcaaattagtgtttatcgaaacgaaaaagaaacatatgaagggactgatgtaatctggatcatgtgtcagcaggggtgtatcctgtcatcagcttgcaaaggctatttgtatttgttcaaccagatcagttcagtttaatgggcatgaactcaacgacactatgctcaaaaggttttactctctattttccaagtcgcaatagctcgataaattgataattgattcaaacaagtgtttcatggctcccacagtcacatgtccagtgtcagatggataatggtaatggaaaaactaagtgtaaactgctacaataatacaaaaaattattgcccaaggaaatactgtactcacactaagtctggcctgcagtcccatagatcgctttcagatgtttcttcccatgaaagatatttgcattgtacctgcatgccagaatatagtacaatcatattttatccagtagtgcatttgatctaacctcaaaaggacaggtatctgattcaaggtggtgtctggtggttaaagtgcaacaagagtacaagactacaagagagactaattaagctacaacatttactggaaagcacacaactattttttctcaaatgaaatcatactgaaaaatatacacaatgtataatcttgaaagtatattctttatataagaagatagcataccttattcttgttctcttccggaagttgagaaccttcctgctcaacgcataagttattcatttccatgttgcctttcatgttttctagtgtagatgcatcaccatcagtaagaataacctgcatcatcgtataaacactgtgtcacctgtctttcctgttgaactaatctctaacctttgaagaagtttatgagcttagttaggagtaaatatagctcatagcataaccatcactagtcgctacagtcagtcaaacttaaagagttgactatatgtctgcattttcatttctcagttaagtcgtcttgacaaactatacaaggcttactttttcacagatatccatttacttgaatggagagtggcattataaactttcataccttggaggcgctgacatagttcagacatacaccaaccaaaccaacaccagaacctagctgtttatcatggaaacatttagaagggtaagacacactcacatataacttttaaaagtttcggtcatgagattttctgttgatataacaggcaaggaaaaagtatgatgctgatgagacagatgatcatactaaagtcatagcaacagtaactgcatatctatttgctcaagaaaaacatcaaggtaaagcgacacatatagtagaagggctttgcagagagctagcgacagagttcaagctcaattttacacattgtataatcactagaaaaaatgcccgtgcgttgcaacgggtaaaaacgttttttatactatacattatactcccttgattttgaaccaaatgctttcttgttttttggaccgaacgttcattctttccttccttttcagctctagtcctagagcagtccgttgcctctatctgctcgacctatctctcttcggctcagcccacaagtggagctgtagacctagcttgaacagtcctttgcctggcctacctctctttggctcagcccacaagtggagctgtaggcccatgtcgaacagtttcgtgcccgtaccatgacggagccgatcctcccaccaaatccggtaatttggtcgagctcgcatagtaccgtgcccgtacgatgacggagtcgatcctctccgtcaaatgcggccgaatctttctcgatctccaaaattgttgagaaattttgatccactcgatctcatttttcgaatttttatcaaaatcgaagcaatccgcaaaactcggaataaaaaatgacgaactaatgggaaattaaggggaaaatgatgagagagtagtggggaatcggtttttgcaatcaattggatgaggaaacgcatggagaggcaaatcgccatggcggcggcgctaggattcaggccgaaaaaaaaaaaccgccaaaaatagcgcgttggatttcgttgaaaccggaaaaatggtgaaagaaaaaaaaagaagagaaaaacaacgcaaagaaaataaaaggaaaatggacgaaaaaaccgcgaaaaatggtgaaaaaatggcaaaaagaaaataaaaccgaaaaaggggaaaaaaaaaagaaacggacgaaaattttgccgtgccgagcttcttttttgtccgcttttttagtacagataagaatcggtcaggttttttttttgccacgcctttttttttccgcgctggacttttttcgttacaatcgaacttttttatcgcttttatttattaacggacgaaggaaacatcttatactttttaagtagtagtagattagagaaatgtacaatggacttctatatatttgtgttgcaaaacgcatgcctaagcaagatataaccagtatttgctgggggatgatcaggttggctcactttggatctgtccctggttacagtaataatattttacagcagaagatagagtagttgagctgaacatattcctataaatatatatatgctagataaagataacattttccatgtatctaaactaaaacacaaaaaataatcggtatttacctcaaagcaacacttcctagagaaaatttttgggtatgaaagaataaactcagataggaataaacctgatggccaaagagagcacctgtaaaagaaaagtatgcactgacatgaattaagaatttatgcaagtagcttaatatatagataatagtagattatatattcaatgccatcataccctgtatcaccttcgagcatattgatagaacatgataatcgagcaaccaagcttactcgtttattgtcatctacataaaaggtgcatgttacaaactattataatttggaagaattcaaaattaaaaactcacttgtaggagaaataaaagatatttctttatagatcttctcagtcctatttaaggatgaattattctgcacatgttataaaataagttacttttagtacagcatttcaacagttattaactactacttggctatattacgatgtttaaaagacgtactgattttgacgacatgaactggccaaattcctcataaagtccatcaatcacaatatctgacgataactcagcttctgctataatccttttaagaatagttgtaacataactacagttttgatctccccctgcctgtaatgaaaactcaacattttagattaggagttacaggaaaatattgtgcaacaaccagaaaattataaaaatgtcaagtaaaccaaattgtgactcttttgtattatgcatctttctacaacgcacacatcatggtcgtttttttttctgttgatagttttgcgtgagataacaaaagacatttacattattgccagtacaactctccaaaataaaattttgaacgtgtggcgtgacagaacctcccccagcttttctgcacaatcaaatacacacaaatttaaataaacaccaccataaacttatcaaaaaaaagaagagaaaacaaaatagcgctttgccttgtcaagttacaatcacattcatacaactgagaagaggaagattattattttttttaagaaaaacctttgtatgaaatttcctgacacattcatataaggtggaaactgacaagttctctgaactttcctgggtctaaagatctctctgctcattggagctcaatcactagccaagtctcatcacactactgacgcaaacacagcctcctccactactaaatccaaaccaaatctctgtatcggcaacatttttctgaaggcaaccaaccgcataggcttgcctgagattggggactcgatcgatcgatgcagagcagcatacgaattcgagcgcgtggggggcgcgcgtacctggcgagggagaggacgcaggcggggggctcccgggcgaggaaggcgagcttcaggtggaggagcagctcctgctcggcggcggcgggggccatggatttc

SEQ ID NO: 45784 - DNA, 1731 bp, Oryza sativa
tactgtgccccgacggtaagcacggttaccgtgtggtaaccgcggtaaccgtgaaaatccatacaaaatcgtgtaaaatttatcaaaaattaattattttttaaatttatttgaatttaaggaggttatcgcggtatttatattaccgtaccccgtggtaagcccagtaaccatggtaaccgtgcggttaccggcggtaagtcaaatcctatgtacaagtactttttggaggatataagattgttttagtatcataaaattattactacttgtcaaaataaatctacagatattttttttcgaaataaatctgcagatatggttccttcatgacaccatcctagtataaaatcctaatataagtgcgcacctgtaccggatttgaacagttttactactacatcttctgatattatgtgcacttattcttgtggtagtaggtgcacttatattgagacgatgagagtaacatatattcaaggtaaatatatttaaaaatgtagtattatgcttaagatatttgaaatttggccataaatattttttacagcaataaggcacgttcttttggataaataaaaatgaataaatgcacatgtttcatgagtttctaaatgtttattaaagggataatgatgatggtgagtgatgaattagtcaccagtcactaccctaatcaccactacctttttggaataaagaaatgacatagggtcaaaggactcgcatgtcaaccaccactaccatcatctctacttttgtggaaaagaaaaatgatattgtgagcctatagagaccatatattagttataaatatgtagaatttaagagatgatgtatacagaaaataatgataatagcaggttaatgatcattttcatcaattaaaattccattacaatgcacgggcaatatgctagtatatacaaacatatataacaatataagaaacggtaggtcatgttcttttctaatcaagatgtagattttacctcagtttcattaacggtttttcaaactgctacacagtgtatttgtgcgaaatttttttagtataaaagttgctttaaaatatcaaataaatatatttttcaagtttgaaataattaaaactgctaatggttttctcgttttacgtaccctacttgatcttcatctttgtcaaattcaaacgggcataatttctgcctctctagctagttaagtattaccacctccatcctaaaagataagaagttttaaggatagacacataagttaaaaaagttggtgaaattaaatagaagaagattgcaattgattaaaaagagaaggtagatgggaaatcggaatggtaaaagtttatgattaattgcgaagagaacgtagatagaaaaattgttatattttgaaataaattttgaaggctttgttatatcttgggacgaatggagaactcctttcgtttgacatatattaattcagatatgaaaagacgaatattttctttattaagacgatctattcgatatttctcctaagcttacatgcttgtcagacttttgaggtggtcaagttctaatcaaccacgtttatacctgaagattggaggtgacaatggtctctaactaagcttgagaaaacaaggatacatacttaaaaatgaagtcttttagagatagaggagttatctcgatcgtcaactggcatgcccaagtttctgggctacatgcctacatcaaggaatcgaat

SEQ ID NO: 45785 - DNA, 10834 bp, Oryza sativa
gacatagaaaaaaacatattttttgatggatggagtactagctagagtagtagcatcggattaataatgaacttcaacaacaactttcgtgcaactcgatatactatgtactaaccccgtcacaaaataaattcacttttcatccatcccacacgctaccaatatacaaaacaaaaaactaaaatactcttatttcatcaaatcctaatgcaactcttactcattttatttatttttaatgtaattattctctactttcacaaacacagatacgatgagtactttaaagacaaacttatttttgagataaatgaaatgagttaaaaaagaacttattacgggacagcagaaagtactatagctagctagaccttatcttccaaatcagaataaccaacaatctaaagcaatgagaatagcatgtaagaatcatcaggagactaaccatctccttaaagcttcctcgcaaacaaacacataaagaaaaattagactacttagggtgtgtttagttcatatcaaaattagaaatttggttaaaattggaacgatatgatggaaaagttggaagtttactccgtgtgtaggaaagttttgatgtgatggaaaagttgaaagtttgacttattgtaatattttggcagcctcgatcgctagcctagctatatatataataactaataagtagtaccatgtcccatctctgctagtcaagtctctctgtctttctctcgacttgaattttcatcgatcggttttaccggcaagcatggcgtcgcggcgggccgccggcagcgtgggcgtcgtcgccggcgacggccaagctgctgctgtctgcgtcgacaaggtggcgaagattggccggcagcgggaagacgtcgatggcgtcggcggcggcggcgacgacgcggcggtggcggtggcggtggacagggtggaggagatcggcggcaacggcgtggacatctgggctcagatcttcatcgaccagacgagaaggaagatgaattcgcagctaaataagtaaaaaatatcactctccgtcctaaaatatattagattttgattgatgtaatacattttatactaatctcattcaaccaaaatctcttatatttgagaatggggtatactaactgcacatatagttattaaggatatatagataagtaattagctgcgaccatttgtgattgtaatttctttcaacagtgtgtataacgtacaaaactcgtgtgttatcgatgaatttatttattattgcactcaatgatcagttacggtaagtacaacttggggagccaatcgaccattcgaccgtgttaattttgtttaatttctcgttttgcttgtactcacaattttgtgaacctcaactgttgggcttcctaaatgtggcccatctaatgcgccccggcccatgcatgtgaaggtgccaatgcacatagagtaaaagtatatgagatggattggaaacttattaatttctccgtttcacaatgtaattcattctagcatttgaatgcgatgttaattgtagcgcccgtttcgtcgtggcgcctagcgggaaaactatctcttaaaaaccctaattgcgaaatccgtttctttgcttgttgtctagtgtccgtgccatctcatatctcaaatccctccgcaaaagtctatcttgcctccctcgggttcgatgggccgaattcctctcggcccatctctccctccctccccatctctctctctctctctccctctcccccactctgcccgtgcgctgcacacgcgtgcgcgtgagccgcgccgagccgagcgccctccgccttcgccgccgcttcccgccgatgccacccaaatcgcagcgccgcccgcgcgcgcgcacgccgtggtggccgatcggccagtcgccgccgccgtcagcgcctgctgcgcctgccccgcgtctgccgcccgagtcgctgctccgttccaaaccgccccgccgtcatcgccgtcgtcatcgactcggccccgcctctccccgcgcgtgcctccaagggacggaggcagagcttcccccctccgccgcgtcgccctctctccctcctccttttccccaaagtggcaagggggcaagccccctttccctcctccctttttcccttttctcttcccagccggcgtcatccacctctgtcgccgttttggccgcgagcgccgagcgccagctcgcgccttgaccgcccaaggtcggtttccaaaccgacattgccgccctataagcccaggcaccctccctcccttctcctctcgtttgtcccaccgcctccactccattgtcgccgcctcccgtgctctgttcgccgccgcctttcgtgcctcgcgtgccggaggagccggcacgttcgtggacgcggaaggggactccaggagctcgtcttcttcctcttccccggcccgaggccggagagaacactcccgcgccgtcggcccctcgtcactgcaccccgtcccgcacggtagtgcatccctccgttctccctcctcgcaacatctcttccccttagctttgagtagccgctcgagtagtaccccagtagttagctggcgccgttccgactgctgtcgtcgctcgccgtgtgctcgccgccgtcgccgcccgagctcggaagcgtctctcgtcgccggcctccctcgatgcgtttcctcctaatccggcgcaagcgatgggttcccgtagccgcgtagatgctctcaccgccgggaatcggcccctcgagacctcgtcgccgtttccccctttcctctccgccggttgccgccgccgcaatccgccgccgacggactccctccggcgaatccaagccgttggctcgctccctctcgttctccctcgtcatcccagtgtacgccccgtcacccctcgtcgtcgcacggcgtcccggagaaaccgccgccgcccgccgtccattcgcggccggcgccttcgtcttcctccagccggcccgcgtggcagccacgtaggcaccacgtcggcgccacctcggccgcgaccggatcggctgacccggccagccgctccctccgttcccccccccgtgcgcatggtccacggtgagccgtgaggctgcgcgtgggcccgccgcaccgcgtcctccgcgaaccgcgcgcatgcaccgcgcctccctccccaaaccctagcacgccccgcgtgcacctcactcacggtgagccgagtcgccgacaagcgggtcccactcgggaccacacgggatggacccggcccaccggctctctctctctcctccccacccgcacgcgcgccttgggccgccttcttgggccggccggcccattaagctcggccgagccgcccctttctctcgggccgcgccctagccgcccgaggaaagtctaatttccctccctccttcttttcttttcttttctttttctaaaaggatttaaataaatccttttcctttagaccaaaaatccaataatgttagaaattcaatatcttcccaaccgtaagcccgtttgactccgttcaacttccaaaactcctcaaatctcgagatctatctaatggcatgcctagaggtcaataatagggctttattttcgccgtttgttgagttgtcccatttcgcgtgtagtttcggagcccgaagacccgcagtgcgaggatttcgaggatcaagctcaagatctcgagcaaggcaagccacctttgaacatcttgaacctatatttgaacgtaattatattgcttgcaaaatattatacattgataggagtgcacttaatctgtttgccccgtctgcaaggcagaccggtgggcctacctaacttgttgcatttgatccttccgttgttaattgttatatcatgttcccttgtaaccacctagttgcgcctcggtaatcgtgcactctgtacgagtatcgacggtcgccttcaaacttaaaatctgagaaacatcttgggtaaaacttgggttttacaaaagacttggaaaacccgacacctgggtcggtgcttgcaaactaaatgaatttccaaaatcgcggaccggggaacgtaccgggtgtacggtttcccgctcttgcacttaaggaccgtttccttggaatttcatccgaacataagacaagtgcgaccacatgggtggaatgggacacccctggctgagtaattagctaatcaggggagccttgatgctgagagacaagtggattcgccgaggtggtgtcggggaggacccctgggcttcctggcacagtatggtctgggacctaacctgttgttggtctgggacccctctcgtcagcatatggtgaacctgtgtcggctttcgaaatgccttgtcatgaaagccctaaggtctctagtcgtggccgttctgcacgggctggatgatccgggttagtaattagtaatgtcgtgtgggtaaagtgtaccccctctgcagaggttattaaactgttcgaacagccgtgcccacggtcatgggcggatgtgaggtgattccttgcgtagttttgtttgactactgctttgtgaaatttgctgatgtggtttgggattgatgtttggaaaatctgcggctgatgggatcagccaggcccgggtggccgtttgaaagttgttggccgggtgccaatcctgatcaattcaaaagactgatacattgcacatactccgaccggacgagacgcactgtctcatccgtgtcgtttgagaagcactcacttagttgtttcagaaaagagtttaaataaaattaattgcaaaaacaacagcctttccttgaagcctgcataaaatacttatttcccatggcttgctgagtatccctgtacccacccttgctctatataaataatctcccccagttgctgaagaagatgaagcggaacccgctgacgaggagttcttccaggagcaagtcggccccgatgagttttagggtttcggcctagttcccaagtcgcgcctgtgatgtgtggtccaagtcttggcttccgcttcccttatgtaatgcagttgtgagctcgggatctgtccgcagcccaacatgactgtacccctactctataataaagagacctctgttgctgtgatattctgtcttcctgtgataccagcactgtttcctgggactggtatcgattaacaggttaatttggagcgtcacgggctagtcccgctcggggctagttcggggcgtgacattaatgaatctagatagatatatatgtctagatttattaacatcaatatgaatgtgacaaaagctagaatgacttacattgtgaaatggagggagtataaacttttctataaaagtgtcagggttacgggttaggtataccctttacccttcgatatacgtcgcatatcggtatggcatacccacgcgcatacggatattctctgcatacattaaggaaatccttcacggaatttacggatggaaagagttctactcggacaagactgggtcgtcaatgtatcgtgtaaggtctgatgtctccgagttctacttggaaaccgcttgacctgcgatataaagggaccccccggggaggacctagggatcgaatctcagagccaacacaaccctcacagcctacgaagtcagagcctgcaaggagccaaatcgccggggatctagtcgaaccaactcgactacgaactcgccggatccgtcgagttccattgttcccattgtaaactggattagggctattacctatcaaggggcctgaaccagtataatctttgtctttgatttgcttgatgtcgtattacgtagattcttgtaccaacgtaccccaataccctctatatccggtctacgggtatcacccgtcgacaaaaagttcttaagaaatctttaaaaaatcactcagataggtaatatgtaaataaacaattctataaaatttcatggacaaactcaatgtgatacaaaattaacaaataatactatttttgtttgtctttttttctccaatgtttctctatttaatatctcacggataaagttgagtttatcatcgaactttaaagtgttgtctaatattatgttaactatctgtgagatatttttttttcaatttttttgaaaacttgtatatatcatcttttcttcaatgtttctcaattttatatctcagacaccgatagatatgaaatgtttcaaataactgatcatataagacaaattccagtacaaaaccaaatcgccgcctctgcatacatttcctatctattttcacatgaatgatatgatgcatgcatatttatatatatgtgagaatggaacttataatttaactcttataatataccttgttcgttcctgcctagcgaagctaagccaaatctagtacatggctggccttctgacgtatgccaagtgatatcagcaacgcacacataacacataatacatcacgcgtgtgattttaggagaaatcatgtgaatttctgaccttcagaaacgatcgtgtatgcgcatcgcatataccatgaagaggacgaaatctttgtttgaaaaagaaacttttgatgaaagcgttagcggttgacgccttcgattattattcagttcttactactatacaggcatatacaactcagtgcacgtatatcgctatcgatatctttgtgcctgatactctcttaagcgtaaaaccctttttttgccatacgtatgtttgtcccttgatggatcagctggattgtgcgctaggtagctcccttcattattttagttcactatactttcagtttttaacatgtgttactgttactatttctgtcactaccagaacacaacacccgtgctgcctcgtcagtgttggttagccaaaagccaacattaatgggatttctctctccgcgcgcgtccaatctgaccaactactagcacttatgactattcactagtgcctttattttttaattgaaccagcatcaaaagaatgtgagtcgaccaaatcaaaacgagccaattttttaagtcggactccggaatctagattggtcgatccccttttcctcctccctgtccatctccccctactcgcagatgataaggtgtatttgaatttagattgaatatgtgatgttgatttgtatttgtcagtgttgatctatgcatattgatttgtgagtgtgtccattgatgtgtttgtgagatgttgatgttgatttggatatgaggatttagacatttggtattgagttgatctaggcatccatcgatttggacgagccagctctttttttttttagcttgtcaacctcatcagccagctcataggtgcccatatatatattattgtgccggttggggacccatttaccggcactgatgagagagggctcatcagtgccctattgttgtgccagttggggactcatcatagatgagagtctccaaccggcactaaagttgttccctgtcgtaatgtgtaaactaaaaaccatagcctttacaaagtaattaatttaattataccatatagatgtaagaagtaatattcaaaacaagtatttcctctatccaaaatatgagcattccaaacgtttaaaatttatttataaatttagggatttctaagaactacttgttacatcaatttatctctcattcaaattactttccatcttatatccttaatcatcctcctatctccaaccgtcctttatttaatgaaggacacaaagctcttttctccttagtcttaatctccactaaacatgtataaatgtttgacatggcacatgtacataaccaattagatggaattggacaagtaacattcgaacatgagctacaattagcatagcataaagcttaaataaggcagtaaagtagtaattaaaccgaatgaaccctaggcctacttggaatgtctgtttctggtccaaaacggtgtaaaatactggcctatatcatttttcagttggactgaaaaacacccttggagaagttgtatctcggattataattcggcatggtatgcccattaccataaaaaaaataatctcataacacgcaaaagggaaaataagttggccgattaagtgctctccgcccagcaccgacgccagcctcttctttgcccatgcccccacagccaaggctccacatcacgaccatcttcttcttccagatgccaccacctcctcctctcccaggatctgctttctctcatgcgcaccggatccgctaccttctccgccctgttgccgttgccagtgctcctcagcacgcgttgccttcctcaccgcaccaccccatcaacaagcttagtcttttccttgaggtcgatggcaccctctccagtgtccttatgagttttgagttgttggcatcatcttggagttgcattgtgcctccacagctcagtgataacttgtgcttgccacttctcttccagttcaaatacatattccaaaattttcaattaccgtgttgatgattcttgtatatcttctacttaatccaaactttcttgttccaattcgatgttccatttatgttttgatgaatagcgatgtctcgaactgaattgaccattcgcttatccagttctttatgagagaaaactttcacttttgtgccttctcccaaatagctcagctagggatttccttttcaccggtattcaatttttttttgggtaaccgaagttataaatgattttatttatttttggactagaaaagaaaacccgaaacattcaagcctatatctcaaagtgagccacgtgctataaataaaaatttcaagactgaaataaaaaagtttacgttctttgcgggaaactattttaatccctcaaggggatatccactcgttctttgcatgtcacttaaatggttatgaaaaaaattaaaaaaaattgagaatgtgtattaacatgtgatataacactccacaaacatgtaagttcaaattcaacttctatatctcgtaacgaaaaaaaaattaaaccgcagctagttaacgtatattcagagtcaaatttgttttttcgttgttagatttagaagttgaatttttacttgcatgtttgtggagtgatatatcacatgttaatacatcttctcaattattttcattttttttcataaccatttgagtaaaatgcaaacaacgaggggatatcctctcgagggatcaaaatcatcttcccttatttgctgttggatataaaagatacagtacggttgttgcacaccataaaagaattggtaattaactatggaacactaggccattattttattatttttatgagattttagaaagaaaaatttgcccctagggctagaagcttgtattggaaactttgacgacgaagtcgaaatgatctttcttgaaaacaaaagcttgacgacgtcgagtgtattgcagacttgcagtgtgccgatccttaatacccaatccaagatgctgtctttttaattatgagtagaggaatcaagtcagaaattaggcatgtgatagcatcgtagtatcttaggtcttaaggcagtacgtacacaggtagctgctggctaccgcgttatcgcatctgttggtagggacgacagtattgaaaggcagctagtgattgactgctaattattcctgacgaaattacgataggcatactgttcaattcaacaactgctatacatatatatgcatcaaattttataagtatatatacgtacgtgtatgtatatgaaaagtatatgcatgaatgtatgcggcgatccagtcaataagtctctggatccgtgtggccgcggcctgcaaattgcaaattctaattcgtcacagagaccgaatctgattcgaatttggaacacgctcctgacgcattcgacgattggagacgaaaccaccgtgcaatttgacgcaatcaaagcgaactgcgagtattactactatgcaaggaagtttcagtaatatatattcagtctactgtagctttctggtccatattttccttgctctggatcttcaaatggttcatacagcttttacgctttaatttgaccttcactagctaatgctgttctgaacctcacagatttctgcattattatctcctcttggatcagttagttttcgtcagaaagaaagaacagcgcattttcttcagctgaataggtcaatcaacgctcgctacagtgtaataatacaaattaaacctcacaagaagcttctataaatacatgcaatgagtggtttcgtgatcattcattcagagcaacagaaaagatcaaggtgaacacatcagagagctagatcatcagcagatcgatcaagaaaaaacacatttcgtcatcgatctgcaggacgaacagtatgccgagtgttcaggagatcagcgtccacagggtggccaagatcgagccgacgacgccgacgacggtggcgaacgcggtgaagacgccggcgccgcctgcaggcggcggcattgacgcggcagcggcggggtacatcgccaagatgaagcggcggtgggcggcggagtcggcggcggcggcggctgcatcgtcgtcgtcgtcgactcgtgctactgcgaaaaagcgttagagattaaggaaatcaaggattatattgcatgcaacacatagatctacatgcatggatggatgaaagttaattagtttttggtgttaattttcattgacaggttgtttccgctgattgtttgttgttattgattgattaattgactggattattgtacgtagcttacttgttacaaacaaggacgttgaggtgtatatatgtttcttattattaatataatataaagcctaaacatgtgtatatatgttc

SEQ ID NO: 45786 - DNA, 806 bp, Oryza sativa
ttcttagttaattaattagtaatcagtgtggtgtgatcatgagttgtcaaggtatcttgtttggtatagctctaactctaacttcagctctagctccagctcgagcttcatctctcctggagtttgagtctagccaaatagtttagctctaatatctaaaataggagtagagctgggtggagttctctcacatgaactaagagaggtggaactgctcgacaactccacttcaaacccaactcctagagttaaatttagaagttggagctctaccaaacagttcatatgggtcatatcagtcgctaatttacacactatgcatgacgcaattaattagcccctgatgcacatggagtaagtaaaataattgttgcaccggacgagctctttttagaattaaatttgaaaatatactgttgatttgtttgtttctcaaaaatattcggaatgcaaatttattagcagaaatataccgtcgatctcgcacaaccattccacgaaagtgacgtggaagtgatgccctgaacggtctcgcgcgaagagagcgcgagaccgcacggtatcgcgtgatcatagcacgataccgtgcggtctcgcacgacgaaaaaacgataccgaacgacgaaatcgaggacgtactacgtggtggcggcatcagaccacgcggtctcgcgcggccaaaccgcgagaccgagcagtctggctcagtcagtgagcgatagcgactgcctctaccgattgaataaggttaattagtgattaattatcgataattagaataattaatcactaattattattaatta

SEQ ID NO: 45787 - DNA, 10970 bp, Oryza sativa
gctcccgaagcggatcatcctggtgcgccacggcgagagccaggggaacctcgacatgtccgcctacaccaccacgcccgactaccgcatcccgctcaccccgctcggcgtcgaccaggcccgcgccgccgggaagggcatcctcgacgtcgtctcctccgccgccaactggaaggtctacttctacgtctccccctacgagcgcacccgcgccacgctccgcgagatcggcgccgccttcccccgccaccgcgtcatcggcgcccgcgaggagtgccgcgtccgcgagcaggacttcggcaacttccaggtcgaggagcgcatgcgcgccgtcaaggagacccgcgaccgcttcggccgcttcttcttccgcttccccgagggcgagtccgccgccgacgtcttcgaccgcgtcgccagtatgtccccatctcatttcaattcaattccattctcccattcttcttgcaattcaaaacgatttctgatgaaattcaatccaattcaattcttgttcaggtttcttggagtcgctgtggagggacatagacatggggaggctggagcaggacgcgagctgcgagaccaacctggtgatcgtctcccatggcctcacctcgcgggtcttcctcatgaagtggttcaagtggacggtggaccagttcgagcgcctcaacaacttcgacaactgcgagttcagggtcatgcagctcggccccgccggcgagtacagcctcctcatccaccacaccaaggaggagctccagcgctggggcctctccccggagatgatcgccgaccagcagtggcgcgcctccgccaaccgccgcagctgggccgacgagtgctcctccttcctcgccaccttcttcgaccactggaacgaagacgacaatgacgacgacgacgatggcaaggaggaaaatggcaagaccaacaagttgctcgagtaataatcttgctgcttgcctctacttgctctttctttagaaattccgtttaaaattctttggaatttgattcgattggtactactagtgtatttctccattggggcgatgcaatgtactcccctttgctgattcttttctgtttgatctgtagcctgttcatacatagttgctagatactacattgataaatactatatatgatttggggaaatgaagcaaacgatttgactatcaaaaggaatcattgcctatattctgataaacacataggataaatctcgagggtttgttctgaatctcattcctattacttgactgtcattaaaggggatctttgcctctcttctgtaactaaacacagccccttttgtttcacctaactttgtttaactactaataatagataggtcacattaattcgagcttttgttgacagtgatatatgagattatggatttctctgtgaaaaacactttacttttggggcaaatgcagcatgttgttagcagatcacctgggaaggccagatacgcctccatgctttcgttcaatttggttcttgttttccctgattattttactcctagatatggccatggcctctttactattttttgtcggggtgaccgaaggaggtcatccaatgtaattaagatggaggaaacctctttactattacaatgtgctttgtttagctaataaagataggtaatattttacatcttcggtttacaatttgtttttacaaggttatgtatttttgtcaaaaaaagggggggaacttagcatttcgtgtggttgcattcttcctttttgtgacgggagaaaaatggtagtatctgttattcatgtatagctagacacacactccagttttcacatgcatatgtcatcagaaacaggtgcaaatgcaaagattccttccttgctactagttggcatgttcatccttgactacacactatacatctagatgttgcaatttcgtgcagtgcactacaagtaggagtacttcttttctccctttttcttgttattttatcttttattttattttctaaaaaaatcagaagtactagaattgtggaaccacaaacagagcactgtccttcctggctggtccagcaaacttgcccatctgacaatctgagtagtaggatccatgctccaaaatctctataggattgtccattccataggaatttgaaaggattggataggattcaatcctttgtttcaaagtgctttataggaaattttcctataggattgaaatcctccaaaattcctatgaatttcctttgaatcaaagttgattttagatatttccaatgtagttttattttcatcattagtttttaagtagctaagtttacgcgtaaaaaagttattttttaatcgttaataagtcattttgacttgtaatcaactcatgtccaactgatgggtccttcatgtcctgcaaagtgtgctgcagtatgaacttcagatgttcttctccttgtataagttcccatgaactgcatatgagcatatcagcagtctgaatattttttgagcaattggggcgagatccccaaatgctgggtgaggtgtagtcttgaccatcttttttttttcttctaaagatggatcaattcccatcagggcttggatttcattaataagcatgaaacttgctggtgatattttgttacatgatggcaattcaacagggcagtgacctacatgttgtacattggaatataagaacaacttgtcctgacatgtgtagattgcgcatctaatttcgctaatgtttgatcctttcagctgccatgaacatgcttcatcactcattcactccgatgtttaatattccctccagtattttatttcccatttttctaattctctgaagtcaaaggggtgccattttgattactactcactctgatcctatttactactctctccacgggaaagtattttctacacctagatattatgacaactaggtatatgcatatagtttaaatagctatataaaaattcataaaattgataagatactttatgataatataagatactatacaaacatacaggtttaaattcgatctatacataaaaaacaaaaacaacaaaattatttgcaatgtagaaggtatttcataatgtaaggcatggtcaaacttagtacggtctctaaaactaatctttgacttataatttctcgtatactataaagtttgtagcaacaaaattataaccatatgaaaatatattgaaataccaatttaatgttattattttcagcaaataaaatttaatttataatatactaatcattagtctttttttaaagttaaaccttaaaatgtgtacgtgttttacattatggaatggggcctaagtatttcgatataggggttgtaatttctttaaggatgattttttatttgcccatgtaaaatactctcttcatgtggatgtgtcacatccacccaaaatcctttatattatgggacgggagaagtgtacgtgaatcgttgttttcatgtaatgagtcaattagggatcgggtcaactttctagggtaaataaaatataatatttttttgtcccttcacatacagttgaatataatttaggccgagtttagttctgtcgaaactagatttcggcaataataaaaggaggtggctatcaagctagaaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaaacccgagatacagataagatattctatctacattaggtatcctgtacccagttcgaataccatcgccgtgtagatatgggatacccataatctccacagtagcccccgagtcctttgcagtcgaccatcgtagccctctcaaagatgataatccgagtacttcaaactcttcaagccaaaacctgccgagtggactgtaaagggcgaaaagataaagaatatggtgcatcgaatagatgcacctaattaggtgtaacccccaactatgtgattagttaacaaactaaacatatagttgaaagacaaaataataacacaattgtgcattatatgacaaaagcgtacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctaaagtactgttcaggcctaggcccattagcacctccgatacccttaactgaaaaatccgatatccaagcgacgcttcgtcttccccgccggaactctcgccattttccccactccctgctacagtgcaaagctgcgccgacgaactagggttcacaactccggccaaatccacctccgaaaagtgcatcaaaatccttcccgtgatccaccgcctcaatccctcacctctcccaagccatccctcgaatcaaatcagcacatttgagtgaaaccgatggcggaagagagagaaagcttcgaaggccaatgggcgtcatccgacgtaacggaggagaatcttaaggagatggtggcgcacggcgttctccctgccaaggagatcatcaggtggcgaccagcgcacggtgaggctttcccgtctccggatactcatgagattgtggtcttctcgcatttcttctacggcggctttgctcttccgacctcaaaatttttccgcgggatcttgaacttctatggaatcagcttgcatcacctaaacccgaattccatagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtactcttgtcttcctccagtgtaccaagatacttggaactctcttccaatcggagatgaagcagtacaagccttggagttgttggatcgtatgttaaatcttaaagaacaaggcttacagggagagcagatcactcggcacttcatcaaatgccgactggcgccaatcaaggaaagatcccgcacagcattcgagttcgacggcaaacatgatcccaaccgtgaagaaccagattccctggatttcaaaatcatgaaggagaggatgtataaaatcttctcaaatgcaattgtagtcagctactctcatcaactgccagttgtgccatataatgcattcaatccgcctccacaggtatgcatcggaaaccctcaaaccgtgatcagaacataattttatcttcatgcttagttgactaactatggaagcatcttgttcaggaatatgcattgatgaagtcagatctaccagtcactcagcaccggtctcctcgccaacacaccgctcagggaggtggagggccaacgatcagaccagatccgcaacctcagacctccaaattgactggtcaaacaggtcctcgcaagagaaagctagtacttgatgatgatgaaggcgacgatgataaatctggggataagggctcgcctaataaacccccaaaacgtaccatgcccaggaaaaaactagctggccgtgcaatgccaaagatcagaacatcttccaggtattagatctctcggtatgatttccgcttcggcatgttttccgatgaaaataatgctaaatactgaaagaacactctgcaggaaaccatctgatatagatccatctggaaaagaccccgatcctgccatgacagagcaaaatatatccaaggaccccgagccgactgctgaaaaccagccgactgctgaaagccagccgactggcgcccatgcttcgggcgatagggccaatccgagtgacctgccgccgactggaaaccagtcggcaacaactgaaacggcaacaactcaagagcccccgactggaaaccagtcggacgcaggccctgatcaagagatccccgaagtagaagcgcagacgacgacttcgcaaggaccagaggctggtaacgactcgatagctgggtcttcaggtaaagaacaaagatcacctcacgctcagctaggtacatcttcaggttagttgtcttctcaaacaatggcgatttaaataacctcagtatatccgtctaatgtcttggaaacgcatcaggaccatcaggtgatgacggagaagaaatccctcgcataaaggcgaccgacgactctcgtcctcctatcttgatcaaatggtgggacgagaactcacaagccgccggcatagtcataaaccgtcaaaaagaagatgaagaagtgtgccagctgaagaaagcgctcggagaagccactcgtattgtaaatgtaagtcttccgagtgacggccttcggtaactttgttttctttttagcagaactgaaccatgatccatcatgcagagaatccatcttcgcaatgaggccaagactacaactttggaaaagctggttcctcatttgggaactctagaagcagttagggaccagctgcatgaggccaaggagtgcgccaaaaagacagagaaagagttaagggaccgaatcgcccagctccaggatgcaaacttcgaactaagtggttcatcaaaaggtaatcacccagatctgttccattgatttatgctgtcataattgcatcctcaaccatctggatttcaaacagcgcaagccgccaggatggaacagatggcgaagcaaattgaagccctggagagagacaagacaggactggctgcgcaaagggactcagccttgaaggaagtcgaaggtaacgccggctaacaatctgagcttctctccttataatgcaacagatgctcatcataaatgtgttttgcagatcgcaagatcaaatctcaagctcagttcgacgtcctggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtatccgagaattgaagtcgacaccattgatggatttgcagacgggacaagtgaagaagctgcccttgatctcatcagcagtgcgcaaaatgcggctgacaaaattgtgagtgatgttgtagagcaatttcgcaacaacgacctccagccgagtaatgaagactctgatgatgaaaggactgattctgactgagtttgagtgtaatacatggaggctcaatttgtacaatactggtgtatttatgctgtgcttgatgattcttgcgaagtttttgatttcttaaaagtttttgctaaactttcttgagcctaaaacccaaagaagctattaaaaactttcagtcctcgcaaactaagtagaaaaaccaaacaaggcaatgataaaccaagtaagcaaactgaattgataaaaaatcacactccattattatgatgatagcccccgactgacaacttcaaggagaaaacttgatgtttgacagtcaaaatagggaaatacaatgataaagttaagcgtagaaacgacgaatatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcggtgcaagtcgtccactcggtcttcttcatagcgttcttcacggaaattacggaagcgcaaagattcgaactcgacttcactcggcaacattgcttctctgccccgtagtcagggaaaaaggtcactggcctgtggcccgactgggcgtagtacgcaaagaccaaagtactgatggtaactgtgacacccatttgccggcataaggtttaagccggtcaaaaactcgagctttaatcctttgaagtatcatgccgttggccctctccacctgtccattgctcatggggtgtgccactgaggcgtagcaaatcttaattccaaagtcctcacaaaagtctttaaaaactccgccagtgaattgtgtgccattatcagtgattatccgattgggcactccaaatctatgcacaatgttgatgaagaagtcgcgagcattatctgctgtgattgtgacaaccggtttagcttcaatccacttggagaatttatcaatggccataaagagatgcgtgtaaccgccaactgcctttttaaacgggccgaccatgtcaagcccccaaaccgcaaacggccaagacagcgggatagtctgcaactcttgagctggtagatgaatttgtctggcgaaaaattggcaaccttcacatgtgcgcacaattttgtcggcgtcggacactgcagtaggccagaaaaaaccctgccggtaagctttgccaacaatggtgcgcgctgcagcatggtttccgcatatcccagaatgtatgtccttcagcaattgtctcccttcctctaaagatacgcagcgttgcagaattcctgaagggcttttcttgtataactcggcttcatgcataacataaagtttgctccgccttgaaatccgctcggcctcatctttgtattgagggagttcttgagaagtcaaaaatcgtatgaggggctctcgccagtcggcttcaaccatagctatgtcatgagtgtccgcaacttgagtagcatctttgtgaggtactgtcggcgaataaaggtgttcgacgaaaacatcagatggcgctgcctcgcgcttggatccaaagttggcaagtctgtcggcagcttcattgttgtgtcgaagaacatggctgagctcaagtccatcgaacttatcctccagtttgcgtacctcttgtcgatatgccatcatgttgtcgtcaatgcaggaccactctttcataacttggttgacaaccagctgtgaatcacctcgaacaattagacgctttatccctagggaaattgcaatccgtagcccatgaaggagcgcctcatactcggcgacgttgtgagacgccgaaaaatgtatccaaagtacataacttagtctttctccggtcggggaaattaaaaccactccagctccagtgcccgaaagtctttttgacccgtcaaaatgcatggtccagtgctctattttctccacgggggtatcctcttggcactcggtccactcggcgacaaaatcagctaacgcttgagacttgattgaagtgcggggcttgaatgatatgtccaaagacatcaactccaaagcccacttagcaatccgcccatttgcttcgcggttgtgcagtacatcgccgagtggaaatgatgtgaccaccgttaccgagtgaccttgaaagtaatgagacagcttcctggtagtaattagaataccatataacagcttctgaacctgagggtacctcgttttggagtcagccaggacctcgctgacgaagtagattggtcgctgaactttctggacatggccttcttcctcacgctcgacaaccaagactgtgctcacgacctgggaggtggctgatacatacagcaacaacggctcctgcgggtgtggtgaagctaagaccggtggcttggtgaggagttgtttgaaatcttcgaaggccttctgtgcttcgggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccataaaaccaagcagcttccctgacggtactccgaaggtgcacttttcaggatttaacttcatcctgaaggcgcggatgctcgcgaaggtttcttctagatccaagatcagatcatccttttgcttggtcttgacgactacgtcatccacataggcttcaacgttgcggccgatctgtgttgaaaagcatctctggatcatgcgttgataggttgctcccgcgttctttaatc

SEQ ID NO: 45788 - DNA, 1622 bp, Oryza sativa
tttgccagccagtcgggatgaaggacttctttgatgaagcctgctgctaacagcttggtcaattcctccttgatcgcgtccttcctgtcttgtgcaaatcggcggagtcgttgtttgataggtttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtttcggcttcggtttccccactttttgaaatcttggcagcgggcacttctccttcgctcaccgtggttgcagccagtcggatttcctctcgggcagacgccatctcgcgggtttgggccatgtcgcaactttccttgtcgcatgtgacagcttgcttgatgtcgctccgtagggttaggactcctcggggaccaggcatcttcatcatcatgtacgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccggaagagtgatctggccgagtggagttgcggataatcctggaattactccatgaaaaggcgcattgcttgattttaactcggagcgagggatctgcatatcatccaaagtcttggcgaagaggatattgagtgcactgccgccatcaatgagggttctgcgaagcttgacgttacggaccactgggtctagtaccagggggtaccgccccgggtggaccactcggtcaggatgatccgagcggtcaaacctgattgcgatctctgaccatcgaagatattggggcgtgtcgggctgaacagcattgatctcccgttcggtcagcttttgcttccttttagactcataagccatggggccgccgaaaatgtggttgagctccttgcggtggtcttgaaatccagccggggtgtcgccgtcgtccttcttccttgacgtgctttgtttctcgtcggagttcttccgagtagacttggtgtactgctccgcgaactgcttgtagatgaagcattctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttgcgttgttcagaaaatcgtcggatatactctcgaagggattctccggatttctggataacgttgtaaag

SEQ ID NO: 45789 - DNA, 1972 bp, Oryza sativa
cctgctgctcccgccgtagccgctcttgctcttgtgcttggcgctcctgctccagtcggcggcgctcgatctcgcaacgtgtttcggcttcccgggcttggcgctgctcctccgtttcattgtcggccataaagacgccgaagaaaagaggagtgcagttgtcttctaggcttccgtcgaagtcgtcaagatccgcgtcgtcgtagtagcgagaaccaaactcatcgtattccacgatttcggtgggacgtgagtcgacggtgggagagctgtagtagccatccagttggtccgtcgaaaccgtgccgagtggttggaggatgacgccgacttccctgaagctaggcgaaatcggtgttaagaccgacttccgcccaggcctacgggatggagacggcgtggcggtggagacggctgccgaatcgtcagggagctgcatcaagatcgatgggtaaggctcatcatcttgatctggcgttgttggagtagatgcgatctcggccgagtggtttgaagccgactcgatcgagatggtcttgaagtaactttctgccgcgtttgggaatccaaacgggactggaagtcgattatctcccgactggtctgattccgagtcaaggagagaaatcttgccgaagttgttggtgacgaagtcgaggctgccgaaccgaaacgtctgcccgggtggaaagacgaagtcgtcgatgccggtgacggaacccatcgcactgatcggcgaaaagcttgacgctacccctacctggcgcgccaactgtcgaaactagatttcggcaataataaaagggggtggctatcaagctagaaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaaacccgagatacagataagatattctatctacattaggtatcctgtacccagttcgaataccatcgccgtgtagatatgggatacccataatctccacaagttccaatctttttcttcaaactttcaactttttaatcacatcaaaacttttctatacacacaaacttctaacttttccgttacatcgttccaatttcaactaaacttccaattttagcgtgaactaaacacacccttagagaagtgtaaaagtgcaatgctttgttcgtaacaaatctacccctgccaccgccatgtataaaaaaaaaggagaaaaagatcatgcatatgatgcattgaacctacagaaagctagcaatctactccctccatctgaaaaaaagacaacctcctagtacaatgtctacatttgttctactaggaagggtcacatcccattttaagttatctttttttttggacggatggagtagacgcctcatgtgatggatctttgatcgacagaaacctgacattttcatatctgaaactgtagtcgacattctagcagagaccaaatctcctctccttaaaggcataatccttatgcatgatcactgcaccccaagtgatgctaccacagcacgcgcgcctccactgcacactccaccactccccaaattcacccccaatccatgcattttgcacatttgcattcttcctactcgatcgatcgcccatagtgcccttgccaccacgccttaacactgcattatttccaaattttatcttaattttatcacgcgcgccaccatcctcgaaagcaattaaaaaaacagagataaattttacagtcttgagaggtatgaaaatttt

SEQ ID NO: 45790 - DNA, 3900 bp, Oryza sativa
catgctcatgcttggtcgccggcgccgtgaacgtctggtaggtcacggtgccggcgccggggaagacctcggcggcgcggcaatggcacgccaggccaagcggctccagggcttcggccaccggcgtgcagagcgacgacgcggcgctggaggtgtgggagatggagaccgagacggtggccgggcggaacgcggcgacggcgcggcggatggcggcgagcgcggcggcggcgtcgtcggtggcgcactcgaagctggcgtagcagtggccgtcctccggcgtgacgtgcacggtggcgtagcgcgcgccgtcgagcgcgttcatggagtagccgcacggcgcgaacgcgtaggcgcacaccagggagcgcgggtcattctcgtccaccacgccgccgatccccgacgccgccgtcatctcgtcgccgatggcgtggctggtccggccgtcgccggggcgctggtagaaccgcgcggccatgccgcggtccagctccgtcatgcacacctccgccgtgagccgcgccgcgccatccgcgtcggatgacgacgccgacgacgacgccgagtagacgtgccacctgtgcgaggcgccgggcgacgacgacgacgacgacggcatcacggcggagcggcggaagcggaggagctcacgggggagggcggcgtcgaggtacgccacctcgtcggcaaagtgggcgtgcgggaacggctgcgcctccgggaacaggtactcgccgcgggagtacctgcacgaccggagccggagccggagcgcggcggcggcgcggagcagcacgggcacggcgcggagcagcggcgtggtgccgcacgtcttgagcaccacccgccccgggtacacgaacatgctcgactcggacagcacgtacgcgtccgccgccgcgttccccgctgccgacaccacggcgcactgcgccgcgtcgagcacctcccgcagcgcctccgccggcagcaaccggagcccatgccgcgccacctcgccgccgctcgccgggagctcgaacaccagctccagccgcttctcgaagccctcaaacccgcaagaagccattgataacgatggtgcgccttcgtgatcgatcgagagcgtgaggagcaacgcggttcaatttatagacgatgcagatcaagctggtgccaagaagtggcgggaggttgatgacgatcgatcgatccgaggaagaagaagaagaagaaatgtaagtggtgatggtggtgatcgatcgagttgagttgagaggcggcatgcgcgcatgcatgaggatgagggggaggcaatggtaatgattgtgagcattatggggaggggagaggaggatcttggtgattaatgaacaacgttaatggtggaagtggtggcagtggggatttcgaatgagatttttctttttaacgattagcactagacaacacgactatgagaaatacccaagggtcatctggctagctctacaaggtggtaggccagatgatctgggttcaaagcctcgccccttttaattatttgatattagtctttttctaatattcatgtcttttactagacagtacgattattcatcgaatagaatatgaaaaaattacaagattaattagagacctagaagacaatagctaggaaagaagaaaaaaaatccaccaccacgcaccgacgtcatctacacacagccaaggagaaggtttagcaccggaccagtcggcgctaagcgtgaccgactgccgctaaaccaacaagggtatgggaatgaccgctaagattgcccaagtccaagctataacagccgagcatcaaacacaactctagccacatctataaaattgaggggaagaggatgagagagaagaattgaaccgctctctacgctaggccctctaacgtggccaatttgtttaaactagggcgccaccacaagaggatgagacatctaaagtgagcttgcaccagttatctatgataagatttgtcaagggggctttctagatgacgtctccagggacaggagcgacaatgacactgccgccaccatccgtcgaggtcttaaggagaactaagacaagattttcactcgataaccctacaagaggagaggggatggctcgacaacaccccgaagaagtaagatggcgcctgaagcgccagccaagaccgggctgggtttacacccgccgtcccgccacctgccgatcgaaagctgtgctccattgctacaaccaccatccatcctccgtcgcgcgtgggcaccgttgcaccgccggcccccgccggccaacctccatgcggcctcccactctttgcaccggacagttgtcaggccatcaccgtcgccgaccgccggcctttgccgctccgtcacccacgcctgccacaagccgtcggcctacgtcgcccgtgcccgtcgcaagccgctggcctctgtcgctgtctcctccggtctctagattcggcagcggctgtgccggatctaggcgcgggggagcgggggtggatgtggaggtgggggaggaaggggggcagatctggcagcggtggtgccggggacactatctcgagccgcgccgccgccatcctggcatgccgcgcggtttcaggcagcggcgaggtgggggagaaagatggagggtggcggcggtgtcgggaaactagggtttcgccccccgtgttgtccgcgcatgcacgatgcccgggggtggggtggactgccttcaattgaaaaactctagtgggaatgagatcaaattcaacttatacaagttaaaaaatttagctgtgaacatacatacacattaactagttatggtttaatttcttgtttttgctacagtttgtatgtataagttgaattttaatatgcatttttgtaaagtgatatatcacgcattagtctatcttattattattattttatatgaagacatttgaaacaaagtattgaattctatgttatcttttgcaattcctttggaatggaaaatcctatagacattttggaggaaatttagtaaggaatccaacctattggaaattttcctctgagtctatctctcttatccgattcctgcatttttcctgcggtccaatcaaagctattccgtgtttttcctatattttacaatcctctattttacacttacatttatattagaatcgtttgtttttcatgttcctgtattttttgcattcctatgatttaaagggatcctaagtaattttagtcctcgtatatagtagcgacaaaataaaaacactaaatttttatgtctttcctagttagactggataaacttgtatagtcggtcaaggattatccataggttgaccggtccgtgcggtgcctatatccttgataaagcagctttatatataggatcaaattgtgatgctcgaagacgacaaaatgaagttgacagtgaacctcgcaataatattaagaaatgacctgcgcatattatgcagacatgcagtccccttcctctctgcgtgatcatgaatcggcgcacggtttaagttaataacaacgaagcaaacaaaacaagattaatttgcaaccccattggattatgatacaattcaatgtactccttttggcctgcatgcaatgagtgggccgacacttggagtagtgtgcatatgctgccaacaccaacaattgaaatcttcctcgatcgttgcgggtcctgtttgacttatttttatatccaagattttgtgtactcaaatacgttctttgttttatactccattcgtttcacaatgtaattctttctagcattgcccacattcttttagatatagattcattaacatctatatgtatgtgggcaatgctagaaagtcttacattgtgaaacggataaaatagtataattcggtttcacttt

SEQ ID NO: 45791 - DNA, 10227 bp, Oryza sativa
tatgaaatagagatacatagtgcatgaatttgaatttgtgattaagttgataatgtctggataaattatttcagacaaaatataaaattttaaaacactataatttaacatataaaattcaaaatcagtgtggatatagctgagccaaacatgaccttaattaacaacttccaatggatcaactcgttagctaagctagtgctatgcacagcacttttgggttaattcgtgatcgccatggccaacctgcaggctaaactagctaatgatcgagcgagagcatgcatgcacggaagtatgatggaacccgccgacttgcaaataattaaacacactcatgtttgactagagaattgtcgtgctctgttttgtttgaatccagcttaattacgtgcaggaacttgaattttttcccccgaaatttaaggcggatatagccgtctaaatatcgtatattactagcgtgtgtgaattatgtaatttgcatttctgttccggtgtatgaaaagggaatggctaaatttaagataatttcagtcaccttcaatctagtattggtattgggaagggaggagaggtgaaactccccactaatagtaatgacgccaaaactccgacgacatttagatttgggaaggtgactccctggcaggggcggatctatagtaccatggccagtgtcaggcgacaccgacaactttcggcagaacctatagtaaaactgtttatccatatgttataacaccgatagatacgtcatgacaccaacaaattgattttttgaatctgccactgctccctggcagtggtagtatagctagcaataagaaggttctcttttccgaagatggtaataacgtcaaaactccggcagaaaaatctgagattaggttttatggtaagagtccaaatgggagcggaggcaagggaattgagccggtttcctcaagcttaaagggatggccttatgcaatgggcccagggtagaggaggatacggagatatcaccacctgggtgtgtttggacctctaggttcccaacccaaatctctcgtttttcgcgcccacgtttttcaaactgctaaacggtacgtttttttgcaaaaagtttctatacgaaagttgctaaaaaaatcaaattaatccatttttgaaaaaagaaattagctaatacttaattaatcacgtgctaatagatcgctccgttttccgtgcggaggcactatgttcccatcatccactcgcgaacaccagaggtgacggcaacatatcgactacatgcgtgagcacggagaagaggtgactctgaaaaacttagacagacagtcccttaataaaattcatggtccgttccccattaatctctatagctagctgtaaattatctgcaggaagcaatattgtgtcggtggcatgtggcagcgtgactgtcatatgtaaatcatcctcgtacatcgcacaggcgcaacagacgttggtagagggattctaatcattcgagtaggtgctaaaaagagtatccaaaaaggaaaaaaggcaagcaagtagagacaacatatagctagcccggtacaacatgatcatgcaatgtctggtaccctaagactgtactgttgtcattaaccaacttaatttgcatctctacaatgtagatacaatgctcatcgatcgatcggaagggtccaaagattttgtcagcagatctggagcagcagcttgagtggaagtgtctatctctgatttgctgtaattagagaaacaggtgcaaagaccggtcgacatgccttgcagcgcagatcgatgattgtatgcaatcctcatgtcgggaacacatacgaacaggccggcaggccctagctagcaaaatcatgggtttttacactagatcatgtgtgcttcaccctgtactgttctaaaataattcagctttttatatcaatctaaacacaatctatattgaaattcgatcatcgtatcaaatgaaaagtaatatttagtttagattgtaaagacatattggtagccatagctctcccatgatatattgtggagattatggatatcccatatctacatggcgatactatttgggctggatataggataccgaatatgtatagaatatcttatttgtatctcgggtttgtttcttaacttgtacaacaaggaaacaccttgagacttagtcggtcacggctatatttaatctatatctgtgtattccgttagggatattgattatcttttgtaacccggactccttcccatatataaggggggtccgggcgcctctaggggcagatgttgattttctctaaatcatacaatcaataatacactcggcggattcatccccggacaggagtagggtattacttcttttataagaaggcctgaacctgtataaatcttttgtctccaaacccatacacttttccagcttgatagccacccccttttattattgccgaaatctagtttcgacagttggcgcgccaggtaggggtagcgtcaagcttttcgccgatcagtgcaatgggttccgtctccggcatcgacgacctcgtcttcccacccgggcagacgtttcggttcggcagcctcgacttcatcaccaacaacttcggcaagatctctctcctagactcggagtcaaaccagtcgggagagaaccggatttcggtcccgttcgaattcccgaacgcggctgaaagctacttcaagaccatctcaaccgagtcggcttcaaaccactcggccgagatcgcatcttctccaacgacaccagatcaagatgatggggcttacccaccagtcctgatgaagctccccgacgatttagcggccgtctccaccacgacagcgtcttcatcccgtaggcctaggcggaagtcggccttaacaccgatttcgcctagcttcagggaagtcggcgtcatcctccaaccactcggcacggtttcgacggatcagctagatgactacaacagctctcccaccgtcgactcacgtcctactgacatcgtggagtacgacgaatttagttctcgctacaacgacttcaacgacttcgacgacttcgacggaagcctagatgacaactatacccctctctactttggcgttttcatggccaataatgagacggaggagcaacgccaagcccgggagaccgaagaacgtcgccgactggaggaggagcatcaggcacaagaacaagaacggctacggcgtgagcagcaggaccgtgagcggaccgcgaaggaggctgaggatcgacgtcagcgagctttggaagcagggcgccgagcgcgtgatctcatcggccaacaagatgtcgaagggacaccggttttccgcacccctcaacagaatgcggtcgccgcgatcacccttctcgacaccctactcaaccaaaacgagctcaatcgatccgaccacgtcgtcaacatcttgaaccagacgaagaccatgattgcggcctcggtcccagttaactccgaaagcgtccacacgccgactggcagccgagttccccacttccgatctcacgactaccgtcatccaagcctcagcatcaccggcgcgggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccggatcgccgcgatgacgaccttgacggagttgcagccttcaccgacgacctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaactatttaccagtggctttagcggattccgcccgatcttggctccatggattgccccgtggtacaattggatcttgggccgaactacgcgaccacttcatcgccaacttccaaggcaccttcgagcgtcccggcacacaatatgatctttacaacgtcattcagaagtccggagaatcccttcgagattacatccggcgattttctgaacaacgtaacaagatctccgacatcaccgacgacgtcatcatcgccgcattcaccaaagggattcgccacgaagaattggtcggcaagttcgggcgcaagcctcccaggacagtcaagctcatgtttgaaaaagccaacgagtacgccaaagctgaagacgctgtcaccgcatcaaagcagtcgggtccgagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcatctacaagcaattcgcggatcaatacaccaagactgcacggaagaattctgacgaagaacaaagcacgtcaaggaagaaggacgacggtgacaccccggcaggttttcaagatcaccgcaaggagctcaaccatatctttggcggccccctggcttatgagtctaaacggaagcagaagttgactgaacgggagatcaatgctgttcagcccgacacgccccagtatcttcgatggtcagagattgcaatcaagtttgaccgctcggatcatcctgaccgagtggtccacccggggcggtaccccctggtactagacccagtggtccgtaatgtcaagcttcgcagaaccctcattgatggtggcagtgcactcaatatcctcttcgccaagaccttggatgatatgcagattcctcgctccgagctaaaaccaagcaatgcgccttttcacggagtaattccaggattatccgcaactccactcggccagatcaccctcccagtcacttttggcactcgggaaaatttccgcacagagaacatcagctttgaagtcgccaatttcgagacagcataccatgccatactcggacgcccggcgttagccaagttcatggccgtcccgcactacacttacatgatgatgaagatgtctggtccccgtggagtcctatccctacggagcgacatcaagcaagccgtcacatgcgacaaggagagttgcgacatggcccaaactcgcgagatggcgtctgcccgagaggatatccgactggctgcagccacggcgagcgaaggagaaatacctgccaccaagacttcaaaaagtggagaaagcgaagccaagactaaaaagattcccctagatccctctgatcctactaaaaccgctgtaataggcgccgagttagattgtaaataggaaagcgcgctcatcacctttcttcagaataataaagatatctttgcgtggaaaccttcggatgtgcccggtatccctagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgtcgattataccgacctcaacaagtcttgtcccaaagatccctttgggttgcctcgcattgaccaggtagtcgactcgaccgccggctgtgagcttctcagttttttggattgctactcggggtatcatcagatccgactgaaggaatccgactgcttgaagacttcattcatcacgccctttggggcatactgctacgtcaccatgccgttcggattaaaaaacgcaggagcaacttatcaacgcatgatccagagatgcttctcaacgcagatcggtcgcaacgttgaagcctatgtggatgatgtagtcgtcaagaccaagcaaaaggatgatttgatctcggatctagaagaaacctttgcgagcatccgtgctttcaggatgaaattgaaccctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactaaagaaaacagacgacttccagtggggacccgaagcacagaaggccttcgaagatttcaaaaaactcctcaccgagccaccagtcttagcctcaccacacccgcaggagccgttgttgctgtatgtatcagccacctcccaggttgtgagcactgtcttggtcgttgagcgcgaggaagaaggccatgtccagaaagtccagcgaccgatttattttgtcagcgaggtcctagccgactccaaaacgaggtaccctcaggttcagaagctgttatatggtattctaattactaccaggaagctatctcactactttcaaggtcactcggtaacggtggttacatcatttccactcggtgatatactgcacaaccgcaaagcaaacggacgtattgctaagtgggctttggagttgatgtctttggacatatcattcaagccccgaatttcaatcaagtcccaagcgttagctgattttgtcgccgaatggaccgagtgccaggaggatacccccgcggagaacatggagcactggaccatgcattttgacggatccaaacgactttcgggcactggagccggagtggttttgatttccccaactggagaaagattgagctatgtgctttggatacatttttcggcgtcccacaacgtcgccgagtatgaagccctccttcatgggctacggattgcaatttccctagggataaagcgtttaatagttcgaggcgattcacagctggttgttaaccaagttatgaaagagtggtcttgccttgacgacaacatgatggcatatcgacaagaggtacgcaaattggaagacaaatttgatggactcgagctcagtcacgttcttcgacacaacaatgaagccgccgacagacttgccaattttggatccaagcgtgaggcggcgccctcagatgttttcgtcgaacacctttatacaccgaccgtacctcataaagatactactcaagatgcggacactcatgacgtagctatggttgaagccgactggcgagagcccctcatacgatttttaacttctcaagaactcccccaagacaaagatgaagccgagcggatttcaaggcggagcaaactttatgttttgcatgaagccgagttatacaagaaaagcccttcaggaattctgcaacgctgcgtatctttagaggaagggagacaattgctaaaagacatacattctgggatatgcggaaaccatgctgctgcacgcaccattgtcggcaaagcttaccggcagggttttttctggcctactgcagtgtccgacgccgacaaaattgtgcgcacgtgcgaaggttgccaatttttcgccagacaaattcatctaccagctcaagagttgcaaacaatcccgctgtcttggccgtttgcggtttgggggctcgacatggttggcccgtttaaaaaggcagtcggcggttacacgcatctctttgtggccattgataaattctccaagtggatcgaagctaaaccggttgtcacaatcacagcggacaatgctcgagacttcttcatcagcattgtgcatagatttggagtgcccaatcggatcatcaccgataatggcacacaattcactggcggagtttttaaagacttttgtgaagactttggaattaagatttgctacgcttcagtggcacaccccatgagcaatggacaggtggagcgagccaatggcatgatacttcaagggattaaagcgcgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagaacgctacgaagaagaccgagtggatgacttgcaccgattggaagaggtccgcgaagcagctttgattcagtcagctcggtacttacaagggttgcgacgttatcataatcgcaatgttcgatctcgtgcctttctagtcggcgacctggttttacggaaaattcaaaccacacgagatcggcacaagttatctcctctatgggaagggccatttattatctctgaagttacccggccaggttcttatcgactcaagcgcgaagacggtactcttgtcgacaactcttggaacattgaacatcttcggcgtttctacgcttaagtttatcattgtacttccctatcttgactgtcaacatcaagttttcttcttgccgttgtcagtcgggggctattatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtatagtacaaattatgcctccatttgttacaatcatgctcagtcagaatcagtcctttcatcatcagagttattgttactcggctgaaggtcattgttgcggaattgatctaccacatcgcttgcaatcttgtcagccgcattttgagcattgttgataagatcaagagcagcttcttcgcttgtcccatctgcaaatccatcaatggtgtcgatttcaattcttgggtacaaggatttggtcatcgctaatgccatgctagctcccatgcttccagctttcttgatgttcttgaagtatacatccggtgcaactcttaacttgtcaaagatttcggttgcgtcaagtgcactcggaccactgttattaaggaacatagcttggacgagtggtgtagcgacattggcgacttcgtctcttgctccttcaagcttcttgatcttaccaaccaggacatcaaactgagcttgcgatttgattttacggtctacaaaatacatttataataagaatctgctgcattaaagagaggacagttcaaattgtcagttggcagtaccttcaacctccttcaaggctgagtccctttccgcagccagttctaccttgtctcttttcaaggcttcaatctgtttctccatctgggccattctggtggcttgcgctgtttgaaatccaaatgtttgaggatccagctatgacagtataaatgggacagatctagagattaccttttgatgaaccactcagctcgaagttggagtcctggagctgtgcaattcgttcccttaattccttctccgttttcttggcatactccttggcctcgtgtagctgttccctaacggcttcaagagttcccaaatgtggaaccagcttttctaaggttgcagtcttggcctcattacgaagatggattctctgcacggtggttcatggattagttttgctaacaagaaaacaaagttattaaaggcagtcacccggaagatttacattcacaatgcgagtggcttctccaagtgctttcttcagctggcacacttcctcatcttctttttggcgatttataacaatgccggaaacttgagagttctcgtcccaccatttgagtaagatagggggacgggagtcatcagccgcctttatgcgaggaattgtttcttcgtcatcgcctagtgttcctgatgtatttccaagacattagacgagtaagctggagttattcagaacgatatcacttgagaagatgagttacctgaggatgtgcctggctgagcgcgagatgatccttgttctttatctggagagccaa

SEQ ID NO: 45792 - DNA, 11336 bp, Oryza sativa
agaagcatatcaaagggagttggtgccgagaggtttatacctggacgacgttctaatctttggcgtttgacggccagccagttttttcctgggcatggtatgcttcgggagtttgttgggcgtgcccttgtccccagatttgttgctgtcgtcgccctcgtcgtcatcaagcaccagctttctcttgcgaggacctgtctgcccagccggtttggaggtttgaggttgtgggtctgacctgattgtcggccctccacttccctgaatggtgtgctggcgaggagatcgtcgctgagcaattgggggatcggatttcatcaatacatattcctgaataagatgcctccatggttagttaattcaacatgaagacaagatactattttggtcataagttgaagatttcagatacatacctgcggaggcggattgaatgcattatatggcacaactggcagctggtgtgagtagctaacgacaatggcatttgagaagattttatacattctctccttcatgattttgaaatccagagagtcaggttcttcacggttaggatcatgcttgccgtcgaactcaaaagctgtacgggatctttctttaattggcgccagtcggcatttgatgaaatgccgagtaatctgctctccttgcaaaccttgttctttgagttttaacatgcggtccatcaactccaaggcttggactgcttcatctccgattggaagggagttccaggtatcttggtacaccggaggaagacaagagtacccgggaagagcaggctcaggattctgaacgtagaaccagtttgcatgccaccctttgtttgaagtcttgaagggcatagagaaatatttttggctcagagttccccttagctggaatcctgcccccccgactacgcacggtttgctcttgttcggttggggtttgaggaagaagatccggcgaaacagggcaaagtgaggcttgattcccaaaaaggcttcacaaacatggacgaaattggcgatatgcactatggaatttgggtttaggtgatgcaagctgattccatagaagttcaagatcccgcggaaaaatttcgaggtcggaagagcgaagccgccatagaagaaatgcgagaagactacgatctcatgtgtatcaggggtcggaaaagcctcaccgcacgctggccgccacccgatgatctccttggctgggagaacgccgtgcgccaccatctccttcaagttctcttccgttacgtcggatggcgcccattggccttcaaagctttctttctcctccgccatcgattttacccgaatgcgctgatttgatttgatggatggcttgggagaggtgaggaattgaggcggtggatcacgggaaggatttttaatcacttttcgaaggtggatttggacggattgatgaaccctagttcgccggcgcagctatttactgtagcaaggagtggggaaaatggcgagcgttccggcggggaagacgaagcgtcgcttggatctcggattttttgttaagggtatcggaggtgcaagtgggcctaggcctgaacagtacctcagcccaatacttttaacagcgtggcccattgtgttccttagggacttaggcatattttgctttggcaatatttatgcacacaatagtgttgcccaatgctgacaaaatcctttttatgcggtcatataattctttggagttattgcaatgcaaattaaaaggtgccctgcagaaaagcgttatgctgtttttgtaagcttttttaggctacaaaagctgtttgggttaacttggaatgacttgtttttatcatagtcatttccttggtatgttatatacctatttttattgtggtaacttgacatagcctaggctattagtctttttgttaccataatttttataatatttggtgggtaatctttatagttttatattcggatgcctgtccagtgtgttcattcgtgaaccttttcgagtgtaaaccactcggattctttttattatggctaaaaagcagtcggctagaatgcctctttaggcgccgcgtatgcttttgccatctaatgcatgattgtgttattatattgttctcaactatatgtttagtttgttaactaatcacatagttgggggctacacctaattaggtgcatctattcgatgcaccatattctttatcttttcgccctttacagtcttcgtcttcgctactcggtgggccttggcatgaataatctgaagcactcggattgctatctttgagaaggctacgatggttgactgcaaaggtctcgggggctactgtggagattatggatatcccatatctacatggcgatactatttgggctggatataggataccgaatatgtatagaatatcttatttgtatctcgggtttgtttcttaacttgtacaacaaggaaacaccttgagacttagtcggtcacggctatatttaatctatatctgtgtattccgttagggatattgattatcttttgtaacccggactccttcccatatataaggggggtccgggcgcctctaggggcagatgttgattttctctaaatcatacaatcaataatacactcggcggattcatccccggacaggagtagggtattacttcttttataagaaggcctgaacctgtataaatcttttgtctccaaacccatacacttttccagcttgatagccacccccttttattattgccgaaatctagtttcgacatatatggagtataacaaattctcacctattacctcttatcttaaccaatcataactatctcattttatttcttcatctacattttcatccgggacatctacatttttatcacaattaatcacaaccatttcttgtttaattcttgagacagaggggaactctaccatttttaagcagtgctgctataattatgtcgacacatttttttagtaaccacagtcgattttctgatcaattgatctccgttgagattggtgctacgattgaaataccaatgcactgacgtctttgcgtattgcagcgtgaagccaaacaattaaatttaattcctcatctcatcggcatgtattttcatgaaaaaaaacatattgtagggacttacatacatgctaactatttttttttcgtgaaaaaatatggtggtataaatatcggtaatccctttttaagttttttttggacgaacctccacctccccgctaatagtccgcacgtgggtccaccacaactccacaagcctgttatggcccacccaaaacaggcagcacgtccattaagccaccgtttcggcccaacaatacatgggccgcacatcgcttcaattccgttccgggccaaaccacaaacgggccacacatctgtttatttttttcccactaatttattaagatcaacttcgattcccaactacaagagatcaaaccggtcgaaatgatgaattagagctttctcgccggcgcccagccgtgccgccgccgtcgtcggcgccgtcgagctcccgcgcaggaaccccaggaggagcttgctgctggcctccacgtcggaattatagcaccttgatcgtttgacactgcatcccccatcttcttctttgtcgatctgtcgctcgatcttggcaagaaatccaagactacaactctacaagcaaattgagacttgctgtccatttacaggacaagagagctactcagtatatatctagccacagccatgcctccctaaccttccatgtccatgcagcagtccattagctaatgtttaattatattttaggttgatttattttgagacgttgagtggcagataaggcaggcaggcaggcatgcgtgtgcaaccgtttgcagcggcctttgtttcctattgagctttgcagaaaatgaaccggtttgtctattgctaacagatatatgcatggaaatttttgtggagcgattagatggagaagatgacgctaattaaaggggaaaattaacccgtgcgttcttgcggttgtgcgtcatgtgactgtctcgatctcggcgtcacatatcaaccaacaaaggcagtttgttcttgattctcatttctgaagacatgcgtcactgttccagactatctcgggctcatcttgattgtaacctcgatataatttggatgaaatggtttacttcaatttgcccccaacagcaagtatataagtttcaagaaagaagtctcgtctgaattctgaaaacggggacagtaacatcccatggaaattaaaagctattcatgaaatatgcatgcgagtttctaccttactaaaccaaaaggtaacaactttttacgattcttcgaaagttcaggttaattatgagttggaagttagaacaagaaaatagtcctagtttaaattctgaattacgatccttcaatagcttaatcctttcatcttgtcttatcctagcttaagctctgaattggggaagaacctgttatccgaacaaggtcttcaaaaaatgggaccaatctagaaaggattaaattgattttgaattaaggagggggtgaggccgtgaggctagctcgaacctggagtggtctagctcgcagcttgcgttactagccaggaagaccctgggcctttctctatccaaaccagggttttaaatttcgaaatcaacatttctgccgcaggtgagcgatagaaccgaaattttcaaaatttcggaaaaatttcgtacgaagttttttgaattttcgaaagattttgaataaatttgacaaaattcacaaaaaaaaatgcaaaaaaccgaaattttcgggcaagatgttagcatttcggtggggcgaaatttcgaaccgaaatttcaatccctgatccgaacaaggtcttgaaaacccctcaaaactcaacgaagcagtagatgattcatgcatatgagactaataaaaaaaatactcaaatataatgaaattatttagtccataaataatcatcatcacgtcgtcctaagtaggacaaataattaatacatgcaccgccatctataaagttcatcatcagttctacctggatcatgataacatggctatatatcacataattaagtagatattaaataattaagctccttatttgcagtggcggcatatacggcgagtggatcgatcgatcagaagagtttcccatcacggccggccgccgtcgccggcggcgagccggccggctgccggaaggacttggtctggttgaacaaccttgccctggtcatcttgatgaacctgtcagccttcttgttgatgtcctctttgatgctgtcgatcttcctgaaggtcggcttgggtgccaggttgtggtacaccttctgcaccgccacctcgccggcaccgccgccgccgatgccgccggcggcggcggcggtggccggagcagcagtactgcctcctcctcctgctcctcccttgcggatgatcttctggctctgccaccagctcatcttaatttgctctctaagctaagctactagctgttcttgcacttgcactaaactaatgttatttagctagctagattgctttgggatttttttgcttcttgttttttcttggcttgctttggttggattggatttgcacctagcaaatgggcgtcctttttatagccaatataatattctatattccttttgcattaaggctgcatatatgtgaaatgtcaggctttctcattgagttatttacttttttaatttcctccgaatatattggcctaacctaaccagggtcagggtgcgtgcttgtcaatcataattaagcatcaagacggtcatcaagctctgaagttatcaattttgtgtcacaaatgttttcaataaaattgtttaagacatacgaataactgatggcttttcaaaagaagtaaaaaaaatgactaacaatataaccttttattttccaggttttgatgtaggggtggataacgagccagcttagctcgtttgatctcattatcttaattaactagcatggtggcccacgcagattgcgcggctagcatcattatgttttctcccatataatagcatatatgttttctcattatattattcaaatatattaaaatgacaacataattttaaattttgcaataactttacaaaactactaatacgtaatattcatattatattttatatacgtgttagttattaattatttttaatatcaaattttagttatttgtaaattatatatatttctatatggactctagactcgtgttttaatatttcttttttttaattccgaattttctgtaaattgtatttctatatagactctatgctcttcttccaatattatttatttttatttctgaatttttattatttctaattgtatttctatctggactctaaactcatctttcaatattctttaatttttaatttcgaatttcagttacttctaaattgtattcctatagtgactttaaactcttcttcccatgtttttcttaatttcaaattttagttatttataaattgtatttttatactgactctaaactctacttttaattttattaaattttattatgtttattccaaattttagttagttttaaattcctatatggactctatactcaacttctaatattccttatttttttatttcgaatttctatttttttttcttcattgaatttctatatggactctatactctacttctaatattccttatttttaattccaaatttcagtatatggactctatactctacttctaatattccttattttgaattccgaatttcagttatttcataattgtatttctatatggactctatactctacttctaatattccttatttttaattccgaatttcagttatttcctaattgtatttctatatggactatatactctacttctaatattctttatttttaattccgaatttcagttatttatttcctaattgtatttctatatatggactctaatctcatcttctaatattccttattttttaattccgaatttcaactatttctaaattgtatttctatatggactctagtctcatcttctaagattccatattttttaattccgaatttcagctatttctaaattgtatttctatatggactctgtcttttctttttccctaattaatgtgagaatttatagaccatgagagcaaacatggaggcttctttttctattcctttaataatataatagatgagcctgcttggctcgacttgctaatgttaacaagctaaaaggttagcttgctcattaaaattataagtttgagccaattcgagccaagcattttgtcacgagctaatccaagccacgagttttgagttttttgttcacccttattttttatgtgtgcaagtcattttaaccgagagcttgaagaaacatgtaacactagctcctaatttggagttgaagttgtcagggttaacaatatctccttttcaaggtcaattaattgtcagttactccctccaattcatgttttcatgttgcaagttatgttagttttttttattatgaaaattggtttatatatatcttcggtttctataccaatatatattcaaatttgtttcgtgaaagaaaaaacagtatcaactgacgggacaagtcctcagctcctcttgaaaaatgatcgtctgaatgagatgttaaagacaaataatatagattctaacgaataattccgtaggtattatatcattatattcaaagcaagaaaaacccttaaataccaattccaaaaatatagcaccgctgtgcgtaccatccgctcctcccgtggtattatcaaagacgataactttttgtagaataagccagtttttaacataaaaagtttatcatttcgacaacatcaaatcaactaatgtagtacactggccctaaataaaaccaattttatttacatgggcattctcataagctaatttctaaaaatattttagttttgttctatatatgctatttttcaactttatgcattgaccgagtttatgaaaaatgcacgacaacaactaccatactaaattagttttgtcaaatccatcataaaatttatcttaatactaaatttatttataatctcagttaaacttatagttgttagacttaggaaaagaataaaatgtgcatgaaacgaagggattattttcgatgggcatattctaaggaagctggcgctagctgcgacaatcatcggcgccgttagtcgcagcacacggcattccatcgccatctcatcacctcatcgatgattccattggcatgcattcatacaggggcgtgatgctagtttcgtacttaagatcctgcaactaattaaccttaagctttagttccaccgttaatgccaatttccagttgggggttaaagctaggaaacgtgaaaaaaaatgagcacatttttggttcagcccagcattactcacttatctgactattgctaagcagttttggaatatcaaacgcccagatgataatcttaaagtggccaatttatcttcttttgtaatcagtttcgctacagcacctgctgctctagctaattgttcatcctttccacgtgtggtttctatattatatatggccgtgcctctcttcaatcatcatgattcatgaatatttggtgattgggtggataagatttggtcaaacttttggtacaaatattcggtcaaacttttggtaaaaaaattcaatcgaacttaattgcggtgattaattttgtggggaagttagttataaacttaaaaaattatgatagtatgatagtatgatagtattattcaagacagatttttcttttagaaaaaaacaacgtggtatgatctttgataaactaagcattcgagaaattcttgatatatttagatttttaaattgtactacttttctaagtcgtatataaggcggatctagggaagcccaaggcccagctaattaagtttctttaggtcaatttctatacatatatatattgtatattggcatgttatatatatttgtggtatttaaaaagtttatttaaattggaccaccatacttacttcctccttttcacgatgtaaatcattctagcatttcctgtgaaacagagggagtacaaatttggatacatacgccaaccgtcatataaagaaaaatggagggaataaatatttattatcagagggagtaagtttttttcttaacttaattgatcacctctgagtctcctactttaaagtttcctacgttatatattgtatatgcccaatgtttatttcatcgtgcatgcacaccgtaagcaaaagtagcaagcttaattttttttagataatggaataaaacatcccggcctttgctcatcagagctatagccaattattacaaaagtaacacccaaacactgagtgtagttcaaatgaattaaacacacccaacaaaataaaaaattaaactaagataaggagagcacatttattcaagtctatttgtgaatctccatccataatttgcaaagagttgcatgaccgttgtctcaagcctacgacatgtaaccttcgtaagctctcgatcatcttcacacatttgcagctgtgcccaaaatcggagccaatatatgagatagatggtgatttgtcaaaaaccatatcattcctagtcaaccacagagcccaacatatgatagaagctcctacaagtatgagtttactcttcttcttgtctaccccaaaacccaaccatcaaacatattagatatggtagtaggaaggtatagaccaagagagaactgtactgctctccaaacaaattttgcataatgacactctataaaaagatgttaaatagtctcatttttcataaaaaacatcttaaactgccattccaattttgtcttgccaaattatccttggttagcacaaccccttgaaacaagtaccacataaaaatcttaatctcaagtggcatcttaagcttccaaataatcttgtttctctcaatataactattattaattaaaactagatacatcgacctaacagaaaatattccattctgatgataattccatctaaagctatcagagaattgattcaattgaatatgtacaatagaagcacacaattcatgccaatatgcaagattctgatcaactaaatgatctcctaaaggaaacattaattgagtcgaacagatctcataacatcagcaatagtagaacttttccttcggacaatagagtataaagatggacaatagtagcaagcttaattatggattaataattaacctgttctactaccgaattagttcggcatgtggaatccattacagatcactaattaggcacgtttgtaggaatccaaatggatcatgacggcgacatgtgtatagcgcaagagactgtatatcgccatgcgtgtggccatccaagctctgagctatactgttaactatcactatacatagaatctgccaaatatgacgtcttatcggtaacgattagataagatttgcactggacggacaaaaactgatactgtgatgaccccgtatcaatgccggttcaagtgaccaaccgacactgatgtattcattatgattttttacatgaactggcatggaactaatatcaatgctggttttataattaaccgacaccaaaaacagagttaagccggctgtggtttcagtcgatctcgccctgctctccttcctcactctcttacttttccctcttctcttccacctcttcctctttgtagcgagcggcggccatctttccttgtctaatgatggctatctccctctctcctgtgatggcgcccctcccctcttcatggcgatcagtgacaccgtccttaacatagggatggcaacggggcggggcggggccggattgagttggaacgaccctgcatccactcctttgcgcgtctactcggccctagcctcggactggtggccgggtcaaaaatgagccccgtccccatccctccagggcccgtcactcgaccgggggcccattgcacccgtaggcaaggatgctcgacgcagcgacggtaagaagcagtatgtggaggcgccaccgtgtgccagcaggaggaggcggcgtagccaggctaaggctgatcaacgacagacggaggtggtgcgacgacgggcggaggcagagctgagacggcgacgagcggaggtggtgtggtgacaggcggagctggaggcggcgggtcaaggcagcgtgacgacaggccgaggaggagcggaaacatcagcgacaca

SEQ ID NO: 45793 - DNA, 10204 bp, Oryza sativa
cggccagccagcagtggatgtggaggatgtgtgaggggagtgggactaggagtaggggatggcgattgggaaattagggtttagattttataatactcacttattgggccaaccgggcttgtattgttgaaatgggctatattttaagatatatcttatacctcggggccctgccgggtcacccacggcccacgggtggctaacgatccccgcccccatccccgctcacccgccggcgaaaattgctccccaccccggccctaacggggaaattgccaccctactccttctcttcccgacaagcagaggcccttgtggctccctccttagcatggcaactccctctcatcttcatggagctggccatctagagctcaagaatgtccagatcttatggtcatgagcttaggggcaaacacctccctctccttggtgagcagagggctgctctaccatgacatacacaggctgctatagatccattgggctggcgggctggctgcccccaagggtagaaaccattgatcaaggtcttggcaaacaatttccccgcaaaaaaaagtctcggcaaacaatgacctcctccagcagcctcttcatgcatcttctaagctagtgagttgtagattaaatgggatctatgcatatgtgtgtttgtgttggtcttgggtgttattttttatgaaattcgtgacttgtaaagtgccattattggatatacattttgtgcatttttttcaacttgatgaaatttgtgacttgtttagaattgattgtgtgttgtgttagtttatggatgagcaattgaaattttatttcatttttatccgatttatggtttaaagttatgggaacaacagatcaaaaatgcctcgaaaaggatagcaatgcctttgatctagctcaaagcatcggctcgatttttcattctctcatgaaagcaccatcaattaatctattctggttctacaactgacactactacattatcattgctgtttacacatggaatcgacactgacaacgatctcaaacaggcactgataaccttgtctagtcctgttcagtgattccccatatttgaatgtatttgaggtccacacctccataagtatgaaattatggggctgtttggttcactccctcattttaccaaactttgccatactttttaagacatatgtttgtttcacttctaaacttgtggcatgccacagttttttaattcaaaggcccacatgtcatacaaccattttttagccaaaccatgtttaaggtgtggccattaatttataagccacatatttagctaggtttggtaagaaggtttggcaatgtttgggagggaaccaaacaacccctatatattccccttcgaatcccctcaatcctcttttgaatgagattaaccgaacaagctctggacacgtcaagcaaactgtgcatgcatgcagttactcaaacagccaaattagcttagcaaaagtacttagtaaatctgcggtgattaattctatcttactataaagttataatccactaactcctaaatcttaacatgcaaagatgacacatcatcgttcactaacaagttgacacatcatcatccacgaacaaccaatacatttaacatcatgcaaacatgctatattatctataatttaaaatttattatattttagagcttttaaaatgaaagcatgttaaatcatcatcccccataattcacataatatttcaatatatatcttcattattttttataatatcttatgtacctatgtaagttcatcctcacttgattaatgctatttctctcttctctaattaatccatatcacatcaattgattttagtgcttatgtaagtttatgttgtttagctatcttacatattatttttacttattattttcatactgaattctcgcagcaacgcgcggggtttcacctagttattagagaggtgaatagttaatagagagatttcacccaggtgatgattaatccctggatcaatcacaataatgcatacatgcaggaatctcgatatatgatggccgtcgctctcgccgtggaccggatcggacgacgggaatcaaacgtgatgtacgcaaggtttcccatggaatcaatttaagctaataaaatcggttgcttgtgttgctcacatcgctccacgtctatagcgtctatagctatctcgatcgcctgcgtatgtttgatagcgttacgttcccagcatcgatcatcgatcgtcagcattcatgccacagcatcaatatatctcctcctccttctaatgaatgatatgtaatccttctgtgcgttcacgaaaaaaaaaaagagcatcggtcatattcagtctctgagtctcaagatgtcatctgacgcaaaggagaagcaccaggtcccttctacacctggatcatgaaattaaggttcaggtacagtttcagctaacttttgtacagtttgtatagtcagaattgcagacagaaggtcgtacgcaattgcttctcttcagatatggttgtgtttagttcagcgcaaagtttagattttagttaaaattgaagatgatgtgactgaaaagttgtgtgtgtatgacagattaatgtgataaaaaagaactgaagtttgaatccatatgaccacctgtgtgattagtctggagagaatcgtcaggtaacaatgttcctagcttgactctggcatgacttgacctgctgcctggtcatgcatgttatccagatttcagaaaatttatcgtcagtagatgtacaggtaacttcacaataaataagaagtatttggagatattatattttcttgtatataaattgatatctccaggtatttgaggtatcaaaattcttagtataaaatttatgtaacttgtggtgatttttttaatgattgtaaaatttctttcagttgtaaaggccggactgtattgagaaatgaaacatatacctcagattactcttcagtaggataaaaattcatagttccatctaattaactccattagtttctggattctgataggcgaaccagtactttatcaatacattaaaatcattatatattgatctgttcataagtcacgagtaacatgtgtgacaaaatatctacggcatggaaaatactcagttcgttgcagccgcattgtaaaagctgctttagttttgttttataatcacagggaatttctgatggaagtgttcatttctttaatttaattaatcaccgtcattatattcctgccgcatgatctctgcgttgtatgtaattaattactttgcaaatcattaacgtcaagtcgatagatatataagctgttatatattgcggtgtacatgcatggaatatatctctcctgccaaattagtttggtaatgagacctaatcagccataataattgacacgattaggcatccatgactgcgactactctaatcaatctctcgaaaaagtacaaggggctagcttatcatcatctcacgaatatatcaccactaatcgcacctggtaattccacatggcacaagctaattaacgttaattctttctctctacagttgtcaagattttgaaatatttaatttagagctctcgagaaggtaccatatttaacaccacttttaacaaattaacaaatgccattatatagtagtacttttgtaaaggccgtaaaaattatagtgtgattattaatgggcattattaatcgtgcatcattcgtcaattcattctgaagagttaggtaggctaactccaattaaaaagattatggctatgcctatgtacacccatattggtgtaaatttaatacattataaaaaaattaaacaagattaaccttacaaccttcggccgaccccaaaaaaaaaaacaaaatcttacgatgaaaaaaaggaaatatatgtggtggttttatatactatctccatcccataaaaaaagttcatttttcagtttttaaatacaatatttgactcttcgtcttatttaaattttttattttatgattaataataataataatattattattattattagatgataaaacataaatggtactttgtgtgtgactaatttttttagtttcttttaaaaaaataaaataagattgacgatcaaacgtagggcacagacctaaaaataaatttatttttagacggaggtcgtatgttccatggttccaccatcactaatttcccgtgattaatatgtaagtacgtctgtttttcttaatataagggagaacatataatattttttttgtggggaacatataatatttaacattcatctcattacaacttattacttcttttttgaacgcagaaaagaattacatgcacatcaatatattatattagaagaagagtttaattacatatcgcaaccagtcagaggaccattgccgggggacaagaagaaaagaaattacagcttattactgattatcttgggtcagaataggcgcagctgatctcagattggagagctcacagtacggggatcgatgctgccgcagacgacgatgacaaccacgatgaaaatgaaaactgaaaccacaaatttggtatcaggaaattaagatttacagaatcgatcttactgttcaagctagcacctcatgtcaactgctcaaaattttttataacttaaaccaatatatctgctgccaattatttggcacacttgcacgttgcagacgcatcaggtaccttccacacgtagggcatgaacgcaagctagatcattaagagactcgattaatattgataggatcatatcgatctagtcttctcgatctctccgtgaatgcaatggagtccatatgaatagctagctagatgcaatactggagcgagcaggaacaatgactgcttctcttgtctggatttttgatcatcttcatcttttggaaagtctcaaactgtctagaagaattttattaggtaccaagctagatcataactctccatgactttgatggccagagacaggtcttaacttgagcaggtggctagattggcttactttcgattgatcgacccattcacaaaaaggaaaactttatttttaaaaataatatatttatttgtgttaaaattatatacttaataaaataacacctttatcattacctttttttctcaagaaatatgctcaataacatccaagatatataagtagagaaattttgcggtccttaagaaagtatatgtaagtattaataaaaattttacactaaaaattttggtacctcgagatatctaatatatatttggagatatatataaaatatggtatatcccggtatcttcttaagaatgataaaattcctgtataagtatagcataggagcctctaggcttgcatgcatgtcagtgactcatgcagcttatttctcatttttcagtgttatgcgcgtattataagcaattcgctcccaaagtcttatgttacttgaaaaaacattctgaaaatatcagtcaaaacattttcatagcaaaattaccaatacaattctagacaatatcattggccaagtaattaagatagttaaactgcactcttgggtgaggtacatttttttcaactgatatagcacgtaatatagacattccatacatagaaaacgatagtacctcaaagtatttactcaaaaactgcgaaaagggctcatcatgcatgctagacatagagcccaaccagatttgctaatagctagaaattaatggataacgtgccaacagtttctttcgataataaaaatctcaattcagcctctacatttaagatgatgtgcatatgtatccaaccatcttttggctgtgtacatccagcttagatgtagaggctgggtttttaatccattttctaaaagaaatatatccaactatcgtgccaacaattgattaataatgtgtaatgtttgtattgaaaattgtacaatttcttacagtaggcaacctagctagaaaatcctcacaaaaaaaatttaatttacagtcgtccttatccttatataagcactaactatagcctatgaagttcagtctctgaaaattaaaaatctcttgaaaacacagtcaacatatagcaagctattcatatatttcaggtaaatattttacaacacaagcgcccatcgatcaggggctaattattttccccatatttatgcatgcatacatccgtatatacgtacgtaatacagtgcaaatatcacatcatgcagaccgatcttaacacttcaattaatttccatgatcgagctcgaaactaatttggactaattttggccaaagaacatcctcttcctgtccctgatgtagttttcagacctcttgttgatgtcctctatcgacacgacgcccggctgcttcctgccggcgacggcgccgccgctgccatggtcgccgccggtagccgccggtcgccttggtgctggagcttttggagggttgttacctttgccggcgccgtacaccggcggctttgtcaggatgttgaagacgaggtccagcttgtccaccttctgaaccctcacctcgctgtcggagggtgcggcggcggccatggcggcgcggcgaaacatcgtcgtcgccgtcgtctgaatttctgtgtgtttgaattgaattggctagcttagctaggagacagtgatgtgttcttgttctaagcttgctcttattagcttagctatctctgatggcaatggctgatctaccaatggctcaatttatagggagctgcacatgttgctagctagctggtaggaatgttctactttttcttttatgggattctatggactgtccatcactgtgagagcaagtggcaccatttcccatttctctgaactatgtaaaggaggaagaggtttgtacatattctcatttgtagtctgaaattgttggtatatgctattggaattaattaagtttgtgatggtaaggtggtggcgattaataaacgcgtgggcatctaagtggagcctctccttggcagaaatatcgagtatcaattccaaaagcaaaatcgacacatgggtattgaaggaagtcccacggaagtttggggaaaatgcaacccataataagagaccgcggacaacttggttcctcagcggtcctatcacttctttgtatatagtcaaaacccactatccataaatcagttttcatgtttagccaagtcatcaacactcttggccattagattgccatatattcacacactatctgtaaagcaaccttcacatatagccacatcatcatgtatttgcttagtatctattgttagatgatagtcttcgtctctagtttatccagggccacctctatatttttaagagccctaggcaaactcggtgataaaaatccttaaggccaaatataagtttacttgtaatatatactttataaatcatgtatcatctaaagtgacacaaataagtaatactaacaaaataaacacataatattatggagtaaattaaacaagaagaacaaaacaagatcttagcctaatttttggactaaatagatgaaaaaaaaataaaataaactctagtcatgatgaggtaaggtgtggccgcgtgggattcaggcataaggatggacgatgacaccctctgctagctaggttggttggtgataagcctgagccctaggcggtcgcacaaccgacctaagccctcgagccagcccagccctgagtttatctaaaggttatgtctcatgctacaattaatgtttagtgagttaaccatttatggcgtaataggtttatttttttcgagtacaagtcggaccatacacaacacccggctggtgccaaatctaaaactacaaacagattccaacacaatgagcttaaccatctaaggcccaattcgcatatggggcttcatattatttcctaaaagtaagacaaattacatataaaaaaatattatttcttacctaataatattgtttgtttttttaactgaaaaggagcatctacacagtgaaaaaaaaactctatgagaacaatcaatatgaaaagcttaaagagatttgaatttatatttaaactttgaagttaaagatttgaattttccagtagacattgctcttattgctttcttactgttagaaatttaaacttctatttaaaagataagaacttccaaaacatttaatcagactatatatgaaaccaaaagcaagagcttctattgttaatatatttaatcacaagcgttaacgctatctacattctggctacgatgttagaaagccattctatttctctataaccaaatgttctaccacgtcataaaaaaagagttttaaaattccaactcttatgtgttttttttttgctaaaaaggatatataatatctgttcttaaatatatgtttattgtataaagagaaatttactgacatactacctcaatccatataaaaaagaacagagggagaacaaaatactagtattgaactttaacaaaaaagaaagaacctctatttagtttgttaggttgtcttaattgactcatgatctttaatctctcaaaaggaaatgtgtaccacgttgcgacttgatcacgaaggtatgagaagaaactctctaatctagtaaagttatataaagaaaaggtgttgcccttgttgtaagatataagttcattaactgtttagacatttttacattttttttagcatatgagtacgttgcatatcatttccttaataaagagagattttagaaagttcggacaagtaccttgtaggtaagagcctagctaccaccgcttccctttcttttgttttctttactccttaattttaaggtaatgaaaacattatttggcctctatacctacatatattctacttttgatttattaatatagaaaaaagccaaaaagtcctatctttctaaaaacaaaaagagcctagctagcactaactaacatgcatgttatcatcaatcaacaagacaacaggggagaaaatatgttttctcaacaactcaaagtctaaagtcagaaagaacagaatcttgttcttccgagtgtctgtctttacttcctgctttggggaaacaggtgagcacccaacatacccagaaattaaaagaataataaaagctcgatcgtaccaaattgcatgatcgaattaaatcgatgctagttgatcgattaatttttctccgacgaactagatcaggctctgcaacaatatttatctgaacttccttttttcatcccaagtacaatttcagatacacatcaatcagaatttcagataactcattgagaaaagacaagtgtactggtcaattaactagctgaaaaccataaatttcaggtcatatatataactcgttaatatactttataaacaactccatctggaagctagatatacatattcatgagttctactctcatggaatacttacatattatatgcatttctaattaatacataataactaataagtagagcatcttcttatgtagatatgtagctgtatttatactaaatattacatgataatattgcactgatcgatcaactgataatattaatctgagtttactgctcattcgtctccttgattaaactgcctcttcttgtcctcgatgtacttgctgatgaactccttggtgaccactgatccatgcggccagctcgccggcgccggcgccggctgcctactgttgctgctcccggcgaagccggcggcgacggcagtggtcgccggcctcgccttcaccgtcgtcgccctccggttggcgccgtagacggagggcttggtgacgaggttgtagaccggggcgatcttctccaccttctggacatccacctcgccattgccagaagaggagttcttggcacgagccatggcgtttctaatttctttctttcttggctcactaattgtgactgtaattgaattgtgttgttgctgaagctgagctttgcctgcttgattgctgccatgggagtgagtggtgagctcaatttataggcctgcagctgcaactgaattcaattgagtgagctactgcacctatccctctatggtcactgactcactggtcagtgtgagcagtgaccaatcactagtacagaaatagccatctctgccggttcactttggttcggacggaaaaatg

SEQ ID NO: 45794 - DNA, 4752 bp, Oryza sativa
  unsure (1)..(4752): unsure at all n locations
atgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagtcagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacattgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggtgtgacaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcagctgactgttttggggtccaacttcccaatatttgggttaaatactttggcctctgcaggactcccccacacacggaggtgagttagcgagggtactctccctgtccatagctcatacggtgttttgggtaccgatttgcttggaactctgttgagaatatgaatgtcggttttaacgccctccatccataaaccgagtggtagtgtgnagtagctcatcatgctgggcacaatatccataagcgtacggttgagccttttcagctaccccattctgttgaggttcgcccggtgttgaatactgggctactattccattctctagcaagaaccttgcaaaaggtctagggacttgcccataaggcgtatgtcgaccatagtactctcccccacggtcagatcttagtactttaatctttatatcaagctgattttcaacttcagctttgaatatcttaaatttatccagtgcttctgatcgctctttaattggataaatataaccatagcgggagtaatcatctgtgaatgttatgaacgagtcatagccatccacactttttacaggaaatggaccacaaatatctgtatgaatgatctataaaattcctgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagtttctttgcaaagaaggaacataaaagacatctcgaagtaaaagtgtgaagccattcgcgagctctagcggaagatctccaacagcttcaactttttcttcaactccattggcaactctaatggtgctttctcttccttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctctgcacacaattagcaatgagcttctcaaagttccatttctctggacttatgttgtagttgacaataaaatgtcaaactgctttggcaatgaggccataaccagatggaccagaaagtcatctgttatgcccaaatccattggcttcaacttggaagccatgttgctcattctaagtatgtggtctctaacaccacctccatggtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaagttcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgtaattaacaacgttggtcagaaaattacaacatcatagcacatacttaatgttcctaaaattaaattctcccgttggtttgaaatttaattttagaaacactaattttcatcaattacatctatttgcagcggaaaactatataaaaatcatatgaacagtagcaaaatctctgtaattctctctctgtgaaaattctcccgttggttcaaatttaaacagaggtaaaacatgcaaaaaactattcaaaattctattgaaatttgcatgaaaattgacaaaataaaaattgctactgttctcttttattcatttttcggccccgaagggaccttatatggacttcttccggcctttgccggtcggcccatggccaccttgcgcgcgggcgagcgccccctcctctcccccaggccgcaacctgggcctgggcgggagaagccgccgccgcgcgctccccacttgggccgctttcggcccgagccgccgtcggccgtccgatcgctagggtttcgatcggacggccgggaggggagatcgggagaccaaaacccgacccccaggccgccggaaaccctagctcttcttctctcgcgggcgcgtggccgcgccgagcggcgtcgccgacgccggcggccctcgcgccgccccgccatgaccggcgcgcctttcttttctcttcttctccgctcgccccaccgtctctaacccccaccgtgtgagagagagatggcgacgacggagatggcggcgccgccgcgggccccctcgccggcatg

SEQ ID NO: 45795 - DNA, 5093 bp, Oryza sativa
atttttgttgctacagagctagcccaatcaactcagaggtatcgatctttgttagctgcaaatgcaagagcatcaggttctctccaagacggataatgaattggactcataacagtagtctactactactatgcaaagaattgcaaatatattcaggaaagcacttctcagtgtgatagtggacactccatagcaaagatatttttgtgtcacttttgaaaggaagctttgatctttttgatgtgctggccttgtgaaatatctacaagttggcgattgcaacctttaaaaggtatccattaattattaatttactgttttaggactagcttgtgatgtctgagagaaaaaaaaaacaaagtgaatcaagttcagcacatacagctatagtttttgtgttatgtttggtttagttggttgttggttaaattaacttccaaattatggttccaacttgcaaactttgttagatttcactttctggcttctgaacgtgtttgtatttctacaaacaaaaaaaaagatgtttggttcaattaatgtagccttacagttgctgaagagattctcttgaaattaaataaaagttgcagcagacatgcatggctagttatgttactgaaaataaatcctttttactgatcattaaatacttttaactgctcttaattaattggcaatagctaggtaaatcttggcataaaaatcattacctcagaaatgggtacaaactgcatatatgtttttttttgggtatatccttctttggtaaaagaaggaaaactgggaaattaaccatgaaataagggtgaatcataagttcttgttttatcaatcattgggagttcattatgtacacttctgtttcattctttgaacttgtaatataattcaataaagtgtctgataatttatcttttaaaataaagttttgcccacacatcccaccaagtcatggtatggccaaaactaaggtttatttctaaattaaaaataagttaccggatcacttttaaaatccaactaaatggttcaaaacacaaaaattgaaattggccagtatctccacaggctaataatattagagagaattggtagcactagtgcagcttgctagctaacattccatcaaattctagatatgttagagtgtaaactagagagaattggtagtagcctttattagattgcattgagcatcatgggttgtttatatggagtaacagattggagggcatgaagcttgatctcctaggtaaggcaacccatacagataagtcagatgagatacttaaaatcctagtatatagtagatatggagatatatattccaaacatacttaacaaagagggcattgtaggattatacagcaataactaaaccaatcagggggagggtgaatgattgaactacccaaaaaccaaaacttttagcagaattaaaagttacattcgaatagatagagcttggtctgactggagttgatgcgccggtctaaccacacaggtgcctccggtctgaccagtgtagtcgctctagtctgaccgtcctttgcgtagctgtcgcctgcttctgatacttaaatcctagtatacttgatatggagatatatatattccaaacatacttaacatatagagaacatatacctgctagtccacttgaaacaaacatatctaagttccaaatgtttcagtctcaaaggagaaagttcgttcaataaaaaacactctcaaaggagaaagaaagatgctagtttttctgtacacaattggaggggtagtaaatttgcaatctgttttttttgcatattggagcatggcgatgtggaaattgaagtatcacaggtgaaataggcacaatttctaaaacaatttattaccatgaagtttcaagacacaaaatggggccttttagccctttacatgactggtagtagccacttttgtatcttatatatatgtcattacaagcatgtcacacaattattgacatataataaacttatacatatatggattattacgttcatggcatctagcgacaccgtggtagatgactggccagttacacatgacatatgacagagcctataaccatcatccctagttatcccaagtagaaactcacattttccctagtaaaccatgcgtgctaattagttgttatgtatagccactagacgatgacgtacaccgtctatttctccgatcataacttagttgttcattctagccactgggacgatgtcgtctggttttccagccacagctccaacccgaacaacggtgacggccatgctttcggcctgacctgttatcggcgatatcctgcttgtggtcgctgatggcttggtgacgaggttgtaagcctggatcttctccaccttcctcaccctcaccacaccttcaaccgggagatcgctgctcatgttcttggctccagtgcggaacatcttctccctccctttctacaccgcccctctttgatcagatgatggagatcagcctagctaggtatatctatcacagttaggagggatttcaagctctagctagcaagatggtacatgttcttgtgtgagcttgccttggccaccatttatactcctagacaactaggagttgtgttcttgtgggactctgcagtgtctccatggagatgccaattgtacagtgagagcaatcaatcaatggagaaatatgtaatggttgctgctgtttggtcgacgtggctgcacttttttggattggatattttttttttgaaaagaattttggattggatatgatgctgtgctatctgttcggttgttgctgtgcagagtgcttatcgttttgggcatcttgattccaatcaattaatatcagtctgatcttttttttgcacccatgtggaaatatcgatcccgaattcgcatcgatgctcttgatcaaaagtgaaaactcatgctgtcctggatcattcaataattaagcctcgtgctagcgcgctgcaggcatttgtgagcatatggaatatatatagcccctatttttttcggcttgagcatattgacttagatttttaagatgcttttatagggttatggttttataaaccggtggatatttagattttatttcaaatgtagagttatactctaatccacatatataagtcaatatagtttctcaaatatagttttttggttcaattgtgcaagaatggtttatggattatatatgactttaaaaagccaattgaaaatattgctagtttgtttagactttggcttttagacttataaagcactcataggaggtccaaacaaaaagggctatagaatcgtaaccaatagctatgattgaggtatgtttcatggaaaaaaattatgccaagtgttatatatatggagtgtaaatttaattagaatgtaaatatctgaatctgcatgcgaattccgatcatgcatctgtatacttttggttatataaatcaattaaggagaaattttcatatttttgctgatgatcatccaaagcttttaagcttcattgacacactaccaatctcatgcttatttacctaacaaagagaaatcaagcgtgctgcacgttgcatgctaaatataattaattcaaaagcttaggatctccaataactgagcacagtggagaaaagtttcaggatgcagctgcttttttttcatatataatatataaaagcccatatatatatgcatgctcttttgtcggagagatatatagattttattagtcaactattgaactatatttatctccaagcatatatgtccctggcccaagctgtgtcgagtttttatacgctgtcgccaattaattattgcgacaatagtttggcaatccttgtatgacaaattaaataattaaattatcagtgttaaagtacattgcatgtaaatttaccggttgttgtccttcacttttaattttttacattcattttagataatagaaatatatggtttaagcttgattaattatgtgagcaaaaaattatccaaatatatatgagattttcttccatccttgaatatatacctccatatatactacttcaaaagaaaaaaaaaataaattgattgaaccgattagaaccagagtcccactccggtgctctttacttattagaaagcaatatgaaccattaatctaatttgattgaaggtttcagatctatttctactaccacatcatttaacggtagagagcaccagggcatataaaagttatatatacctcaattttggacaggaattatatacctctgactaaaaactaaatatttatacatctcccaaagattattgaagtaacacatcaaaaacatatatgtataatgtatgtgaatttgaatcctacactaacttgtgagattagttttgatacatcacttattgaagagcagtctcatcaagtgatgatatgagagatatattcctgtccaaggatgacagagaatctctatatgtaaccagagatttatttaatatattcactgtctgcaagcccactcgacatcaattacaacgaaaaattaaatggcatagtgcacaccagagacaaagctgtacttttccttttgcaagagaaataactgtagcttgtgttggtctatattaaaatgttcggtttctcatatcatgagtggctttaagttttttggatgaactaatattctgttcattaaactaacaatcaaattaacatgcaagtaggacaacacatgtgctaccaccatgtaggaaacaaaactatcaacatatataaaaaaaaccgaagtagaagatgtgctgccttattgtgatatatatatatatatatatatatatatatatatatatatatatatatatcgactctttgaaacatgtcaaaataacatgaacagtttataattaagaaaggcttgtgcctcgtgtgtgacttttgtccaatcaggtatatttcaacgtctccatcaaaattaaaattaagggcttctttcaaacatggaaaatttacaagaacttaaataatagtatttagttcaaatttcctaaaaaaaatccttcatttttcaaagtaag

SEQ ID NO: 45796 - DNA, 5159 bp, Oryza sativa
attgtacggtttcacataatataaaactcctccgaacagaccctacatatatatatcatatatacaccgatcgccatatagccgcacacgtatgtacttcaacggtttcagtggcatcatgtgcaaaagttaatcaacttggcctgcgggcttattgttgcctcgctggaacgcctctttcttcctccggatgaaatccgcggctatctcgtcgatgttcatcaggccgtccccggccttcttctccgatgccgtcggcgccaccccgttcatgaccaccacgatcttgtccaccctctggacatggacttcgccgtccagtacaccaccatcaccgctgcctcgtgacatattccccggagcttgtgactactttgatctaacttgctacaatatttataattctagatcaatatgaggaggattgggtacttctctcttggttgatatggattgtatttataggctggctcgactcagctggcaagctacgctagctccaattattgtacagttaattaactggctctttgatctgaacaggtagtagctttgcataccgttaaagaagtgtaacttaaggttaatgtaaggtacgggtcaggtcagatggaacatatatatatatatatacttgtcatttgtgcaaagtgaaatacttcctccgtattttaatatatgacgccattgactttttgataaacgtttgacatttcgtcttatttaaaaaatttatgtaattatcatttattttattgtgactttatttatcatcaaatattttttaagcatgacataagtatttttatatttgcataaaaaatttgaataagacgaatggtcaaacgttggttaaaaagtcaacggcgtcatacattaaaatacggagggagtaattatttgatcttcagattaaggctagccacacatgcgtaattgcatatacattgcgttgcgtgcgtgtttgtgcgaatgaaggtgcattacggtagctagctgcattcacaaaagtccgaaagagtggcgcccgatcgaatcgatcgatggatcagttgtctgattgacaggtgacacatggaatattagctcgctcttgctgacttcttttgttacatatacaggagtagcgtatttcagatcttcggccagaagagaggatactggaagaggattctctgatttacttcctactactttgagtcactaattaatatgcagggtttacaatttcgttttctgaaaattttggtgatttaggtaggaccaaaattttttgaaattttgaaagattttgaatgaatttaaataaactttgaccaaatttcacaaaaaattgaggaaacccaaaaatttcggtcggtatattaattgatttgccggtggggtccaaaattatttccgaaattttgaaccaaaattataaacactgctaatacgtgggtcggttgggtagaggaccctcctgtcagtgaaacagttgaggcagtgcatgcaaaccacagctgtcgcgagagagtattaattgttacggagccgtttagcaatacatgttatgcaaactgaaatttcgttgtagtaactcctccattcaaaattataaattataagtatttttaagattcaaattttgtatcataatatttttcccaatattttaatgcatgaaaatctatacatttttagccaaatgagatgtttatgaagagagcaaatctaagcaatttaaaattcaaaatttgaccacttaagtgactaaaatacattttttttcttcgcctctatattaatttttgctacaaaatctaaaaaaaatatattttaaaaaggagagagtatttcattatttgtgatcatcgatattatgtggttctgtaattattgttttgtcgattccgcttgacgtggataagcctgtaattgtgttattttccgttgattccacttggcgtggataaagagcttataacatagcacctggaatacttattctaatatgtttcagacaattaattagcctttagagccaagtgtgtcatgcatatataaatataacccagaagttaaatttggtctacagtaaaataaaatgcagtttgttgtgaaaaatgatttttttttgaaaaaaaaatgattcattatatttttcttgaaaactttcagttgaataataaaaaaatagatttaaaaaagggtgaatagccaatttagtccttcaagtctttacaaaggttcactttggtcctttaagttgcattttgttcgtatagaacgaattaaatattcgtattggctcaaaatcatccttgtacctacttgatatgctacatagctaatcctagtcaacgtttctactataaaatgtcccagtttgcacacacgggtcaaaagggaaaaaactaaataaatagcaatgtaatgtacttctcattatttcgagctgtacacacaacagtagagcttcaatggatatattgcactacccctagaagtaattaccatgtattcattatgatgaaaaatgtattgtacacaaattttgataaaaagtagctgcatataatcattggatgtatatttgatgggaagtcttgtccaataagtaaatattatagcatatttctcatttgaaatcattcttatgtatgtgaatgaggtgtataagggtcatttatcacaagagatgctgactagatttagccacatggctcctcaagtgggttcgagcacatgatctggattcaaaatgaaaaactgaaggactaatatggatggattgcaacgtcaagtactaaattgagccttatgtgaaatttagaggactaatttagttattcaccaaaaaataaataataaactcagatagatagagtcatgcgtgcaaccaacaactccacctccacaccggtaatcattttattatctaaacaaaatctggtatacggctctctctgcatataaactgccaagtcaagttgcatcttctttaatcatttcaatcccaacacattgattactacttaagtaagactatcatgttgactcgacgaatgaagaaacacacacatatatatttagcctagctaaatttgtataacaaaagtacaaaattgcatactaattaatccagttaactaacattaattgacaacaaacaacagtaataatacttaacatgcaaaaaaacataagtatatacatatatgcataatgcatccatatcatatccatttgcatatatatgtagtaacactagtgctgcgcattgatctctagctgctatgatcagctgcctcctccgccgcccatttctgtttcaacctgtcgatgtacgcctgggaggccttgtcaatattccttcctgcagctgcagccctctccggcggtgctccgccgccaccggccgtcctcggcgtccgcgccgcgttgatgatcaccttcgtcttcgtctccggctcatcatcgatccgctccaccctgctgatcttgatctccttcgtcctctcgacacgcgacatattgttgtttctatatatgtgttcaggttttgcttggtctgaaattctgaatgaatagatgataatcaagacatgtatttataaacgaagagatgactgaagaagtaacgctaactatgtggagtaccttggtacccaaggaacagaaaagaaggcataccagaagcttcatgcatttgtgttgatattgactggacctattcagcttaggagaaaatgcagtgttctttctgacgaaaatcgccgcaggatgtatcggagataattaattaactagtataatgtgcatatctatcgcattgtcggttcagaatagcctagcccaagctagcaaaactaccaagtgcacaggatctgatggtcaattgttaagacgtaaaaagtaatatgaatcagttgaagattttgcaacgaaaacatggaccagctagtgctgcactacacggtgtttttttcaaacagtaggcttaatactgaaggagcaagacttacctggaacttccttggttcgtactctcgattcgctttaattacgtcattagattgcagctggttaatttcttcagcgtgaatgcgtcatgatcaggagaactccaaatcggaatccgatttggtagggatgggcgcgtatacagtgtaactgctcatcaaggtcaaatgcgcccatccctagctagtaaacatctgcctctctgctctcatctatcgatagtgcaacacgcaagttaatcagggcctgtttagttcgtgaaaagaaaatttttagatgtcacatcggatgtttgactggatgtcggaaggagatttcagacatgaatgaaaaaactaatttcataactcacctggaaaccggagacgaatcttttgagcctaattaatcagtcattaacacatgtgggttactgtagcacttatggctaatcatgaactaattagactcaaaagattctctcgtgatttcccccctaattgtgcaattagtttttttaatctatatttaatgctccgtgcaagtatccaaagatttgatgtgatgttttgggaaaaaaatttgggaactaaaccaggccttatgccttctacgtactcccttcctttcgtattataagctgctttaatttttcctaatcagttttttatcaagtttgcacaaaaatatagcaacattttcaacaaacatattaataaattatatttaacgttacattttcctccgcaaggttcgtccacggagggtgagttagggcctaagattaggctatttaaaaaaataatttagtgttttagatgttattaattttttttataaagttggtcaaatctaaatattttgttgtcaacaatatccgagagagttgtttgatctatatagtttaaatgctatttttgcaggtcaactacattttattccgcgatccttgtaatcattccttctggggataattaaaaagagctcattctggtgcaacagtttaattacttaggtctggttaatttgacacagcttcagatattagatgcatgatagatttgaagttcatatgttaaattatagttattgttatattttatattttatctaaaatgagaataaaataattaattcaaatgtgttaacgtaatcgcagatctagatgcataaat

SEQ ID NO: 45797 - DNA, 1918 bp, Oryza sativa
ttccagattgtgcctctcttcttggaggcggtccgcttcttccttctctttcctaagtgaatgaagctcttccttctccttggcaagtcgacgagtgacttgcatcatccttctgctgagcccagtctgtccaatccctcatatgtgcttgcaactctttctgccgctggacaagaatcaagaccatttcatccttcttatcttgtgggatccaaaccttctgatcctcatcatatgataaattgattttgctgctagagtccataccctctgtattggcatcatgattcgaagatggagcaggactgtcatttgaggacggcaatggcaacgacaatgagagatctgtgctagcagctggtaatgggttcaagttactactcagcttggcatcaaatgatggattggagggaagggcagcaccagtaaaagaaaggtcaggtggtacttccggtcccttcatgcttgcagaaaaccctttgcctactttggatgaggccttcaaactgctagtagtagaatctgaaaacgacctgcacttcctgtccagcactgcgctacccaaagagctatgcttgcttgacctaagagatcctttagaacccagtgctcgggaactcttatcaaaactcatcaacttctgccgatgcaaggaatcccgcttagaactccccctcttactagggattggcttatcatctttcacaggttgtgtcgcagcagcaacgaatggttgctcctctgaatgatcaggcacaggatttgagttttcttttggcttaagattcgggatttcactctgcgccttacctgagacagagggtttactgctcggtacattcaggtttgctggtgttgcggatgaatcagccttggcagtattgtaagaattgggtggcactggggtaagttttccacgaaaagtgacgccagtctgtgggttggtaatagatactgataaatccgaacttggattattaggttcatagtttccaacaactggctgggcaatcacttgcgtatccactgctgggagggaagccggattgtagtccatggcacaggcattggccacattcatatccgacataagcaagcagaacatcacatcacctgtagtgtagaacggctgagcctgattgaccaacgcaatcatgccaccgagcactgcctgctcaatcttcctcatgtcttcctcggaggcgccctcactcaacatgtccccctcggtcttgagcacctcgaccgccgcctcgccgaacccagcaaggctctccctccaattgtactgcgtggcagcccgcaggacggcggcacgcgcggtgggctcggagtaacccatcgcgatgatcacacctacggcattgtcgaacgtcgcgtccaggcccttgagaaggatctcctcgagcagcgcctcgttggggtcattccaattcacatatctctggcactccagtagctcctccgccgtggggtgaatatccttgcaatcgcacgagcccgggatgaggtccaggttgacgccctcggcggccaccgcggcggcggccgccgccgccgcgatggctgccttctccggcgacatgaactcgaagcccacgcagtcggccgtcagtgggtactccagcccgaatgaccccagctcggcggacggcggctcggcgcggtacttgcgcttgttccggctcgccgccttctcctgcgccgccgccgctggccccaacggtggatgcgccgcgagagtggacatcacgatagatagctgctgcaaaaaaaaaaaaatccccccgacccaacaacaaattcatcagagaaatcacaccgcgcaatctcaatatagcacaagaaaacaaacaaaaaaattccccggatacggagaatttgcgactcacctctggttccttcctgcgcgtgcgtg

SEQ ID NO: 45798 - DNA, 7348 bp, Oryza sativa
  unsure (1)..(7348): unsure at all n locations
gggggtcgtcggcggggatcgaagcggagtcgatcagaggagtggagaagagagagagagagtatggctagagagagagaggaggaggaggaagaagaagaagggggaaggaggaggaaggagatgaggagaaggaggcgcttgtctctcctcttctctaggcctgatggatggagagagagagagcacacacagcacagcagttacggttgaattttttttttaccatttcttttctctcgttttctgctgggtgctgaccccaccaatggttaggtgccacgtgtaccgtgttcttcgggtgagggctgacgtggccggtggcggtcgatgtggaataaaccagggaagggagatatgtgttgttcttggttatggaatgcgagatgtttggagatggttaggttggttttgctttgtttggtgaatggattgttgtttttatttagcatgggttttactagtgatagattagcattcagtgattacggtgtaaattggctaaaaaatggaaattgcccttcgatatggtgtttagagatggatgacgatcgagtaaatattgaatgaaatagcgggaaaatagaattgcacgaggcaaattctgtgaacaattgaattacctacataattcctaatgaacgggattgctatatattattcgactgaaatatgggatagccgtgggtggcggaggaccggcagtgggcggtggacttcggcgggcggcgaggcagcagcggcgccgccggagccgcggagatggaggagggcggtgggccggcgtcggtggcgggggcaaagcaagagtgaggttaggaggtggtgggcagtggttgcagatccggcggcggggagccaccggagatgggggaaaacggcggcgcgggggcacctcgccgtcgccgccatgaggagaaagagaggggggaaggggagggggaaagggaagggtgagggggctcgccgggggggcctcgccgacgccgttgactctttccggccagccggcgaggcaggcagcggcgcggtggggtggtggtgacggtggaatcgcgcaacggcgcgaggacgggagtggtggcggcgttctgaacggggaggagaggagttagggttaggggggtctgcacgaatctttaagcgtatccagtggtccaaaattcgaatgataggaggtgggattttctatcacaagatatatagacaacctctttaatgaaagtgaaggtttatcctagaaccatgttttttttttgcagggaagaaccatgcaaattgttattcaacaatatgtaatatgtgatgttcaaatatcattttgttactattagttacacatcactctagcattgcttttaccccattaatccatatagtaaactctgcgctggtaaagttttgaagtcatatgctccaatagaaacatacaacaactaaacttagtcttacacatcnactcatccaacatnagataatacacacagtcctcatcagctaggagtatcannccacatcaggcggaatcagccacattnagctctacatcnttgcntatctattggcaattgtggtatgagatatattgcaattgtggtatgagtaagtgatttgatatcttccttatttagtagtactatgtcactagatagagcaactaatgaatagctgaatagcaaaatagtgttttatatcttcacaactgttactaatccaagttctagaaggaatttagtattattttttttcatgaagcaagtaatgacttgttgccaaacaaatgctctcaatgggattatctcgtttctttaagtttaccgttttacttgatagaataagaaatacaactatggggtgtttagatcccaccccaaaattttataccctgtcacatcgaatgtttgaacacatgtataaagtattaaatataggctaaaaaataattaattgcacagattgtgactaatttgcgagacgaatcttttaagcctaattgttccatgatttgacaatgtggtgctacagtaaatatgtgctaatgacggattaattagacttaataaattcgtcccgcggtttactgacggattctgtaattagttttttttattagtgtccgaaaacccatgcgacaccatatataatacctgatgtgacacgctaaaactttaaacccttggatctaaacaccccatatgattgtcttaaatcaattgacattagcccaatcaaacctcataattagagcaaggacaaagggaagaaaatgtgttcatttgtttgtatgattccacatctagcatacctaatcaaaagaacattattctattctttttatgcacaccgtgaccgcgaataaggtaacttcaaaggtacaatgagaaatctaaaaaaaggaaatttttattgaagatgacgaggtaataccgtaatacacacttttgcatccattaagtaagaagagcttgggctaaaaacaattattgcaaggtcgaagctcgcctcattcatcttgatacttataagggaatggacaacaaagtctaacactttcgagagtacgtgttttggaagatagagaaaagaaaatacaacaaggttggtccatttaccccaatactaatgggattttatttggttgacatgcctaaccaaagcatcaatccatgttcatgtgtgcctacatctatttggttcattcttattgatcgggcttagctaatactagcagtaaaaaaaatttagatatgatgtgaccatcaagtataggcatacaaccaagcatgagaaatataaagcattgccaaagaggatgaatggaggatgtacaggatattcaagtccaacgagttttagaatccagttcggcctccagagacatcactgacttcaaacggacctatcgccttcatgccaactacgatttgcgtgatcttggaatggaaatattatctcgtcatctttcaaatgcatccagtctcatatccaaattcatctcgagtcaacgagaatcatcaaaacaaaacagtgctattgctgaaacggaacttgggcctttggtcttgtaatagactagggccatctcagaagtgtctccctccacctccccgaattagtacttaaccctagctctagtttcccctatgaatgtctatttacaccgtctagaacaattgggttttatttagttgaattatgccaagtgctattcaccttgtctctagttcttactcgattagagcatccctaggagatacgctactacatcctccgttcgcgatttggcgtataggagtgcaaaaaccgtctccaggagatgcgccatccaatccggcaaaagtggcggatgcgccaaaaagggagagagaaaacccaaaaatagcgtgtctctctcctcgcgccaaatcacaacgatcgagctcccgcccccatccggaattccacgacgtcccctcccccgcaacctccactccatcgtcgtcatcgccggccagcgaaggggagtgcgccatgcccgtttttgatttttttttttgcaatggagggtggagagaaaggggtgtagccgtggagtgagggtggagggggataagcataccagatcagggaggagagcgccggcagcgcccaccgccatcgccctgcccgctgctgccgcctgccgccgttgcccctcgcccaggcgccgctggatttagcggtggaggattggagtagatgcggaggcccggccgccaccgccgcccgccgccgcgacacctccgcccgcgcctgcgacacggtcacctgcgcccggtcgctcatccgcccggcaaccccaccgcccgcggccgtgaccccgccgctcgcgcctcgcccgcccgcgcatgtgaccccaccaccgcccctcaccagctcgctcacgagaagaatagcagtagagagagtagtagagaaggttagttgaaagatgttataaaaaataggaggatgcgatatggatgatgtaatatagatgatctgttggagtgggaagggatatgaacgaggaatcttttttggatgggcatccatatgggcatatagaggatgatatttggatgatctgctagggatgctcttagtcgacgactatagattggcaccccccctaaatagttggtgtgttgatttacctggtcgatcagatataccacttcaatcgcaactatttctttgtgcttaatcacctattcataatatttagattgcatcttatcttgttcttgcagtgttctctcgtttgcattgcaaggatcctcaaccgcgtgcaactatttctttgtgcttaatcacctattcacaatatttagattgcatcttatcgtgttcttgcaatgttctctcgtttgcattgcagagatcctcaaccacgtgccacggttgatacgacatcgtttatggtgtagcgattgcatggcgatctagacttgttctgattggtagccatgtcgtacacgtcacactcgataaaagcgagagttatcccctaccagaagatcaggccacgagagagagcacgtcatcaagatacgtcagtatcataattgataagtagaatgagaggccatgcttacttgggagagatacatatgtcaactaatgcaacccattttttcacatatttggagtacaatttaacatctttttccctctttgaaatctctaccatctggtttattcacctaacgttgaaatgaacgaggaaaattctgcttgtgaggcaagccttagaaaaagcatgcccttgaaaagaccatgcttgatctctacacaacatgagacctaagaaaaagactttgcaacttaaaagggtgtgttcaggaggagttgggaacttctcatcaccacacgaaaacatgatagctcattaacacatggttaattaagtgtactagctaaaagaacttgaaaaatggattaatatgatttttaaaaacaactttcatatagaatttttttttaaacgcataccgtttagcagttcagaaagtgtatgcatagaaaaatgatatagtagaagttgggaaagagtagtgccgaactaagtgcaaatcatgttttgaataataatacgattatcatcttaagtaaaaacgattttgctagagatcaatcaaaagacctttttcttagccatcacaggtgggaaatcaatcccacgacctcttggttgatgccacgcggttgtaaccagatgagcaagctatcaatcctatcgtgtttaatatactccctccgtttcacaatgtaaatcattctagcatttttcatattcatatttatctagattcattaacattaatatgaatgtgggaaatactaaaatgacttacattgtgaaacagaggaagtacaaccgatgtacgatgccattataatataattaaactgtaattatattcgtgtgatttttacattgaaaaaaatattttgaacgatatctagtagccccaagtaaaaaatatatttagacccgaaacttaccattcaagccaaggccgtgtttagttcccctaaattcccaactttccatcacatcacatcacatcacatcgcatcgaaaacttttctatgcacataaactatcaactttttctccaaactaccaactttctcccaacttcccaacttttccaccatctaaacacagcccaaaaataaaagagttaatttcacaaaactataggtactttgtacaatatatcacaaaactacatatttaagagtttgtttcacaaaactacagatttattgtctccgtttatcacaaaactataggtacctgtacaatatatcacaaaactacagatttaaaaacttgtttcacaaaactatagatttagtgtatccgtttatcacagaactacacatttagtgtcttcatttattacaaagctacatatttagtgtcttcatttattacaaaactactccctccatctacttttgatagtcatatttccaaatctgaaaaatctatttttgataggcatatttcaacccaacgacctatcctcttaatgactttctcggatttaatgcatgactctccattattccacacaagattggctacatgggcatcgagaaatgtaaatattaataaatctcttgtttacgaggaataactagtagcatgtttaaatggatgataagtagaattacttatccttgtctgtgtgtcaagatgaaatatgactatcaacagtagatagagggagtacatatttagtgtcttcgttatcacaaaactacaatttttgcattaaaacctgtagttttgtgataacgaagacactgaacctatagttctgtgacaaatgaagaaattaaatttgtagtcttgtgaaacaagttttaaatctatagttttgtgatatattgtgtaaagtacctgtagttttatgaaataagtttataaatctgtagttttgtgatatatggtacaaagtatttgtattttttgaaatttactcaaaataaaacctgagtaagaagatcagcccggcccggaccagcccagccggtccacaaacatgcaataccacatttcccttttcttaatttttctaacacgaaaaaaggccccgaatgggtgggaggggcccgttcgtcttctccagtaacgcaggagggaggagctcgtggcggcggcgccgccaccgcaccggccggcggtggggacgcacggcgagggacccggtcaatttttcccaaaacaaaaagcgttcaaatcctcaccacctcccatctctctctctcttgacctcacgaatcccctttgccgcgagcaacccgcgacctccctccctccgcggccacacgaggtacgcgcgctttcccccttaccatctcgagataatccccgaatcgattgatttcgacgccgatttgcggcgatttccacaggcaggtttgctcgcgtccctctctgctctcgattgattcgttgggggttcggggggttgagtgctcgatcgttttggttgcgtgagtcgcggtcgaatttagggtagtattgcttggcgattcgtttgcgcggactggatgggggctttgattggatggggaggtgggaaaatcgctatgcatgcttgttgattggaattggattttccatgtgtgggcgttgcttgtttacattgggattgatttgcagagttggacttcatctgattgcgttggaagcaagcgaatgtgtcgtgagattgaataatgtgatatacattttcagatgttaggtgccatgtgttaaaaacaccctcgggtcgtaggtttgatctccatttatgatttgagtgagccggggaaacaaccgggggatcca

SEQ ID NO: 45799 - DNA, 763 bp, Oryza sativa
ttatttttccttgtttttggaggaaataggtggaggatacctttagatcagcagaatccccctttgggagctaaaaactgaggagtctatgtgaaaagaaagattactgggaaaatcgtaaaaacttagacatgttagtatgttcagcgtccttcttcatagaaccataccatctgtttcatcttaagcttcaatggtcatgtaaaaggtcctttgaatgactgcaagcaccttccataggaagcattctgatgttggtttcagatcatgttcatatgatggaggttaaaagcaatccatactttatcaatccagtagaacaataaagtagtttttaatttttggaatattcagaattggcagtccatatatgttgagaattttctcaatatggaacgaagattccaatttcctaatccagtgctggtgctctacagttgacttcaaatcccactgaattatttgtgagcaataagtcagtgctagttccttgctaagccctttctagtgttgaaattttagtgtttaattctgtgaacttctagggagggaggatgatgtttttaagaaataaaaaatggagaaaaatactcttgatttcaccacttcctttttcaatcttgcatatctcctgcagtaagcataatctcctgcacatatgctgcttttccaggattctaccttttcttccgcagctgtctatctaccgccatggagcactgaagccccaagcatccaaatcacattgaaatccttccattta

SEQ ID NO: 45800 - DNA, 1638 bp, Oryza sativa
gcgcgagaccgcacggtatcgcgtgatcatagcacgataccgtgcggtctcgcacgacgaaaaaacgataccgaacgacgaaatcgaggacgtactacgtggtggcggcatcagaccacgcggtctcgcgcggccaaaccgcgagaccgagcagtctggctcagtcagtgagcgatagcgactgcctctaccgattgaataaggttaattagtgattaattaatcgataattagaataattaatcactaattattattaattaatcattaattaggataattaatgactaattaagtagctccgttggacatgacattcggtctcgctgattccttacgcgagactgttcggtcttgctgcttcatcacgcgataccgcgtggtctcccgctcctaccgcgcgacaccggtatattttcgctaaaaagtgtatatcacgaatattttcacgaaaaaaccaaatcaatagtatatttttaaatttaattcgctctttttatcactagctaatagccaggattacacaagaggcatgtggcataaaagtgcacttgaccagcaaaaatgtagtgttcaaaactaaaaaaaatcatgtgtacttattggcagattaattttttttactatgtatatatatagatcaaagcgctctctcctataatattattggcaataacatattttgacaaagtattgatgataaaagcctttggggaaatttgcaagatagatttgcatgcatggtatatatatacctgtgacaacgttataaaagtaagaaattattcttgcattctagaaaaaacaatgtgtacacattaggaacttgacggcagtagtttatattattattgcagtatatatgccaatcaatgcaacatgccatcttttatgaccagaggaaccaagccaggaaataaaagcatagctagtggatacccgcagctttgctatgggattttataaatctttctaatcaaaacaactaaaaacaacattgaactaaaggcgataaaatactcaatatatgcatgttaagccacaactaatatagaacaattagcatacgtaataaatttatagttatgcttaagcatagaaataatctaacgaccgtgattaagaatgatagtgatccagcggtccttttttttttgttgacgacgtgactcaccgcatgttaagcgtaattgggtctaactatataactagtagacatgggcatttttatgtcatcttccggaggtagctcggtgacgtcacatattattttctattatgtggaagcaagaaacgcgagaaggttagtgggcgaacattcacccactacctatctcgcgaatcggtcggaacgaagaggatgaaagatgtgccacggaggagaagggggaactcatgggggagcgatattgttcttccctttccaattttcggttttcctctttttatgtggtcctttatctttttctttttttcactacctttttctttttcagatttctttttttaactcttttcattgtttctttaacataaacatttttatatgaattatttcatgaaaacttaattcctagatatacatatagattttatgtatgtaaagtttctatatgtagactttatgtatataaactt

SEQ ID NO: 45801 - DNA, 1364 bp, Oryza sativa
tagctcgtgaacattcgtatactagacatccccttcactatttatacaaaaatatattgatagtgccgacatatatgaattaaaacatcatcactttaataatagatcacaaaaacattacttggttggttgaaaacaaacaaatacaactagattacgtcacatttaattctagatttgtttttttggatggaggaagtaccaaaaaattgaccgtgcccaccacaggacctgtcgaacaaccaattcgagaggtttaacatgccacaaattgtattaattgcggctgtttgatacgagacttgtaaactttgattgttcaacatggcattaaaattgcgatttcttaccattattgttgcaatttttattaaaagagtactattattttttttaaataaaatcttcatatatggatgtatgcggcgagatggagtcaggtttcttaattaaattcgatgcgcgtgtccacggcctgcaattcaataacagaatctgattcgaattctggaactctcctgatcgagtccagctgacgcactcaaacagacgaaatcaaccagctgcaattatttgatgacgtaattaaatcgaattgagattacgtatatatacttgtatccagaaattaaagcagaagaagttcgaggccgcacttttgttgtgtttgtgtgtgtgcatgatgcatgcatgcacggtcaggtcaagtcttgctctatcagactactgtttgagaacacgctattcctagctggtccatacattttttgttgctaaagcttcaaatggttcatacagctttatgttttaattgacctgcagatcgagtgttatgcacataattatcatgaagacgtcgttttcgtcaggaaaatacactgcattttcctaagcttctgatatgatctcgccttcctctgttcttggaggctaaggtactccaaagttattattagtgtttcttctatcatttcatctccatctataaatacctgcctcgagttgcttcatgatcattcattcagagcaagctcaacctagctgatcagtactcgattgatcaatcagctatatatacaagttaattaattacttgctaagtacggagtaattagctagcctttctctgtgtgtgtgagcaagacagattaattaatatgccggcggagatcagcgtcctcagggtggataggatcgagccggcgaagaagacgaagacgccgccgccgccgccgacggcggtgaactcggtgcagacgccgaggatgggcggcggagcaccggcaccggcggcgactagtactgcaggccgcagcagcattgacgcggaggccgaggggttcatcaacagggtgaggcggcaa

SEQ ID NO: 45802 - DNA, 1031 bp, Oryza sativa
tgcgaattcggttccctacgcgacagcgcagcccaaaggactgggcgatctcccacaggaagttagccaccctgtagaatgcgtgcattgcgccatgcgctccccgctacccgaggcaccgtttttccatgtccgccagttcttctgccccatccgcgccggatgcgcgcacccagtttctcgacctgctgaacgccgccctgcatggcaataccctggtcaaactggtattggcgcgccatgtcggtgccgaccagaccttgcaacggatcattgctaagccgctgcaggtcaagggccagccgtgcctgtcgctggtctatcgccaccagacccgtgacatcacccgcaatctggcgctggagcaggcccaggcgctggtcgccgagctgctaccggacagcttccgcaacgcgcacctgttcgatgccgacggtgaagtgcagttgaccttcagcaagaagggcaagcccagctccagcgccacggcgcacaggcgccacgcgaagctgccagcagcagcggccatgaccgcgagaagaagcgctatctggagctttcacggccgttcctgcgtgacctcggggttactgacgcacaaggcgcgctgataccgtcgatgtcgcgcaagtggaagcagatcaacaagttcatcgaagtcttcgaccacgccctggccagtgcaccggtgccggcggagcaggcgctacgggtggccgacttcggctcaggcaagggctacctgacctttgccatgcacgactacctgcgcaatagcctgggccgcgaagcgcaggtaaccggcgtcgagctgcgccaggacatggtcgacctgtgcaacgccgccgccttgcgcctggagcacccgggcctggagttccagtgtggtgacgtgcgtagcgtggtgcccgaggccatcgaagtgatgattgccctgcatgcctgcgacatcgccaccgactacgccatccacaccggcattcgctgcaacgccgcgatcatcatggctcgcggtgtaccacagcagatcc

SEQ ID NO: 45803 - DNA, 1386 bp, Oryza sativa
  unsure (1)..(1386): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcctacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgctgatgctagtccatctggacaggcaagtgatggtaggcgaccaactggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtactgagtacctccgactattgttgtactagtagtattgcgaactattcggtgtttgtctcgtaatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttgaactcaactttgctttgttttgcacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcagg

SEQ ID NO: 45804 - DNA, 2675 bp, Oryza sativa
cgggcacgctgggacttcccggctggtccactacgcacgggccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggacgaccagtggtggacagcgcaccctacggggttggtcgcagcgcgcagtggccagaggacggtcccacgatggggacttactggtgtcgacgtggggttagtgcaacttcgctgcgttataagtttatcagtcatcttctttttttttccttcacataacatgtctaattccgatcatgtttattgcagcgtcgttacgctcacgtccaggtgaaacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcccccctgccgaccactcgtatgttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgagcagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgatttaactgcacgtttcctcatcgcaggacctcgtatgccttcgagcgcgttcgcaggcacgaccggcgcttccgcgagctccgcaggggcgttcgccacctcttcgggcgcgttcgccagctcttcctctcacggagcgtcgatccctcacccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccagaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtattgtgctcgaacaacttatgctcacaacaacacactttcggcgcttcacggtagtgccatatccagtagcgcgcacagtccacaacagcacacatgaaaatggaagcctattaattggtaatacgtaatctacaattgagattatgtacaacattcttcactacaattttacattttggcagcaaaccaaatatgatcaaatgcaattttaccttaccaaatatttggtagtgccaaaacttgcttatattttggcactaacaaaatatttgtacggtaacattccaaatatgccctaaaaaataataaaattgtattttaccagtcttggagattttaatcttgtatagttttcaatataaaaagatttgataactattgatatttatataaaaaaaatatagagcacagtgcaaaatcgccctagcggagggcggcaagggggccgcctgcaaaattccatgccccctcgccgcccatttgcaggcggccccccgcacagtgcaaaatcgccctagcggagggcggcaagggggccgcctgcaaaattccctg

SEQ ID NO: 45805 - DNA, 20822 bp, Oryza sativa
gccctcccagagggcggtaggagactatttccgttaattttcaaaatggaaaattatttttgtaaaacttttaataaaaaaaattataaataaaaaaaattcgtcagtgctctcagtaaccttgggcctgaaatgacaggcccaagtatgcaatcgcacaagaatcaggcccaatgcatttcctatccttgtccttgttggcagcttagaacttcagatatctccactgcggcactgccgaactgtcagtctttgacaggcaataattcaagatatcttattaggttagtggtacattagtaataacgatcaaattaagttatatctaagccaaaactaacgagtaaatgccaaaacacacggaatgaaaccgacattctgaatgagacaattagctgcaaaatattcaacagtacggagccaaaacttcatttatatattatgtctgatatttgcacgaatcttgagtacagtgaacaaataagatcccaaagaaatggatggtgcaacagatcagcttgctgtggatgccgaattgccgatgatgctggctctgatgtagtatatgagcaatctcacttttggagatgcttcaaaacctggtggtcaaaacctacatgctccttccttccgtcccatttaaagtgtgttgtgggattttttgtctaacatttaaccgtccgtgttatttaaatttttttatgattaatattctattattattagatgataaaacatgaatagtattttatgcgtgacttatttttaaaaactctttcataattttttttaaaaagatggacagtcaaacgttggacacaagaactaacagctacggttagaataaaacggagggagtataatggtggccttttcttcctctactccctagtaattgttcatcttttgtcttatagctaagcaaacttttcttttttttgaaagagggtaggcaaaaactcttgcttatgagcatcattattgatcatgcaactccaattgcggaaaggtgcgcaactttgagcagcaaaaattcctcgtgtaaaacatgtattccctgtccaggatcaatgttcagaatctcatattagctatgcatgcatctgagtttattactaagaaaaaataatttgacttttatattacgctttgttaatcaggagcttaataaactatgtatattttgtatgctgctccatatatataattaaggagaaccaaacatttcaacaggttgtggtcatttgttgaacgtaaaaggcaaatgtctaaacctattagtcgtacttagtgtacaccaaatcaaaattttcagtgatataaaaatgttgtaactaacttcaagtattaattgcaatgatacacatataaatcttttgcatattcccgaaaaaagtggtataaataattatgtcaaaccataacacgttaagataaatgtcataagcatattagcatttcaaacacataatctgatcatatatatagctagtatgcatgtggagtgcttgaggtgaaactttgccattatatagtatgtgatcacatattatcgtgcatatatacataaattctgtgctttaatcattagctctctagatatgcactttaagtatattttactgttttctagagtaaaagttcaattagaaatacttacaatccaccagatgctagatctatatcacaaattaattgatcgtatatattccaagaaaaccaaaataatcatatcatcactttattattgctccaatctgaactacaattaataacatgaaaaaaaggaaattaacctagctagacagtgctaacactagaaggattcttgtacagccaggatgatcaactggagctagctgatgaaaatacacaatataattaatatagatgcaaatacaaccatatatataacagttcttggattcggtgattaatttgcatcaatgacggcgccagctgctacctagtgatctgcaagctaagactggatcaggagagtcaaagggcatgtgaggtttgtacaattgacaagcagctagcaagcatcgatccggtatttctgttagctatctactaactaactaactagtatacataattaatgtgtgatgtttgttattcccatgcataatataggtcatgtgatgtgcatgcactgtggtcttaagccaagatctagcttagctagctagcagctctgcctagctagctagttgctcatggcttaataactaatcttaaattatattagtgtctacctgcatctcatgatcagctagtgagactcgtcctttcaaccattagtttattttcgatgcatctgaagccattattgttcttttttacagtgtaaggaattctcaagaagattactggtttttattcttgtgacagacaaactttgctaattaacaggatatctactagaatctgatactacaaaaaaacagcttacgaattaccattcatctctagcccattgatagttctactccatattaattcatcagataattaagtacacaaaccaggcatctccactgcctgaacggcatgtaatcgcatccttaagctgttatacatagtgtgttcgctatgtaattagcaaccaaagcaaagaaattctcgaataaagagcatgcataccctttttcagggaaataacatgcgtacttagaagtaagaacaatcaagaaaaattaactgcataccttacctagtagtattatagctatatgatctataatcatcgaagataggaagatcacctcacagacgactgcagctaagaacgcaagacgtctgaacccaacaatgaagaacatgcaccatgaatatcaagaactcaagacggagatcgaagttttaatggctagaggaagcctccaaaaggatcgcatgatccgtcaagctgcttgtagacgacgaccgccatggaagcgagcgagagcgatgaaggatcaatgcgatccctttggatgcttccccaagacattgctgctacaccggctggcccttctctctttctctctctgaattctgaataagtctgaaggtctctgcagaggcatggaggagagaaggtgttgtgcaagaaagctccagtgatgaggcccttatatataggtacgcaaccttgctttgcccataagtttattcacatttgctttagttttcctcccaaaatggaccaatattttatcctcttccaatttaagtttgcccattcctccatgatcacactgtaaaccataattaatagtttggttcttgaactgtaaattaacttgttaaaaagtactacatgccaaacattaaggggacgttatttatatatattatatcatatagtcataattaaaagtgagatctataattactgtgttttgttgtactagatggtacgttcggttttgtaatgatcaagaaagttgttagtagtggacatcaaaatcaaatatatgaatctctagagggcgcatatgcgagataacattgttaataagtacatgtttatggtttgtttatgccgtaatcaattatggttgcatcattagatgaagcgtaaactggggtggttctccccaagatgcctttaactttcccctaattttagttctttctagctagctagtttgcaaaatgggctttgcaagaagcaatgcatatggatgatttgattatatacatgaaagcaaattaattaagaaagttggatgactgtatcagcacctgccagatcttttggtgattagggacaccattttttttagctagattaagagatgcatgtggccctgggaacaactaattgcagccattcaatcattaaattcagccattacaactgattccccctacccttctgcttatgtgcccctaaactgctttttctagctgctattctttcatcagttgagaccccttgaagcatcttttgcctcttatcttaatgacaagtgcttactagccttttgcacagtagctagccttggttaatatattgaaagaaagggtcctagattgcaagtagaatggcaaatgtcctgcagatctgagtactaatcctgccttatatgttaattgtgtctggtacattcgccgtttgtcatgttacagaggttgttacagtgtagtaacatgctagaacaataatgtcacttttgtcctcctgctgttgctttcccagttttgctacagtgctgtaacatgcatatcatccaggatgaacaaaatctagcagaaatagcagttgtaggccaacattcagacagttctcagaatgttgttgtaacatctacaccattatgttctgctctttgtaattaggaattgttgaatcctacaaaaatggatactgtaaaggttgcccaatttggacaagcaagtaggagtagacatttgagcatggtagattggcactagtggatttgcttccttctctacaagatcagcatgggtacattcactaggaataaataaataaataaataagtgaaaaaaagccataaactcctcctatgcatatactgcctttacagatgtcttcaggaagatgtacccatcatgcatgcagggaagctcttagtattatcaattgtcagaagataatgaatgccataagataatgaacaacactctttttggatatataatcaggaactgcatgatgaatgaaatgcaggtactacatgttacacctctcccaaagttaagaaggttagaaaaaagatttacaagatgatgtgtcatatgtacagtgataccttggcatctaacactgctgatttgtttgtctgtcttgatttggctctttgtttgtgccgaaagaggagatgtgaatatatgatctgccatgtgcattcatatgattcctcctgacaaagtccaaacattcttttgtgtgtgatcaccagatgcaatcttatctctgaaagcaaagctcaccatcagctccttgtagggcattgctcattgctcacatgtgctcaatccaaccagagtttctcaattcctacactctccattcacaacagaaaccaataatcaatttttgctgcagtgctagctagctgcctcaacagcatgaaggccatgcactcacatgtaaagatccacacaaaatgggcatatgttctactactcacatgcaaaggcatacatgcccatgttgctatttcgtcgctcatgatgtgtgaaatgtgagctccgatgtatcggagtcggaggtgcgaaaaagtatcgcaggccgacggttcttcgacgcaacaattattgtagaaattcagggaattcaggactagtagactgatgtgaatgcgctggaactgaaagtctgaagagctgttcaacaatgtattccacactaacattgttgatctcaggataagcatatttgaataatgctatttcagtcaaaagaacatgtgactgcaattatatattcagtaatacttggtgtcctaaacctaccaacattcagaagactggatggaaaaacttgatgaatactactgtactgcacatcatctgcactaaagaaaaataaagaaagaaaagaaacactttggccactagtttctgaaatcctaaccaaagtactgtattaatttgatctctgattggtatatcaaactgtcacaaactgaagctagttactatactaacatataaaatgagtatcttcatgatgattgaaattgcgatcgaggaggatcctgttggcaatctgaaaaacaaagatttgcctcacctaaaaggacggccgttttcagatgttatttttttctgcaagattggccgtctcacctcacatgcatgagctgcaccagaaagaacacaaaatacgtcgctgccgtctctcgttcagcacatggattgcagcacgcatgagctacgaacctcgtgagcatttctcccctttcttcccccaatgattgaagagtacacgccacagcaagatcgccgcccaaaatttggttcagagatttttctttttttctttttcttggtttctttctaattactttcttccagcttgctcaactttatggtcattaaccaaacaaagatgccctcaattagtagcactaactgcaacctgatctgatctgatgacggtttagatagcggcccaatcatttgcgccgatgattagctagccacagccggtactgtattatgaaatcaaccaatttgctgttgagttggttaatcatcatacaatgtgatgattacatatatataatcacactagctagctagacattatggatcagccggccaagcttagactaatttcatgagaaattcaagtggagcaactggccatgtaacacttggaagcatgatcgagcatgccagttggactagcattcttttattttttttttaggaaatcaaatttgtattcttttcagtctgaaattagttagccgttttttaggaacaaaatgtaaggaattcaactccaatgttactgggcctacatgactaaggcccaactacttcatggcccagactttatttcccagatttcaagctgggcttttacataggcccattcccttgcctgttgcgcagcaggtcgaatcgctgcattttcagttcaaaacaaagctaatttgaattcgatttggtttactgcacaaaataggaattgaattgaatttgatatctgcaagtctagtatgtcatatattcttttttattttttgtcaggtcggtcaaaagttggctgacctaatttcattaagataaggagaagattaaactgtcgagttgggcgtgggcaagataagccacccctgcttgctctaagtagtcaacaaatctaggataaatagctggcaattgatcatgccattctgaagcttctgcagttctgctccatgccgagcggattgatgcagatcagtcatggcatcgataacattttaatgtttggatttgtgtgttacctttgattgatgtgatactctcctgccaatattttttgaaaatggaaccactgatgatcatgggaatttcataagtagatatgaatgtaaaaagttccaaggaataaattatatatagcttaccgtataattcccgatgcctttcatgcttatgatatagtcttcatgggacagtttttgggcacgcatatacactgtccaatcgtgagtggaaatgcttgtgtgattgagtgatgaattcagtccatcctcttctccattttcattatttttcttttttttcgaagtattttcattatttttcgtttccaaagggaaatggaaagcaatatataggccgttgatttcgctacgagtaataacaaacagtacagatgaaactaatgctacgcgcaggcacacctactagatttattttttttatatagtaatccattacctaagaagaaaatctacacgagttttgatttaatacccaattatcaaaacccattgtttcaaaacacatcttgcattttcaaatgaaatgtaaatactacacatgactgccaactaaacaacaacaataaagttaaacataattgctagagaacttctacaagttttttttttttttgccttcaaaacttttagatctatgaacctcatatcacctcgaaatttatgcatgaaggaaaaagaaaatttcgcacttgtcacacgtaagattctagtgcgagccaaccaacctatagttgaatacaagttttatataagttataccggtaattgcactgcagttatagtgtagctatagtgtagttataatgtaattaaatttcaattatgttatagttatatctgaaagtttttcaaatttgcggcagatttttaatactcccaagttaaattaaactatctcggctgtaacaatgcttcattcaggcaaacgaaaatgttcagatcaagagagaatacttgtgcgtgcacgtttcgaaccacacatagtttaacacttgcatgctcaggatttctgcagcgaaagaacagaggaactgcactgtgggactctgaatagccgttctttttttttttttacggatcaaatttcattaaggttcagtgaatgcccttttgtcagacaagtatggaacctcgtttgctcatggctaaacttggcaggaggaaatgctcaacccccaggcggaacatccaacgaaatcgatcgtcacggttcaaaagagcaaaagctgaaaacaagaggagctctcctcacaacatggtggaatatttggttggaaaggaataataggattttcacaagttctgttagatcagagatggacgtagcttattttgtcaagcaggaaattgaccttcgtagctcggcttttaagcccccttgatctgtaatttttaattttattttgctcgctctggtctgtattgtacggtttttctttctctaatcaaattccggcagatctcctgccgttgatttcctcaaaaaaataaattcattaaggtttagagaaaatagttacatgagtataatctcaatattaaactgccagagttatgagtggctgaacaccctcaaggaagaaaccgagacaaagaaaaaagaacaaagactacatctcctcacgagattgcaaaatgcccgcagtcttccaaatagagatttctacctggacatcattgacgagcttctccgccaccttcaactctgtgtccaaacactctcctccgtttcgctctttccaaacgaaccagcacactgactccgaatagccgttcctctcgtcatcttaaattaggagcacgaccatgatgctgcacggatgatctaagatgctgtacaacttttcacgattagtcgaagctgaaatttccccaagcctctcatgcttattgctttcatgcatccacacacgttaacagtagtaaatgtttaaacgtgctaaaagctgcttcttcttcttggcaagctatgtgcagagaaaatacacaccgtttttgttcagttggttaatagatcctactgtataactgtcttgctacgcttcgggggaattgttcaaacccaggagcgattttgagaaattccacttgttctaaactggttgtacatattatatgtgcacatggtagctagcatgcatctcgtgtatcttgagtagagaagaagagatgccaaacaagtgtaggtgcacctccatttacatggggcttgtttagtagagcttcaattgttaaatttagctataggagttggatatggagtgaagttgtggagcagcctaaatctagctccacctctctagttcattgtgtgagaacgtgatctagtcagctccgctctcattttgggtggagctaaaattgtttggctaggtttcagctccaggagagatggaggtgtaagtggaacaatgccaaacatgccaaatgccaatattattagtgaaatccatgcagctctgaatatataaatgtagctatacctatacgaaagggcatgtagcctagtggttacagttacctgagtagtaccctaaggttctgagttcaaattttctatggagcgaatttcagattgggttgtttgcgtggctaagttccctatttcaatggccgtatatatccggttggatgtagaggcagggtaaaaaatacccttctctaaaaaaataattaaaaaaaagctatagctctaagtagatgtgtaattaagatgagctagcatcaagagagtagctaaattgattaggttgttgttcttggcagcttatggattgtgaattatcgggggcaagtttccaaaattttcttttaaaaaaaaacttatttatcagtatttttgaaaccagctttttcaactttgtaaattttaatttgttcatttgtgccccttaagaattgtcagaaaattcagttttagccattatatccattagcagggtttacagaatgattaaccgacgaaaaaaagttcagttttttttttctgaaagccggacttcccgggccggatcgataatacaaaacaattaaattacaggatactaattaaattacaggatggataatctctcctagtttctttgagcccgcgataattcgatcttacttagcgattatgacccgcagcggagtagctcgatcgttggctgaagatacactcgtttctcccctatcattagactagagcgacgattaggattatcagacctccaaattcttttctgataattttcgaacgaattccctttttttactagagaaagatattttttacctcgtctttttatccaattagatgtattcagccttttaaataaagaacttatcctctaaaacaacacaatctaaaatttgctcatatgaagattgatatatgcagtcttttaaattaggaacttagccccttaattaacccaatctgaaattcgctactatgaagatttgaactctgcaaccactattgtatgccctttcattgggtgtagatcctctggagttggttccgaatccaccggatggatttcaggtgatccaagccattgtttaatttcaatggaccagattaagcaagttacttgcttttctccctatctctacgattgcacacatcatcctagttaattactattttccgggaatataacacaaagttagaagcagaataatacaagtagttagatacttatatttcctagagaatgtagattgtaatattaccgccaatagattgaatatatcattaggagatcaacaccaaaaagaaaacatggcacatacatgatgcattcactatgccatttaattatgcatatatagctcatcgtcactaggatagcaaatcaaaacaccatgattaatcattctgagccgcgtgaagaaaaaatttagtcactgtggctgtgtttagatctaaagtttggatccaaacttcagtccttttccatcacatcaacctgtcatacacacacaacttttcagtcacatcatctccaatttcaaccaaaatccaaactttacgctgaactaaacacaacctatcttgtttctatgcgatgtcatatcaagatacagagaggggcttcagttctcgtgcatgggattaggcaaaaagaaagtgacgtggctaccgtctatacctcctataaagaaacaaatggtccagatttgtagaaatccacccggtggatttggagaactaactccaggagccgggatctgtacccgtccagatcattgtcatgattcagaagcagttcctctgcttccagcgggagtgaccttttacaatctggcacgcgtgttccggattttagtccagtcgttgacgtctcgacagagatgaaatttcctgacgcttctcatgcttaattatgttcatgtatccatgcaaacataggcttatatagctatagcttgcttttctctccccttaataattacctctgatataactattttgctatgtcgttatggagaatcgttcaaataatcacagaagaaaagctatatattttgctactatgttttaagctagcatatatgcatctgggatccgattcaggtgcagtagctagtatgactgcatgataaacagtcacactagcatcgcacaatttaaaatggacatcccagatatatctgagcactgtagcgatttactgtggaagggtactgttctgattttactgtgccgaatcctttttggtcgttagattttgacatggagggctcggattgcgtgcagtagttaccgtgcagtcctagtagctactgcatcagatctcaatcccaattatgcacctggtatgttgagcgcacagaccaggagagagaggcaaaacaagctagtgtgtctgtatatatataggcaaggagcatgcacccacttattatacatccctgtaaacatatgggagtagtacatatttgctacttcctccgtttcaggttataagacttttctagcattgcctatatttatagagatgttaatcaatctagacacacatatatgcatgattaattaacatctatatgaatatgagtaatgctagaaaatcttataacctgaaacagaggcagtagctgtaaacattacataattaatgagcattatggactagccaattaatcgagagcgtattttcactgtatacatcctttctggatgtaaaggccagtttaacccattacaaaaataattgagagcgtactacttatctatactttcgtcccattaagtgtaccttacacattccaatcaatacctttgacaaaaactcgacaaattaattagtcctgtagaactaatttatttttttttcaaatcactgcaaaacccacccaactggttaagcatttccctcgccaaaaaatgtagttagaaatttctttttagaaacaaaataataggaattcaactccaatattgttaataggcctacatgaccaaagcccaactacttgcggtgcccaaactttcctgaaatcaaagctgggcttttccttaggcccattccacccttgtctgttgctccggtggaatcgctgcattttcgattcaaaacgaaagtggatttgaattcattttgccaggtcagccgaaaatcgaccaaccgaattgcattaagaagataaaaaatcgagctagttacagaacgatattatactgtcgcaaaggtataagccccccccacccacccccgtcgcaaaaaaagaaagaaagaaaatccagaaaaacaggaaccaggagaaactcccacgtggtactctctatgcttaaacacttcagcttccctccaaatcagcatttcatctctaatggatctgtaaacttgcgctgttgcgcaatctttgtgatcaaagattctcgagttgcgctctttccataacatccaacataccaacatggcacctgtcgccaccattccgtgaagtgttcccctccatcctccggaaaggaaaaggagaccccgagccaactccttaacattctctacacactgtttgtgaattgacagccactaacaagtgttgacagcttgggttgtttcagatggagtgaattttagattgggttgtttgcggggctaagttctctatttcaatggccgtatatatccggttggatgtagagaccgggtaaaaaataccattctcttaaaaaaaaaaagtgttgacagctcccctccacattgttgcacaaagcgcaagtgtcactgtgcggcgcccaccctcttttctgaaggttgtcagcagctaaaatctcgcaaaagaggagttgaatccatagattcttgccccttgctgggtacggagtcaccacatcgcacggtaaatgaattgatcttcaacacgcatgatctgagatgctgtacggcttggatcgatctgacgaagctgaaatttccctaagcctctcatgcttattgtattcatgcatgcacacaagctttagcttagttatatattggggccttattaatcaccaaaatagtagaacatatttaaacgttctagcttcttcttcttggctagcttagctatttgcagagaaagcacacaccgttttttttggttcagttggccaatagactctctcgtactgtaactgtcttgctcgcttctgaaaaattgctaaaacccagaaaggatttggagaaactccccatgctctaaacttgagttgtgatgtatcttgagctgagaaatagaggtcgaccaaactagtgaagctgtatatataagcatacaatgatatatacaagggtatacaatgcagtccggccatgtagggattgcactaataaatttaaagcatacagtacatttaatcatttattagaggagatcgaatagacacggtgccgcatctgtccagcagccaggacaatttttagatgcgtgcatcaaagagatcaggctactattacagaaatggagctcctagctagccaattaaccgagaaacacaatgaacaaacagagggtatgaggagttatgtgattgtatcgtaacagtagcaatatctgtgatctctaaattcatgatgtctccaagtcccatgttgtagtatatgggcgaatatatatgcaatggacaccacaatgcatgcataaatttcctatccatcgctatgatctgttctagcttggttgccaatatgtttatctcatatatatccacacatgtagaaacgtggggagattggctctggttggcacactatcggtctgagatatatactactagtatcccgggtttaatctttccgtttggatgtttctatcggagggtaccgatatactgaaatttccaaaaatttgaataaattttagtcaaatttgaacaaaatttcgccaaattcacaaaaaattgaaaaaaaaactaaaattttttgccaaaataatcaggggagggtccgatatgaccgtgaattttaaaccctgctagtatcatgcactgggttgatgcacagtgttgatattcattgggtagctatgttactcagcaaggtacaatcagttgatccatgcatgagcagtggttaattaagattcataattggatttttttaaggaatacctccttaaatatgagacattattgtgaaagggtaattccctgtgttctaaattggttgtatatgtatgtgaatggtgtatagtagcattcatctagtgtgtatcttgagcaaagaagaaagagaggtcaaacatgtgtaggttctaataaaaaaaaagtgtagctgattggtggtgtccatgcaaacatgcttccatgcacctctctgtattacaccatgcacatactctgaacggtttggcagagctgaattactgcggccatccttcttaaatttatactactgtttccaaaaaaaaatactatctatctattatatactaaaagtttatgaaacatcctaaaaacgctcctaagtcgatacatggcacccctaaaaacgctcccaagctgccaagtggcgctctaataaattagataaacatctaatcattgattttcacttagcttggtggacccatcagttttgaccattagattaaattctcatctctccaccctaatatacgatggttgcatgctttggtcccaccaaaataattagttaagagtaaacaaacgcggagaatcagttatttctctcccgaaaaaatcaccgcagtattaattcttggaaagaaaaccgacgttgtagatttaatgcaggagcctgggtgtgtgcttccctcatccaaaaaattataccatcgaaaactttttaagtgaatatcacctttgcgtcaaaaaagtgaatatcactaactgctctaaactatttacagagttaggttcagattcatgaatattgccctcaatagttagtttctgaatttttgatgtttctgtttgattaccagggcctgatgaaattttcacagatgctaaatctcactacattaaattctcatctctcctccgtaatatatgacggtttcatgctttggtcccaccaaaataattaattaggagtaaacaaatgcagagaatcagttctttctctcccgaaaaaaaaatcaacaaataaattttcagatgcaaagccataggaaaagaaagcaatgcgcctctagcttactttttcgaccaatatcaacgacatccatctacattttttcaggaacgagcagcaacaactaaggttgaaacaatcctaatcgtatcaaacaggtgagtgatgcaagcagcaacttccatctttttattgtttgatctcttaacatagccttccacttctctatttttttaagcatataatttcgcttttttacctacaattttatactactcctcggtgatgttcgtattctgatctgttgctactagcttctacaactaagcgatatatcaaagctcttgcctcttggacaatatattcactaattaacatcgggtatttgggtgctgtcagtttatttttgagcacttagtcaagacgtcttgatgctgcgtgctttgccaccataaatttgttaattgattttttagataatcattttggaaaggtaatgcatgccgcttttttaggagaaacatattacaaacacatgagtttatatacacacgcgtacacttatccatagaaaacatattcgagagactgagccaatgatatatcttcaaattagtgaagtcatcataaacgcctcgctattgataggaacgttgcctactaaaaaataattagccataaatatgagacccatgtcaagtctagatgttaaacctaggtgggtaagttccaccataggtaactaaccagccacactcactaattgcagataatgtggagcccctcttccctctccttaactccttttttccatacattatttgagataaatgtagtatataaataatagataaactattgtaatttttaaattatatatacaatttttttattcgaccacaattatattctgtagaattaaatcagttcatatcgatttgaccaattgcgttatatctcacagacaaaaaaaacacgaaaacatatgttatagtgtcatatatcacattataatcataaataactaaaaatagctctaatatgtttgaaaataaagtttactacattatgttatttaccattaacttaatatatgatctatattgactatactttaatctgtaaaataaaattatattttaggtcatatttttattcttggtctgtaatccaaacggacatgaaaattattaaaaaaagataacagtatggagtatatatcactatatattctttatcggttataataatatgtaccattaaattagatttacaatataacaagaaacatgtcgtatctttgcgctttacatgtcatttgagaattataacaaaacgtgaaaaaacaatttaatgatatgggtaatatcatcacataaatatgcttactatgtagggtgcactctatttggcccaaatcagttcacaaatatgcgcgactgaattagatttacaatatcaacaagtagcaagtcacatccggggccttgcatggcaatcaagaattatgacaaatcatgacaaaaaataacaatatggattatatgatcatataaatatacttatcatgtggattccaatctattcggactatacggggataatctaaaatgtcaattcaatttaccaaatcatgtataagttgtacgttttgtagactacaccctaaatattaagtaaaataacggatggagtacacgtcgtgttttctcccctttgatttctattaaatacgtatggtgtgtgggtattttgtatatactaagtttggttaattagggaacataaacaatactaaagttatatatgagaattcatgcattaaaaatacacttcataacaagaacttacttaacaaaaatgtactttagtctatggtgcttaaatatttataaattctctaaacatactaattatttctgctcttatttcaaactaaattcattttctctacataatataagagatcatatgagaaaaaaaagaggagggagaagaagtaaatagaagtctgccattgaacagatagaataaagacatctataacatacaagaaaatttgttgattaaggtttataaactccaaatgtaagatatgctaatttctaaaaaacacacacacatggtacacataatagttccatatgaagcaacactattgttgtgaaacaatagtttctcataaattaaaaaccacatggtttaaataaatttgatttagaatttatatgttgaaaggtaattagaagaaaattaaaagcgacattcacaacaatctcaaataaattattgataaaaaacatgttcagaatagagtaaaaaaatattttaagaaatactcatccacacataagtattcataattaacattaaataaggtgtcccgcgcatatgcgcgggctacctttctagttgttgtaaaaactttattaataaacatttatctgaatactttttaaatcattttccaaaacttactattatttcattaatttggttgtgccctttaataattttgtcacaaactcaattttagtctccgcttaaaaaaaacacaacctagaaaatgtatacagttagggggcggaccttggtttgagccaggccccacaccagcacaccggataatcggatattgggccaaagagaaattaaaattacatgggtgaaactgcatgtatctacacgagctttgatgcccagatcagaggcctgcgcattcccttgtatgctgatgaattctaggatatcggcaagggaaaacattattgttttcttaatttttagtcttaaaatgaataggtcctgagatctcccgcagacatgcactgatgttccaagttcccgtctagcattgcccagttggcccaatctgaaattccccgatgactctcacgcttaattaaataaatatatatacatgcacgcatggtcacaggctattagcttagcttgctctttattagtacaatatatatgtttcgttactctttctagcttgcataatctggggtttctcttgagcagacaagaagagatcgtcgttaaagtagtgtagctgcgtatatatagacaaggagaacagtagtcgactagctgccctggggtctgatcgagttctcaattcaattattatattgtattactccatccgttacatcgtatcatattataagtcgtttgatttttttctagtcacatttgtttaagcttaaccaggttcatagaaaaattagcaacatataaaacaccgaacttgttttattaaatctaacattgaataccttttgataatgtgtttgttttgcgttaaaaataataatatatttttctacgaacttgatcaaacctaaaaaaatttgattaggaaaatagtcaaacggcttatcgcatgaaacggatggagtaatttttttttatatataggaattattattgtagtactaaatacacacatgtatgttgtaaatagttaattagtgtgagtgaaacatgtcagatgaattcagttcatcctcttctctgcttttgtttcacattttgtatctttcactgaaaagtaaatacgttttgccctggaattaatgtgcatactcattcgttccatagcagttacacagtaaaaacaaaacaagcaaatttgaattctagttccaagccaaatttatcatcttaattgatccacagaagtccctgaatgacatattgcgcaatcagacgatcggatgttgagagtctgtcctgattgttgggtttagtctcaccttggtaattgatgatgggggagcacgacttaaaaggtgggggcagtcctcacccatcagactagtcttttgagttgtataggttcaggagttaaagttgtgactctggttggacctgtggtgaagcaggcccaacgtgacttgagtggtccacggtttgtgggccgggctgcgcacttctaacactcatgaggtagccgtttctcatctcgccgtaagagtgatctaaatttatctagcacgaatgatccagggtgtgtttcagcaataaagctgaaattccctgatgcttctcatgcttaattacattaattcatccatgcacgtaaacacaggcttatatagctagctctctctcgtttataattacctctcatatagctattttcctatgttatggagaaatcgttcaaataatcgtagaaggaagaaagctgtttttctagtatgttctaagctagcatgcatctagtgtatgttgatcgcacagacaagatgtgaggcagaactcaagtgtatgtgtctgtatatataagcaaggagagcatgccgtcccactcattattagccctgtggatcgcactaaacatacaggagtagtactctgtcaagaaaaaaaatcgtagctataaatttggacacgtatatgtccagcttcatgattagaattaggtttttaatgtaatggaggtggttatttgctacttcctccgtttcatattataagactttctagcattgttcacatttatatatatgttaatgttatacgagcattattggattagccaattaattgagagcgtaccttgtctatacttccatcctatctagtgtactggccttgcacattccaaccaatactatagaactcgacaaattaataatatctctacacaaaaagaactcgacaaattaattcgtccgggttaataaaggggagatgagaatttgtcccatcacattattttttattttgatttatttttatctttattttttttgttattttaataaatttatggctgtgttttttacgacagaagatggagatgtaacctatttctattacccacataattagttagtcctgtagaactacttcaatttttgcaatcgctacaaaactcaattggttgagcgtttcccttgcaggaaaaatagtcaggcattttttaagaaacaaaatagtaggaattcaagtcgtacaggcgctggtatgtttgagtggaaaatgtgagatgaattcagttcatcgtcttctctatttctgttctattgttaaattccaaaggaaacaagtggaaagcaatgggtcgttgattcacgagtattaacaatacagatgcaaattacttctaaacgagttaatggcatattcttttttttttgcggggaagttaattgtacattcagcgagcttaaatactgacatcgatttaatggacaaaatttcaaaatccgcacaattgtaatacatttttaatttttcgaaagatctataaacactatacttg

SEQ ID NO: 45806 - DNA, 5351 bp, Oryza sativa
attttgaagcagtgccgcactgtcttgcaggacaaaatttgaggcgtgcataaaagagaccgggctaccgttacagaaatggaactcctagctagccaaccgagaaacacaaagaatctaaacaaagcggaattgttgggggatcggctttgccctcctccgctctagaaaacgggcctccctttctctgaagaaggctctaaattcgaaggaagcttagaaggggcctccagaaacgatggaggccagctgggtggcctcttcctcgaggaggctctgtcggaggaggccctcagctgagtattcatggtgagaagatgggttattaagggcacatttaatgcccacaactatctgccgctctctcgtaggaagcccgcagctaagcattcatggcgagaagatgggccattaagggcacattcaatgcccacaactatctgccgatacactcgtggtgggagcaggtagggtggatgtcaaggcgcctcgatcatgtagcatgcctcagcatcgagctgttcatcccaggattcacggtttaattgaggcaaccattttttttggccctcataggattttacctttttgccccttgggctaagaccacttgtcagcctcttagtacgtagtaggcggaggcctggggtacccttgtaacttttcatacgatccatgggactatacaattgtaattcatttcccaaagggagcaggagcaaaagtaatccagaaaacacacgatccactattgattcatgttggattattctatttcaacattgacatcatctatggggatcggacaatattatttttatgaacacgaagtcgaccgctcgagagagaatggctccgaaaagataggctactagtgccgcaacacagcaccctaggagggcagcctgtcacctagcccggttgaggcacccggtgctcgctacctttggtgaagtcgctccacaacgacgacagcgcaaccggcggtagtgaaacaaacgtggggcagggctcggccctgccctgcgagcaggatgaggggccagtcccaccacccatccctgctgacttggctgcagccatccagtctcagctggatgatattgcagtcaaaagccatcgggtcgacacatgtgccgaaggactcgtcacctctaaattcctgatgtctccaagtcccaaatatccattgctatggcatgaagctctgaaggtgaagtgtgttttcctacctatggccatcttatcttcttggttgatggagtggccctggttgtcactctgcctgccaaatatatagtgtacccattattgatgaataatgttgatatttactgcgtaccaaactcttagtcagcaaaggtacaacaaattgatccatcatcatgagcagtagttggttaatcatgattcagaatgaataaatgtcacatttaggttctgatatgggttatcacgagcctatgctttccaaatttttaaacggtgtcatttctttttttaaaaaaaaaaagctttctatatataaatttgatagaattctcttttaagataacattttaaatttgtaatagtcgttaatttattcattcgtagtatcaaatattagcacaaaactagttaatccatcatccatttagcactgtttgaactgggccttaaccatggagtctagaacgatcggactgtcaagcatgcatgttacagttacactgttcagtaaacagtgagaacgctgatgtagctgagagtgaaaaattaatgagggatgagttcatcctcttctctcttctaaattctgttttcaaatgacaaagggaaagcaatggttaatctgttgccaattctctacgtaataatataattcagatacatcctgacagcggttttatttaggggccaaagttttattcagcgcaaagcgaggatgcaggtacaagtatataaacggctaaataaatttcttaaatttgccagatgaaatggcaaattaatactccaagtgacagatcgctgttaaacaaacaatgcacattgaagtcggtcgcggagagttcgttctaaaaacgtaacttggtaaggtggtggttcacccaaagcagcgtgttagcaaacatagaacagctaggggcctaagggttaatcctatgtttgtctccaaaattacgtataaattatcttaaatcatcatgtaatattttagaagcaaaatcaataatctgttagttgagtcccagattagctctaatctttagcagattctggctctgtcactggttaaaagtacagaggatcttgctaacaccattgttccagtaacttttgagtataacagtaaagtcccgcactgatgctcctcattcttgtctagatttgcccagtcggcccaaactgaaatttcccgatgtctctcatgcttaattacataatagttacatgtatgtttttgttactctttcaagctcgagccgcatgcatctggggtttctcttgagcagagaagaagagatcatgaaagtagtgtagctgtgtatatatagacaagaagaacactagttgatcactagcaagggtggatccagcgtgggtgttggagggactcaagtccccctatcccgctggatcaccattgatagaaggagagagaaaggggggaagaagagggagaagaggaagagtagggggactaaacaaagaagaaggaaatgaattcaccctttaatattgttctggatccatgcccatgattacctgttattgggtttaagttctcaatccatattattattgtagttatggccgtaaagaattaataggagtaagtgtcaatggtacaagactagttaataaagggcatgtgaccatgcatgtgtgcttaactttgggatagtggtacgaaaaagacatgtttttttcttttacgtttgtaaattcttaatcttgaatctaccgattaaccgagaaccatccaacatatatgcctgtacgtacgttcaacttttaaagagaacaagctgaaaatgtataattttacaagctacaaattaatcaagtttattagttcagtgcactatttcacaactttgtgtaaaattttgaggcctccttttgaatggagtattttagagaaatttaatttaatagtattaaaataattgcaacagaaatcctataattttctaatgtttcaaaggagcccttataccagggaacactaaagttcaagtgtcctaataataatccaacatagaattcctactctcctaataaccatacaagaagaaacaaattaactaattacccctcgaaattcctgactattccgaacttatttttatcgataggcatttctatcattctcctcgttttctctcccatattaatgaagggcatagtagactttcatcctcttgcttaatttgtctttaactaactaaaacaacagtcttttagggatggtgcggagtatgagttttgttccttcataattttctcatctttgagtggcttatgctagaacgggggcatctcctgccgatccaagagtgagtgagagagatgcatatttccatgattacaagagatcgagaagcaatccggtataggagcaagttggcacatagctatatatgcagttgtcatccaagccttctccccatctgaaatgtgatacttgcacatagtactgtagcatagagctggagtaaagaaaaagaaacaaaaattaggagcttatacaacagaaaacaaatctaggaaaaggttacttgcgtgagaaaaaggaattaatgtgtgacctctaaatttccgatgcctctaagtcccatatcgtatgtacacaaaatggacgagcatccaggcagagaacgacacattatattgtgttttgctctagctactagcttaattattggtatcttatattcttatttgttgacgatggaagagaggcgaaattaagcatcatctcatctgcagatatacacataggtagtggctcttgatggcacactgcctgacttagtgactttttccaccatgtgcaataattatgattctgaattactccctccgtacttgtaaaggaagtcgtttaggatagcgacacggtctccaaaacacaactttaacttcttgtttctataaaaatatttatttaaaagtgatatatgtatatttttatgaaagtatttttcaagacaaatctattcatataacttttaccttttcaaactcaataacttgagagttatttatgatttatattcttaaggtttgacttaaacattgtcctaaacaacttcctttacaagtatggagggagtacttccccgttgcaacaattaaacccggcttcatttctgagaataaagaccagatttgatagtagctacggagtagtaataacgacatgtaattgatgcatcaaccgattcacacggtacattaaccagtagaattttgtaaattgaaggcacagatcctcaatcactacttaaacaagaattcaccagattaactaagccagttgaactaattcaattttgccaatgcctgctaaaccgcttctgtaattttttcttatgttttaacaagacacattggctacaacattgtgtagtaattcgcattcagggccgcacatgctcgcggttacatatggagtatcaaaattcacttggcttaattactaactctgataactgtgcataaggcactgagatcggctaatcagatggcattgagatcctgagccgtcggtactaggtacctcgcagttctgggagtgaaaacgattgtgattcagtagaaagaagttcatgtccagcaggggtaagttcagacgcctaaaattgaaaactcctgatgtctctcatgcttgactctgcataaatatgaagtagcatcgatctgatcaggtacttgtcgatacatatattcttcaagagaacagagctaagagatgagagcactatattcttcggaagaaatcagatcgagctatatatatagtccctactggtactcccaattcaattaattatcacgatatatatatgcacatttatgcgattacctaatcgtacatgcagtgataatggtccttacattttaatctggtcgcatcgatttgaagatatacggacagaaacatttcctggaccaaacaaagatgtcctcaattagtagcactaatggcaacctgatctgatctgactaacttcatgaaaaagagtaaagagtaacgtgaactctatgcattttgccctagcttcttaataacttgcactccctccgttttttaatagatgacgccgttgattttttctcacatgtttgaccattcgtca

SEQ ID NO: 45807 - DNA, 6534 bp, Oryza sativa
ttgaataagacgaatggtcaaacatgtgagaaaaagtcaacggcgtcatctattaaaaaatggaggtagtaataagctaagattatcttctcttggaacgtaacgttgcaggtaactatagagagaagtagaaactagctggtcaattgctagctagcttaacatgtcaggtgcgatgccgaccaattgtcagcaaatattccggaacaagtctcagaaaagtgcacatatttgggatcgactgctcaactcactgatcccaaatgacgagtctcttccagctatatagacgatttatgtgttgttcctctacatctgaatcatatgcactggaaccagcgctgtgagaggcacggaagcagaacagtttgctcaaggattttaccgtggctcatcagatatgcagccactgaacattcatattccccttgtctctcatacctaacagtttatagcttctttgcacaggccgatcgatgtagtttaaacagccacaataatatgaatttgtctgaaactctgtagtctgtacacataaacatatggagtactatatctttatgatggcacaacgcttgctagcttgaagactaagctggtggcaaacgtcaagcctatatatttgcgactgatttgtattgattgtgcagggttattttgtaaaacattttctagtttaattattttttaattggaaatctatattcatgtacatgcacaatggattattccagcctatatatacataaagttggtgtgtaatcaaggaaagtgcattgattatttttgctagaaatttcatttgtgtgtagtaccattttttgtctatataaagccagcatgactcagactcatgactctagcctactctactgccagcgcttgctatcgtccgggtagtcttggtcttagccattttttgtgttttctttcatgtacttagagccaccagatttgttttattggaggtagatgatataattggcttgggaggcattggtaacatgagaagtattgggtagatagagagaagcctggcatcaattttattaggaaggaaatatgaacatactctctagtattgggaacataggatcaagccagcacaacaaatctgtccatgaattgctgaccatgcagtaggtaacatggaagaactatctactgcgaacaggcgaacggcgatgggtacatcttcgtcaacgatcttcagccagggaagtaaatatcacgctgaagggttaatttgatccatgtcactctaaatttgccgatttgaaaaaatgtcactattatttgtgatatcggctgagtgccattgggtacgagtccgggtcaggtaacggctaggttggcctgtggaatctttcacaactgaagatgcccgctcctgatcaagttacaagagacagagcagcgacgaccgaactattgtcataccggagggaacaaaaacggaattttgtaaaattgaaaccatgtcattgccgtcacatttttttttatcttcttccttcttctcttttcttcttctccccgtcagcaaactctttgatgcggcggcgcacaggcggcatgggcggcagtgtcgatgcccagatcgggacggactagggcagtgcacatcgagcatggtcgtcgtccggtccttaggtggatcgaggcagtgcagtatgacgacgggctcctacattcttcggaggcggtggggctggcaaggtctataacgacgcagatcaaaggctgacggggccagcaagctccatgctccgcccgctgtcttcagggccggctctacaattttgagggccctagggcaaacttgacaacatgatccttaacgctctctcccctatagagagacgtgttatatgtatattcacattttttgggttgttcagattaatgtcattttgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggacagcaaccgtgctgatctccgcccattcaagagaaaaagaacagtccagtttggaaagagaagggtgcatgtggtatccccttgaagtataaaaggaggaccttgcccatagagagggggttggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttcccttgttctgcctaatggccgagcaagcgaaggcgcacgacctctctccgagtgtgagcggcgacgacggggagccaaacccacgccgtcgagctcgtactcccccacctccacaccaaagtcctaagcagggggaggcgctcgagagggttgataaatccgcagcatcaccggtcgcgggtgatgcaggagaacggcgagatggggagcgacgcctcctcgtctacggcgacggcagcacgcctcagggcgcgcttcaggctgctggcgcgctcctacgtcacccgcccgtcgtccatgaccctgagtctccagctcagcgatggctggacaacgtggccaacttggtcatgacggcccagcagcgcctgggtgctggtggacggtccgccaccaccaagacctccggcgccgccaccaccggttccgtgtcatcaaggcggagggcgcggcgagcggcggcggctgcacgtcattcggctgccactccctcgtcgacaccttcgactcgggaggatcagcatggggagccggatgcccgcctcaacatcgagcgccggcgtaatagccgacgtactccccgtgcaacggagggcgcctcctcgtccagagtgtcacctcgacatggacgtgaggaccagccctccgtgcccccggctggtggtatcggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacttgccacccgcgtcggtccactcctgggaggatttgtgccaacagttcaccatgaactttcaaggcacatatccgcgcccaggtgaagaagcggacttacacgcggtacagcgaagggatgatgagtcacttcgctcgtatattcagcggttctgtcaagtccgcaacaccataccatgcatccctgcacacgcggtgatctacgcgttcagggggggtgtgcggcacaaccgcatgctcgaaaagattgcctccaaagagccccagactaccgcggagctttttcagcttgcggatcgagtggctcgtaaggaggaggcatggacctggaacccctccggtcccggagtggcagcttcggccgcccccggatccgctgctcagacagggcggcgggacaggaggaggaagaagaggtcggcccattccgacgacgagggtcatgtcctcgccgtcgagggcgtttcgctggccacccgaaaggggaggtctgcgagcgacagaaagaaggccggcgctccttgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaaactctcaccaatgtgggagggtccgtatcgagtgatcggcgtcccccggccgggctccgttcggctggccacgggcgacggcacagagctgcctaacccgtggaacatcaaacaccttcgtcgcttctacccctagtgggggtcgggtgtcaggtttcgggctcgggccaaccccgcacccccccgggcgtgcagggttggccgggggcttatcttttttctcttccgtatttcaacaaaagcattttcgatttcctaaaggctgtgtctgtgcttttgtttcctttttgaagaatcttgacttgaaataggtcactcgtgctcaaccttgccctcgggggctcggttcggtcagctaaaatcgccaaacggggcccagaaccgagccgtgccccggggcgtggtgaactccgagggggaatcggcaaaaacccacaatcgggtcacccataaccctcggtcaccacgttcccggcctggccagtctcgacatgtggatctccccaggcactagccccgacccgagccatttgaggactaggacctgggcacgagcccttgatcaagccaagacacagaaggaccgcggcacagaccatcctcgtctcatacacacaacaaatagaattgacatagaaatttcctctttatttggttgcagattaaattagtctatacaagaagggggcccgaaggcctcggaagaagaaagaaaaagctattcaagattggcgggggcctgggggctcactccgacgcgcccgggtcaccagccttgtcgtcgttatcgtccgcaccaccgtcgccgccctcctcgtcggagtcgagggcgaacgcgagccgaggggccgtaccctcgaagctgtgaacgatgtggtcggcggcgtcccggacctgcgcgcgtgcgccgtcctcggttccgaaagggaactcttccagcgctgcccacggggagaagtcagggtccgagaggcccccaagccgaacggcggcccaaggcccccgacggccagagttggccctccgcctgcttgtccgacggtgtcaggcgcccccgaccctcaggatagcctcggggccactgcgggaaggccgcgcctgtcgccctcttaccccgaggatatcggcgcagaagccgagggcgccccgcgctgcctctcggatgaagagcgccctggagatgcggcccctagcgaagaggatcggccccgccgaaaggtgcagcggcccgtctactttgttagtgaggccctccgggacgccaaaacccgataccctcgggcccagaagatgctatacgctattctgatggctccgagaaaagcaccatcaccatatctccaggcgaagcaaatcggctcgcccagattcgtgcgctgctcaggtaatgtggcagtcttgaagagaccgcccattatggacagccaagtcaccattaccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggtcgggttgcgcttgccccggccccgagggccgaggcaccccgaccccttaaggaagtctgcgccacatatatgggataagtgagcacagctgtgctcacctaacagcatttattgcagtctggtcagcgtgtcacgctgcatgcaacgcagtacagcgcgttcctttatccggtctgt

SEQ ID NO: 45808 - DNA, 6110 bp, Oryza sativa
agagaaaaagaacagtccagtttggaaagagaagggtgcatgtggtatccccttgaagtataaaaggaggaccttgcccatagagagggggttggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcacattttaaaccatatcaatttttgataaagttgttaaagatgtgcatccatttagtttttttaccaaactttagtaaatacataagaaatcctgctaaaactaggcaatatcactaaattgtaaaaattttggtattgccaaaatttggtaagatttattttggctacaatatgaacagccccttcattttcaaagtgtgttttcaaatctaatcatagagagaaatgaacattgataatatttcatatatatgtttttagaaatagaaaaatatcaacacttaaactgatcttgtttatttttcccatttacttagcaccataaaaatgcttcttgagtaaaattacaacttatcagcacctaaaattataaaggaaatatatattatcaacaagaatctatctatacatacaattttgattgttgaatatagaatctttattaattcactaatcagtattatatagatactagtagataatcagaagtggtagatagtatgtaattattcactaatcttaaaataatactttggctcatacagtactcatacaattttaggcatgggcccctagctaggacgggccctaggccgtcaccctcattgccatgccccagagccgggcctggctgtcttctttcaatggccgccgctgctaggagctccacgccatgggtgaggtgatgggggagggaggaagcactagggatggccttcctggctccagcgatggcctcggacgagggaggatggaaaaaaaaaaggaagaagatggaaaatgtgatggtgttgatatgattattatttttttttttcgggggtgatgatatgttttcaattttgcaaaatttcaatgcaggatgacagtacgtttgttattagctagttggccaatgtttcgtaatccaaagttacaattcccaatcaaaacacaaaattagaattcgtcaaactagttaatcccactaaagtgttcaattgtcggtacaaaacgatattttcatttaacaagctaagctagcacataatatatacattgtgcaaaaataagcatttcgacatgcccgtgttcattgagatagttgcaccaaacgagatcaagtagtctggtttatagcaagtatgtcacaactagatcctaagaaattattggcgagctacaccagtcgaggagggaaaacaaataatgcaggacaaacgtgtctatctgcatcaccgatgctttcatttctgttcgtgcgtagctcttcatcatcgcaaaactgaaaactcctgacgtctctcatgcttaactgtgcatatctgcttgagcttagctcgatcttggcactagtatgtattcatggagtatcatctcaagcgtgcagacacatgtagatatctctcacagaacagagctatgtatatgcaggctatatatggtgcatcctgtgatatatatgtacatttattcgattacctaatcatgtgctacggtgcatcctgtgatttatcgggacatgcatgtacatttatgtgagaaaaattttggggaaaatatatctgaattgcataaatcatggatccaatcatctaataaccaatcgaccctaactgatgtactaatttaaagcaacagtcagttatcaaaagtactttccaagctaccagtaatatgtgaccacctcagtgtcatgtctcatcccttgtagaacaccaggcaccaatttgatttcttccatgttgcctgagctatgcacccaaaattcctctgagagactaatctggtttttatttctcttagaaagatgtgattttttttgtgggcaggaatttaggaaagaaattaatgatcatggatcacacaatgaggtcatagtggagtgctgcacttggtcaaaacaattgggagaattgatattcatacaaatataaacaccgtagttttggtcaggcacttgatccatgatctgcaggatttgttaattagatcaaccgatcgtttttagtgatctcatacgatctcatgctttcatctgtatagattgcatacatgtcattctagaacttcacaccgtctcgtgcaagtcgttcaaaaaaaatatacatgtcattccacaaccattagtaccagctcccggggcaagagtaatgatgcaagaggcatggaagcagaatggtttgcatgaagataacgtggaatctagttatatttgcaggagagggacaatcatcttcccggtgcctcccagatctagctagtaactaagcttcgttttttagacacaatggtaactagcttcattgcacaggccgatcaatgtagtatatataaaaagcttcatgagcctaaaattatagctatggcgtacagtgatggagtaaaacacaaacttactattacttcgaattcaagatgaagaatctatatagcatgggaaagaaatttaagttgtacattagaattcaaagtgttttttaattgtagattagatttttccgagcccagtcgtaaaacaatactaaaaatatcttaaaaaaaagtatcaaattctaacacttggaaacaaacttcaaattataatctttagctgaaccaagcgggctcaagctcttaattgctaaaaaaattataagatgattaaggaataaaaacttattgaagcactaactaattagaaggcgtttatgtggcgtgaaatcgttacttgataagaacatagctcacgctcattcgcttgcgtcttgcattgcacgtcgaccgagcatccaagccaagttgtttaatttctttgcttgcttatcagctggctatcacaaaggctcaaaacttcctaataatcactgtttaatttgactaaagccggtaaggaccacagaccactgactccgtgaggtacgcaagctccgtcaggacgtgaagcgctcctcctcgcggtcgagctagcgtcgtcgttgcctcaccaacagatgtcattcagccatggcaggtcggcagctcaacggcgatgtagaagactgaggtgtatgggggtattggtgtcaagggacagctatggcggccgccacagcatgccacaagggagggtccgcccctgtctgaaactctgcatgttatgtttatctccatgtatggcactacacggtgtctagcttcaagcctatatatataaagccggtgtgaaaacctatatgtacagtacatttatttcatccatggcggatatagattttcatccctcaaggggatgtcccctcgttgcttgcttgaaaaaaaaattgataacatagattaataagaaatatatcactccacaacatgcaaggccaaattagacttttacaagttacaaccaaagaaacaaattaaactggaaatagttatcatacactcgcagttatatttgtattttttttgttacagcttgtaaaggttgaattttaacctgcgtgtttgtggaatgatacatttcatattaatctattttatcaatttattttaaatttttttatgactatttagatgacatgtatgaaacaagagaatatctcctcgagggatgaatacactttcccatccatggcactctatatatatcttctaaaatgtgggatactaaggagctagggactcagtaccaatgtagcttgagccagttatatttctatcaaattttggtgaaataatattgggaagaagtagagcatggtcaaaaagatttagtctactgatttagtgagaaaatggggatgaacttgaggactgaacaaggcaaactgacacacctgtgcttctccacgaaccgtccgatgtacaagcagcggtctagattgatcaggagccaaggtggcaactttccacgatgcacgattaatttttaagaagtgaacaagtagatccaagaccgtccaaaatcgggtcgcttcttaccgttagatgggacataaacggttaggatgttaaatcattttacataagagcccttcaattgcagtcaatgcatgcagctactcccttcattccaaaatgtttgacgccgttgattttttaaaaaatgtttaaccattcgtcttattaaaaaaatttaagcaattattaattctttttctatcatttgatttattgttaaatatacttttatgtatacatatagtttatatacatatagttttacacatttcataaaagtttttgaataagacgaacggtcaaacatgtttaaaaaaatcaacggcgtcaaacatttagggaatgagggagtatttgtcaacccgtgtgggtacctcatgctaccctaaatagcctccagtgtcattatataattttctcttacaaatactccgtatttggtattggtaacaaaccaaacatactttacctatgtctgccttaccaaatatcagcaatagtaaaatttggcactacttgttttttcgcgaacgcgcaaaaggattacacatcaatatattagacgaaatcagaatataacctgccaagcctatataaagcatatgtctgcatgtgcatgaaaactctatgtagcctgcctcaagtgattatactcaagtctgccctgccctaagatcagttaatttcctgatccattacattctcatgaagagatgtacaccagtatatgaattgatatggatccataagcctatgactatgaattgatatggatcccatatcagtcttccggattttcctcttggatgaaaaagaatacaataggcttgggaggcatcgcgaatttgaagttaatagtactacttgaggaagagcaagttactgaatgatttagagctcttctggttgctgctcttgctgggatcattctgcctggagcaaagccggagaggtatgcgtgtgggttgtttgattgccaccctaaatttctccctggctcaggcaactcaatcatgttccagccaccacaaagtgacaccaaactcactcaagcatcaagtagatggaagattatttttgtgatgaacccaaaaaacaaatgtgtgatttgaactagtttcagtttattgtaccaaaacatgtaaaggcttaggtattgaatcaataattacaatagactgatcacaaagacaatcatgagaattgatgatggaggatatatttgttcttttgagacatgcatggtttttcagagtgctgccaatctggttactactcctttagatgagatcgcttattgttatttaaccttcagatgagatcagacattgtcattatcaaatctcattggtgtactccatctgttccagcatatacagggtttatgtgattaaattgtccgatcccatcagcatacgcggttttcttaattggctatagtactggtgtcatttaggagtatttacacgaacgaacaattagtatagcacatttagtttaacttcaattatcaaatcacagtatctccccgagtttcccatattggaatcacccttaataactgtatgataaaggcagacagactgggactaaccagttttttttttttgtggactgggacacccttattaagcattatacatgaaacaagtgtaatttcagttagttcttttgtaaatatcaaattaaaaaactcccactttgtttggaaagtctgcctgatctcatcctccagttgaatgcctgaatgtgcccactgaactttcttcagttcattttcatcagtcagtcacctttttctcactactgtacacgccaacttaaatactggccagcattcatgctca

SEQ ID NO: 45809 - DNA, 32592 bp, Oryza sativa
  unsure (1)..(32592): unsure at all n locations
cagaatgctcccaaatctcaatgtctcattggtcctcctctgaaaactcaccttcctgattaccatggtcttctcatggatatatgtattggcatgtgagaatttctctatgtatgtctactagaacgtctcttgatttttgtgcttccatagcataataataggcctaggaggtgtcaggagcgtcttaggttttaccctttctttgctagctacgatcaggggtttgtacagttgttcgatgtacatggaatttccttggaatattcttttgctagtatggcggcatctaatccaaattgcgctctctagagttgaagctggtagaaatacatcagtacgagacaagatgaaagtgtgccgatcgaaaagaactgggagctcagagtagatggatcaaaacacggatccttcgtcgctggcagccgtcaccggagaattaggaggaggatgaggcaaaggcagcaatgctcgctttcgggagaaagcatcggaggtgttgtgaaatgtgaaagttctaagcctcacattgataatggtttaatcaaacctaagcaataggaaagaacataagattagaaagtctaattatttgcaattttagcaccaaccacgcagcaggcgcagaagattgcttattaatttttctttttttacattatgatcgcttattaattatgaggtgatattgtcaggcctcctcgagaactaaaaacagccatgttaataggctaatagccaccataaagctcactctgtgactatgtggcctctctgtttcgcctatatgaagtctagatgattacagtacatatatgctagtctgctcgcaatgctcacattcgtctccttagccttgctcggtctgcctctagatcaaacttttgccgtttcttttacttgcatatgttttgcatcaccatacaagatatgttttatgtgcatatcatagtgggcttgggaggggtcgagaatgaattcagacagtggaggcggttcagcatcaaattattatgcacatgtgcacaaaacatatgcctaggtttcagaaataaacaaggaattggtaagaacaatatgaaccttgcagcaattgagggttctggtgaaaccgatggagacgacaaggctggagtgcttgatctcatcgctgcttgatgttattgggagttttcacccccaagtaggcgttggctgatggtgaacaagttggtgacctgaaggaagcttgatcgtagtgttgcttcttcagttcggcgttttgtttcagtactgttatctgttagctagatgtttggatgcagtcctgagatcttgtcatctggttggcctgcatacccattgttgcgtgaaatttaagctggttcccagcaacaattctatattgctttcagtcaaaagcagagcgtaaaagccttttttctaaaaacaaaaaaaattgatccttggcaaacagaaagtttatcgaagatcggatagatatactagaggttccattttttagtgaaaaacctagaatcgctaaagggaagttaatgaagatatatattttttttagaataagatgaagatgacatttttgtgtcgctaaacttttcagtaaactttgttttgtgtggcttcaaccaattaataaaaggtgagcaaatccaatactagagatacactaataaagttcttcaacttcttgatgtcatgaaagagattagacattcagagtctgatactttgtttcagacagacagttcaggattggcatccctttttctttcagaaactttgtattactttgctcagagtcctacattatgcagattatttttcttaagttcaatccaaatgcctgaatgcgtttgcttaaatccaacttattcattcatcagcaacagcatgtgcaaataattaggcatttaccattccaagtactatacagtttgcagacactgaatatcactttggtcagaattcatgtgcagtgatgtactcccttatcacaaatattagcaaaatatatgtatgctccatccattttggaatctataaaatctcaatgtctgctctcaatgatggacatctcacaagccctgctcccagtgccacttgtctcagtatgctacacatcgatgtatttcttcgaaaatatgcaataggcttgggaggcatcaggaatggatgatgctgcaatactgtatcttttcaagttattttacatatccgcacgccaactcggatcagctgcagtcaaacatcaaaaaggttgcattttgtatcagctttgttgattcagggccatatcaacttgttcatgcgagtctgactgtgagacagcggttcgactgctgcaatcaaagaaaaaggatcactctcctctggcctacatcatcagcggagcgaaggatctcatattgggagtgagaacttattgtgacaaagattcacaggccccaaaatggtgttagtcatttgttagctaatacagctaggtatgagtctgtttcagacttttggttggaggaaaattgtaatctaatctcacatttaagtatgtgagggcatttcttatgagtaatatattcccccttcccgcaaaaaaaagaaaaaaaagaaaaaagaaggttcatgcggccacaagttgaacagaggtgttacttgtattgaagccttggccgggctgctccagggagaaggaagccaacttttcaaaacaacatgtcatgtcgggatttcctgtggtttctaatttaaaaaggtagcccagaattgaatctccatttgtgatacagttcagttcaatcatcagagactcccagcccatgtgactaatcgttgacgatcatatttaacacagaaatatcagcagtacctcgtttcctgcattttcaacttcaactaatgaatttgaggtgaccgcgtcaggacatgcagaaattagattgtaaaatgtttgacaaggtttggtacatatgcatatccgtgtattaaccagctgacataattctccagatggaagacaatgcatcacgtttcaaacacccaacccacattgctgccacagaagcatatagaatcttggtaatacacatattcgtttaccttgagagtttcttttcccatccttgcaaggggcgttacatcttacgacacaaaatttgagcataatgctcagaggtgtacacggatggaatactcatttgctcttcttgacctatatggtacaacacaagacacatatcaggtaaagctttatcctatcaacacctacaaaactgtctggcctgtagtcactctgatacagttcagtctcacagtaactcattgccagaaatctctttgaagcgtgtagccattttgtaaagatctcagctctcgtcgtcttcgtctatgctggagagcaagctcttcagggtctcataggtcatgaaggcaatccctacactaggaacaaccttcaggtactcagggactatccctctgtagaagccacgaaggccttccttctgaaagatttggcggatggttccagttatgcttgatttacagactgacgatgtcccagctgccccttgcagttgcattcgtctctttacaagatcaaggggaaatgtggctgcaatatttatagcattttaccaatggaaatgctgtgagtcagtattcagatgacagaagtcatggtgttctttattcaataaagttttacaaaaataagaagaaaggttaagaggagttaaacatggcttaccagtagatgatgcaataccagatagactcccagaaaacaaactaacaactgcaggggaatcttggggcctgaagcacgtccacagccatcagttggaaatgaccaaaatagatactcaaatattattcaaacgagagaaataatgatgtattgatgttcacctttccatttgccaatgagacctcaatgattcatatacagtaaagctgattgctatgctaggtccgactccctgtaacttcaaaaattacaggcagcccaacttaaaaattgacatatctcagtaaaaggttcatggcctaccaataatgtggccccaaggcccttgtacaatcctttgacaccctcatctctacaaatggtagacactgcatgaaagatgcctttgtaatacctggttgttttctgcacaaatttaagattaaatttctagtgaatgccaaatatgaagcctcccaatagttgaaataaagtaaaatacactaagcccgaagcctgcatcatacaaaaattaatattttggagatattaaagatgatgtttaaattcatcaataagcaatgttttatttggaaaaaggatagcattacctgtgttgccaaacgagtacggacaacatccaagggataagttacagatgcagcagtaattcctgccaaaccgccactaagtaaacgagcaacaccaacataatttgagtcttcatcaaggccaggaaccctttggagaaactgcaatgatatttcacatcatttagctaatgataataaaatgcagaacctcatcataattcatgcattaagtgctaacgaactgcttacttttttgtagcgctcatatgaataaaagctgatggcagaataaggtaaacgatgcacaattgtcaccagattgcctttccaaaatgctccaaatccttcttctcgaactattcgtgaagcttcatgccatatgctgtacttctttagagctgccacatctgaatgcatacctgccacctgtcagatcagtatgtcaagcacgtgcaataacaaaccttattcagtagttataatttaatctaataccaggcacagaacagaaataagtagctcgttattatgaagcaggaatcacaaggtttagacacatagttaagcataacaatgccatgcatcaactctgtatctagtaagagaataggggaactccatatggtatcgatttgctgcttttgatgcacgattggaccaactacctattgttgaccaattattttttatacaaagtgaggtgagaacactttatatcatgtatggaagtaatttgagcactaatcagtatgtacaacaaaaataccaaattagatcctttctggcacctttacagtgaacaaaggaatacttaaatgcgcaaaaaacaatatttataagaagctttttcttcagcgacacacgatggtatgttcctgcctctatacaaaccactggctgccatcacattgggaacctatttttttcctataaccctttgaacaataatagactgaaattaaagaaacaaaaggaatacttgccttctgttcctgttagatttcagtccctgctaactggaacgcctacaatggcatgaaaaggattgttccaaactgccgttagccttgtgcgggcacaaattgaggcacgtatataataagatttccataggtgcccaaatctccaaagttttctaacacgctaagaaaggaaaattattcttcagtgcgatattttgcatctaaagttgtcaacataataaatacaaattttaccggagaattgaactagtaagaaaatgtcaatacacgaaaactctgctgccgtttttagcttccattgacgactaacaatctaacagcaagatgcttcactatagtacctcactattacaattcaattcctttcaaggtgcttttgtgccaagcaataagtagcggtacagcgcttataaacaaagaaaagcttccctcaggcttacattttcaccagtcactactcactactggagtactcccaccgtttctgagtgacaaaagaagtcatatttgtcttatgctttctttactcccagttccttattagggcacacaggattccaaaacaacaacacatggtatgctgtactacaattgtactggtttcacccacaggaagagaaatccctatgtgttcaaaagggagactcctttatggtcaaatcatttattaaacacatgttaaagcaacacacaacaaggttattagtaacaaacgtcgtagctgctcgtgccaaccaatccctacatccaaaaaaaaaaaggaggggaggaaacatcttcctccccgaattccacttgcgagacaaggaaaattaacaaaattcgcctccgcagtagcagtagctcccaatcccctcctcctcctcgccgtatccagtacatccacccccaatactgcccgtacggacgaagagcgaaatctcaggcagggaaatgctggggggacgcgctcacctggaagaggatggtgaggcgggcgagtggggcggtgcaggtcttgctgacggcgccggcgaagcccccggcggcgaggtgggcgacggtgccgatgtggcggcggcccatggcggcgcggccgccgtcgacgacgaccccgacccgcgcctccgtctgcatgggattcggataggggtagggctagggttggaatcgaggcgaagcgaagcggctggtggtttcgccgccgcctggaggtgaggtgaggtgaggaattcgaagcagagagagagaggggggggggaaggttgggcgcgtagtgtcatccacctcctcacgtttgttttaccctaccttattttaataatgataattttttttccattattgtgtatgtagtacgagtaagtacatgtttatgtttttttaaaaaaaattttgtgatgtggcacaaatttgagtaaaaactgaaggaaaattttgagttaaacatataaaagatattttgtttgggtattgaaatttattttgtaatgcgtaatatgttgttttttttgggaaaaatataatgcaaatgtgcacgcttatggccctgtttgggggagcttatctcagctgcagctttttccaaaagctgcttctgctagaagctgccccaaacagtccacaacttttgagaatctgtagttatatattctgaaaaatgaactaagaagctagaacctggagaagctgggtttagaactttttcagatcagaagctggctaccaaacagctgcttctcagaatctaaagctcccccaaacaggccctatataggcacacgcagattgttcccaacaatcggcacacgcaaatgttatccatatgaacatcctcgagaaaatagactaagattggcaaagtcaagtcacaacaaatacctcactattgatcgtcattttgtttattactagaaaaataattaattgtaaatacgatcatctgttatgagtcggagactcaagcccacatgtaccaaaaggaatttaaccaacggagcgtttatgtcatgatcttcaaatctaaattgcattcatggagatatactctgtgtgaaccaaatgtcggagcaaaccaaattcggtatatcagtatatgtcgtttaaccttttctttgtacgttgaaatgacttgttggtgcaagctagtatcaaattgatgtagaaaatacgctaaactaaattaatcaagtgtgctgagagttcaccgaatttggcaagataaggtcatgtattgaggacatgtctagctattggctaagcaataattaatgaaaaatgaacacatcattataacttgtatatcttgtccaagttgcaatgtcatggattcatgaaaacagatgcagtaggaagaggataggcaacagcctgaaacaggaaaggaagcctgaaacagcttaggcatttggccgcccctagttttcttcagaaaaaccagctgaaaccttgccagatcatgcagcattgagcatggtcaatgtcacctgctagatagtgtcattgtcacttgcgacggacagagatgcttgacgattgtggattaattggcctcgttaataatgccattataaactctgaatatccaccatacttagttttgtcttgactttaagcaataataatatacttaaatcagtaagataaaagtatttacttttataaagatccttctgtgatttgataagacgttagcaactcgatcacacatgtcattatcaatatttttttcaaatctggattatcaatgattattcgcagaagtgttctctttcaggctagcaagctgtaagcctagcagcgattaagaatgtgactctgggcttctcgatggtacaagaggatcgatcagcccattttgaggcccaaaattcggagctactacgaatttggcccataagtagagaacggataataaagcagttgggccttcggaacgggatactggccaacatgcgggccagatctactctgggcctccgtggctccaagcgagggagcaacagtttccggcccacgatatccgaagcgatgggcctcccggacgtatggaacgttgggccttcactaaggcccaaagtttacaacgcgaacacaaagtccggtccataatccgacgaaggcctttataggacgcagatatttgggaggatcgctatcaattatagcgatctgtcattcttacatttaggtccctatctggatattaactttttacaatcaggtcctcgtcggcctcgtcatcgtcgtggatccatgggctactccgtaaccgcgaggtcgtcggccgctacgccaatccacccatgacttcttcatcgccctgcttccctcgcaagcatattccgatgatctcgccgtcatggagcgggatgccgccgccattttaggcgctcacggtggttgtcggggtctgggagtgggagtggacgacagttgggggcggtaagcagcaaggccacttcacggaggtagcggcgccggaggtggcaggccgaggtggaggcggaggcggaggagcggcggcgccggagatggaatcgagcctcgtgagtcgtcgtcgacggcggcggcggcgagagagacaccgagcccgtatcggtatcagatttaagttgggccggaatccgattccagcctatgtaaaacaaacgggtgaataatcaattaatcatattattcaaaatgtggccgattcaaatgtgaataatccgattccaaatgtggccgaaccaaacatattattcaaatccaattcggactacactaatcgattcctactacgaacggatgaattatcatggcgcgagttacaaatagctaagcgaagctattgttttattgttaggagagcttacaagggatcaaggtggtaataattaattaacacatccacgcacgtacgcgtaagtgtctcactcgtagggcaccatggtgaccacccggagcatggcagtgagggaaaagatgatgaagaggaagaggttgtcaccggtaccggcggcgatggagttggcgctttaccacgataacatcgtccacgtcgcctgccttgtggctgctacctcaccggagccaattgccgacctactcagtctacgtgctacatatgttaacttgttaatataaacttatttatatatgtatatggaaatactttgtatattgactgtgtgtgtattggtggtaaacacgtactgcagctgcaaggccatgcacgcggcggtcaaggagcgcgacgtcgggaaacgtgtgcgctggagaggctagataacatgaagtgggtggagaacgagcgctacctcgtcgccgcggacaacccggacacttgcttcatcatcggtgtcacgctcgtcttcgcacagcaggacatggcccagggccttttcctccttgacaaggctgccaccgcgggccacaagacagcggcctacgtgctcggcctcctcctctacaagtccgatgaggctcgcgccactgggaaaaagtacatcagccaagttgagggcgacggtgatgaggcggcgacgaccgatgccgggaacaagaggaccaaccaggagtgccgacggtgccgaaagatcgctgaggatgccgtccaggaggtgatgtggaaggtcgttaggaggcgtggccaattgctagtcctacctgaggacaaccaccagtgcacaaccatcggttgtggtctggagttgggatgggaaggctacgaaggcttttgcagtgacagttgtaggattaagcatgaatactccaagttcttcacagaggtgatgaactacttgccatagttcccaaacaaccaccagttgtggtctggagttgggatgggaaggctacgaaggcttttgcagtgacggctgtaggattaagcatgaatactccaagttcttcacagaggtgatgaactacttgccatagttcccaaacaaccaccagttgtggtctggagttgggatgggaaggctacgaaggcttttgcagtgacggctgtaggattaagcatgaatactccaagttcttcacagaggtgatgaactacttgccatagttcccaaacaaccaccagttgtggtctggagttgggatgggaaggctacgaaggcttttgcagtgacggctgtaggattaagcatgaatactccaagttcttcacagaggtgatgaactacttgccatagctgtgaagaactacttgccatagttcccaaacaatcagaagacgtgtgaatttagagaaaaactatgtgttttcagcaaattagatttgcatgtctggtacttttaagtaacgagtgcacatggctaaagggaaaggaatgaaacaaagcaacatcagtgtagatgaaaatcacagaatatcctaactgaagcatttccattggttccaacatccaggttcatgactcatgagccattatgatactgccaaaaaacttggtcacgacaacgaccttaaacgcctaaataagcatacattcacaattcatggtccatgtatacttatagaaaggagcggttcacagccctcaaaactaatcttatggcaaggaaatgattgtgttaatcattaattcctaacaaaatccttcagccgcctcagccagatgaggtattctcggctgtccttgttgatcatgtactcgtgtaggaagtttgtggccatgggcgtaatcccgcgcatctccaggtacttgtggaatgccctttgcaggttttcatcaaggtcactgcagcagacaaagggcaaggtgttgaacattagcactcggtgacagtgattagttgaagaatttgagtgttcaataaatttaaatacactaggtttggttttcttacttgaaatcagggccctcatacgtgatcatttcatcttccccactctctgatggcatcacagacaaggcatcgatgaggatctcatcaggataggcagtgcagatgaattcaaggcttggtccctcttctcccttcgagatggtgacagttagaggaatgctagattttggggccttctgagtttcttcctcctgatcatcctcgtttctgtcctcatcagcctcattctcacggtcaggttcatcgccagtcacaagactgggcatggaaactagaacctcaatattctcaccctggtaagttcttgtgagagtaattgaattaaagcccttttcatcactaattttaaaggggaagttgtcaggaatctcctcaacctgtgtcaggatgaaaaagaaaatgaggctctcagacagacagtgacagaaaattgctcctggaaaagcatggaaattgttcaaagcaaagatgaaagtaaaacatagtgttctcagaagaaaaatataactgggagttcaattatttctgaccctcatggtttctttttgcattgtatgtgtacaactctacactaaatcatgccataattaaaatttgatgcaagactagatcaccagaacgagatgcttgatgtcaaaacagcagggattgcaaagtcttatatctgtgtgatagaaactacacttcctttgttggtttttcttctcttcaaacaagcaagaaatatcaaacagtgcatgatgcaaaagcatggatgcttttaggcttggaaacttaggagcataacccaaaaaggtcgttagaacaccatttttccagcccaagtacataacattaaattgaccagcactttaatgcattaagcttatatatgaatacaaaatataagtatgtataatatgcatagagtaatcaagctggcatgaaaacttaaactgtacagttcgagaaaaataatcaggtcccctcaaaaactcaagaaaaaggacagggactagacacaatgattcataaaacaccaacagagttttaagcagcagaaaagtttcaaaataaaagattttagaaaccaacattaatagaataagactacaggggggaaaaggtaataataaagagcacaagaggttataataaagaacacaaggaacaagagcaaaaggaacattgagttcttacacagagaaacacatgaatcattgcacaaaattaagcacagtacaatatgatcaaacacaaaaatagtgccataactgcaaagaagtgacacccaaaatatatttataatcaagagatgttgaggttaaacatgggcatgaaaaagtggaataccaaatatatatttgtaccaagtactacctcagtctcagcagagcaatgaccacgctataaacataataacgctaccaatatatccttgtaccaaaatactaccacacaatctcaacagaacaataagtatgcttcacgctaccaattgcagaaggaagtagaagaacaaaatacctaaaataagtgagtaaataacagacgcccaattcccactactgaaatatactaagaacgtaatgcaaaccagcagatgaactatctaacaaaggcagggctgctactttgattccatccatgctaatatgaacaaaattacagaaaataaaggggattcaggatgccaaaaaaaaaaagaggctcttcttttacgacatacggacagagcgaaatagcaaaattagtgagatcccgggaactcgcgcacgcacccggtcgtggtcgtcgctctcctcggcgaacttgatctcggcgtcgatgatgcggaggagctcgccatctgagctgggcctcgtggagggggccgacgagaagggcatcgagcgaggctgcggccgcgccgcggcggcggcggccagggggcggagcagggcggcggcgccgcgggtggtccccgcggcggaggcggaggcgcggaggagggggagggtggaggtggcggcgcggcgagcggcggcgaagagagccatggcgacccgtgcggcggcgcggacgaaaggttagggttttcgggggtttaggaggagtttttttctggaagatggggaggcgagaatttgtgttgttttaagaagggaattttttttttaaaaaaaaggtaggggcatgggccccacctgtcattctgtcaaaacttggtcagtatgttcattcgatctataagcaatattcttcgcttcttggagaggaagaaaaatagttctgtcgccataacttattagacccgttcctttttcattaaaatttaaattttacatcgattttccttagcaatattttttaaacggctaaatggtgtatttatatgaaaactttgtatataaaagttgctttataatatcaaataaatctattttttatgtttgtaacaattacaactcaattaatcatgtgctaatggattttttctatatcctaattttgtattcattttcagtaaaaacaaacaccactttactcccttcatcgaaaaaacatttctagataggaacctcggcataggcatattcaggttcgagatagaagtttttttttacgcagggagtaaatgttcacatttttgacaaaaatgcaagaaactgtgaaaattcaaggttttgatgtgggacaaaagctattccgtgtgaaatttttgaatcacttttgagaattcaaatttgaaacattaaatttgatggggatttttggttttaccaaaatttgatgaaaaccttcataccattaccattaggagttggaatccggcactcaattgaaaagtnnnnnnnnnnnnnnnnnnnnnnnntgcagtggagcctaactcccataattttgaggtgccaatgactatctccttagtttaactcaatttgatcattccaatttgtaagctagctattcaataacaaatagtattatacatgatgaataaattgcattaatggtacatcaacttaacatgcaagtgcaatttagtgtaaaaacttgagaagtaagcgtggtagcgcaacaatttgatatgtgggtacaatctagtacaagaatctaacaagtgagcgcacggatgcaacgccttgcaaggttggtgtgatttgctataataacataagaagtgatggaacaactaaatcatttcgagcattttttctatactcattttgtttttttacttattttgttaatatactgtagatttctctaagtatacttaatttgtgtcattcaggtaattaaagtatacttaatttgtgttatatggtgggacaagtagaaagggcaaaatctccttatattatgggactgagggagtagtagcatctacgcacagtgacacccttcgccggtgaccatgccaattcttatggacaaggactgaaggacaggggacaacgaacaataagatgaatagatgatgggatcagggctggatcggcggctggccctgcatctgcatgttcctctcttgctcttcgcgcagcttgcgcctcgtcaccagctccatctcttgctcttcgatcagcggccgcctcctctcttcctcctcaagctgcatatgcaatcccgagttaccgccgcgcgactggagcgggtctaccacatgagcatgtgtcagcagagcccataggatcgttataaactcgccgccggtcgccatcctggtggcgtgtgccaccgccctatccgacggggagatgtacagcatcaggttcgcccagaaagcggcgagcaccttccaccgctctctcgtgtcctcgatcctatcgacgaggtacacggcgacactcgcgccctgagacaggatcttaagcacgttcaccgtgtcgttgctcgtcgagttgtccagctcgatcatcttcttcaccttctcctcgtcggagtcgtagctgtagatgatgtccttgcttttctgcgccatctcgtggtccatcactattttcgagcgccccagctcgatcagcttcttgtacttttccccgtgggacttgcagccgccgaggaagtcccgggcattttgcagcgtgccttgaactgtcgacgtgctcctgtacgtgttgtcctgcactagctccggctggaacgctagcaggtacgcgcagtaccctgacaacttcattgcgacctcgtgattcctcgcgaactcgtcgtcggtggtggtagcgccgttctccatgctcagcccgtagtcacagatgctagtggcaatgtgccacttcaggatgtaattagcgtatgggttgccgagcaagacgtcacgatcgaggtccatgtcgatgatgcccttctgatacaaccacatcctcccgtcggtgatgttgccgttgcagttcttgagctcacggagcacggcgtggctcacctccggtgtcaagcggatggagcgagtcatcagccatgagtccagggccttggcctcgatggagaaccatgataggaaggtcttgatccagtgaggatgaatgttgtctaggaggaagtattggccgatggttcccttccagtacctcgtgatggtactgaaatggcacaacaccttgagtgggacctccatgagcgccctgtgccatgactcattgcgcacgtaccgacacatcatcttcaccttgtgccaatcagagaagatgaaggtaaagaactgataggactcgaggaagatgtaccaaacgattaccaaacgggtgacaaggaggtcaaggttgaagccatggatgatgatgttgctggcatctccaccgtctccgggaccaggccgaagcggccggtatcggagaaggtccggggagaagagggtgaataggcttgtcgtgaggatcgcgacatacacagcaaggtcaggagccaggctgttcttgatagatggataacgggcatagaagaaatcaaagaggaacccaagctcggcctcgaccacccggtacgccctatcgaggtcttggtcatcggcgaggagccccttgacgacgaagtcccatgacttgccttcttggaaagggagggcaaaacgaccaacatgatcgacggcaaaccttaacctgagcatcttgaagagggcgaaggacaggcataggtcccgccgccgcgccacaccttgatcccttcgaccgtcgctcaacttcagcagtttccctttgcattgccagaccttctcgacatccaccgtctccggaaccccgtaggctacctgtttgacttgctgcccgaactccaccttctccacctctttgccatcgacgaggtagatgtactccttcatggtttcggggtcatagttgcccttacaagatcggacgccggtgctgctcggtggctcatgctctatgtaatccaacacgacctggttctccttggtgagcccacgggagcgattcgtcgacaggtacgccttgaccctcaaccccaaccgcaccacgctcaagctccagatatagttggccatatggcccgaggcccgatggcccagcccatggcacgggaatttggcccggcccaagcacggcacggcccggtagcaatcgggcccatgccggcccggcatgactattgggccatgcctgggcctatggctgggcacggtgggccggcccggcacggcacggaccgaggtcggcacgatgggccggcccggcacggcacggcccaacggtcggcacgaccacggcccgtaccaacggtaggcacgagcacggcccagcccaacagacagccaggccgcgccgtgtgcgcccgcatatataagccagcgagcgccgcccctcccctccccagtcccctctcgcctctcgctctccgcctctccgcctctccgcctaaccctaaccctagccgccaccgctcaaccgcctccgccgatccgcctccgacgctccaccgcccactagatctcctcctccaccgtccgccgctcactcactcagggcctcaggcgcgcaccggtgagactcaccgagtcgcctcccttccactcttccagatccagccttcctcttcgtctccgatcgatgcctcgcctgactcgcatgaggggcgcatgaggatgggggccaccggccacgcatggtcgcctgagtcatcgtccttccactcttccagatccagccttcctcttcgtctctttcccttttgttcttcttcgccagatcccttggtcttctcgtagatctctgagcctatcgtcttcaacggcaactctggtgctccggctgcgcagttacaagcatggaaccatcatttttcttttttttttctccatttccgaccctaaccttgagtgttgttggctgcttgcaggtcgcaagcccgttgcttagcggcagccgccgttgagggaccagagtgcctgcgatggacgacgatcctacctctgtcaactacgagttgaggactatggggatgcgcggtgatgacgatgatgatgtggaggaggatcgtgtggaggtgttcggcaatacctccgacatcccgatccatgtgaatgtcgatgacgacgacccgccggtcgacgacagtggcaatgggacgccgactggctctagtgcgacttgtaccaacaagaagaccaaaacctccaaggtatgggatgactttgaggaactttatgaaacgaccaatggtaatagggttcgagtctctgctaaatgcaattactgtcataaaactttgagtgctcgttcttctgctggcactggacatttgcttaggcatattaagtcatgcaaacctagaaagcttgggtctaatgctttgcctcagtccatgcttagatttagtgcagatggttctgttattccatgggaatatagtcctgaagttgctaggtttgaattgtgtagattgattgctagagaggatcttccaatcagttttggtcaatctcctgcttttgtgaactatattaaggttgctcataaccctagatttgttcctgtctctagacaaactactaccagagatttttataagttgtttaaggatcgtcgttctgttattattgatcgtctcaattctgctagctctattgctttgacatctgatatatggtctggtcatgctaaggaagattatttgagtgttgtagatcactttgttagttctgattggcaattagaaaagagggtcttgggtcttaggcttattgatgagtcacatactggtgctaatattgctgagcgtgtgattgctgttgctgaagaatatggtattactgataaggttttctctattacattagacaatgcttctgctaattctaaagctatggacacccttactcctgctctgtctggttatattggtgatttatttttgcatcaacgctgtgcatgtcatatcatcaatttgattgttaaggctggacttgacaagttcaagcccatgctaaatgacattagagctgccatttcattcttgaatgcatctaatcagcgcattgctacatataaaaatgtttgcattgctgcgggttatcgtcctcgtatgtttggtttggacatggatgttagatggaattcaacttatctaatgcttaagcatctcataccacatagggaaccattcacagtatttattagtacacaacatccttttgttaatgaccatccattactcacagacttacattgggcatgtgctgaatctgttttgtgtttccttgaacaattttatgattcaactgttgttttgtctggtgtttattatccaacatctccattaatcatgcatcacattttagagattgctggacatctaaacacatatggcaatgttcaaaaccttgcaaatgttgttggtcccatgaaaactaagtttatgaactactggtctaaaattccaattctttattcatttgcatttatcttggaccctagggccaagattagggggtttagtaaagtgcttcagattatggctcaactcattggtgatgattactctgcttatttaacaactgttagagcttcattgtctgatacttttgctaagtatgaaagaaagtttggttctgttagattgcatagttccactattccaggcccttccactggtaagaaaaggactgcatgggggaagatttttggttctgttgttgctgctgggcttggtgctggtaatgcaggtgccagtccaggtgctggtaatgctggtgccagttcaggtgctgggcttggtgctggtaatgctggtgccagtccaggtgctgggcttggtgctggttcattatccaggatgacatctgctactgctttgcttcaggcagcttcttcaactgctaatctcaatccttctgaactgtctgcatatcttgacagtgacactgtcaaccaatatgatgatgacttcaatatccttagttggtggcaacagcacaaactaacttatcatgttctttcaatcttagctaaagatgttatgactgttcctgtttctactatatcgtccgagtctacttttagcttaactggcaggatcatcgaggaccgtcggcggcgtctaaaccataggctggtggaaattctggcagtgatcaaggactgggagctagcagatgcaaaaagtcagcatactactgagaatgtggagcttcaaaatgcttatgagaatatgtatcttgatgatgaaattgatgtaaacccttgaactggatgattgtaattgatatgaacattttagctatgggctgtactcttttcctttctagggttttctcacgaggtgtgtgtttttacctagaaaggtttttaacgaggcaccattgcataatcacagcttatataaaccccttttatattctaactttctgaggtttgtgattctaagatggacttgatggaaaatagtagatgacttgatgtatgcatttgatgaattgatttgaactgattgtaaatctgtgagactgtgacttgatgaattggtgacttgaagaattgttcatttgtttgtaaatctgtgcttgtaaatctgtgacgtgatgtatgcatgatttgatgaactggtgacttgatgaattgtttgtgattctttgacttatttgatgaattacatgtgaatttcatgaatttgatgtgttatgtcaatttgttgtgttgaattgaacctttgaaggggtttttttgccagggcgtgcctaggccggcacgggcacaatgggctagccgggccgtcgggccagcccggcacggcccgaggctacttgggccgtgcctgggccgtggttgtagcccgtgggctggcacggcacggcacggcttgttcgtcgggccgtgccggcccgactgacctcggcccaggcccggccgtgcctgggccgtgccgtgccgggcggcccatatggccaactatagctccagaggaggaagaggctgacgaggaaggtgccacggagctggcctttgtagtagaggatgaggaagaggaggtagacgacatagagggcctggttcatcatggacctcgtctgctggctgctgtcgttgaagctgaacgccgtcatggtgtcggcggtgccgaggaggaggaggaagcaggcccagacgacgaatagctcgttctggatggacgactactgcatcaacccgattgtgtaggagatcaccgggtagttgaacatgaaggctccccagacaaggagcctaagtagggcgccgccgtggtggcgccgcctcgagttggataggacaaggacgctgacgaggaggtagcccactgtcactaggacctcgatcctcgccagctgcccggaggagctggaggcgaactgcttcccggcctgggtcgcattcctcgctgaagcaacaatttgatccatggtggtgtagaagaaaggaagcaaggtcaaatggaggagatgagagaggctaatgatggagtggtacagagcattggcgtcttggagtaggcagtctctatataatcgtcatgaataaaactggacgctccgagaagaccgcatcgaccgcctcacaccatcgtggagaaagaaatgactagagccaagtcaatatctatatgcacatggagagacggtagagtcaaaactctcatcaaaatcaaatacgaataaactacatcgatttacgcatggccagctttatatggttgattattgcacgcaactcgaaattaatacctctcaagcatggtaaaatttttcatatgtatacacatgcgcatccacctaatagggaattattctaacattaatttctttgtggatcaaggagttgaagacggtgctgacatcttgatacataattatggagtaaactctattgtcagttcttaaaattgtattgggatgtcactttgatccataatgttatgaattactcacctagatttgtaatctacgtttaatgtatcacagcattcaaacatctttgactaagaataactacctcttggttgttcgatcccggtggccgaaacttcacatttaggctttccaggtaaccaccgtgacaacaaattaaatttgcatatagtcccttattactaacattgcctgtatttcgctggtgagcgtgccgatggtgtattgcaggcttgcagccaatattaatagtggtcagtcattcccaaaaaaaaaaagaaaaaaagaaaaaaaagtggtcagtccacatctcaggcttcaccattggtgagagaaatcccgtacgtcattggtgatgatcgggacctaatgtatgatgctgcttcccgcgatctgtgagtgagtacgagcaattccaggagatggaatttttagaaaaatatactgtatattttataaatagaccctagaaaatttattacacgtatgaacccctaactcggcgccaaagtggagtgtgctgtaaaatttcaggaagactaacaatacagtatattctaactcatttccaataatttatttttatttatcaagacttaacctgggaagagatttttgaaaacaaaaggaaactcaacaaattaggtgcactgaatcatgatatattgatttgtgaaagaaccttctcaaatcatccagtgagccaggtatatgcatcagaatcctccaatgagccaagcatatgcatctgatctgcccacaattgtcattatactatatgattagcattcctccatgcaagccaagttgccaacggagaatcaaggatctaacaagttccatcagatcagggccggccctgcttgtgcccttttatcttcctcttcttcaagtagaataggcaatcccggggcaccgccacgatgttgaagcttgtctactacatgggcatgtgacagcagagcccaaatgatcgttacaaactccccgccagtggccatcctcgtggcgtgtgcgaccgccctatccgacggggcgatgtacaacatcatgtttgcccagaaggcggcaagcaccttccaccgcttcccggcatcctcgatccgctcaacgaggtacacggcgatccttgcgccctcagataggaaccgaacattgtgctccgtgtggtccaagcgccccagatccatcagcttatcatacttgtcactggcggactcgcatttggcgaggaagtcgcaggcattctgcagtgtgccacgggccatcgaagtgctcgtgtacgtgctgtccgggaccagctccggctggaatgccaccagcagtggtgtccatgctaagcccatagtcacatatgcttgtggcgatgtgccatgtcagtatgtaccgtgcaagacatcacgatcgaggttcaagtcgataatgcctgtccggtacatccacatcctcccgtcggtgatcttgccatcgcagttgttgagctcacggagcaccaccggcatcaagcggacggagcgagtcatcaatgatgaatcaagggcctgggcctcgagagagaaccatgagaggaaggtcttgacccagtgaggttggatgttgtcgaggatgaagtattggccgatggtccccttccagtacctggtgacagtgaaatggcacaacacctttagcgggacctccattgccatgactcattgcgtacatatcggcacaacatcttcaccttgtgccagtcggagaagataaaggcaaggaattggtacgactcgaggaagatgtaccagacaatgaccaagcgggtgacaaggaggtcgagattaaagccatggataaggatgttgttggcagcgttgctgccaatgggacctgtatcggagaaggtctggagagaagagggtgaacaagctagtcgccaggatcacgatgtacacagcaaggtcaggagccagggtgtccttgattgaggggtaccgagcgtaaaagaagtcaaagaggaacccaagctcagcctcgatcacccggaatgccctgccgaggtcttcgtcattggcgaggagccccttgacgacaaagtctcggcacttgtcgtactgtaaagggaagttgatatgaccgacatgatcggctgcgaaccttaacctcacttgtggacacttttcgacgtccaccgtctctggaaccttgtacgacacttttatgacctccccattgtccaccttctccacctcctcaccgtcgacgagatagatgtactccgaggagccaccttgaatgccagcgctgttgagcggctcgtacttcatgtactcgtacaccacctggttctccctgatgagcccatgggagcggttcgttcataggtacgccttgaccctcaagcccagccgcaccacgctcaagcaccagaggaggaagaggctgacgaggaaggtgccgcggagctggcctttgtagtagaggatgaggaagaggaggtacacgacgtggagggtctggttcatcatggacctcgtctgctggctgctgtcattgaagctgaacgccgtcatggtgtcggcgctgccgaggaggaggaggaggaagcaggcccagacgacgaacagttcgttctggatggacgaggactgcatcaggccgatggtgtaggagatcaccgggtagttaaacaggaaggctccccagacgagcagcttgtgtagcgtgaggccgtcgaaaccattcaatcagtttttaaacggattgaaatcattcaatggtgtattgtcatgaaaccattttttactaggctttagcgggagaaaccaaagtttgttgtcatgaaaccattttttgaaaagagaggctggccgcacgaagatctctgctccctctgccaacgggaggaagaaagctgcttgcatctatttgtaaaatgcgacttcactagacgagtatgggcgctgatgcaaggatggattggcattggcttcttgccgccgacgatcaacgactcaagcctggcagaatggtggatgatggcgagaaaatattttcggatgggctacaggaacatcaatatgaatctaacaattacgtcaatatgaatcttttaagagaatcaatatagactttattatttgctaatgaaaaagaaatgatatacacctacgtaccacatgggaaggagctgacaccatcgtgatgagcaaaaataacaaagactaacagctagctaagtcttctaaacttcattatttgcttaagaaaatgaagtgatatatatacacatctaggggcgagcttcaatttattcgtggatcaaggcgctgatcaattgctccctccgtccctaaatatttgacgtcattgacttttttaaatatgtttgactgttagtcttattcaaaaaatttaagaaattattaattcttttcctatcatttgattcattgttaaatatactactactactcaagtttttgaataatattcacaaatgtttttgaataagacgaacaatcaaacatatttaaaaaagtcaatggcgtcaaatatttaggaatggagggagtatttgcttacggccaaggccgggatgttatctattccattatctaaaaagttttgcttacggcaagaaaacgattgtgctaattgttacaggctaacaaaatccttcagctttctcaaccataggaggtattcttcgttttccttgtagatcatgtactcttgcaagaattttgcggccatgggtgtgatcccacgcagctccaggtacttgttcaacgccttttgcagactttcatcgaggtcactgcagcagacagggcaaagcaaattgcacataagaactcggcgattaatagttaagaattaattagactgctcaataatttaggttttgttatcttactcgaaatcaggaccctcatctgcgatcatttcattgttgtcatcctctggtggctgcatcaaggacaaggtgtcgatgacgatctcttcaggatgggcagtgcaggagaattcaaggatctgtccatctccctttgagatggtgacggtgagaggaatgctggatttggagggaacctgaatctcttcgtactcagattcatcgctggtccatcttttctcacatttgaccttggcagtggcaggctcaggttcatcgtcactctcaaggctgtccatggaaacctgaagctcaatcttctcaccatggtaagttcttgtgagagtaattgcattcgagccctctccataattgattttaaagaatttaaagattttaaagggggagttattagggatctccttggcctgtatcagtatgacaatgaaaatgaggccctcagtcagacagtcacagcacattgctctcaaggagagcatgaaaattgttcaaagcattgaacttatatatcatatataattgcgcagagtaatcaaactggcatgaatgtatagttcaggaaaacaatctggttatgcataatcgcagagaaaggtacaggaactagatagaatgattaaaacttaccagcagagttctaagcggagaaaaatttcaaaataaacgactttagacatcagcactaatagaacaagaatacaggagacaaaaaagtactacaattcataaggcacaatagcaaggcatattgaattcttatgaggaacgcacaaaaccttacacaagaattaaacaaggcacaacaacaatgatcaagcactaaaatagtgcagtaactgcaaataaataacaccaaaatctactataatcaagagaagttgaagttaatatgagcatgaaaaagtggaatagcaaatactccacatcattgtaccaaatattacctcaatctcagcaaagcaattgcaatgctgtaaacatgattatgctaccaattacagtatgaaaattactccttttctttaaaaacaaagttaaataactaatcccaatccctactatagcaacatagaacataacgcaaacaacatatgaagtacctaacggcgacagattgcttaagtttatttcatggtaatatataatacgactaaaatcaaaacaaacaaaggggattcaatgatgtcaaaagataattctctgatgatagagcagaagatcgaatagcagcatttgatttagtgagattcaggagctcgcgcgcgcacgcacccggtcttggtcgccgtcgctctcctcctcggcgtcgttgatcgcgttgtcgatgatcctgacgagctcactgtcgaaggcgggcttcgtcaagggggccgacgacgagaacggcatcgagcggggctgcggccgcgccgccgcggcggccagcgggcggagcagggggagggtggatgtggcggcgcggcgagcggcggcgaagagagccatggcgacggtgcagcggcggatgacgaaggttttagtcagggttttgggggtttacgagctgtggagaattggagatgaggacgacaatttatgttgttttaatatggaaaaaaaaatggaaaggaccattctgttatcaatcatgtttgtttgcttcttggagaagaagaaaaaaaaatcgattatctaccaaatatcgttatccgttaattaaattcaatcaagaattgttgtccattagtatagatagttaataaattcaattgttcttttacggattttctctttacccccttgctttgctcattatctaatcatcattgtcattatcagactatattactacctctattcacatgtttaagcattcctagtagcggtttaagttttgaacagacatccatcgagtaatttcttttcacatagaatatcatttcagccatcacaattcacaattccacacaaaattcagataagcagcaccaagaaacggtaaaaggctagtaaaataagcactgatatcataagtgccaatagcctcagattgactactgggcatcagaaatcgcacattgcagggaaggcagtttccccggttgttgcattgcttcgcataattctagtaatccttgttacatatgcaggtatgctaaaaggctaagctaccaaaaatcctgccaaattgctcggcaatttctcattgccggacgaagtccttcagcttggtcatccacccgacgtactccttggtttgcttggtcaccatgtaatcgtgcatgtagttggtggtcggcagagtgatccctctttgctccaggtacttgaataggcccttctgcacattcaccggtagctcgctgtagtagaaagaagcgattcgatgaggattatgagtagagatggtgctcaagaaggattgagaaatggagattgaaaccggtgttcttacgtgaattcagggccctcgtaagggaatttctcatctccttctgtggctgcattctccactattaacatgtcgtcgatggtgatctcctcacgaaaggctgtgcaggtgaactcaagtttgggcccagagcccttggagactgtcacctttagagacacgctgctatctccagcgctctcgtcttcctcttcatcttcatcatccttgctagcattcttgccctcaccctcggcttcttcgtcgtcaaactcagggcccccttctaaatttggcatgctgacaatgacctcaatcttctcatctttgtagtcccttttcagaataaccacactcatcccttcttcgtcaaggatttcaaaagggaagttttccggaacaggttcctgttgcaagaaagataaatgggtaagatgaaacacctttggaatattcaataacagatgttaaatgccttgatgtcaaaccagcatgtcaattttacagctagatgtcacacctgcagaggtaattttacagctttgatgtccattcattcattcacttttcagggttatgcggaaaggattattcaacctcaatgccagttctaatattgcccttgcctggagcttccaattgatcaaaatattgaacccaaaccatcacaaactctatcatcagtcccactatttgtctattccaaagtcataccgctttaaaagaatcattagaatggttcaatgatttgaaacaaggaaaacgcttaagaaacgatttgcttacacaagggtataagacttctctccagacattcaggtcaaacatgacaaaatagatgcaagaaagttataggatccttgaaaaccagatgagcattgcatagctgacgcagggaataaatctaaagtcttaacaactctctgaatgccagttgcaataaacaattgccaataaactatcacttaaagaattcagacacctagactaatggcttaagataaaataaataaatagaagatatcgatgcatgagtaagatgaacaaattctctattctctaactgccaccagcataccgaagtaacaatacgtcatcagtcaccaattgatctgtattaagagagaagcgccgaacgagactgcaaaagtaatctattttaggtgaaagcaatcgtaaatatatttcccaattgtagtgttcaattagctagagatgcccattatttatcaaccagttaccagtcgacgtgtagcattcacgcaagacagcactataatttgacaaaacctcaccaaaaattcatcatccccacaagacaaaatcactgtccaatatgacaaaataatatctcatttggcgcgccaaatcagtcaagtttcgatgacagtagtacagtatcgcgcaagagaagagcgcgcgtctcactctcacctgctcgtcgatggcgaggtagtcctgcgcctccctgatctccgcgtcgatggctccggggaggttcccggcgccggaccccttcttcttcttcgccttgaccttgctctccatcaccacctgccccgaagaggcgctcgacccctgcgccgccgcgcgcagggaacccgcgagcggctgccgttgcagcgagagcaagggtgttcctgcgcgggacgcggacgagacgccggggaggaaggcggcggcggcggtggcggcggcggcggcggagacgaaggccatggcgaacgcggtggcgaagcgaaggagagaagagaggagaggggaggggataagaaaagggaagaggggttttggatgacgcttatacctaccgtttagtgggacccatctgtcgctgacactacttgcctcctgtcctctttcaacgatttcgtttttacaaaaaatcaacagaacttgcgtatgggtttcttgtgcttgtgaaattaattctccttctccaaatggtctagcactatgatttgatacaacatctgaagctgtgtttggctcttgtagttggataatccctcgtgcatcattaattaattattaggtttttttttaaaaaaaaagtatataaaataactttcttatataattttttcgtgaaaatatatcgtttaccagttttagaagcgtgcacatagaaaacgagataaaaaagctaggaaaatagatttttttttaaaaaaaaaagaaaatagagagaagaaaacaacatttagtgtagtgcctggatcgattttcatcaaagaaaggaacagtcaagcgctgcatgacaattaaaggatcatcattgggcatcaacaagaacatttaatttacaagactttgctgtgctacacattggaagcaagtgcttagattacatatagtagtaaatagtattatgcatgtttaattactgtttctgattctgattgagagcctgcaatttggcaggaacaagatcgagctactatacaaacggcagagacagagacagagacaggggcccccatttgcaaggcctttcctgtcaattcatcctgcctttattattatcgattgataattccaagataagaaggagaaaaagaagaagaattaaaaacgcgggaattattactgtaattaataatcctccaagagaagagacgaccatgacatgacatcacaggagctgggcgtcgcggctggccggagaagggaagacgggcacctcggcgaagcggaggcggccggagtcggccgcgccgccggcgaggcggacgtagtagggcgcccgcggcgacgccgacggcgactcgttggtgaacgggttgccgatcggcgtctgcccgccgttggcgtagtggacgatcgccctgtacaagaacggcagcaacccctccatggcttcttcttcttcttcttcttcttcttcttcttcttcttcttcttcttgccaagcaaaaacaatggagctaagcaaagcaagaaccctctctacctctgtctctgtttggtggtgcaactgcaaaggataaagaggaagaaagagaggcgtgtgggtatttaagggcacaactgcagattagtataataaggtgagccttgagattttttttttgactaaactaatcaatgctgattagtggataacaactggcttagctttgctcagctaagctactagctagctagcacaaggaaatggtcaaatgagagagccacatcaattggagaagatgatgatgggatgcatgcacgcatgcctgtggacttgtggataggaaaatggattttttgtaagcagaacaaagatgctgtttacacttcagggggacacacaaggtgcattagttttttgtgatgaaacagctattggaatttaaggtgtcacacaggaacaaatcagggggcaattgggttttgtggtgactgctggtttctgattggaattaggtttaaaataggacagcttctgctgattctggtctgggtgttaggggagggagaccaatcctatataatcatataaagaatatcaatggctttgtgcttgaaggaagggaaagccacaaaaaaaaagggaaaaaatgatgcacagatgtggtttgaagacaagggacatcttacctgacctcaaaagggtatattgtaatggagtttgttgtgttttccctcttctttttctgtgtttgttagtgaagcttgcaattgaggcctcaactaaccctataattaagacaaaaaagataaaaggctaaatccgaagtctggtgaaccatcgttctcaggtatcccaatagaaagaattgggtcgactttaagcatcatccaagtcgtgagaatgacaccctactaggtcagagtagcagacaaagggtagatatatattttttctctctctcttgaactgagtacattacaaactgctcacggaactgcagctggttcaccaggaataactgtaacaccaagaagaataacagggtacaacagtgtgaagttcttacatatatatcctcagggcttcaatttgcacctcttggtaacacataatttaactttccaggaagaattttctagcagcatgtggcaaatctctctacataagctacctatgctcaaggctggctggctcttaatgtgacaattcctccgtgtaaaagaagcgcaagtcaacgggggtaaacaggatattgcttacaaaaccggcgaggcaacgatccaggtttcatggatacacatcacctagatcagaacacgcctacgagctaagatggaagatttgacagtctggtttgtatttgttcttggaagcagcctgctcaaacttcttcaatggcccttcattctctctcaagccagtctggataaagtatcgcgaccaccacgaagaactccgcaactttgcctgtgaaaaaaaacagtccatgtcaccaaacttctagccttcgatatagctcaattatttatattgtgttctagaaaatactaatgcatgcataacatcaaacaaatcaacggttattccattcctctccaaacaagtaaccatcaatagcattaatggacagcctaacagactaagcaatactagtcaataggcaacagcatatttgtaactgccaacatacagaatgcaattgaaattatattccatgatgtgatatactcatatactactgtataatgaaaagaacaccatacatgcaacatcgctacaacatcaataaaatgctaagcatgaatatccagaacatcggtaacctattaaaagcataaaaccattctacaacttttataagctgcctttctggatcatggacatggaatgcgtcaaatcaatccttttgtgtcagtacggtactggtcttagaggtcatat

SEQ ID NO: 45810 - DNA, 16204 bp, Oryza sativa
  unsure (1)..(16204): unsure at all n locations
atactccacagaaatgttaagaaacaagcactttaaaaggtccaaaagtcaaaccatactagtactagaataaatgttacagtattgttttaccattctcatttagttaaaagaatataaatatcattagtatggggctatgggcttattaggatgcatccaattaaagagcactagaaataccaatgatgattgcacaaccaaacatcaaataaacgaagcttcattttaaatgtaagatctagggaaaatgaacaatcagtatgctatcacttcaggtctgaccaaactaccatgacatttaaaacgaggggaatcatcatgtacatctacaaatatagccgtttatgtgtcaactatgatcatcaacaagtatgcgattaactcaaagaaatacataccggcaaagataacaagaccatctgtagaaatccttgctaaatctggaagtgttttgttcagatatcttggggtcaaataatccaaagcatctgatacgataacaaggttaaaggaatcttggcggtatggaagagggaacttgatatcagccatacgaacaaagcccttgcgcacaaggcttttgcagctactatcagtatcctccaaatcataaggctccactccccatgcttcaaccttcccttccttcaacaagttagaaactactgtacaactatcagggccaacatggagaaccttatgcaactcattgccatatgcctttttaagataaggaagtgcttgcatgacttctggtgtacaagaacctgaatgcaaatgcaaaggaaaggttgagataatgagaagcacaaaacttttcccaataacacgtgtgaaaaggaatacaatggagattcctaaaaaaatcaattactaaaccctcccagagagggtcttataagttataactatcatgttccaatatattttatcaaaatttagagggttatctattagtatcatgaagcttaggataatacagtaaactgcgttgctgtttgtaccacacatcagacactcagacagccaaattacattggtatgacagtgtcaaaattcagcaggggaaaaaataattatcacatggtccatgttgatcatgtcataccagttgaattctttatatactgttcatggcctaatgaagaataacaccgaaggcatcaacaaagaaaaaaaaagacagaaacattcatggagaataaaaaaccaaatgcagtatctccagaatgcttatatgaaggattgcacaacacctatttcttactgcagcgagtatcagaagaaattgaagagataaatcaacaatgcattaagagaggttaaaagatgacagcagcatatgatttggcacacaaagaataatataccttcagacctgctcacagcttctctgctagtaactgttacacctggccattggagaaaaatgacaattagaagtatgagctggtccacgatatttggcactcgagtatgagctggtccactttgctatctctaggagcaggacaattcaacgttaaaaaatcacaaaatatattcatactacagggcaatctcagttaacaattgaatatcccaagttgattttgttttgatatttcagaaaatcatgacagcaacaatgcagtaccaataagaaaatgcaggtacaatgctgcagcaatgtcactgtgcactaattgtgacagcaacaatcagtgatggcatctagcacgcccacccctacctccaaatctattatttaagttgctactacctttctttaatagaaagcagagaatcaacagaataagggaacagagtgaattagtatgagttactctcactacggttttttcaccattttgcaatacaagctaaacggaacaaaaataaacaggtgaagaagaatattcaagtggagttcaagctgacctgagccgctattgaagtaggcgatcagaataatgacaccctgaaacccccaaaaaaaaaaacaagcacacttctgtcagctgagcacatgagaaatcctaacaactaaattgacaaaaagaaagatggaaaactaccaggaccacgagggcgatggtgagcacgggcggcgagcgtgacttggggtgaagcaggccaccgacagacggcaatcccccatccgccacccgccggctcggattcaccgacctcctcgacatccactccgagccctctccaatccaagccgcccaacctctccccccacccccgctcgatcgatcacctgctcgcacccaacaatatcatcatcccgtcatcacaaacaaatgcccacacaaaatcacacccccagcacgggcggaatccagatccccctacagcccacagatcggaacacccccccccccaacgcagcagcagaagcagaagcagcagcagcagcaatacctccgatggaagtggcggacgcggcgggcggcggaggaggagggggaacccccgagagcggggctagggttcggggaggagaggggattcgcggggggcggcggcgcggatctgaggcgagtgaagcaagcagcggcggcgaggtgggtggcgatccgacgcgatagggacgggaggagtgaatgatacggtggcacgggattttatacggccgcgtgcaatgcaagggtggtggtgggattagcacgccattagcgagggatttagtggagcacaacccgaattccgagacggggagatgggggaatttgggggatgtcggtcgccgtcgcctgctttcactgacaggtggggtctacctaccggtcttttggttttccttttcttttctttgcttcgctggccgtcggcctggcccggtgggttccggcccaacccactgggctgaaagtacttactactagtacatgttattactagtcaatggtcaaataggtctggaaaattgtcaatggtcaacacaggaaatttggtagctatatctgaaattttagtgtacctaacactaacgaatgctccatcgtgcaactctctggattattatgccaactgattagcacccagtatttccatttcattcctgcccaggaaaccaaatggtcaaactcgtgtcacggattcgcattacatttgaccatttagtcaacatcatttctatctcttagagcaggtacaatagcaggctataagagcacccgcaatagtaaagtaaggtgctatctataaaatatgtacatctcagcaatagactagattaatagtaaaccatttcaatagtatatctacatgggtatctatagctctctaatccattgcctcgtttttctctatagactatctccatgttagtagatagctttgctctctcgcttcatttaatctcttccaagtagaaaaatatgctgacatggatcttttgtagagagcttatagataactattgtgggtgccctaagccagctgcaaacatattttaagtagataaatgtagagagagaagggtagcaggctacagatttgtagccagctgcagcacggactccaagacacagtgtgagtatgacaggtgagaccaagtattaatagtgtagtatgtaactattgtatgaatgagctattatattgactatagatgaattggagatagtagttggctatattattgaacttgctcttaagcatttgcacatttattcatgtcatgtgatcgtgtactactcctctctgcacttggggaaaaaagagagaacatggcggcaatatactagtagtagtgatactattcagcaactaatttaatcagcaccctcaactctactggatctcttcctctgtctctctattgttcatcatttgcagaaaagagtctccttcgtggcgtttccagtggttgtattgaccctgatgcaaaaagttaattgtagctagagtgagctcaatgtaatgtacatacagggagacacaaaataagtgcaatggacagccattggtgtgtgcatgattgcaacattggttacttacccatcagcaattttgcagaggtattcacgctgatcgtctcgcagtggaacatctgtaaaatctggaaggccaaaaaaaaagagagagagaaacttagatgtttgatgatcccatcaaacaatagtcaattcagtctaatgcaattttggtcagcctctgacaaaatcaaaactctgttgaagcattttgtagatgagtaagaggttggttagagattgaaaaaataataattgatcatattaatatgtcaacaatccgatagtttgcagataaaaggagtcatttagtttggcatggccatcagagagacaggaccagtaacttgcctgctccatatatgttggaacctttgaacgtcgtgtttcctgtggcaagtgccccttccaagttggcatttgtcagatttacctgtgaaatgattcaagagacacaccatcactcgattgtcagtttgtcactaggttatgcaagctagtaacaaactatttgtgctgcaaacctgtgaaatccatgcttgacaaactggtagtaacttaatcagaaagtggtcaatgactttctgaagaaagtgaggacttatgtaatgaccaattatattatgtaacgcaagcttgttcaatattgctatgatgccaatgccaaattgctatcaatttattactggtctaatcagtaaaaaggaaaaaacaatccaggctttctgaacaatgcaatggtcaatgtggaatgtagtagcatttcaattagcttgctatcgctaatgcttttctttgagcaatatgcagtactaccttcgatacatttgccagtgagaaatctgcacctctaagatcagcatcagagagatcagcacctgaatttatcaccagaaaactctgaataatcaatgcaactagaaccaaaacatcagttttgccatttcagaacttcacattggggaagaatcactacaactactgtgataaatggaacatctaacaaattcacaagcacagcatcagaacctgtcagatctgcatcaaagaagctcgcgccgagcagcttcgcgcctttgaagttcgcctgcctcagtatagactgcaacaaaaacataccaagaaaacagcataagctttgcaattgcatttgctgacaattcagatactcttctggacatagaattcagtaattcacccacaagaacagttacaatttatctacagaaatatgatcatatccgagttcaagaactgaaacagaaaggcaatgggaacaatcaaagagagtaccgtcttgaagtcctgcctgatgagcgtctggccactgaagtccttgccggtgaggtcctgcccccgtgtcacctgctgcccgtacgggcctcctcccttgaatgccagggccgggtcggcgacgaggagcgaggccgcgacgagcgcggcggcgccggcgttggcgaggtggaaatgcagggaggaggaggcggaggagcgcaccggcgtggcggagggtggggatggcgtgagcttcagactgcccaggatggtggggatggccatgatcgatcgtcgtcgattcttgatgctctccgactccggtggtcgtcggagttggtttctttgtgtttcttctttagcgacggtgtgtttatccgtcttatctgttcgtgggttgcttgctcagtcgaccaatcgttgatcgccacgtcggctgttctttcctagtataaaggaggagaaaataaaaggaatttttccagccattctgatatgattcaggttttatttttttattaaaaaatggaaatggttcactttcttgctactacaagtttcaatataattattttgcggagaaatatgttttatttgatatatcttagtgtttgtatgttcagagttactccctctgtcccataaaataccaatttagcactggatgtaacgtataattttttttagacgaagggagtcggtgaaaaagtgtgtgctaccatcataagaactacgagtaccagatttcctaaactattgaacacgttttaaattcaccactcaaatttaccttgggtttttaagcaaaaaaaaaaactttactgccactaccgtgatacttcctgcatcccaaaatatacatatttctagcacagtacattatttcaaaatgaaactatttcttcacatacgttctcctctcaaccaatcatcactattctcctttacctacttttacttatcaaccaatcacacatttcctccgattattctcacctattttttattaataaccgtaccaacctaaaaaaaatgtctacattttgggataagggaaacaatttggcaaaaagatctatgagcactcatctgtaaaaataaataattcattagggtgtaatttgtaaattgtcttgagtctttacgaacaaatccctatcctgcataccgccatcgtctctttctcgtcgtcgccggcgacgcctcccgccgccgccgaggatgccagtgagggtggtcgacaccgcaaccccatcctcccagcccacctcaggttcgtccacctccttccccactaccttctctatgctatgcacccacccctaattttgctgtgtaatccaagctttagatctgatcatctgatagagtctaatcaggtatcaggtagcttgtggggtttgatatagtgcgattttaaggtttaatctagattggtctgagttgtactgagggtatctgtgttgatccttttggaatatactcaattttttataattttggccactcacgctatgcgttatttggggagagctcggatggttttgtagctaagctgacaactaattgtaatgtattgtatatttttgaggcgttgctatgcttgtggctttgtgtcaagtgttcttctgtttcaggaggccttctatataaaccaattgttgattttgttcacctgcaattgaaatttcattagttattttgtatgtatttctggaaatagatagcccgccgtgccaatgtgccatactgattaaaatgctgcaggtcaagatgcaaatgctgggcatccgtctcctcctagctgttccctcttaagtgctggaagagtaagtctttttgtgctgttatttggaacttgaccaaggatcgaatcttcttatcggtgttgtttatggaactgaccagaccatatgcttgtaccattctttcagtgttatgctggaacccagaatgtctctactatacaaaaagaagaagcttggaaagttaatgtgcggatcaatgactgtgatcttgaacagggttatttatgtggaacaatggaagcagttaatgttcccttagctgatacccctgtgagctactacttccttttccactttgactctgatctttatgttccaaattgttcattcgtatactaatttagtaggcaaacagtttgttccgataaaatgtaaaataatgctatgttttacttcttgttaccattatctgatttgcgtagcaatttgtaaataatttccataggtggtaacattctgggagggggagatagtggatgctaaaaattatacatttttcactggcaagtgggaggcatcgtgagtagttaactatttatgttttatccttgatactatcatctacttgttttattaattgatgccctagtttagggtaacagtccaaacttactcatcaaacattattcctgcttatgcttttgcagcccagaggatgatattagacactggtccaagttcccatcatttacacctcttctggtattctgttgcctatcttcgtgttgttagttgccacgatttgttaggatacatttctcacttatgtttctccacagagtcagatagagacagatggtggcaagtctgtggacttcagcaactatgcttacatattcatggtactgcaccatctgacctttcatgtatgtgccccatttattgaaatacaaagtcataacaacttagcattattctgatgctacatgtagagatggaaagagcagtactttgtcaatgttggagtggactgtgggttgaccatagctggtttctactatgtctgcttttcatgtagcgatggttccattagcgggtattattatgatccaaacagcaggtaatgtatatttcgctggcactttttattgcgatgtaacaactaaattctattgaggaattgaagtgatataaatatttcctgctctctcaatttacagtccgtttcagaagcttgaactgaagtgtaccaatgagaaagattctggatttaccttttcatcctacgagctgcagtgagagactgacaggcctgttgtcattatagtatttgcggatgttaatatacacaatgtgtgtactgaactcataattttgaatggcgtcccattaaaagagctgagatggcatgtttgtaacagtgattttgagcaagatgtattttattctctttgtaatatgattataagctggtaaaatttctaatttgaacctacctgtgtgttctttttgtgctaatcacggcatggttatgtccagaataaataagacaagaatgtgagggctagttgctcgttcaaagaaatatatatacttctttccagagtaattgtagttctgcagttggaggatttttgttttctttcaatatttctgtactgcctacattgtggaatttgtggtcactgattgtgaatctaatatctgatactgagctttatctgaagagacacttaagattgaaatcttgtacattagtttctggtacacagccacagaaacctccttttggtttcacatgcagccattgtaaggtatgatgtaattctatgaacaaagtatacttgggccgaacactctgtcttcgcctccggtcttcggacattgtaaggtaaacatctctctacttatcttgtttcatagagtcttgatctcatgcttcaagccgtagtcaattctctaatgagtaaaattcttctgcatctgcattgcacaggcttcaagttattgctaaaccctataataatattctgcagataggactacccttgcacacctggtgaagcttaccttcatacacacaaggatgggtggacagtggaacaggaggtaactcttctctcctttctggcagaaaccaagaatacacttcctttgccctctgtaccaaaggcctctcaacattctcacaccaggcgtcaaacatatcgaggacagcctcagtaatgacttctgagagtactttatcaccttctccaggtgccagcttcagcatcatgtatctcttgaacgatacgatcttctctaacatttgccttctgtcaatattatatgatgacatcgcgccttggattatagagaccatcctgaggactgcctcacagactatagcatatgcatgactgaatatctcggttgctgtttctgacagttctttgctgtgccaatcattttttacaggttctggcccctgttctaagattggcgcaaatgttacagtcttcggtttggttgtgttgacacggagctgctttgattccctcagcatttcattggcttccttcatttctgactcaaacctgctgctgaccttgaagtatggttgctccttgtgtgcagttgggctcgggagtggggaattctgccttgatgatgcttccaagaaaacctcaggtgcacatgctgattcacacgctacgatttacatggaaaacacaagtattactcttcatcataacaaaattatactataattgatatcttgactgaatttaactggagattgtccaatgcatgcaatattctgaagtctggcagacatacaggaatggggatgtcgagctgtgcttggggatccgtagtctgcatcgttgtgctccttgctgtcgtctgcactgggtcctgctcggggggtccacatcatgtcttcttgcggcttcttcttgtgatgcagcaggtgcatccatttcttagccttgctcttcaccttgccgagaactggcttcttctggctcccatttggggtccgcggcgatcccatcggactcaccggcggtgcccgtggcgaaggccagtatcgttgttgctcctcccattcatcgactggattttggcctgcaatattcagagacgctgagggaaatgtcaatcaggcatgatcatttctttatttctaggcaggtgaggcactaacatccctgtatcattacttccagaagaataatttggaacacattgatcaagctatacattttccaagatcgaaatgtcatgagaaattatgaaacatgcaggaatggtgaaatttgagatgagaagaaaagaaccaagaccgacaaatctattaccattttggacggggtgatcacctcgtttggtgctgatcccgcgcttcaattttctgatttcattcatgatttgtgcaagaatggaaccaaatcctagagctttgggaggagctgatcaggcaagaaatggactctatcctaaagttggcaaccctgagggaaccaatttctgagttatagtggtgacaagggctaaattctggtggagcggttaagttgccaacctattctagggggtgtttggtggttggagggtggccatgcttttcttggagccatcccagatcataaacgaggttcatatgtttttgccacgagcagctgaaaaatgtaaggacatacatcatgcatgtgcgggatgttttgaactgagcaggtttagggatattttgatcaaatgtaatgttatttttgtagaccgaaaaaaaaaaaagcgatcctaggcttcctagcgctagataaagatacagaaggttcgagtttcatgaggctgaagacccagattatggaaaattcgagtaaaaaaaaacagaaggttcgagtttcatgaaatttgagttgcagagagaaggatgaagaccgaaaattcgagtttttagggaagtttcatgaaatttgagttgcagagagagggatgaagaccgaaaattcaatttttttacccaaaaaacaaaaaaaaatttcttgtcaagaatgggattcgaacccatgccctttcggaccagtacctgaaactggcgccttagaccaactcggccatcttgacagtttcgatatggttttattgacaatttataataatgtgtgtagaattcttcgcgacggtaaattatacaggacaataaaacgctgactatataacgtaaccgaaaccaaaattcttgacgaaactcaagaccctctctgtataatatgcaagctaccattgtcttacattaaaaggttctaaagctaacaggccaatatacataataaaaccataaatgccacagtaaaattacgccgaacaccgagttgcttcaaaaatggttactgctattgcctgtcaataaattgacttgtgttctttgttcataaatatgtaacaacattgggtgtcagcatatccatgttagcccatgctgccaaagatactacaaggagtaaacaatgttgtaccgatgaaacaagttttctccatgctctctgtaatctgctaagctgaaggtgtgcctcccaaacttgctggaagctgcaaaggcagcagcgcccctccatgcatctataagggggtcggctgctctaacaagcttcaggggtgagaggtagggccgaaactgccggattccggattccagccgagggatcatgcctgggatcaaagaacagcctccagtgacaaggatggactggcaaaggcgctccttgacagcctcgtcttccattagtcgcctaagtgagatgctgaccatctcatcgataccagcctggtcaattcctatcataccaggctggaacaatatttcagggcaccggaaccgctcgatccctatggaaatcctgtaatcttctgctgtaagagtccggaccttaggaggctcaggagtctgttggacagcttcagctttgttcacaaatgtagggtccatatcctgcacatggaagcatcaaatagtttatgattgtaaaagaaactattgaggtgtgagatctaagtaagacaaaatggccatcacggctcacaagcaagattgcttgaacgtgagatcttacctggatcttagaagcaattcgagcaagttctgattcatcatcatcgttcccatcgtcgtcgtcgtcattatctttgctcatctttttgtagactaaccaatcttcatctctcgtaccaaaagtgtcctcgcccttcccccgatcaaatgcagcagatgtgagcaaccgcatcctttctttctgggcggcattaagacgttccccacggcctactccaccagatgaattatgattaccattggtcttaccaccattgagtttctgtcgcttcctctgatcaaccctatcagaaagttccgagtatcgagcacggagctcttcaaggtataactctgggttctccctggatattaaagtaaaacatatcataaaagcagcgtatagagcgcatggcaaatatttatgacagattcgagaaaaatttatcccttttcatagagtgtatatttcattgatatgaggataatagaatagtaaattgaacattgtttggaattgcagaatgcatgcttgatttccagggcttatatcagcacgaagcgtatcacaagaacaaaaactaaaaagatggctctgaaataactggttaactaacccagtgtacttaaaatttcaaaaaagaggatcttaagctgaatgcagataaactaattatgacggccgtatgaatgataaatttcagactggggacatcgcaacttacaaacgcctctcttcttcttgcttctccctcaatgcttcctcctcagcacgtctctgcttggcacgcattcgaccttctgttgtggttttaagtagtatctgtttcttcttctcttttaactgaaagtatacgaaagtgaaataagaatagtaaatatttgaaacatggaaaatatctaaacttggtataatagatatgtgctcatgtcacacagtcgcaaaaggtctccccaaaacacaagcaaaaacaaacccctttgctacagatgataaatggacagacacacacctgttctggtgtcaatgtttcatcagggacagacacaagtggatacttatcaaccccagaagcatctgctttctcttcgttaccattggactccccctttgccttccttaaggattgtgttgctttcaaaatagcagatttgatttcctgctgggaaagatacccagatctacctaaaatggctgttgcttcttcttcctcagctccatcaagttgctccattagttcctccaaataagaaagctgtttttcaagttctgctatcttctgcgacctttttgcagcagccatatctcgcaaacgttgaccagccttttccttcaaagctgcttttcttgcaagttcttcctcagatggtggttcttctacaggaggcgggacccatggtagctgccaatacctagttttttcttcagcttcttccttattgttctgccaagtggatcaataaattcatagtgttgaaagaaagagctagaaatgtaacacggtagaaaagccctgtgcattctatagatgaactggatttggaatttacattggtaagaaaacaaacggtaaataaaagtttctcaccttaaatatctgcaactctgacatataatcaagagctacgtaacaatgttccttcttcagctcttcagccttttcccatgtaatgcttgcactactcaatgtaaagtggcaacgattagacatggtaggaaaaaaaaatgcatggagcacttcagaaatatgctgcgggcacctacctgtgatagggatactttagagagaggagctgcctcagaaaatctgtgatgtgaaagccaccaacgttggttctgcagcatgcccccaacacaggttctccctttaaaaactgaatgcatatacacagcaaagcattaatcagaatgcatatgtggacaaagaaagaagattttatttcacagaaccactttgatgagtacaacataatatttttgtttattgattgtttcaggatcatgacaacaataaacaaattgtgaaaaatacactacagagaagaatagtctaacttggattggatgagttagtatgcagcctaccatggaaaagtaagcagaaattcaaacacacagggctcaaaatacaaagcaacttttaccaatgtagttgtccggaagcatcatagattagatggaaagaaaacaacatgctgtgtctggagatcaagaaaatacatcccgacttccatgagcaaaatgatttagctaagaataggggcactctttctctctctctctctttccatgagcatgttatatagcattacccactacagattatccaatcagagttttagaatctacaatgcattcaacaatactgtgttcttcaagcatgcaatgcattaattttccgaacatctgacaaggtaatggaaatgcaatggcaaaggatttgtatgttgcacaaagttaagaggaaggcatgtggaaggaccaaacttactggaacaacatggcatgttccatgttcacacgaaatggccagtccatcttctccacaattcccaagtttctgattgtacttgtaactaaacacatcgtcaatgccaaaagctgaaactcacataggaagaaacatctttagcatcgacaattcttacttcaaaactaccatgcacaattgataacaatggcacaaaaagataagtatcattaccaatggatggcacgccatatgtctcaaaaagtagttctgacattctggctcgagaaaaggatggattgcattcacactctgtcataagaatgggatggcccacctgcccagcattactgttacttccagcagcatgaaaccaaacaaatagctcatgtgggaaccagaaaattctaaggtaaaaggatgcatacaaatatattactatataaccaaaggcacataacactttctattagaactatatgatactaatgagaaaaatctgttcagaaatgcctgctatgcctgggttattttttcactgtcacccaccatacacttgagaggagaaagctcactgatgaagataattgtccatgtctgtcatatgtctaggatggatatgctgaatatgacattcacttgtcatttaacttgcctgttttagaggctgagagcctgatactaaagtttcccaaagactttgaagcattacgttcaacttgtgaacgtcaactgtgtcactatgcaatatattcataagaaacttaattctgaacccgaaaccaactgaccattttagaactcacatgctaaattcaagttttaataaacactacatagtcccaatcattgcacacacttcacttatacatagaactggcatacaaaagaacccccaaatttcatcatttttatttgagagggactaccccacatttactagtgcaaggtaaagcaaagctgtcaaaccaaggaaacagtacataagtcaactacattcagaatatattcatagtacagatgatggcagagtgcaatttacctctgaagtggcacctagtcgatcaaaaccaaagtcaagaatctgcaacccagacagtaataataccagatcaaagaaatacttaaaaaatgtttgttacacaagcaataaaggttggagtgcaaatatcaacactctgaagtaagcaatcatgtgctgcactctaaatttgtgaaacataacaatatgtattggtatctaatgtcataaaggatatgtgaactatgaaagatattatcattaatagctatagaatagagcatactcatagaagcaagttagaatatgaatttctaacttcagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45811 - DNA, 1155 bp, Oryza sativa
aattaaacagcaatgttttcctcaagggataatacttgtgcgtgaatttgggttttggcatatcggcggggctaagggttccaggccattaagcagccaaaataagagatttgctccgatccaataaaaagtatttcaaggtaccagtacctcatgatacggccttaaaatactttttgctggactggagcaaatctcacaaaataaatcacattactcctgtaaattttctcttctttttttcttttctctgaggccttaagggatcttgtacaacttttttatctttctacttgatacagctactccccgcgttctcgtacatctttataaagaaagtgttaacatacacatctttataaccgtctgataatattatttgaggcattttaaagaaagtgcataaaaagaaaagcaaaggcattatctaaaatgcctgggaagaaaaattgaggcatatgttaaaatgcctcaaaatgtgtttaaaggcaatctaaaaagtgccttcatctatacttatgaaggcattttgaaaagtgccttaaaaaatcccttttcctacagcagtatatccaacactttgaggattggaggcatttttttaagtagttgaggcattcttaaatgccttcaaatgctatccatcctatagtgtttcttatcttctacttaatacaagtacacccctcggggtttcaaagaaaagacactgcagtttcgcggcaaagagcggaggatcgagctgcacactatgagacttacaatactgactttctccgtatgacgaagctgaaatttccccaagcctctcatgcttattgttacatccatgcatgcacacacgatttagcttagttatattcggcctcattaatcaccaaaacatagtagaacgtatttaaacattctagcttcttcttcttccttggctagctagctatttgcagagaaaatatacaccttttttttcttgttcagttggttaatatatagaccctattgtaataaagctgtctagctacgcttctggagaattgttcaaacccagaagggttttttgagaaacacatgaagctgtatatataagcaaggagagcatacaatacagtcctgccatgccatgctgggattgcactacaaattcaaagcatacag

SEQ ID NO: 45812 - DNA, 15158 bp, Oryza sativa
  unsure (1)..(15158): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaccacggagtaacatataatatagtaggggtttaagtgctgttctatctaattattgccactctgttcagaccgctttgtccctccgcgggtgctgcttggtacaggcgtacagcgctcatgacaagtagtacactactacttacttcctccgtttcacaatataagtcattctaacattttccattttatgataatgttaatgaatctaaactagctgggtggcccgcgcaattacgcggctagcacccatataaaattatatatttttaatatgattttacttcaaatttattaaatagttatctcattgtcttaagatttttaaagactacaccttattatcctcgtgtttctaatttttttagtttttaaaagtcacaacagttgctaccccttacttctttcatattattctttatttgcttacccgatctaccactattttctattcattctccttagaatctttaaaaaatggatctaaaaacttataggttttagagtctattgtcctgtttggcatctttttttataatttctagaagtcccatcaaacacttccattatacttatctatgaccgtccaccgcatcgtctctttattgtcattgctattttaaaaatcgaacataattatcgtttaggtttatattttttactttctataagttccgccaaaacgtcagcgactttatcactgtactcctctacggctcacccgctgccgcccttctttattgtcattgagattttaaaatcaaacaggattatcgttggggtttatttttttactttttagaaacccgaacctttaaaaattggagtttattgtcttgttgggtttcatttttttaataatttttagaaatcccgtcaaacgctgccactatactcctctacgacccgtctgctgcatactctttattgtcattaggattgtaaaagtcgaacataactatcgttggaattcatttttttttactttctagaaggcccaccaatcattggcaacttggccattgtactcctatacgacctgctcgctgcctctcatttttattataatcgagattttaaaaatcaaatatgattatcatttggtttatttttttactttctagaagtcccgccaaccgccttgaccgattgcttcacgacctgcctgttgtatttctttttagtcgtcattaggattctatttgcggtagtttttagatgttctatcaaccgccaccactatgctcctctataggcatgttacttaattaatctcgtcatgtgtttcaaatggtcttttcttttagtaatctttatttttttatcaccaattttagttatttataaattgtattcctagctaatatcttatttttctttttctaatttcagaatttattttatttttcgtattgtgtgcttttgatatttttatttttattttcaatttcagttgttttaaaattgtatttctactttaactctctttttaatttgcctaatttcagattatatattatttttattttgaattttagttaatctactattaggttcttatatgtactcttattttaatattgtttatatttaattccgaattttaattaattttaaattatattcctacttgaactcttcttttcttttcttttttctaattttgatttttatttttttattctgaattttaattaatctcgtattgggttcttgtatggactcttcttttaatattccttatttttaattctgaatttcagctatttttaaattgtattcctacttagacttttttttttttgctaattttggattttattttatttttctttcaaattttgattaatctcatattgtcttcctatatggaaacttctttcaatattacttatttttaattccgaatttcagctatttttaaattgtatttctacttagactctccttttctttttttctttttctctaattaatgtgggaatttctagcccccacagcgaacgtgatgcctcctttcaaagctgttttaataatatattagataaatatatatgtctatattcattaacatcgatatgaatatgaaaaaatattagaatgacttacattgtgaaacggagggagtagtatatagcacgggatattgcgttatcctttgatgcagcgaactcattccattgtcattcagttcagctagtgcgaatcatccatccattcatccaccctcaccgtcctggtgttaatttcagctcagtactccctccgtcccaaaataaaggcaaaccctagatttccgtgtctaactttgactgtccgtcttatataattttttttataattcatattttcattgttgttagatgataaaacatgattaatattttatgcgtgacttgtctttttagtttttttcatagtttttttaaataagacggacggtcaaacattggacacggaaactagggtttatcttttttttctatttttgggacggagtagttcactcacatttaccttccgtgccgatctgcactgctgcctctttcatcagtgatatgatactatacgaaatcgatcggacgagacgccgggacagcagcagctggggggagtatataggaaccaaaaaaacggcgctgtacattttggtcggttcgccaatcaagccgcgccgatggcacggcaagttgcagggccgccaaaaaacctcacgtacagattcctgcgtgcgattgggcccttccggaaagaagaaataacgggaaaaaaaaagcgcttgaccgatcgcgcgcgcgtgaccgcgcgggccactccgtacgtgccgacctcggtgatttgggaataaagtgcgtgtgcggtgggcactgcgtagcccaccacctctcgactctcatgccgacctcgccagggggcccggatcctctgctcgaaaccatgtggatttccctcgtccgcagatgcgatctgatcatcatcatcgatctcccgtgcgcaccgatgtgatgcgaccgtgcaacagcacccaacacatggaagtatatccggcttatccgcacatgcatgtggattttcgcttttttggatatttggatatacatacctttggttcgtcctttttttcctaagtacttgtcgatgcatagtacacttcacagcttatgcttctcaagttttgcgctttttatacaaacaaagcgatttgcaggcatggataagatatgtgtggagcatgtgcttacaaaaaggtgttaggatcagtatctcgcattcacagttcgttagttccatctcaaccagctcgatcactgttatctaacacccggggctatttagtttttctattgaaggcaaaaaaaaaaaaaagagagagagagtttgctgcagtccattacatgtgccgaggcttcatttgaaatcgagaatgactttatacccctctaaaatcttactttatactccctccgtttcgaaatgtttaacgccgttgactttttagcatacgtttgaccattcgtcttatcaaaaaatttaagtaattattaattcttttcctatcatttgattcattgttaaatatatttttatgtaggcttataattttacatatttcataaaagtttttggataagacgaacggtcaaacatgtgctaaaaaagtcaacggtgtcaaatatttcgaaacggagggagtacacaatttgacaggtatatgtgagggttcccccccccccatttttaagattatttttgtaagtcttcaagaaaacaaattaaagtttttgggacaatttcatcccaaatgaaataagatagaggcgtatatgtagagagattattttattacatagagtagttgatagaaaacatgatgaagcagttggtaaataaaaaaaaactatacttggtgctcacttttaaaaggagtatataaaaactcactgatcggtgcagtatgattttttactgcatcctgaacctgacattatatattgcaccaacggttacaaactgcgtgatacaaacacaattaactggcaagctacatatgccccgcaattaacctagaggctagagagcctgcctacttattcgaacgctacaatcggatacaaaattacatatataaaaaccataatttaattgactgcaaaagtataagaatcagtaaattcttgccgtgtagaaactggtttgagcatgactatcccgttcagtttagggcttgagcccgctataggtgccgccccgccgggacgcggagggaccccttctcccagacgctgtagtccttgccgtgcaccgtctgatggaaatccgacggcaccgcgttgcccacgtcgtacctcgtcccgatcttcaccatgaccttctcgtcgacgacggcgacgtatgcgtcggcgtcggcgacgacgatccggagcttgctcccggcgttgatgccgttcctctccctgatcgccgccagcgcggttatctcctgcttcaggttccagtcgaacatgtggtcgtagaactgccacaagaagcgttcatcaggacacgtgtacggtggaggttaatcaggacatggtatataatactataatgcatggtttgcttacgatgcaggggactccggggtgggtgaggatgtaggcgtagccctgcatgaccttgtcggaggggaacggccaaagcttctgcgtcgagccggtgtcgtggttgtcgacgaacgtgacggccttctctggcagccacccgatcatgccggcggccttgccgttgccgtcgcgcagccgccacagctcgccctggacgcccgcctgcaggaggcccttggtggtgaagtcgaacgtcatcgccggcccgccgacggcgttcacccagttcaccagctcctgccggccctggtcctggttggccgccggcttgccgtcgccgttgtagctcagcgagttccatatctcggcgacgacgaagcccggcttgcagctctcgacgtacatcttagcgatgtccgtggagtatcccttggcgaagtcgaggcgccagccgtcgaagccgacgtcggacttgagccagttgagccagtcggtgagctcccgctggacgcgcgggttgaggtggtcgatgtcgggcgccgcgccgaacccctcgccggtgtcgcggtggcccgtgccgtcggagtactgcgtgtcgtcgctgcagatcatgccggggccccagtcgaggcggtcgtcgggcgtcccgccctcgaacacgcagtacacgccgcgggcgtccttcttctcggcgcaccggtggttgatcacgacgtcggcgacgcactggacgcccttcccgtggaacgccgcgatcagcgacttgagctccgccgccgtgccgtacttggacgcgtccaggtcgtagagacgccccggcatgtacccctgcggcgccacggagtgcgacggcggcggcagccagacgtgggtgaccccggccttggcgatgtcgtcgacttggcctttcaacatgttgtaccagccaccctgctgcttccacgactcccagttgaaaccctgcatgatgcatgttataagtaggtaagtgatcaatcgatcacacataaatatctcaaaattctaatgtgtttcttcagcaaaagtcttcacagaaagtgatgggtagtagagtactacgtacctggaagaggacctgtgcttgacccgagttacaggtcaagctgcagagcaccacgaggagcagcaaacacaagctgctggtgttcttcatatctgtgtaagctgaaaccgtgttcgatagtgagttgctgctaaccactactgatcgatctcttgtagatgatggatgatcgatgtgttcgtggcgaatgacctcgacgtcggggggcatatatagaacaccgggggcacggtcaccgtggcaggggaatgagaatgatcaggagagacgaccacaataaatggcgtggatatggataaggcaataaagcatggccacgtaggcgccgcgtcggccgcgtcggggcccggtctccaaggcgacgggatgcggcggcgtgatcgcgacgactgcctgaggcgggcgccggctacctcctcctccatccatcgccggcttggataaggcgagcatttctctgaactttcatcttcagagttcagacaaaaaagacagtgctacgtgttctagcaggctgatcgtatataatagggttgcagttagcctcttgactggccgcttgatctcccgtcatgtatatgcacatatggctcgtcctccttcaattcctgacatggcaattctatccacatctcggtgagaccctaatccggacctcgaaatgcgagaatcagataatgctggaatcaatgagtccgagttgttcatcgtcatcagccaatggagcaagccggaaagagagactactgttctactaagactagccatctcatctattgtagttgatgaatttatgtcagtatctatgaatgttacgagtatcagtatgtcataagtcataaccaagttcattacaaattccatatcaaagccgccatgagcaatccaaatggataaggtagaagtaggtgtatgtttgctgatgaatactccgtacacaggcacatatatgaatgtcatgaccaagtttatcacaaacttcatctccgccggacgcccgcagcgagcatttaagtcatcgagatgctaacttaggagctgctgatttctagcacgaactagaacgttcctgattgcgcacacctatatcttcttttcagaacggattactgattgatgattgcctatggagcagtggagtagctagcacaggtggttgaagatcgacttgacgctctcagcaaaggggactcagcagaataaacttccctcctactttcccacaagagcaaacaaggcactagcataggaataagtcctcaactcatgggtctggttaaaatgcaccctcaaccgcaaaaaccgggtataaccaatcgtctaactcataaaaccgttgcaaatcaactcccccagcggttttggaggcggtttcgtcgtacgtagcacttacgtgacgggttgacttggtcttcatcccatgtggcatcgacatgacgcttacgtggcacaaaataaaaacaaacctaaataaaaaaaattgggcccacgtgtcagttactcagctcctccctcttccctctttatactcagtgtcgatcgagatggagagagcagcggggcggcgagagctcagcgggagcagcaggatggcgggagcggcgggaactcggccgagcagcgggagcagcaggacggcgggttgacggcgatgtcgacggtgttggtgtcggcagccgggagctcggtggagcagtgaagcagcgggagctcgacagagtggctcggcatgagcagtaggacggcgggagcagaggtaaggaagcctcgccaccgcctcctctcctccctccccgctgccgcctcctatcctccctccctgccgccaccctcctggtgatcctcgctagcctcgaaatccgcgtcgtcgtcgggcaggggtcgaggtggaggcgaagaacgaggtcggcattggggaaggagagtggaggagaggaggcggcggcggcgacggcgtgccgagccggcgaagaggagagggtgctgagccagtgtggggagtcgtcccctttgcctagatcgacgtcgccgcgcttgcgcgtcgcttgcagtggagcacacatccgccggcctcgctgacctagccgtcgaactcggaagcctccgccattgtcctcgccctccgttgtgctctgtctctctaccgccaccatccactgccatttgccggtcgctgccatcccccatccacctgagaaagagaaaaggtagctaacacgtgggcctgaagtttatttttattattttactcactgacatttgggtcctatttaaggtttgttttcattttagtgccacgtaagcaccacatcgatgccacatggtataaagatcaagtcaacacaccacataagtgccacgaaactgcctccgaaaccacctggggagtcaatttgctacggttttggaagttggaggatgagttatacccagttttctcccgggagagattgtccccagcgcagcaccccaggtagccatcgccgctaacgagtccagggtcgggaagtccaacagtcgcaacagtgacggcggccgcatcgcgattggccagtgcttgcgcctctcttagtggtggtcgcgacggcgacgttccggttccgtctgtgttggacttgcgacctccgcgccgcacccgtcggcctctgcgaccttacttcgccgttgcgcctgtcccctctgcggtgccaatcccctctggtctccgtggctgcctgcgaggaaggagaggagaaataaataatgtaaccgatatgtgggcctcacatgggccccacctaaattttcttattgtgagtgccatgtagatgtcacgtgggatgcagacctagtcaagatgccatgtggatgcaacataagctaaagctaggctcaatagtgccttgggagtatatttgcattggtttttatgataaggacctgattttacgattgagggatgcgattcgactaggggcaagagatcagggacataaaatatacttattcctacttcctccgtttcacaatgtaagactttctagcattgcccacattcatttagatactaatgaatctagacatatatatgtgtttagattcattaacatctatatgtatatgtgggcaatgttagaaagtcttacattgtgaaatggagggagtaattaacaatctacttacttcattcaagcacgagacaacaatctgttgctggtcaattgatcgttaggcgtccctcaaggcttatcgattcgctacgaatggagcttcccgaaacttgagtgggcgtcaagggcctgacatccgggaaacaggctacagaagcccaaaagttagcaggccgagacaatgactgtttctctatatttgacaggccgatttgtgtggacccatttactggacaattggatagtgggaaaacttggtttattcgttgggctggaagcctcgaacggtgtggtgacttgcatacggcccaagatcattatgaatggtgggttatgttgggccagaacagggtgatgactgatgacggtgcaacgtgcggactattttagtggaataagtttagttcatatccctcaatttatcgccgagtccaaattggttcctaaaccgaaatatcacccatgcgggccccacatgttaatgcctagcactttcctcttcctcctctcttctcctttctcctgtgcccgtcctcccactccactggcctccgtcacctctccacttgtggctccgctctcaccaccttgtgcgcattggtcggtcaccggtgcaaacattgtgtcattccttctccgtgcctttaccgttgagccgccccacggtgcgcccctctgaaaccagctctccatgcctatggccccgttgacgttgtccattgcttgtaggagcctggactcctcgaccgagagctgtatcaagttctagacaaatgaggaaaagagaggggagatggaagatgggagggaaagaggagaagataaggggggagggaggagaaaggaaatgataggaactgacatacgcgggctgcgtgggtcccatgctgaatcagcttgtcacgtcggttaaaaccggtcacaatactgtctaggtcctctagtgaaccgttttgaaaattgggggaccaattatatacagtatttcggtttagggataaatttcagactcgctgataaattaagggaccagtgaacttattccttgggttataaaggaaaggtgccccattatagttaggctaaatcgttgctgtgaagaacattcgtcccattatctttggaccgctaaatgagagacaacgagcgtgcgctttgggccggaatatgcagtgtcattcttttacttacggcctaatattgctgggccaaacgggatcaagttgagctttcaatccaccacggtatccacaccgctaaaagcgggagtaaaaaactgaagtcaactgacaagatcttgcaagtctttcttgaggatcgaaacgaacagtagctagttaattccattcatcctacatttctgcaggattaacagggtacattccgcttacttatttccgaagaacgctagttataacgaagcgtacatcgatcgaagctcgctcgtacacatctcgcagcaaaattgcatgattcatagctagagccacgtacgtatatatattatctagggttgcaaagcaccatgcaactcgatcgctatagctaaagctaatagtgctttctaccggcaggaaccctgaggccttccttctcccagacgcagtagtcgttgccgtgcgccacgacatggaagtcggaggggatgatcccgccggcgtcgtacctcggcccgagcttggtgatcaccttgccgtcgatcatggcgacgtagatgtccccctcggccttgaggatgtccagcgtgctctccgcatggatcccgttccttgaccggatttcagccagcgtcgcgatctcgtgctgcaggttccagtcgaacacatggtcgtagaactgcatacacacgtacacatgcaccagcaatgagctcaccaatatgaacgaatttgatgagaaagatttcggtggtgatacttacgatgcatgggatgccagggtgagtgaggatgtaggcgtagccctgcatgaccttgtcggaagggaacggccagagcgactgggtcgagccggtgtcgtggttgtcgacgaaggttacggcctgatcgggcatccaccccatgaggccgggcgccttgccgttgccgtcgtggagcctccacagctcgccctgcacggcggcctggaggatgcccttggtggtgaagtcgaacgccgtcgccggcttgccgacgccctccacccagttcaccagctcctgcctgtccgcgtcctggttggtcgacggcttgccgtcgccgttgtagatgagcgagctccagatctcgccgacgacgaacgtcgggttggtgttgtcgacgtagatcctcgccagcggcgcggagtagcccttggcgaagtcgaggcgccagccgtcgaagccgaggtcggtcctgagccagttgagccagtcggtgagctcccgctggacacgcgggttgaggtggtcgatgtcgggcgcggcgccgaacccggcgccggtgtcgcggtggccgcggccgttggagtactgcgtgtcgtcgctgcagatcatgtcggggccccagtcgaggcggccgtcgggcgtgccgccctcgaacacgcagtacacgccgcggctgtccttgtagtcggcgcagcggtggttgatgacgatgtcggcgaggcactcgacgttcttgtcgtggaatgcctcgatcagcgacttgagctccgcctccgtgccgtacttggacgcgtccaggtcgtagagccgccccggcatgtaaccctgcggcgagacagagtgcgacggcggcgggagccagacgtgggtggcgcccgtgctggcgatctcctccaccttctcgtgcagaaagttgtaccacccgccttgcttcctccacgactcccagttaaacccctgcacgtacggcaaaaacacccaaacgcaacccatggtcaaatcaagcttcctgactgcggcgcgtacattatattgccgtgcaagattattattatcaagtattaacaaactttcaccaaggcgtcagtaaattaaactacctggaagagaacttgggcttgtgctaagctggacgccaggcagagcacagcaaaaacgacacaacacagggtgacatggtgcttgcccatggctacagagcaatgcaaatgcagtctcaactctgcttcttctccaaactaacttgtttcctaatggctggccaagtagccaaccttcgcaaagagaagaagagctgcctgctgtactctgcttctctgctcttgcattgcctgaactggcctctatttatagtgtccaagaggatcaggtcggaggttacatggccgaggcgaattaaacgcgaacaatcaatgctgttgcaattcacggataagcaacatggataaaggtggttatttctccaacggaaacgagtagtctggaccccggtgtccggtgatggagtgccgccttgagccgtgcagctacttcaggccctgctcgagtcaccgccgcgccgatcgaggcgcgcgcgagctctctcgactcgtcgtccggtctctctcggtgatcgatcaccgatcacgcatgacggaaacggcgatacgttgataagaggcaagccgcaagcggaggagccgcacatcagttggttgttcgaacaggtaccgggcctctaccggcgtcgcgtcatcggtgtgacggatcaagcgccggcagggaaactttcggtttggaaaggagatcggtgcaacggacatatattttgcatttacttttttttattgaaaaaagagaggagatcctctcccatttcatcgacgaaatgccaatatacacttttacagagtttatatgacctgcagagcagacaactcccctgacagaaaacaaaggccataagcaccaactccgtcaccaatccaccataatcctgcaactgcaagcaacttagtctaggactatttgcaaagaaaacagcaaacgtcgattgacttggtacaatcacagacatgcaatggaaagctcaataactccagatttgcaccacgtcaagcgcattgcttgtgaccttcatccatatctttgaattatactaactttatgttctaatgtatgacgttgactttttgtttaacgtttgatcattcgttttattaaaaaaaatgcaattattatttcttttattgtgacttgattcatcatcaaatgttctttaagtatgacataaatattttcatatttatacaaaaaatttgaataaaacaaatgatcaaacgttggtcaaaatacggagggagtataatttaacggcaacctctcattagcagcgccaaccccagctgcagtattcttcgctagtcctccgatatctgcataatggatcaggaattgatccagtaaaaaccttcatgtattagttcagtaggatctttaattctcttgtttttgaagtaagctgtatttctggccttccacacagtccagatgactatagccccatgccaaccacagcaattttcttattttcttttactaaagctatgtaaccgtcctttgcgtttacttttgatcttgagaaggaactatactaatttgatggaacgttgttgatttacataaggtgaactatggtttgtcacattttatgccgttggattgaaaccataattagatatgcacatctgaaagctaattctagtgctaagggagtcaacattaaaagctactaacaagataatccccctccccctttctatcaacggactgtacccgactatgatatttgtaatgtattgaggatgttgataccatggcatatgcaagattgtggtaaaatagacgggagacatatttttgtataggttcaggctccctttgacgggtaatagcgctactcctgttggtcgaagcagatgccattataaaatcaatctctcacaagtacaatggggaggagtctgacagtatagcggcataaaagtcaagcatgtggttgacggctagcaatcatcagattcctcgattgagtactctgctagcaatcgtcagattcctcaatttggaactcgacgagattataggtagctatagatctctcttgacttttgtggcgcttgttggattgtgtcatggcttatgtggctctatattgtcttatcccctctccttccggatgtctcgtgtttatacccttggatatcccattgtacaagtagaagtactgtagaactagagagataagtatggatgcaatccgaatagaccttgtagagtccaagtagaatgttgtttatcttttcttatctagaacttcttcattatcttctcacgaatttggccatacttcttcattatgagactgatttcttataggacttgctatatggtaggtcccaccaagcttaatacacaagtattatatattccatatttgagacagagactgtttcatattataaggtgtttgtctttttataagatctttagtttgaccaagttcgtagaaaaaatatctacgacaccaaattagttttactaaatattacattgaatataaacatatttctactttgataaaaattttgctctattttctataaatttggtcaattttttttgaaaaataacatataaaaaagtgaaaacgtcgtgtaatacgaagatatctactacaccgatcaagtgcagtactaaggatttcaaaaaaacaaattgacagggattttcacaaattgtataagatggagaccaaatatatactactccctcaaatgtttgacgccgttgactttttcaaacatgtttgaccatccgtcttattcaaaaaattttgtgaaatatgtaaaactatatgtatatataaaagttcatttaacaatgaaccaaatgatagaaaaagaattaataattacttaaattttttgaataagacgaacggtcgaacatatttaaaaaaattaacggcgtcaaacatttagggatgtagagagtaatacagtagtgacttagaaataaaactgggccacatattagaacattctctctgggccggccgggcacagcccacatgttcttcgtgccgttcctaggctaaaggcccgtgtgaactggcacgacatgggccgcttaattagacggaccaaaaaggccgtgcgtgcctttaccaggcccgcatgtgtaccgtgctcttgcgcacaaatgcggccgtgtacaattaaggccgttccgtctttatctcgaaggcagctgaagcacaattaaagcctt

SEQ ID NO: 45813 - DNA, 10994 bp, Oryza sativa
tgtacatgcaagtatatttaacaatgaatcaaatgatatgaaaagaataaataattacttaaattttttgaataagacgaatggtcaaacacgtactaaaaaaattaacggtgtcaaatattttgaaacggagggagtacattggaatctgtagcatgggcgatggcggtctccttcttccttctccgtccaacacgtgggtaatctctctgcgcagatcagagctgtggactatggtaccatgtcagcatctacatgactgatccatcaattttatgcagagatttggagggtagatgtgtgatgtgtccccccttttagaaagagctagcttagtgtacatatataaaacatacccacgacggataaacggtcactggcccttgctagctttgcgcctccggattcttgcaatggcaaccgggcctccgaatcctaaagcctaatgagacgagatgttttacactggtcgtgcaaaccagtgctacacgttgctccatgaacagtacaaacaaaggcttttagttttggctgcatggacaagcatcatcagccacaattagtagctgtgatcatgtgcgagctgctagattgatggatgtagctagcaaaaggaagggaaaaagggagctgaaagaagaaggtagctctgaatgcaaagtctgcatcctgcaaaggcacgagagggactggattgttggaatttggaaagggagccctttccggatccttgcacgccgctttcttggattcgggattcctcggtacgtggccgtctgcagtctactcgtcttcactttcctttgcctgctcgtcgcctttcatggtgtcaactgtcagcgcagatgcgcaatggggcagcagcaagctcctgctatcctcgcaatggataggcacagcgatatgattgtcaatatatccggttggttggctattctcggttgcagcctacaggctagtagtcgtcctgtcgttttgctctcgatatcgatcgagcactcacattgtaagatcttgcagttcgtcaaacgatttttgataaaatgatccttctttaatttccggcagtgtgccacttacttggagtaaccatgagcctcactacggtactctctactcataatagaaactaatctaaattattgatcttatttgatttaagggttcagatctatttatactactatcctagttagcggtaataaaaacgtgaagagatattattataaaaatactgggtgcaaaatggtatcatcattatttaacattgattaaacccctttccttttttttttgctttttttatggatatgagttatgccagcacgatggatgaccacatatcgatctagcctggaaaaaaacataaataacaaagttaaccataatagatatattggtaaattaccgatttattcttaataacgaatggttcaaactatttctactgattaagtagagagtaccggagcattactcgagcaacaataggctacatacattactaatatccactgacatatatttattttaacttgtaaaagtctaatttaaacttacatgtttaagtgatatatattgatctatcttattaattttttcatcaattatttgaatgaaataaaaaaagagatatattctcttaagagatgaaaaaacatttccctatccactggtctatttgtttctaccactttggattagctacaacctacagaattttttttctcgaacgcgcaaaaggattgcacgtcaatatattggaagataagaatattcgttacacaaatagtcggtctggcttgctccaacctacggaagaataacattttccttttattgggtcctaggacccatcattgtacatgaaccttttctccttgctttacaaatatgttgagggtttatttctttggccttgtcaagggttttgctaaaaaattatttatcagcaaaatcattcgatcaggtttcaatgaagtcctcagtattcaccagttgagaaggtggcagtgaccggacatattgaaattcaagatttaggatcaccatcgagcttatcggtgatgccctacatttagagtggggctaaatgatgaagggaagagaaaacactaacaatgtcgtagtcgtgggagacaggtatcaggtgttgagaagaggttaggtgttacaagggatagcaaggtgaagaatataacatggtgtaacacccaacatgtaacttggcgtgggggtctagggatgaaagcccatggccttacatattttttcaccatggtatggtatatggcatttgggcattctcaccagtgattttgttgtacaccagtgagtgggggttggagaccgagggagagaaggaactggagaaagctaggattaacatcttatggattactccagcttagaaatttggatgtttttattataaaacctgtcgacacatgtgtatagatgatggattgatcccttagcagtatcctcctaccatacgctctggattaagacgtgtaattgcagggcgtgggcatggtccttcctgcctttggcagtattgcagccacagtgtgcatcgtcgcccagatttttattccctcataattgagctcgatctggttgatcttgggacctggctatatatgatgtgctttcatcggtaggctttcttcacgctcaagtagttttttttttcttttttgctcttttgaaaactgttcggcatttatcatcaatgggttgtcctcatttggatggtgaacgatgggcagctcgtgccattgggaacagtcgtgtatgaataccagccatttgagctgcaattaataaattggcctcttacatgctttttttttaataatgaaaatcatcagcctcgtgcatgaattagccacgttcctgataaattgatcgtataaaatcgtgaccttcactccacagtgctggcttaccacataccagatcatccattcccggcccaatgacatggttcaatcatcactagaggaaaataaacccgacgagagatggagttcgatcactatttaagaggaaacaaaaagcatgcttggatgagtatgctgcggttgtgcatctgctaccctcggctagctgcgacctttatttcccaaccgtaccaatgcaaggggtttacaatctcgacgaatttcaaatggagttttctagtaaatttagaaagctctattaattttgttgaaacaatcaatatactgcaactttcactaagcattttagataatacaaccacatcatttaattttatcagaaagttagaatattatctctgacaagtttgggcccaccaattataaagacataaaataattatttttttaaaaaaattgggcccatatgtcatataaatatattggataaaactacagtttatataaaacttttgctattaatttgtagtctgtaaaatatttagttaaagttatagcaaaatgtacaatagttttgacccaaataattatggttttatgaaatttcaaacatcttgaattgactcaaaatgtgtgtctcgaatagctttatttaaaatttatccaattaaaaaaattaacatctcaatgaggattaaaattcgcttagcaaattgaaattgcaaaccctggcccaactggctcaaacactgcaacccaaataaaccataactatcccatctattttgggggggggaaaattcttttaatccctcgaaggtgtctcctccttttttacatatcatctgaatatataattataaaaaaattatgaaaaaactgataatatctattaatatgtgaaacaccacgctacaaatatgtaaatttaaatatgactttaataaggtgtaaaaacatataatttaaatatacacatagtagttgagttttatcttttttttttaacaaactctaaagatcgaataggaacatgtatatttagaggatgatatatcaaatgtgtaatctatcatgtcaatgttttctaagtttttcataactatttaattgggttgtgtttagatccaaagtttggatccaaaattcagtctttttctatcacatcaacctgtcatacacacataacttttcagtcacatcatctccaattttaaccaaaatacaaactttacgctggactaaacacagccttcatgtgtaagaaactatgtacgcccaatgtaaaatccatcactcctatctagtaaactgtttgtatttagtttgctttaagcttaacgcttacccacgtgccagctagaaatctagagtagggcctttttaaggtggccctttaaccaaactaaccaaactactccctccatctacttttgatagtaatattttatcttagcataatggctaaggataagtaattctatttatcatccatttaaatatgctactagttattcctcgtaaataagcaattcatttaaataagcaattcttaatggctatgtagccaatcttgtgtggaagatgaagagtcacacattaaatccgagaaagtcattaagagtataggtggttggattgaaatatgcctatcaaaagtaatttttttatatttaaaaatatgtctatcaaaaatagatgaagatagtgtttgagattgatctggacctaaaggttaaccaaacaattttaattccattaaaaagaaaatggaagactaaagtgattaaacaaatcggatgatggctatgcatggaagcaaacctgacggtccaacatcccactaaaatcaaatgtaaaacatggcgatataattttttttagcaatgtcgtcgtttagaagttgaaaccaaaaaatgctatgtaacttatcccgttcagacggaataacgcctatgagatatcaccttatacctcgaataggatgatacctagctataagatatcgctcaacacctaataggtatcgtgataactaaatattaggtgataccttcgagttaccatcccatccgaacgggattctataaaaacagactcaactttttttttccgtgtaggaagacgggacgtgagacggccgcctttcgcgcctcgccagaattgccgaacgtgcggccaccgcacaaaacgtgaggcgagccgcgcccccgtccgtcggcgtcggccggcgttcgtacgccactacgcctccctcccttgtcatcgtgtcccgtgtctgcggttcgcagtaacccaaataaaacaaacagagatgagccggaaggcgcgcgaagtggctcatcgcgatcatcgatcgcggcaagttgcgcccgcggacgacgcgtgcggtgccggaggccggagcgtacggttccatccaccatccatcatccatcccacccccgcccttcgaccgcgtcatatgttgccgtttttttccccctcaccgtctcgatcttgtgggtatttttcgttttcagcaaacccccgatcagtacatgaaagtgaaaccgcacagtggcacgagataatactagtatgttcttacaacaatgttaccatggcaagtaccgccgaaacaacccagtacacccatcgttttaaggccacgaaggtgatatggaaaaatctgtgcgcgcgacagttccagagcagcctaaaaccgccgatcgagagcgtcgaaaacgtagtcacgcgacgccgacgtgagtacggctgcccgtcgagccattcagcaactcggctacaacttgcaaggattggattaatttgtcatgctacagcaacatccatgtcaaccaaaacggctgcactgatcgagccacgggagcttcccgaagaggagggtagctgaggacagagctaaagcccaaggcagcgacgtgtttggatcgactgaatgtcgaggcaaatcgcttgcatgtggtctgagattcctgagaatcttggtgtatctcgagccgtacacaaagccggagattaattaaccttgctgtctggttagcaagcttgatcagtctcgttgtaattggatttggcaatgaagaacaacccgtcagttcctttggtccaacagggttggtggacctgtaaaaggattcgaatctgagaacgccacttaaagttgctacagatctgaggtctcctgccattcctgattcatctgactgtgctcatagcgaaattttccaaccaaagaaatatataaaacttgaacaacgtataagtcatttacaggatgtgatttagttagataagatcttttccttttcaaaaaagaacaataattcatagcattaacaaactctaatttgagaagtaccaaatatatatgatggtgaagccgtgagtacgcgactatatatatcaatctagtgcatacaattacacaccaaggatttaccgttgatctcaatttcgtcgagcttatgcgtggtgtgcgcacgtacacgtacgttgaagaaaaaaatgcaacttgaattagcccataattttgggtttggtagctagaaccgtagaagtcatcagatactcatctgttgtgataaacccaacagcccaaatgtcattaagcgcttaattacgtaaagtgtaatgagaagatcataaagacaatgccatatcagtgcactacagtacgtatcatcaactaggattaatagcagggacagcgacatttctggagcaaaccgattccatcagcctttgctagccaggtcacgcatcatcagagacggcattcaaacaaatttctggcagttcaaggtactgtagatggatacgtgacatggccgcctcgtctggtgcgtgtgtggtggccgccgcgacacgttacgtacgcgcgcacgcgcggcggcggcgtcgtcccgttctgatcggtggtggtctcgtcactgctgtactcctccatgcctaactcaaccaacaaaccgaccacaaaatgctgccaactctctagctccccgatggcggcttggtttggtgacaaatcagacgaagcagctagtagtaaccggtgccctgtacaattgatcgatgggatactttttgtttcgatgtcaagctagcccatcaggtagccgaggccacaccgccacagcattctctcctcatgatcattgtgctgtaccatacgaaaaatgtcgatcgtacacacgcgacagcggcaacacgcaatccttgcgcgcgctcaggtgtgggcttggttggtttattactcaattcagccataccaaaacacatcagcaacgctaataaactaacaacccatcgcttggctgatgggaggaaaaagcgaaaggatatatttgcaaatgaaaaataatttgcgaataaaaattttatatacatgttcttaactatccaaaagcaaagattaaaaaataaactataattaaaaaaatcctaaaatcaactcttaactcaactttaaatttaaggttaaaaatttaaattttggctgataaacctaaatataaaagaaaagataagaccttaaatatcagtttgttgctagaaaaggcatcgccaaaattttgacaacacattaaaaaccaaagtaaagcacactccatacctagtggtggccaggaagctcgtggctcgttagctcgctcggctcgtgacaggcttggctcggctcgtttgaatttcctaatgagccgagctggcattttagctcgttagagataacgagccagctcgagctggctcgagaactttaacgagccaggacccatcagacatcctcaaagacccagcccaacaacaggaaggcccaaggcagcccaactgcccaacagcacggccgcatctctgtgagactgtgactctgtgcaaaaccctagactcctcctctcctcagtcctcagtcctcacttcctcagtcctcacgacctcacccaggcggccagccgccaccaggccaccgatctgcgccgcgatccgccggccgccgcacggctgcggtgccggcgcccggctgctgcgctcggcacgtccgcacacccagtcgccactcgcccctcgccgacgcaccgcatccgccacacttccccagccgccgcacttccccagccactagggccgcgggccgccgccaccaccgcacttccctcccacttggcgccacacggagcaaggcacaggctgcgaatacgatggaggaagaacgagaggtgcaagagcaagtgcctcaggttgcaagtgtggaatcctagaggaaacacgcgagcgcgagctgacgccggcctcgtcgaaagtagcggcgggagcaggagctgcaggaattgtgatttgtgatttgtgaaattgtgttcaatcatggactgtggttatgtacttgtgaagttgtgatttgtgaaattatgttcaatcatggacttctgttacattacttatctcatctgtgactatgaatgggaatatgtgattgtgaatttgtgatttgttgctttgatattttcatatttgcatttgatttgcgtactcaaacaacctattaacctatataataatatatactgccatcttgatgtcttgttagttaggctcgcgagcctaacgagctagctcgagctttcaaacgagccgagccgagctgggtttctagctcgttaggataacgagccgagccgagccgagctggctcgctatccagccctatccataccacatcgctctcatgcacgcaggccacacgtatacatccatgggcacattgccccataatacacgtatgttaagaaaaaatttggcaatgcctaaatttatagttttattaattgatgttgagtaaagctagatattaaatgcagagttcgttttagtatacgacttctgcttttgtttctatgcaactgcattttagtataactataccagtcaatttgcatcgctataatctgaagagataatcgtgcttttgacctattctgaaggctaactagtattaacttcacccctatttttccaactttacatatttgacactgcttttgaaaaaacaaacttgttgcctaactctcctctgtccacatcaccaggagtgttattagaaaatgcactttagagaatgaacaagatcaaaatgcctttgggaaaatgtgctaaacctaggttagttttgtcacatatttttgtcaatttccatcgtatattttatagggaaaagtgaaataactaggtcaaataaacaaaaactttgagaaatcaaagataaaatgagcaagggtattaaatggtattttctccctaagttaatgtttaccttcatgaaatatggtcaagcctgatcttcgtttttgaaaagaaagttcatataagcaaacttccaaaaaaaaaatgaccaaatcgatagttaggctttaaaacggggttaaaaacacaattacctctaacctgaaccgtctatgattaaatgttctctctcagtttttctaatttgttgcagtaaacagatttctcttattaacatagtagtttgcttattggcttatcactctctaccagaatttaaattttagaactcaattttagagctttctcattatattctattcttaatcttaacttttaaaccgctaaaacccaaatagcataaattatttttagttactttattctttttacaatttatcagttatatcttaaccaataagcatagtaaacaagatatgcttgtttcatattataagtcgtttgactttttttaagtctaacttctttaaatttgactaagtttatagaaaaatatagtaatatttttagtacaaaacaaacatattatcaatatatattcaatgttaaatttaataaaattaatttagtatggtagatgctgctaagttttttatataaacttagtcaaacataaataattttgaataaaagaaagtcaaacaatttataatatgaaatagagggagggagtacattccttataatggtgcgtttattatttttcataagatttgaatttgtattaattggcatcgatccaatcgtccaaataacattgatgtctgaatggtcacggtgagtcgggtgagacggtcgacgacatagggctggacaacgatcgatgctctgctctagctgcatgctgtgtcgggaaacaccgaaacagtatggccagcaaaactcgctacttccagctcgctccaaatatgcgaacattagccgcccgccggcccgccagcgcaaacattgctctccccgccgtccaaccgagggagcacgcgcgccggagatcgaacgattcgtcgctaatttgcgccgttgcgcctgtcgaaaggcagagtgcaaatcagagaccggttgctcctgaaagttatcaagattttcgtttgcaatctgcagcgtgaccggccgaccaggacggcagcgagattagtatgctgttaattaataatccaccggaaaataatagctgattgaacagtaaatagctcacacatgcatgggccgattttacaccaccctgaaatggccgatcagtttcgcatgggcttagttatctgctcgacgctcagagattgcacgcatgctcgtaccgtcacccttggctcgatgcgagttttgtttcatgcgagagctatgtttgaaacttggaaaccacaatccattatcgataagtactatctaaaagaaatcattatagatttgcttacgtatcctgagaccaactgaactaaaattattcctttttcagataactgagaaattaaactaaaattgttctttatattacaaagatttaaaaatatgtttagactagatacggtctttgaggtgcaaaatatactacctccgatctaaaataacttcaatttttggtttatgtactcgatgtttgaccatctaccttattgtagcgcccgttccgtcgtggcgcatagcggaaaatttatttcctaaaaaccctaattgcgaaatttgtttcttcgcttgtcgtctagtgtccgtgccatctcaagatctcaaatccccaatctatcgtcgagttcaattccgaatccaaatccttccaaatcaaattcctccgca

SEQ ID NO: 45814 - DNA, 53136 bp, Oryza sativa
caagcccccctttccctccccctttttctacctttttccctctcgccggcgtcacctcctgtcgccgttttggccgctagccggagcgccagctcgccggcttgaccgtccaatgtcggttcccctctcccaaaccgacattgccgcccatttaaacccaaggcgccctcccatcgatttccccctcccgtttcgctcgccgcctccgcgccattgccgccctctgtttcgccgtcgccgttcgtcgttgcgcatgtcggaggagccggcacgagcaaggacgcggaaggggacttcggccgcgccctctccttcctcttccccagccctaggccggagagattactcccacgccgtcagcctctcgtcacagcgcccctcctcacctcggtgatgtctccctccgttcttcctcctcgctccatctcccccccttagttttcggtagtagctcgagtagcctccccgtagctagccggcgccgccccgaccgttgccgtcgctcgtagtttactcgccgccgtcgccgcccgagctccgtagcacccgctcgtcgccagcctcgctcggcgtagctccgctcaatccgacgctagcatcggattcccgtggccgcgtagatgctctcaccgccgggaatcggcccctcgtgacctcgtcgccgtttcccttctccctccccgtcggttgccgccgccgcgattcgccaccgtcgagcttcctccggcgaatccgagccgttggctcgtctcccctcgtctcgtgcaaccacccggtgtgctcgctttcgcctgtatcgccgtggttcgctccgccgctcgccgctgtcgtccgccgtccgttccggccggcgtcgtcgtctacctcccgccagcccacgttgcagccacgtaggcgccacgtcggcgccagctcagccaagaccgggtcgagccgaccccggtcagtccctccccgtgcgcgcgttccaccgcgagccgtgaggctgcgcgtgggcccgccgtatcctttccaccgcgaaccgcgcacatgcaccgcgtccctcccccgcccgcacgcgtgcgccgtgtgctccctccgcacggtgagccgagccgctgacaagcgggtcccacccgggaccgcgcgcggtgaacccggtccaccggccctctctctcctcccctcccgcgcgcgcgcacttgggccgtcatgggccggccggcccatttagctcggccggtccgctccttttcccttgggccgcgccctagctgcccaaggaaaagtctataatccctccctctttccttttcttttctttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttatttttgccgtttgttgagttgtcccgtttcgcgtgtagtttcggagcccgaagacctgcagtgcgaggattgcgaggatcaagctccagatctcgagcaaggcaagccacctttgaatatcttgagcctatatttgaaatttaattatgttgcttgaaaaatattatgcacttataggatcgcacttaatctgttgtcccgtctgcaaggcagattggcggacctacctaatttgttgcattgatcctcccttgttaattgttatatcatgttcccttgtaaccatctagttgcgtctcgatattcatgcaccctgtacgagtatcgacggacgccttcaaacttaaaatctgaaaaacaatttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccgaacataagacaagtacgaccacatgggtggaatgggacacccttggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacatgtgtgggctttcgaaatgccttgtcatgaaagcttggaggtctcccgtcgtggctgatccccacgggctgggtgatccgggttagtaatgtcgtgtgggtaaagtgtaccccctctgcagaggttaacaaactgttcgaacagccgtgcccacggtcatgggcgaatgtgaggtgattcctagcgtagttttgattgactactgcttgtgaaattactgttgtggaaaggggttcgatgtttgaaaaatctgcagctgaagggatcagctaggcccgggtggccgtttgaaagttgttggcccgggtggccgtttgaaaagctgttggccgggtgccaatcttgtttcaattttaaagactgatacattgcacatactccgaccggacgagacgcactgtctcatccgtgtcgtttgagaagcactcacttagtgttttcaaaaaaaaaaaaagagttcaaataaaatccattgcaaaaacaacagcctttccttgaagcctgcattaaacacttaatttcccatggcttgctgagtactcccgtactcacgcttgctctatataaataatcccccccagttgctgaagaagatgaagcagatcctgctgatgaggagttcttccaggagcaagccggctacgatgggttttagggtttcggcctagttcccaagtcgcgcctgtgttgtttggtccaagtcctggcttccgtttcccttttataatgcagttgtgagctcgggatctgtccgcagcccaacatgactgtacctctactctataataaagagacctctgatgctgtgatattctgtctccctgtgataccagcactgtttcctgggactggtattgattaacaggttaatttggagcgtcacgggctagttccggtcgggactagttcggggcgtgacacttatttaaagaaattatgaaaaaaataaaaaaatagtcatacataaaatactattcaggttttatcatataataagtaataacaataaaaaaattaatcataacaattttttaataagaagaagagtcaaacgttgtattcaacaactgaaaaatgatttattttttgagacggaggtagtataattttccaacatagccagcattgatgtctggacttccacgggattattgggttgcaatatatatacacttctgtagcgtcactagatagaaatgtgaattttcttaatagacttacagatatcttttttttttacttctagaaagtcaatactaatttagagtccagccttccaggtatattcttacccatatacaaatagaatggatgagctagggatatcagatatctcactaacactcacaagacaaatgacacgtgcttattgaaaaaccagcaagcagctcgcagtgtactatgtcaaaaatgtatggagtacaaactttgtgtgtcccgtttcgtcaagctacagaaggccacgtagccacccctgccttgactgaccttaacactctccacacgcagatatcgagcagagcaagcgaatctggaccgtgtttgaaatgtcaaggtccgaccgcgatatgcatcgccccccaatgtaattttagtcaaatgcgttgggacctgcactgcacgtacgtacgcgtgcaggcacggccatcatcagtcgacgcatggacgccgtggagaagcctatctgcatccaggatttcatgctccgaaatcgcgacgcaaaaaaccgtatcttcttgaacagttgaattcctcaacggagaccaagcaaaaaattaaaccaccacacggaggcgtccgattggccggagttaatacgggccatgcagagtctacctgtcccactccagtggcctagcttgacacatggtggatcggcgagcgcgccacctgttgcccctgccggggattttcacgagttttcaacggcggcgagcggcgacgtgcgaaacctcgctgcggataccgggggaagtgacgatgtcaggccaggtatttccggcgcgatggcatcagcagttacgaattacgtacacagcgttgctggcgcatgctgctcgcatgaacatggagagagagagatcggcgattcggtgcatgaactggggtgctaacgtggcatctagtgaaggagaaaaacaaaatggtgcatgtgcataaatttggaggttcttataatctatctcgataaagaaaaatcttatcgagtggttggattgactatttcacaaaataacaaagaaaaacaagcatggaaatgtatccgctttaacaacaaaggatgctatgtcatctataaaggagaagcattgttgcatctacataaattttgaggtttttatatcttttcttgataaaaaaaattatccagaggttggatttgatcatctattaactataagttaaaatagtagaaaaagatgcctccatgttcacttttacggcctagaaattctcatattaatcagagaaaaagagaaaatcaagtccaaatagaaatacactttaaaatagctaaaattcggaattaaaaaagtattgaaagaggacgactagagtccatacatgtatagaatttagagcaaattgaaattcataattaaaaaaaagaaaaattagaagtagaggttagagtccatatagaaatataatttagaaataactaaaattaaaagttaaaaaaataaggaatattggtagaaaaacctagagtgcatataggaatacaattttaaaataactaaaattcaaaattttaaaataagaaattttgaaagatgaatttagagtccatacagaaatacaataagaaataacgaaacttcagaattaaaaaaatatatattggaagaagagtctagagttaatatagaaatttagaactaattgaaagtcagaattaaaaaaataagaaaaattaaaagtagagtttagaatccatatagaaatacaatttagaaagaactaaaattcaactttttttaaagaaaaggaagactgaaagaagtgtctagagtccatatatcgaactgaattcaaaattataaataaaaaaatattggaagaagtgtctagagtccatattggaattcaatttagaaagaactgaaatttggaatttaaaaataaagaaatattgaaagaagtgtatagagtttaagaatacaatttagaaataactgaaatgaagaatttaaaaataaggagtattggaagaagagtgtagagtccatatagaaatataatttacaataacataaatttggaaatataaacagaaatattggaagagtagtatagagtacataaaggaatacaatttagaaataactgaaattaagtattttggaataaaaaattattgaaagaagggtttagagtccatataggaataaaatttataaataatgaaaatttgaattaaaagataaagaatattggaagagaaatatagagtccatataggaaatacaatttataaataactaaaatttggaattaaaaaataattgataactatcacatgtatacaatacaatgtgaaaattatatattggttagtttagtcaagttagtacataatttaaaattatgttaccattttaatatattttaataatataatatgaaaatatatatgttatttgtgcgggagaatataatggtgctagccacacaatctgcgtgggccaccatgttagtttcacaaattcaaataaaattcaagcatggaaatatatctgctttaatgacaaagggtgctaacgtgtcatctatgaaggataaacattgaaatttaaggtttttatatcatttcttgacaaaagaaatcttatcaagaggttagattgaccatttcacaaaatcatataaaattaaatcaagcatggaagtgtatctgctttaacaacaaagcactcttctcttgctttttcacttagaagctcaatcccctctctttttttcgcttctatgcttgtgcatggtgatattaggataccagacaccggcatcaacattaaaaatctgttttatatgtacatagtctaagtagaaatatattttacatggtagcaagagcagagatactagaagcaattatgcaattaagaggtacggtggagctaagatagatgatcgactactccaatactccaataccagatcagtgttatagagtacgtgagtaagagatattaacaacaacaatataattgaaaaccgatatgccatgatttcatcaccgataggtccatgaactagccatatcttggacactaacatcgtgtttcttaaggaaacgatcggaaacgttcaggaaatttccatatttatggatttaactatttagtgtcaatttcattgcgacactgacataaattagaaaactaaattttagaaacagtagccgttagtaaagatattattgttatatcagttatgtggaaacggtatcggtatggttaggaaatttttgtaccttcactagttacattattaaatactgatataccagcatgttctcatcactagcttcttaaaataatataactatgctaatcaaaatttctacatcacttaattctatctctcagcttgtttctttttaaccatacatcattgaaaaaacaccctcaacacatgtaattgtctatggtttcctgagcattgaattagtgattagaaagctaggtaacaattgatagccttggtatgaagcatgacaggctcacaatagccaaggatcgggcatgttgcatgcctggtggtttatagtgtttccagaattggaggcaacaactgttgtgctaggaaatcatttcctcaagacaagatcatgggagacaaatgtagagtgtctttacttgagtttaatttttgtgtactactgttgcgacaacaaattggaaagttaaagtttttacctttgttgcattcgtacgtcatcgtaactaatttggttctgatatacgtagaccgttggcatgatcctatgacatcacaaccaagcaaatctttgttttgcccttttgtttttttaatttttatgtactactattgcgacagcaaaatagaaagttaaaatttgtaatatttttgcattttgtcgtacaccgtacgtgcgactctgatatacagagtagtatatcgttggttcgattgtatgatgtcatacgagcaagcaaatctttgttttgtcatcttcttgccgtttaattttgatgtattacgacaacaaatatagaaagttaaagtttatacttttttttgactgaatgttaaagtttatacgtttgttgcatttgtcgtcatacttgaaatcataccttagatttctaatatacctaggccattggtacgataatatatatgatgtcacacaagcaataaaatctttgatttggcaactcaagtgggcacggggaacaccaagaatgggggtagggtgttagagatgagacaccgccatggattaactcaagttggcctcatcgattgaacattggagaatagctacgttgcagagaattgcctaaaatggtttgttctatcttcttttctacatgacaagtgttactatatatagtttatacagaattgctaaccatttgttgacagaaaatctatctccaaatcttacagattttggtctagatgtgcttcacgattcgtactctagctgcttcttctccaactccggcgaactcctctccttctccggcgtcggcaacaacccaaactccgacggagggccgatgagttagggtcccgggttggggaggtgtgggagggggagggggaagaagggggagttcgccaggcttatagggatggtcgtgggtatagttggccataaggcccgaggcccgaaggcccggcccacggcacgcctctttggcccgtcccaagcacggcaaggcccgacttgggtcgggcccgtgccggcccggcccgactgtcgggccgtgcctgggcctccccaccagcacgctgggctggcccggcacggtcgggccggcccggcacgatgggctggcaggccaggcccggtacacaaagtatagggactaaaaatagacatataaatgtcaatgtctaaagaatagggaccttaaatagacttattttagctatttatataccacagcacaaagaagagggaggtaaaatagactttttttagctatacaatgtcacagcccaataggagggagaaaatttagacttattctgaggaaaagcacgatggcccattgtgccttcgggccggcccgccacggcccgaggcgtgttgggccgtgcctgggctgtgagtgcggcacgtgggctggcacggcacggcccggtgcgtcggtcgggccgtgccggcccgacaagcctcggcccaggcacgtccgcgtgccgtgccgggcggcccacatggccatctatagtcgtgggaggcggcggtccggcggtgggcggcagaacaggtaggcacactagtggagataggcacatctatgacaatctacttttgtcatggaagacgcgcaaatcgtcataaagtaacttctatgacgaatttatgacgaaatgggattcgtcatagaagtcgcgtcacatatgtttttctatgactaaacagtagatttcgtcatagaaatgcttatatccatgacgaaggtgctcgtcatagaactgctttccagctggctaggacagacgtcgtccatgccacgtggctatcacacgtggagtccatgttggctgtgatgtggcggatgacgtgtacgccacgctggatcatcatctcccgtacgctagagccaagtggcagtcgtatttaacgccacgtgttggcatttggtatgtccacgtggtggtgcaagctgatgccacgtggtcgaacgtggtggcgccacgtggcagccatattaacgccacgtgttggcatttcttatgtccacgtggtggtgcgcgctgatgccacgtggccaaaggtggagacaccacgtggcagtcatatttaacgccacgtgtttacattttgtatgtccacgtggtggtgtacgctaacgccacattgccgaaggtggaggcaccacgtgctctcattttgaagcgccacgtgtacatatctgatttgtgacacacgtctttacctgatgttgccacgtgttgatttgtttggatgacacgttagcacagtagggatgaaggcccgctcatttttttttcttagcccagcccatttggccacatacttcacatattgttgtggcccatcccactatgagatctaggaaatttttagcattcacccatttcaagcaacaattaatcagaacttcgcagcacataagaaaataggcccaacatcaagattgatcacatggacaaacaatcagaacttcacagcacattacaaataggcccaacatcaacatatatcacatataccaacttcacatagcaccatattacaaaaaagttcacagaacctagcacacatatgttcacattaagtccacaaaagtttgccataggatgacattaagtccaccatagcaccaaacatcatttcacataatcaagtccaccacatgacaataagttcacagaaccatcaaacaactaatataagtagatggagttcatcacagtgcagaagatcataaaggagactaggatagatttaagttaccctgggaaaggctcaagatacgtcgaaggagcaaattgttctcttcctgctgctgcttgaactctgccaactccttttgagtctttgccagtgcttcatttgcaagatttgcttgttcttttagttcgacaacttctgcatggagaatggctgaactttgcttttcagctgcaagttcttcctgaagtgctgcttctgtcggtgtcactgatttcttggagctcatctgcagaccagcatttttcaaaaacgtggtattggagttgtcccgagagagaaccttggacacaacttctgcactagttcttggtgtctcaccatcaggtacaggttcttccataatagctttcatacttgactgcagcaatgattgaacattagctatgaaattagatacatgaaaaactggctgctgcataacacattcaaaatactggcagttgcacaacacattcaaaaagtcactgaaaactgatggaaagctaccaggaagcacaaactagaggtaaggaaacttgtatagaatgcaaatttaaccaaatttgttttccataagccaaaacagaaacaaattatatgagtaagccaagcattcccatatttagaaatattgcattgccctcttaactgtgaaagagaccagaaacattttgagctctaactatggtagaatgtaattattttctatctagcctctagcaacaatgcaggccaaatgcttcttgacagaatctaggatactgttttagcatatatcagaaggctgactttagactatatttgattaactttcatggcagcttttgattgatggaacaccctggtagctataaaagaacaaggttttcccctcaactactttcataaaatttggagggggtgcaatgttacttagcgttggttattttctattcctcctatgatgcctaaatattttccctagaaaccactaatgtttagaaagaaaatactagtgtggagtacataatccctcacaattaagtttacttttgcaagttacaatgaaataagttttgaagtagtaaaggctgaaatatattcagtcttatgttcatatgattcaaaacctcaatacatgcaaacaccactacagcagcttaggtaaaaatgagttttcatgaatcacaccctcaaacccgggatattgataaaaatacaaactgcaaccaggatcaattgatgaaaaaatgtttatgtagcttatttggcattttaacccaatctcaacttatgttgtatatggtaagttgtctagcgacaagtttccagctacaaatttagtttggtatgtattctaacattgttagagtctataaattccattaagtctgtaatgatcttagctgcaaatatctctgcacactaaggacagaaattatcctatggatgtaaatataaaatgagctgaattaataatatgttggcataggtatcaaggaattgagttcaatgttgtaagaatatacaaagtgacttacaattgcatctttggcagcatcacttagacctttttccctactggtatggcagtcctcaaaggcatccacagcatcaagctctacaaccttgttcttctccttctatttcaatacagaaaatgcagatcaattattttatatatctattacattagataagtggttcttaactacaattaatgctaaaagataatgggaacttacgtaagcgtgcaagtgtgcagcatagctgcgagatcccgtagcctgatggaacctaacattaagccggttttgcttgttctgttcagagatttgctacaaaagatgtatgtgttagacatagtcgcaggtataaaatgaaacaaatatgtcattagagatgacataccatattctttggatttgaccactttgcaacaagttccagccactgttcatcagtcatgctacttatgggagaggtagttctaatctcgttagcaggtactccattgaagtaggccttcttcaaattataccgtgtttgtcgtatccctttctgccatacatcagcacaagcatcccttgttggctggtgtttttggttaatggccaacctgacctgatggtttgaattgcaatcattaaggagtaacactaggtcatataatagatgaaatataaaagaatatagataggctcttacagataacttgcccatgaagttgttaatatagccttcatcatccttgtacttcttccaatgagggaagacaggaactttagtcctaatgataacaccagcctctgatgcaaacttggcagcttgcaccggttcatctggccttttcttcccttcggcaacagcaatgggcattcttcccatagctttggtcatcttgtcaagcattattcctgcagttggtggccttgattttcttgtgcctcttcgtataggtactacagagtattcaattacaatgttagcattcatcaaatagttaaaaaataataaatttctcttcgttgaactaactggccttcaacatcagaattggtttgctgtgcaggttgctcttcatggttggcatcatgtccatatgaccagtccatcaccgggctcgggggcctgttcacatcattatcttgaagcaaatgtccactgcccacatcttcatcaccattgttttttgtttctggaggcagttcttcatggccattacctttaccttgttctgctatgagttgccttttcgctgaccttgttgagactccaggaggcatttcggttggagcacccgccctcactctctttgatatccttactcctggtggcatcttgagggtaggtttcttcttcgtcgcacacttctttcgtctagtttgtcgagggtactacaataataaacacaaaagttgtaagcatgtgaataaattagcaacaatcattaaaaaaataatcaaatgctgcacaaattaaatgcggaaaaattattgcagatatcctagctccccccccacagccaagatagaagaagcacctcaatcattatggggacgggctgctccggttctaaatatgaatcatcatcacactgaaccccttgttcatcatcttcagggagaaactctgatgtatcagaaccttctccatgacttttcttggtgcctgagttttttgtctttgaagatgcatgttgtgtttcgatatgtttaatagtggcagctatgtctttgatgccaagttcatccatccttcttatattctgcaagattttctcttgccacgttctttcatattcgttttgtgcaggttcttacatgaatacacatattttaatggtcagaatactagatggcattttgatggcatttcctaagcatataagcattttcagaaatagaaacaataaagtatctaggcatttgggatgaaaaaaaaagagaccatgctcatcaacattggggatttaatgatcaatggtgaaaaacaactttacttcaatatctagtaaaaacaacagggtgattcacttttccattttaaaagacaattttgatgagaactctggaaacacttttacagtgaacaacattggtcatataaatgatatagccattatatcattctctttcacctaataaactgtatctatttatacgactaactcaaattattggtacattcataaacacaaacaaagcagaatctaaataaaatttccattgttgatctgaaatccacactctggaagatgcttatggcaacttaaggcacaaatttatttgagaatcaacatagcatgattaatttaaaggtgcgcctgaataacacagaaacaatgccatatgcagtagcaaactagcaatagcatcaactgttattgtagatagtgacctcaatcggattgcacacagaaaattcttaatagaagttggacggcaaatcaatccacatgatgtataacatctaatagcttgagacagtacacataaacatctgagcttgagacgacaagataattttgcgtacctcgtgctactggacgtcgacgtcttcccatcggctaggtacggcgacggtgcagggaccttgtcgatggggtacccggctccggtgtggcggtaggcgtcgacggtgttgtgggagatggcttcggtgcagcagtagtcgtcgacggggtaccggctccgatgcagcggaagtcgtcgacggcgtagtgggggaaggatctggtgcagcggtcgtcgtcgacggggttgcagcggaaggcgtcgttgcagcggctgtcgacgacgaggaagtaggggacggatctggtgcagcggtcgtcgtcgatcggtttgcacgggaaggctccggcgcagcggtcgtcgtcgacggggttgcgggggaaggctccggtgcggcggtagtcggcggcggctctggtagagcggcaccccgatggtgtggcggctggatttggagattagggtttggtgggtgagaggctttgtaaatatatagtggttgcacaaatgcccctgggtgttgttttgctcttcgttagatggaggataaaagtgacatttcccattctgatttgggcaaatgggcggcaatggaatgttttggggctgtcattggcggtaggtttaggcgccgaacgaaaaatcctccatccatgagtaattaacattatccataaatcgaaaacattcaaattatactaatctatctggattaacaatttgactttaaaaatatactccctccgttcaatattatataacttgaaaatttggattaagggggtgtttagttccagggtgtaaagtttttaaagtatacggacacacatttaaagtattaaacgtaaactaataacaaaactaattatagattatgcccgtaaactacgacacaaatttattaagcctaatccatccgtcattagcaaatgtttactgcagcaccacatactcaaatcatggcgcaattaggctcaaaatattggtctcacaatttacacgcaaactgtgtaattggttattttgtctacatttagcactcaatgcatgtatctaaacattcgatgtgacatttttggaaaaaaaaatgtgggaactaaacaccccctaatattatttttttaaagcaactttcctataaaaactttttggaaaacacagacaatttagcagtttaagaagcattcaccgattaatcggaatacggttgtcagacggaatacggttttccacaacactgctttaagcatgactgaatttatttttagaaactagcacctataatatattataggcgtctttttttaattaattggcacctatgacaaattaaaggtgttggttttttttttaaaaaaagaaaaccaacacctatagtattggtgtcggctcttctatagtcaaaatctgctgtggacgtctaccacaggggcgcggtcgtcgtctcccatgtcatcgagacctccatgtcatcctcgtggttgctcacctcgccattcaccatcgacaccgtggaatgcaagaacctggttccagcctcggtggcgttgccggtggatctaaagccaagctggaggatgatcggcgacggaggatttgagccaggcaggtgataaaatcgtctcagtttaccattcatggatactccctccgtcccataaaaaaatcaacttctggctatgaacctggacacatgttgcgtccagatttatagtcagaagttggttttttatgggacggagggagtatataggtccaattgaaaattgaattttaaaaattttatgttcactttaaactgggtgaaccggtcggtgtttgtaggaaaaatgttggaccggccggttttaatagaacggactgggtggtttggaccgacttacccctcattcttatcggtagaactcacatataacgagggtacaatcgtaaatcaacacacatataacaacggattcagatccaaaccaaaccaaatcgtaacaaaaaaaaagagcttcctcctccatggcggtgagaattagcaggaagcgcaggagcccgccgacgcgtgggctggggacctccacgacggcgtgctggagcgcatcctggcacgcctcccgccggacacattcttccgcctccgcgccatctgctgccgatggagcgcggccgccgcgtcaccacacctgcggccgcatcccgtctccgactccgaccgcatcgccgcagtagcagctggtccaggtgccgcatctccaaggccgatgctcccagcgctgctggtgaagaggacctggtgctggccatgatcgagtagcaagcttctggtgcttatgctgcttgcttcctggatgtgggcgacaacagtagcttgagaagaaatgatacttctttgtacagcttggtgaattcagattgagatcgtgaatgtgaataaacttatggctgattattgtgttattttgaaaatgtgaagaccatatttgtgtcatttttttatgtcaattgaatatgacaattaagaaaaaagtgtaatgctttgaacagatgcttgaagtgtaagttgtgtttgtacagattgaaattggtttttgctgcttgaaatgtcatggtctgtacagttttagactgatatgcagtatgtcacttggaacaaatatatatgtacatcactttgcatactgtttcaccaggaaacttactggattgcccaaaaaacagaagtaaaatattttctcttctcctgaaatttttgacccaactgcttcacatattgttaggaatatgagttagcaccatgaacctgggaaagaaatcaaataaatgcaaatcattgctggtaacaactctgttcttaaaattgctagctcagaatctcgatgtgtttcagatatgcaatggcaaatgagttcacagaataaatcagttgtgacatctcagttacataacacaaaataaatgagtttatagctcatcccaattacatatgacatatcagatagatgacacaactcaagatataatttaatcatcatcggtgtcttccggcatgtcatcttcagcgttcccattgccactgtcactacagtactgcaatattgtgtcatcttcatctgcatcatccctactgtcttcagtcaagttagcttggttgttaaggtcttctaaattagcttcaataatagtaacttctccatcttcctgcaaatggtctagatcctcatcagcattaccttcatgcacttcatgttctgtatcagaacaattatcatcttggtgtacatcaaaaatgtggtcatctttttcagacacattatacatgttcctatgttcgaatttctgcacaattcgccattcgttgcccaaagaggtgtcctgcaagtaaaatatcttcttcgattgagttgctaaaatgaaagggtcatccttgtaccaaaatgattggatgttgatggatttgaaatgcccgtcatccctaactcctcttgtcttgccaacttgattgaaccaatcacaatggaaaagaaccaccgatcgatagatatctagatcagagttatactgcaactcaagaatctccctaaggacaccataaaattcaatgttatccccttcatgtgtaccatcaaccattacaccactattctgcgtttggaggtatttctcacggtctacagtgctataccggactccgttgacaatgcaagatgcacaactctttactcggagatcaggaccacatgacaatgcaaatagtgcttcactgaccacccctggattttctttcctcagcttccagatctgatatatatatatatatatatatatatatatatatatatatatatatagtaaatttgtttggtgctccatggtgcccgggcaccattgttgaaattgagtatatacccaattcaaatgagtatgaatctttttcaattacttaggtattaacattaactactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattattataactaggtatatactcacaatttgaaattttgaaaactttgagtgattttgtgcattagataccatggtgcccgggcaccatggtgccccatatgagtgtcatatatatatatatatatatatatatatatacaagaaaaatacacatgttattcccaatttgaaatttcatcaccaaaaaatgatatttttgtaagtgtgcgtcacttacatgagtcttaaaccacctagcaaatcctttttcaagtcttctgtcaacatcatgtgcatcttctttctccaactcttctctatgcatgctgtagcaaattatgactcaacaattaggaaaatattatatttaatacaatacatgtgaaataaacctacataaatggtgcttactccaaatatggttgaacctcctcacagttatttagcacataccaaactagcttatccatgatttcatcctccatgtactatatcctagtggatcctatgagtttaacaccatgcataaaaacagagctgttaccatccaatggcccatccccatgacgggcgtcccgattaaatctagtgtcaacatcctccatgtaccttgaacaaaatgtcaaggtgtcacttgctacataggcctcagcaattgatcattcaggcctagccctgttccgcatggaattcttaaaggtgccaagtcgtctttctattgggtacatccatccatattgtacaggacctctaagtagtgcctcatcaggtagatgtacggtcaagtgcaccatcacgtcaaagaaggctggaggaaaaattttctcaagtttgcataggatcagcgggatgtcttttttcagtcgtttgaggacatctatccttagatttatactacacaattccctgaagaagttaccaagctctgcaattgcttcgtatatatcattgtccccaaatcctcttatgccggcaggtatgattctttgtgagaaggacatggcagtcatgagttttgagcccctgcaccttggaaccatctgaacttatgcatcttgctaggttggctgcatatccatgtggatacttgacacctttgaggaagttacaaaactcaattctttgttccttcctcaagacatagcgagcttgtgggatgcgaactgagttgccatcctgctgtaagtgcaagttatgtcttatgttcatatcatgcaaatctatcctcgaattgactgtgtcctttgtcttgccctcgattttgagcaatgtgcccaaaatgttgtcacatatgtttttctcaatgtgcatcacatcaagattatgtggcagcaacaaatctttccaatatgggagcttccacagacttactttgcggcaataaattagtggcccttcatcctctccacgttttcttttcttacttgtatcatgcttacccggtctaacatctttcaccttctctaactgctcgaggacctcatctgtgctgaattttcctggctcaacctggttttcatggtgtccatcaaaagcatggcttcttcgccaagcgtgtgtccttggaaggaaacgacggtggccaaagtagcctatcttatttcttagtgctcgtgacaacggatttttgtcacaatgaatgcatgcataataaccttttgtagttcgccctgacaaggtgcttagagctggataatcatgtatgcaccatagcacggcggcacgaagattgaactttctagcactgaatgcatcataagcactaacacctatccataattcaagcaattcttctatcagaggctccaagaataaatcaaaatcctttcctggagatgttggacctgggatcagtaatgacataatgcagttcgatggatcgacagattcccatggtggtagattcaaaggcataacaaggacaggccacatgctatacgaattgctcaccttgccaaatggattgaatccatctgtagctatggcaagcctcatattccttgcatcttctgcgaaagttcgatactttctgtcgaagtccttccaagcctccccatctgctgcatggctcatttcattatccactggcttccgcttgattttgtgccactgtgtgtcttcagctgttcgttttgatgcaaatatcctctttaaccttgggataagtggaaaatgcctcaaaactttgcgaggaaccttcctgtcgccaaccccatcttcccatctggattcaccacatattgggcatagatccatattggcatattccttccaaaatagcacacaattattcttgcacacatggatcgacacatatccaaggcccaattcacgaagatatttctttgcctcatcataagattttggtaattgacattgagggaatgccgaggacaacaacttcaataattcagtgaaagctgtattgctgatttgataatatgacttgatatggagcagcctcacaagaaaggaaaatcttgaatggttagatcctgggcaaagtgcctgcttcgcatcttcaagaattctagcaaaccttggtggctgtccatcttcctctgccgcagtgtatagttcacctattaactctggaactccattgtcatcctcgggttcatacccgcccacatctgtcccttcattatggttagtttcatgtacctgttccaaatattcgacatcttctgtatcaactaattctccatgataaatccaccgggtgtatgttgatgacatcccaaaaatatgtatatggtcatgatttcttgctgaggcagtgaagtgtggttaagacacctacagcatgggcatggtatgtcaacgtgttcatcaaatctttgtccaacaaattccatgaactgtttcactccctccatgtatgcaggtgtgaattgtctcccatgtatccaagttctgtccatctgctttggcatgttaaaaaaagcaattaggcaaacaaagctaatccattttttaggacagaatattttctaaaacattagatggaatagctggttgctacatgacttaaaccatgttgatttgttcataatactctgacttgtttctctgttcatacaacacaaagcataatctttcatagctgaacttgcatttcatactcagagtaatgtacttatggaaaatcataccttatatctactgaacggcgttggtgatgggctgtgcgcgctgacgacaggattgagagaggaggtgctaggataagacggtgggcgaggagcagccgatccgtctcagtcgtcgaggatcccccgcgccgaccgggatccctccgcagccccaccgaccaagatcacttcaccgcgccgccacccaccacgatgctccacatcacgatgccggccagcctgtggagccgcccttccctgcaccggtgggataagaaacctcctcctctgcgccgtcccggtggctaggatccgccccactgagctccgcctgcgccgccgccaccctccctccctggctgtgaccaaaccctgcgccaccgcccccctccctccctgaccaaaccactaggtcgcccgcataaagcattcaatcattcttgtgttcgagaattgaaaggaaaactaaaagtaaaacatcatcagcatgaaagctccttgcagcgtagtggttaagctagaattatggttagtcacaagtcatgggttcgacccccaagtgctgcagcattttttttagaaaaaagagttcacatgggctgcacagattcacacatgggctgcacaaattcacggactgcacaaatttgggctgcgaaaaaaaagttcacatgggctgcacagattgacacatgggctgcacaaattcacgtggactgcacaaagcatctgctggcccgaaaacgcacctgtgctgcatatacaatgtggggtccaataacaatctggatagccacgtatacaatgtggggtccagtgacaacctagatagccacatatgcaaggtgggaccaacagcagaatagagatttacttacaactaacgaaatatatttcagcatattgtattaataaaggagcgtcataagtgtgttacatgaatggtgcgcaccattttgtgacgaaattatctattgttttatgacaccattttaaatttcgtcatggagtttcgatgtctaccctccgccatgagtgatccatgacgaaacatgaaatttcgtcatagatatgttgtattcaatgacgaaattatacaacgtcatgagcaaaacgtcatagatggacgatttcctactagtggcagcgaggcattggtggcagtgccagagccgtggggacggaggagggcggtgagccggcgttggtagcaggggcatagcgagcttgtggtggcagatcctgcggcgagtagttgctggagacgaggaatacgacgggccgagagcatctcgtcttcgatggctcgaggagggaggtgagggaggaggccggccggggggcctcgtcggcgccgttgacgccttccagccagccggcgaggtcgggcgacggcgcgctggggtggcgacgacggtggcggaggcggcgcagaatgcgcttgcgctgaggagcggcggtgtgagggggaatcgggagaggagaggttttgtagggtttggttgcctgcacgaatcttaaagcaatcgggtggtctaaaatttataagattcctaagggggttttctgtcaaatgatttatagacagtctcgttatatgcctacaaaatatttcatacatggatataagtattaggtgtaaatatgtacccacgaactattgtattcatttagagaatggaactttaaagcatatagaatattcgtggcagttacaaaaggataatatgaagcgggagatcaagataaaagcatgtattaggagcttagatatggtttagacccttttggagaaagaaaaagtacgaaatataccctgaactcaaaaaccagatattttacaccctaaagtatataaaccggacaaatacccccccccctaacataatttgaagtggtttcgatcctacgtggcagtccagtcagcaatttttttattaaaaaataggtggggccagcatgtcatactctccctctctctacctctttcccctctcacctttctctatctactctatcatcctctctctctctcactgagcagagcagggaggagcagatggatccttgccggcagcctccaacgggcggcgttggacagcgacgggcagaggagctccctatcccctctctctatctcgcggttgggggcaacgggcgaggggttgaaggtagctgggggaggcaggcacggtggcaaaggtggcagccacggcagtgaccacctcccatgcctcgcattggcggcctcgagcaacaacgaaaaccttcaattggcatcatccgcctgacaacaacgacgacgacgaccttcgattacgacggggacagggagatctggaggtgaacaggcggtgggcgggcggacggtcggcgaggacaggcagtgtgcggggacgggcgatgggcggcggcgcagggacatgcggtggcgagcggggggacgatgggcagtgggcaggtggtcggttggcgccgacgcacggcggtgttgccggaatcaaccattggagggtgggaagggagggagatctgaggtgccagagctagttcgcgcgcgcgcgccatcaacgtgctggcgcgcgcggcccctcaccacgccaagccttcctttttctatttttggcaattttttttgcttttttttccggttttttctgattacattttctaatctttagcccacatatttttttcaaaatgttttgagttgaaagtttttaaatctctagttaaaaattttcaaatctgatttgaaagttttcaaatctcgagttgaaaagttttcaaatctcgagttgaaaagttttcaaatctcgagttgaaaagttttcaaatatgagttgaaagtttttaaaagtgggttgaaagttttcaaatcttgagttgaaaagttttcaaatttgagttgaaagttttcaaatctgggttgaaagtttttcaaatttgagatgataacttgaaagttttcataatttgatttgaaaaatttaaatttcaagttgaaagttttcaaaattttgaaaatttgacttcagatatagatttctttttaatttgttagttaaaaaatttcatgaaaaaaaatcctaactactatcgttattatctcaaactataattatctaagagattaagactaatagaattagtctaactacccgaaaaacagcgccagggacgcgcacctgcctctccgccacggctgccgcctccggtcgccatccgcctctttgccgcttgccgtttgccttcttgatggtgagcatggcgagggaccatggcaccactccacctcaccggcgttcacctccgcagcgtcgacttcgctgccgctgctgtgtttttcacaaggccggggagaagagagagagaggatagggaaagaggtagagagaggtgagggggagagatctgataagtggcccccttgattttaattattttttttctgactagaccgccacgtaagatgaaaccagttctagattgcggtagggggttattcgtctggtttaaaaagttcgaggtataaaatgtctagttttgtgtttcagagaggtaattcggttgaccatgatagttcggcgcggggggggtgggagggggggtaattcgtattttttcctatatccaaaaagttttcttaaacataaaacttctatcgatcacaatttcattttaaaatatgtctagaaattgttaaacaagaacaaatactccaatatttgctagattgggtataggcccgttgatgcattcatcgaattattgggaattccatctcaaaactcacaaaatcttatataaaacattgcaaaaaaaaaacacttctattgcaaaaatcttgcagataaattttctttttccaatgatgcagcttatatttatcacttaaaaaagtcatctcctgtgccgtggctccatttgctcccttttatttatttccccccatcccggttatagatcaaatccatttgaccattaaaagaagccaaaataatcaagcagtaccagatcacacaaggcatctagaaagaaagaagaaaaaaaacgatattttttttaaaagaatcaggaaaaatatatccaggaaccatggtacaaactactgaaactgttgtgcaaacttcttgatcttttgggatatttctaatttaggtttttttttgttgaattaactgaacagtggacaccttttttttcaaaaaaaatctttgaccaaatgagaatagtttaaaagaaatgaagagagctgtgacaaaagagagtaccgtcttcatgcggaagaaatggcattagaggttatacaagtggcaagtaaaaatggtctaaactttatggcaggctagtaaaaaatagtaatataaacaacaacagtctaagcaaaatttaactaaggattacaacaatccataatgatgtagtaccaatcaagctgtcagagagatctcaggctctgatgctatgttgaatctcaatccccaaatcaatgcctgtccatgggccaaatcccagggaattcgtgcaagccccgctgagctgcacatgactaggaccctatttgaaagattagcccagaactaattttgagagctaatatttagtaatgaattggtaggctaaacattagtctaggttggtatgtttggatctatgggctaattcaaggctaaaaggtagagagagagtagaaagagaggagagagaaggagagagagagctgctttttgatggtccccacacaaaattagccccattagcacttcttagagaggctaatattttgagaggggctaattcatattagctcaaaattagacaacctgtttggattcttgagagctaatttaaggctaaaaggtaagagctaaacattagcccatggaaacaaacagggccaggaatcttctaatctccctttcatgtgtccctcctttttttctccctatccccaaagatttcacattttctaatgagcatcatgccgtccatgagctctgttttttatcctaacacccctctgcagccgtgctcaccctctataaataccccatacaggtgtcttccaatagcaccaccatttggaagaatcctccccaagattgctcgatcccctcgtgtccctctctcccaacaacactgcgccacagacacaaatcacactcagatacgaaagataagtacagagagagagagagggcacggattatacactgcacacaagcatatatatatatatatcgattagccatccgtgctgatctgaagagtatcatcggtagagagttttacagagttgtttggacaaggagacacacacatggctttcttgctcttctttgtctttgtgacagctgcagtgctgtgcttcgtcgtcccggcgttcttgctgctctgcacgagcgtgcagaggaggagagatgttggacagggtggagggcgagattggcagaagaagaagaagctcaggcttcctccgggatccatgggctggccgtacgtcggcgagacgctccagctctactcccaggaccccaacgtcttcttcgcctccaagcagaagaggtaactaggcaattcctccgtctcataatataaaaagttttagcttatatagtcagatatataatttaaaaattgatggcgaatgtgcttaatatgttgtcgtcctcgttgatggttgtgttatttttgggtgtaaggtacggcgagatattcaagacgaatctgctggggtgcccgtgcgtgatgctggcgagcccggaggcggcgaggttcgtgctggtgtcgcaggcgaggctgttcaagccgacgtacccgccgagcaaggagcggatgatcgggccgtcggcgctcttcttccaccagggcgagtaccacctccgcctccgccgcctcgtccaggccgccctcgccccggactccctccgcgccctcgtcccggacgtcgacgccgccgtcgccgccacgctcgccgcctggtccggcggccacgtcgccagcaccttccacgccatgaagaaggtgagcgcacgcacacgcacacgcagttgccgccagttgccacagaccaggggtcgatcggctcggcgtcacgcgacacgagtgaagctaagtgacgtgtggggcgcgcgcgcgtcccggacgtgtttgttgttatgcgcgcgcggcgtgtacgtaatgcgtgaccggtgttcgtgttctctctctcttttgtatccagctctcgttcgacgtcggcgtcgtgaccatcttcggcggccggctcggccgccggcacagggaggagctgaggacgaactactccgtcgtggagagaggctacaactgcttccccaaccgcttcccggggacgctctaccacaaggcgatccaggtatacgcacgcgcgcacccgcaaatctctgtcgaattcgacattgatcatcatgcaaattaaacggcatgcgttgcgcatgcaggcgaggaagcggctgcgcgcgatcctgagcgagatcgtggcggagcggcgggcgcgcggcggcggcggcggcggcggcggcgacgacctcctcggcggcctcatgcggtcgcgcgacgacggcaccgccggcgcggtggcgctgctcaccgacgaccagatcgccgacaacgtcgtcggcgtgctgttcgcggcgcaggacaccaccgccagcgtcctcacctggatcctcaagtacctccacgactcgccgaagcttctcgaagccgtcaaggtaaacgcaacgataattaaccagagtttaagtactcgatcacgatcgagcgagaacgatggtgagctaaccaccgatgctttttttttccgtcgtgtcgatcgcgcgcgcgcaggcggagcagatggcgatctacgtggccaacgagggcgggaagcggccgctgacgtggacgcagacgaggagcatgacactcacgcatcaggtacaagcatgcctctttgttgtttttactcccgttttattgttacaaggaagacgaatatgcacctattgctgcatcacacatcacggaaaagaatggctttagtttagtttggagattagctagcattttgtgtttggaagtatatgtttggctgtgtatatctactgtatatctatatgtgtggatatatatagagagacttaattattattcttatttggtttagaaatgaggtgggatgagttagacttatccttatttttttaatgggataatccaattatctgtttggcatgagagatggagtgatcttatttttcttagggaaggagggggtggcccacatatcaataacagagagaaagtgagttagattggtccaccaaattttgagatatgaaattgatccgaatcttagggaaatattccttttgggaatcaatccatcacatctatttctaaacaaacatcctgaaaaatggatttgccccaacctagcctatatcaattgaaccaaacacatgccaaaagttcagtagcactgtgctcatttgtgccactttgtttccattcgatgcaggttatactggagagcttgaggatggcgagcataatctccttcacgttcagagaggcagtcgccgacgtggagtacaaaggtaagcacgtgttcaacatggattgggagtcagtgtacactgtactggagtcactgaacaaaagctagcagtagcagcttgcattttgcagtacgttagccagttgtaccaccagctggatcatatatatggatcatgcatgtacagttcctcccattgcacctcgatgtggtcctaataatatggactccaaattaaagtcaccttgagaaaatatcgtacaagattaaacaataagaaaaaaaatggaacctcggataaggccatggaaataaataaatgggtttaaaaatggataatatcgaggtgtctacacatatatatcatggatcataagtcaaccttgcattcatgagatcaatgttaaggaacatacacatcttcaagcatatctagtggccaaaaatgatcgaaatctatcataccttttgggaataattgttgatttattgtgccagtcaatctccttttttcacatactatagataaaaatcctagcatatgcatatataggatatttttatgcgcaatattgtagaacatatttcccattaattgtttgatctatcaaagtttggaggttcctaggactagctagaaaaggtgtaaaccgttttgggagggttaatgcttagcaacctcaccaaatgctagtaattaactccaaccgttttgggagggttaatgtttatcatgggagggttaatgttttctttaaaaaaatattgtggtcttctgtaataagactgataaccaactgcatgcatgctcccccttgaagagaggtgttcagtaaatttcaatcgaaataggggcaacagacaaattcatattttgtagcaaagataaagatatactgtaaataaaaaaattaaaattaaggaacataaactacatgatgagtaacgtcatatccacctcagcataatcatgctgctccgaacaagtggcttgattatttctcatgcatataagccacatggcaataaagagggatgcattttaatttgtttaggcacagttaattgtcgtctccagtgttgtatgaacagcagagcaccctatttcagcttccttgtgtgatatgatatactgacatgagatggtgtatttttcgccataaaagggggcaaaacatccatgtcctctcgttccgattaatatctgaatcatcagcatcacaacgggcggtccagatgcatccttagctgctcctgttcccggccggcaccggtagctagcgaccgattcactccattttcgagtggcagcgtagctgcagaaatgaattgagattgggaaagcaattgaggtggttctgggaacatttattatgtcgtataatagaagcggcataataattaggaacattaattatgtagagtagcactcagtgtttaatttgcaaagtggtatctttcgacaagttaaagtcgcatatatatattttcgtcactgaattcaatttcgagtgagactgaacgacgtttgtgtcgatctgttttgtggtgttttgtcaggtttcctgattccaaaggggtggaaggtgatgcctctgttcaggaacatccatcacaacccggactacttccaggatccacaaaagtttgatccttctagattcaaggtaatgggtcctattccttactcctaagctactgctcactgacccttgaatatggattgcatcagactaaagtaaactattagcggcattaagtacacacgaagacttttaggacatcccatcagaagagtggtagtagcacagttgcaaatcctcacacacgctcaaaattcagactctggtctcgcttacgagacatgcagcaaagtcaaaggaagcaattactggctgcttaccatcttcgttcacactcattgttgactcttttgcgtagactcattaaaccagatcactaatttaacatcagtttaattccccggccaggcctgcactagcttgggcgtacttaacgacgacatctctgaattttgccggccgcttcagtaagcaggtggcagctaattaagtgttgtgcatgcacgcggccaagtccaaaccaaacactagctagagtacaaaggttaatttaggctcactaagatacaatctctcgagcattagcagccggagattaggccgcgaatcttttggactttggttggaccgagagtgactcatccttcagtgtacgtgcgtgcgtgacgcgtggctgtgcgtgcaggtggcgccgcgtccaagcacgttcctgccgttcgggagcggcgtgcacgcgtgcccgggcaacgagctggccaagctggagatgctcgtcctcgtccaccgcctcgtcaccgcctacaggtaagtgatacggcgtacgtgaaaaccaccgtgttttccacggcttttgccggtggcgatcgacagtgtgacggacggcgtacgagcggatgatgttgttgttgttgttgcaggtgggagatcgtcggggcgagcgacgaggtggagtacagcccgttcccggtgccgaggggcgggctcaacgccaagctgtggaagcaggaggcggaggaggacatgtacatggccatgggcaccatcacagcagcaggtgcttgacacgtactactgctgatggtggctgatgtgtccttggtttcttttcgtcgccgtgtgtgtggatgcaatggtcgatcgatcgatctctcctgtaatcctcggataaagcaaaggccatgggagggatgagatgatcgtgtagcaaaatctctcttcactttttcgtgtgtgtgtgttgggttggataatggtggtccatggatatcgttcgatgatcgatgatgatgatgctaaacctagtcttggtgtgcctagtgtagcactaggagtagtagtttatcaattgcttagctgttagctagcatcgctttgcattgggttaatacagctagctgtcaagcttataagtaattaagctctctaatcagggttttaaatctcctgtttgagaagtttgagaaggattctctcatgtacaatttagccgctataacttcatttagcctggctataactgtttgagaagctaaccgctaaatgtcttagcctgctacttaaaaacattgctctttattgcaactgcaaactcgagcatgtgtcatgcatgaacatggcagttgtgatgtcacttctgagttctctgactgtaacaccagtatcagcgacattgaaatgctgccacatgccagaagtctgtggctatcagggtatgcatcatcgatcgatcacaccagtgatatatctgtgtacttttctaaagctgattgttactccctggtcccattttaactgcaatcatgagtttccgcgttcaattttaatcgtccgtcttttttaaattgtttttataattagttttttttataaaatgacaaaacatgatcgaatagtactccacttgtgacttatgttttcaatttttttaaaaaaacaatttaaataaaacggacgatcaaaactgaacgcgaaaaactatagctgcacttgaaatgggaccgagggagtagtactttcaccttcaccttggataaaaaataatttggtgatcacagggctggcctcttcttttaaggagatctctttaagttttctgaaagaaatcgaagaatctgtgtaataatatcaggttgatctctagacatcatagataatcgcgcatgatcttaagtccaaaacaaaagcttgcattatccatacttgtcgccacaacggcatgccacttattacagccgatgtgaccactacaccaaccatatggatcaaccactgcaagactgatcgccagcttgtcactagtaaaaaaaacaatagtaaaattatttagataacaaaaatggattgaaaaaacaaccgtaataatttgtaccatagaatgtacatgttagcagtttttttagacagttctgtgtttgaatatgaagtgaatttgtttatcttttctcatcaattaagcttttgagttaaactgtatataaacctcaacataatatcagaacaactcaatatagtatcagacagaaatctcgagttcaaatccttgctgaagcgtaattaaataaaagttgtacaccacttctattccacgcttgagacttgacggagcctcacgtgaggagaagtgttaaaatataaagtgaatttgcttacctttctttatcagcttaaaattttaagctaaatcggtccatttgtgcaactcaatattcttcgatgcgtggtggagctgcctgtggatgtggcgtggtcttcggtgcacgaaggctagccggcgggggtattggtgcaggggccccacatgtcggcagagtttgagtggtggtgaagtatcggtgcgtcagccgtggattggcaggtggtgagcggcgggtgaaaaccaagcccggccttggccggaccgacaacgatggtcaattccccctcctaagggcgttgtcgtgctgtcttacccctcaagggtggttgccgggcgaaagcccagtcttggctcctttgagccctgacggatggcggcggtggttttccatcgcttctcttcttgaagacgtcgttttggcacccccttgttgtagggcgatctcgtctgtgttcctttgttggtctagcggcggccggtcacgcttagcggtggccggtccggtgctaaccttctcctggtcgtgtgtgttggcgttgtcggtgtgtgggtggtggtatttttttcctttttcctagttacgatcctccagggttgtaatcttgtaatttttttcctgctctattaatagaagttcgcaccatctcgtgcgagtcattaaaaaactcaatattctgagcttgacaacttttagaaaatatagtgttagttgtttgcaatagagcataaatatatgtcctccagataagcaaatgttgtccaggtttattatgttacaatgaaatactgcatcctgtcatgagggacacaataaataggtttgttaaaaaaaacataaggtgacaggacaaacttctaactttattagtgactaactttctatcatttctttcttttctagcttgttccgttcaatctcgccactagccgtgcaatacggggctgctgtcccatgacactggagtagtacttgaccgtgcaaatggttatggaaacggtatgtttaacataaaagggaaaaacaaagaaagcaaaaggtttccatggcagtacaacacctgttagcacattactgtccggatggcaagttatttttttccatgtttccaggctgcacaggatccagcatctgtactagaaaggatcaaaccgcatttccgagtggatggtctttgtcatgtctcagtacgaaaggggcactctttttatttagtttttggggaaataattgaaagctgtgcaatcatcctactcttgtcagactgtagatcactgtagcttttgcttgatctttattcgatctcccttcctttttcatgtttcttgattttttctatgaggggttgtgtggttacaggcttacagcaatgctagctaatgggtctacaaaatcaaatgccactgatgacatgctgcatcaccttcgattgatggatatctttgctgatgcatgccctggacaacacaaagcaccctccatttctgtatccacataatagctagcctcatacgtgtcaaaacttccatgtgtttcgccgtacaaccaacacatgtttatggctgccagacaagcaagaattatatatacgtctcccccacaaggaacattggaacaaacatgctgttcagctggagatgcatgatgccaacgttgacggtgtatggctcagaagaagaagaaagattctaataactcgagtggacgtctacccgtttattacatgttaactggataattaaaaaaaattcaaaaaaattgataagatcatggttcaagaaagcgctaggcgctagttggacggatagggggcgcctagcgcctaattggcgcctaggccccgcctaggcgggcgcctaggtcgggtcaaatagttaaattcaagaaattagtaggcatattgcatagaaattagactatataacactaaaatagcaataaaacactacctaagtaatttaaccgcctaatgcaccattgaatgcctaatcgcggcggctacccggcgcctagcgcctaatgggcgcctaggcggcgcctagggccgatttttagaacactggataagatagatcgatatgtaatatatcgctctataaacatgtaagttcaaattcaacttctacaagttataacaaaaataacaaatttaattgtaaatatgtatataataatttgagctttgtttgttatttttgttacagttcatatgtaacgtcccgcctctcataggacgggcccgcttacatttggcagctttactcgtgtgcaccatccgggaattcctcacttacatttggcagcttttataggtcatatactgcccttatagactaacacaagttttttctaaacactttgtcctcactcgtgtgcacccgggaagaatttcccggtcggtcacccatcccgaaattgctccagaccaagcacgcttaacctcagagttctttcgatgcaacttgttaatatgagtattctattaattctattaagctctgggccgggatgtcaaatcatagaagttaaatgttaacttgtatgtttgtggattgatatattacatattgatctatcttgttcatatttttttaattttttttataactatttagatgacataaaataaacaggtggacgtctactcaagctcttaaaacaatttcatataagaaacctgatctacagaaacaaaaacctgatctacagaaacgacgagaatcaggttgcttttattggttgcatcagctagctagcgttctgcactgaactgtagctcatcttcttctccccagcggtagagcgccgcgtgtcggatggtgctagctccggtagaggactgaactggtgtttctgatgggaaaagcatttgtcagatcataccaaccgctgttctagttcggtcactgctgtcgaaagtgagttggcatccagtgtttgtagggttcggacttcggacaaggtgtgtgttggagtccagctaacgaggggcagtacttgctctgacacggcaagcacggaagcacacgccggacaagagctcacgcgacggcatgcgcatgtcgtgcagtgtccatgaggggatcatcggcttctcttttggcccctctcttaaacaccaccagttttgtgtcatccgtgcattacaatgacggatctcaattctcaaatcaataacaaaggttccaacttaaagaatagatcactccggtatgaatttcatgcgtataattataccacaagttattttaaaatgaacaacctagatagtctatacgatgttttgtattaataatagagcaggaaaaattataaaacttctagtaaactttttttttacaaaactatattctgaaatgttgtaatccgaaaaagaaaaacaaccataccaccgtacaatgctacgttagaccagtcaccgtcagacctataacgtagccactattgaactgcccatgaaagcctctaaacagccgaaaacatcacagcctcatagacaccaccagcgagaaaggttgcataagggacaagtgagaataacatctactcatccctgaatagacctgccgtcatttaagagtgtcattccaattgtttgaaggggtaaaaaaaaacataaacatgatctcataggcaatgcttctaagaaggaagtaatgacataaacatcgccaccacctgtcctaggaatctagatgttgtttttacttagaggatcccgacatgggagaacgaaacacctcgataagaccttttggagggatcacaacacttgaaaatgttgtcgttgtcaatccagcaagccatcaggctagccttttacttgctgcttgttcggcccctacaactacagctccattgcccccaacattcaatattgctaacaacgtatagacacctctacaccaacacccctctatcggttagcctctacacaactctgcatgctactgctagtgtggctataggacaaaccgtagcaagagccaagcataatgtcatcccttagtgtagatctatccgccgtcattgacctcataaaccaatgtcacccatgccactaccttaggggccgaggacacctacccttccctacaatggatttggcctaccgccatcaacactttcgtcgccatagaggccaagaacatttgtcctaccatgtcatagatttggcccacaccaccattgtcaccagccacctacagaccacctcctctcaccagccagctcccatatgaagcgacagcaccttcactaggtccacactgttgaccagcacctccgtcatggcctcctcctccttgctttgtcgagcattggttgtgggaaacgtcgtcatgtatatccgctgaccgtgccatcgccgcacccatgcacctcatcatcactgacaagcatggatccagcctcgggagccaaatctagcctcaacagagcaagatttgtttccacggcttaggagttagggctgccatcgctaccgccgccataggcttttcctcaataatttatggctagtgagtatgggaggatgatgggagaaagccttgctaccgctttcctcgcagactttcagcgatgtgctctagtgccagtgaggtagaggagaggaggtggattacgtggtggcatgagtgttagggtttcacctatattgccgagggggatgagggggatgacacagacgatgcatgccggtcttaggcccatgaacatgattataccatcaactattggcaactatatatacgcatgcaaataatatataacatcatggtataatagaaattgagagaagacaaactatccacttatactctcacattataaaagcttaaaacaggatcataaccacttattgtttccttgttatcttatgagccacgagcaaaatttgaatttcaaaagtcaattttgggattttttttaaaaaaaaggcttttaaaacgttaatacatagtaacacaaatggttctttttttttccacagcttatcaaacatagctcacacgatcagagtaattttccacagcttatcaaacatagctcacacgatcagagtaatgatcaaattaacgccacccgctcctctataacaagtagagtttctgtttatctcatcttagatacattttatggcatctgctggaataaagatccagcgctaaaacactctgcgctacagcattgcatcaactttcttctcttttctgttgcatttgattgctgtgtgtgtgcagtgaaactggctgaagttgccgggagaggtttcttttcccctcgtgcatcatggaatcgtgatccatgaggaatcaaccaatcatgccgatcgatcgacagaggagctggctgggccatggccgactgctcgaccgggttggccgggaaatatctctttctcggccatcaatcatcatcatcattcatcatcaatctaggagatctggaagggcaacgcctgaagtcgacacgtggagaatactcctcctttcgctgtgacctgtcactgtgagtgtgagagactgagtgagagtgctgggctccagggccagctataacccatgccgctcacctgtgtaagctggcagtgtcccttggcatggcagatgccaggcgatctccatttgctttcggttcgtgtcttgcagcagcgcaccagaccgaccaaagtacagtagttaacggcacaagaactagtcagtaggtgcaatgccgatgcagggttggctggcaaagccgcaaaggcaaaagcttagttaggactgaggcatcatgtccagatcagaagggttaaggtgagagttgtttggttagttcgaatgtttaaacattggtcaaaatgtcaggcaccacaaacattagcgaggtttgatatgaacctgaacctacattaatgcaaatcccagcaaatgtcattacaaaggtggtacttcagttgttctgcaaacgttttttgatgtttctccgtgactacagttataacatagtacattacattatatcacagcaatatcgttcattgtcccaagtcaatcccttgttgactgttacccaaaaaagtgagaaaaacaaaacatctggcctgtcgatgaaaatttacaatcgatgtatctcaatgcctaacaaggctgtgcttttgattgtagatagatctgtgtgagcatgaattggttgctactccctctttttcacaatgtaagtcattctagcatttcccacattcatattgatgttgataaatctagacatatatatctatctagattcattaaatcaatatgaatgtgagaaatgcaagaatgaattacattatgaaacggaggaagtactacataagacatactagcagactagcttaccgtacagcagaaactacacattgtatattttcaactagagaaaggcgcaagaaaagaaaatgtctagagcatagttatacaaaaatcacttcaagctttgcacatggatgatctttaatgtatttgtcaagatctgcgtcatctctaaatctgaactggtataatgcctgtcgttgtgtaaggccgattggataaattttgtataccttcaactcgtccccacctctaatacttggtggtctttcatccttccacacaggaacatgattgagcgatctaaatttagcaagcacagcagactccaaagcacccatagttaattggtccgacctgcattgcataggaaaggcacaagttttaaaaagactagcaggaaaacaatcaggtaaaataagttagaaacaattgtatatttaagctattcaatttgcaagcagcattagttgcagtaaagacaccaagtttataatgtaacaaagctagaagttattttatatatgtttttaaaaagagcaaattgcacaatagggcaataggctaggtattattaccgaagtttcactttggaccaggacaatgaaactttggaccaaagttttttttttccatttgttgcacactgggctacccatcttaccggctggcctggcattgcctgcatctcaccatcacggcatccatgaaccctctgttgttgctgctgctgcaaggcatgaagagtgcatgcgcatgcagagtaagatgagttgctccaagggggcagccattggagcggtgagggcatgaggtagatggaggtcggaagcgggtgtgaggaagtcgacattaacagagcctgagcttgggacaacacaaatagagttcaagtgcagggacggcaatggtggagccagcgaagctcgagctcgagggatgccaaggcaaaggcagccattgctgaaactgaaatcaagtttgcggcagccaggcggaggtggaaagcgagcttgggcgctgtcaaggcagaactcctcctgtgccaactacgggtaagcccatttagaaggaatagctcatggaagggtggggacagtggtcatcccaactgcagctgccttgatctggagaggagttagagcaggggaaccacgggagggatgtggaaattggatacgcaatggcagtacaagcacaagctcacgattgcttcttctgtagcaccagaagccaactaaccaggcatcctctctagagttggagagatgggatggtctaacctgcaacaaaggtaatatttcctagccctatgtgaaaacattgtttatgccctggtccaaagtgaaactttgttcataatacatggcccaatgtgcaattccctctttgaaaaatgatcaggagcactgtgattcacaagacaactaaaccagtagcaccatattcatcggtgccatcgtaaaaaacagaaggttggaaaatatcattgcatgtgcaagatcattctcacatgcaattatatttctgtctttgtggtggaatttacctatttttttcaaactagcacttaagtccttataatataaaaatataacagtagtcaggtacaaatgcaccatctgactatctgagataataaggacattagagttgagattacataatataggatgagcatctgcccttgtaacattttttttaaaaaaatcccttgatattttgctctttatcatgacagctgcagataacaaatctaacacaggtaaatataacagtaattaattccatacctcagaaaaatgctctctgtcttgaaccgccctctttctctgacaaacaagtggtatacctttcctcttttgcttgaacaactacatgggcgattcataaattttggtgtcctttcctctttctcatgaatcttcgtcgcgacatgtatgcaaagacgacatgatgaatgaaccgctgccatgtcaataagggccttgaaagaatcagatgggccatcatacttccatctacaaattcaaaacatagaatgagatatgcacagcacagaaaatggtgacctaataatggctgataaaggatctttgacaaactgtacagtaattttatcagcagaatcatctacacgtgaatggaacccctgaactactcaaggataccttcaagcaaatcaaaggtaatgaggacgccaacttactctaagcctaaactgcatcagtttttttataattatgtcttgaataatggttccaacaaatagatttacaagatatgggagagtgaaacaaaaaagacaaaaagaaaatacacccagtagagtctcatggcagtactataatttggctatttcttcattctaagataaataagaataatctatctaaagcagcaatagcaagttaaaatctatgttagacagccagttatactaaagactaattccagtagcttctgatggtggtttcatgcttttccagagtgccagagtcacatgattggtaccaacaagtttacaatagagtatcgctgcaatagcattttaagattgagaaatggatttccagaaaaaatctttaattgtagagtaattttgttcctcaacaagttacatatttgataatgcttgtttgcaagatcttggtaaatgaaaaaatgagtgggtgaaagcaacatcatagcaagttaataatgtataatacagcattacatcttattccttaaaagaactatgccaaaaattgataagcatgactccatatatttccaatgctgaactggtgattgctttttaatgcaaattcagtgtacatgcagacatacaccatgattatgcttgaatttgcggagatcattagatgttccaaaaatatgattggtgtacacgtgatgctccaacaataccattagtgaatgagaaacaaatctatctcaggcatgaagtcaacagggaaagcaggagcatttacctcaaagattgattaaaggcttcctgatttgatgcaatatgtttcattgtcttggcaattgaaggaacatcatcaagctctttaatgtgtaatattgcgccttctccaggagagaactcttgaatgtttggagcaccaatcacaactggaatagctcctgtagcacagcgcagatgaaattttcaatcacttccattccagttagaaatctaaatttcacagagttcaaatttaatcaattgctggaattggaattaaataaaattcatggtgaacagaaataaaatgttaatcagtagatatgggaaatatgtacatcacaaatatgacaatttggtttatgatttggaagatcctaatcgatctgtttcacaatatttgttcacttgcttcatgaaagtactttcataatatatttcaattggtgagagtcacgataatatgattttccatgtctgtgcaatattccaccccagagagatgactaacaaatgggcataaagcttatactaactctggatccaatgttggatgagaatttaccaatgcaaattgtgtggatgggtgggtgtgggctgggggtttgggtcaggaatgcttaatagcttatccaattacctgttaccagcgattgaaaaaacttttctgtaacataatcttcctcgttggaattctcaaaggccaagctaaatttgtagcgcttcaaagtttccactttatcaactgcaccaggcaacatataaagttcgcataacatttctttcctcaaaacatatgcagtacaacaatagaaatacaaactagtccaatcataaaagcatcatttatgtaggcaaagcatttatcagattttaacaacacaatatgatataagaaaaggaaaaaatgttgccctggacagtgcatcaatgtccaaaacaaattatatttgcagccagaaggaccaaggaagaataacttaatgcagagatagataaaatcttaattaacaaagttgaacataacgatagctctttggtttttaatcttttataggttgaaacatcatttgctgctgctctaataataatactatgtgctactctatataccaacttctggcagcaacatcatttcccagcaatagttattaagatttaaaaaaaggttatgtgcaaatattgatgttgaaattattgtgatcatataaataaaatgtggaggtcatcagtgtgcttaatacaaaagtagattctaaatcatcaaacacggtatccttaaaggcttcataaaatcaaaaagaaaagaaaatttgtcatgtgattttcacatacccagttaggaattatctcagttaaacagaagggagatggacctgacaattagcatattgacatagcagcaagaattggcagttgtgatagttttatatggtattcaatatttttgattgcttggaacaattaaaaccatgccacgtggaacactttgctgtggctggccactcattacactcttggaagcataaggcaacatatctcattaactatatacgagtaaatttcacaaaagttaataaagtatgtcactcgaaatatggaagagaaagtgtacctttgccatcatgattacgatggcaactaccatatgaatcaattttgacatctaagctctcaagcatctcaagggcttgcaaacgaaaattacgtgcaccacagtttgaaataaatgctgcagctagggcttcttcagtttttggaggcacaggtgccattatatcatattcagcccatgaaaagtagccaacaggtacatctgaggaaaggcttgttgtcatcacaattttgtaacctctcctgtgagagagcatcaggattgctcagtccattagaattatgcttctaaaaataataaatcacactgaggattaaaatgaatagttccgtagctggggatacatgatggtaataggttcacaagaacaatagcatattcaatacaatactggttaattactattttactattttattttaagtgagaatgtttgagcatcagcacgaagccaatatagtagccaaatagcgctctttactttcttaatattacaaataaaagtattaacctacaaccatgtgtgactattaaccatgtgtgacttctcaacatggataacagagtagggatcttagagccagtatgaaaattgcttacattatgaaaacatctaacagttctgagtttatgtaccaaagtgaagtcacacatggttacaaactaccaaagtgtacgtggaacacaacaaataaggttaaaatatcatttaaataggcagagaaatcacccaaccagaattaacttggttcttacccaccctcgagccacagcaatgttgttctctgaataatactgagatgactccatcgatctgaggatactctctacagtaggatctggggcaattccaaaagtagcatcaggcgtcttagtagctgaaaacccaaattcacatcctacagaacatttattccaatcctgagaggggaaagaatgcataagcacgatatatggagaataagtaaagcactaaatgaatgacaagtgatggcaccaatggtacaaacaacaatcatcattatctgcaatcatcacatcacaaatggcagtatggcaccaacacaagcgtatagcaccaggtataagcttacattaaggtatgcagttgagcataaagcttgagggcaagatcttcgaattctctgttgctaaatctaattttcacaatattttatttttacaccatttagaaagtgtttgtggaatgttgagtaacacactagaactgccccctccttcctcctgacataatcaaaccaacatgatatcatgtgcattctgatctactatttgaaaaaaaaaatactggttccaaacattcactaccacatcccttcattcccatggaaatgatgcccacgtaagtttgctaaaccatggtatcctaatttccagcatttataatcccaatttaataatcattgagtggtaataatgtcaggatatcatgaccaacccaacagtccataacctccaattcgtgtcatggtttatgtttaatataagaggttacttgttctttttcactttggatgattttgtttgtaacagatacaaatatgcaatttcttttataactcgtataatggtatgaaggctagaagactgtggagtctataagcacaaagtcaagatttttcataatctactagttacagatgtatgttaaggaagccccatatgtaacctggtggagaggccagtgacgaacgtgtcaccaaattttagggggtgctaataaacaaaactgacagaaaactatctaataaaataaatgacatatatgttttcttatatcatcttactgtcattgttgtggtgcaacaaatgtgttccatattatactattgacaatagaactaatgggcttgactcatggactcagctaattcccttggttgctcaaaaaaataacaaagcagcctcgctggcccaaacagccgaagcccccaaactacagaaggatgtgcttgctaatgtgtgggactggatgtgtacgtctggtgtgcaaaggctcttgtaccagtggaaagggtgttctgtacttctgttagtgcccccaagtaggtcgaaatgttgtgtaaaatctgcaactaagcatgcaagtgagaaatttgcaattccaaaatggcaagtatggcgtagatgcataatctggacctttacatgcacgagctagagttatataagtattgctagcgacatacagataacagaacatcgactagaattaatgagctttaactcgttgatttggctacttggcttttgttgctagaacaaataacagaacatgcacatgcaaacatgaaatcccacgtaagcctcaccagcccaaagccccaaacaacccaagcccccaaactatagaaggatgcactagctaacaagtgtgtgtgtgcaagagcccccgttgagtcttccgctgagagagactcttgcaccatggaagggatgttttgttagtgctctatcttagttcaaattgagcatgcaagggaaaaaattgcaattctaaaatggcaaatacgacgtcagatgcataatccggaccttttgcacgagcaatccgtgtgctagagttatctaagtaatgttatccaactaagcagaagacctgttgagctgagcagtccaaaagtagctctcctaactcaaatgcaagagcacaaggaggcggatctccgaactgaaatggaagagcgcgaggaggggcggatcgggagaacaggtacgagaccttagcggcgcccccgacgaggacgggatccttgtcgaagtcgcggtcgtgcggcacgccgtcctccctctcaagccgctcctcgcacaaccggatgtcgccgtcgtcctcctccaccacctcacctccgcccgggggcgcgtcgtccgcgtccgcgccggggaccacgaccgctgccttcccgtcgcgggcgggggcggaggagcgggcgtagaaggaggtggtccagctctcgaccgcggcggcgttcttcgccatgtcgaggcggccgaggaacgcgatctcggcgaggaaggccgcgccgacgaggagcggcagcagccacccgcaccgccgccgccggcccgcctgggactgggcctgggcctgcgactgcgagtgggaccccttcatcgccacgcgcagctccgcctcctctcgccggtggcggaggcgatgggtggggtggtgggtgaggggcggagtcgttagacgacctggtcgtgggagttggcaaggcgacctcgtctcgatcttcttttctcatcgtgtgggcccacgatgtcagtgagagagcatggcagagatccaattttgcttgggcccatttaaccattctattttcctgggcctttttctgcaggcctcgtggtctgtccaggaaccggagtcaaacggcccatcctttagtgggctaacagcttaattatttgggaaaagtgtacttttactccctcaactatcgcccgagtatgatttatgtcctccaaccacaaaactgggtatatcgacacctccatctattaaaaccggtgcaaacaatgcctctgggtggtttttggatgacatgacgcctatatggcgattttaaccgagtctttgtcctacgtggcgtttatgtggtattagaataaaaataaaaagaataaatgggacctatatgtcattcacataaataatgtattgtagaaccactgacataccgggttttgtggttgaaggacgtgaatcatactcgagagatagttgagggagtcaaagtatactttttcctaattacttccctatatttgcatgggctgatcaatgtgtcccgtctgggccgtctaattgggctagagctggtatactccgtggtccttggcattggccgattctgaccgagttagccacgaatgaagtttatgcatgtcagcgagagtttaaattcagatcactatttttttagataatattcagatcactatttggattagggaatagttaattgaaaagttatagctaatctggtacagccagtagctcgaaagagacccctgcaaaggtaagaactaagaaagaccgaagaacactgaagagaaagggagctaggcatatgcaggaatgctaaagcactgaagaaaattcagtgtgttacagaaatggaacttggcattgctacagtgttgaagaaaattcaagagtgttacagtcgcatgaatacatgtcggtgaactcggaaacgtgagattaacttcgatactgtacagatccaaggcagtacagattattgcatgtgttcttttctctcaagatggcactgcagcaatcaatctgaaactaaagcagcgctgaattttcctcattccggagtgttctgcagctgatttccaattgggcctaggctaggtctgggctaaagcaaactaacctaggcctgggttaggtgtaataaactttgcatttagtgcttagattaggttcaaatcaggattaggctccaaccataccatatgcatgcatctagctcgttctgcaacacaaaggcaacgcccacgaggcgttagctagacaaagggaatcatcaagaacatgctgtgacggtagattagaacaagcaagaaatataaatcgtttcagtttgtcatctgtgcatcgcatgtctgggaacagcaaaagcaggacaaaatctaaagaggtggttaaaaccaaaagtacaagacggacgaacggttctatgtatagagtatttcattgtgtcaccttggccatccatcacaaatacgtgatcccaacacatgagacaagccatgcaatagagttctgcttggaaaaaaaaagactagttattgttaattaccatggattggattccattgctctgaatgatgctctgtttgtggtccatgatcatggacaggtaggaaaggagcataaacatattgtacagccagccagccagccagcccaagcaagactggcgttgcaaccatttctgcatcccccccaaagtaattaggattattcatttgaaagatagaataagaacctaactaaggcattggtttctattcccttatctgttcttttatgttgattcctctaacaaactagaaataaaagaaagtaattaaatttgtccttgtccatatacattcatactcgttggctagcttctcatgtagcgattcccaacgtcaatgaggtttagggaccagtaatatcctaataaacgaatactagcacagtctgaaagaactgaaacttctttttggtgatggcatatatacaagtccgagatgttcagagaagcaacaaatcgaccacatatagtactagaaagactgcaattttttgttgtatcatagggattccaataggttaactacctacacattccaatggaggagacatcacgaatttttatttgatgcatccctatcacaatacgtacgtagctaagtatagctcattcttttttctatctcaacctgggagagaagaaagtatctttgaataccgtttcaatcaggcgcacgggtgtcctgttcttaaatctatacgcatgctcagagcacccacaatggtaaaataagatgatatctataaaatatgtacatatcagcaatagattagattaatagtaaaccacttcaatagtatgtctacatgggtatctatagctctctaatctattgtattatttttctctatatattatctcaaggttagtagatagttttgctctctctttatttaatctcttccaagtagaaaaatatgctgacatggatatcttgtagagagcctatagataaccattacgggtcccctcatcaactacctaaaaagtgatcatggcatcttcttttctcttccaccaagtttaatttgcctatgcctacaatggctacgtctaggctagctttgtttgtttaacacaccatgaagcagaaccagaattgtgcaaatgttgttgttcactttgcctttgcatgctgcggaccagctgagaatctttatttcgggttgttcctttgatgcggtgggatagtttttgtgggtatatatatgcgactctattgctactacatgctagggtttaaattctgatatacggagtacatatgatatgtttttattaggtttgtactacagatcggtataaaacctatagcgcacatgttttttaatatttctccatcatatatataattataaaaaaatgagagtataactgcatgaaagtatttctaatgaaagaaatctaaaaatgtcacttttacttatgaaatcttaattattggcgatataagatgacttctcaaaaaatatgtactaccaccgtttttaagagatgacgtcgttgactttttgtcacacgtttgaccattcatcttattccaaaaatgtatgtaatcataatttattttgttataagtcgtttttatcactcaaagtattttaagtatgatttatataatgtataaaatttttgaataagacaaatggtcaaatatgtgttcaaaagtcaatgcattcaccaataggatttaataattgtgggttctttatcttgtgttggtgcttattagtttgtgcttatgctttgttaaatcttggtgtgtttgtgtgaaccctttggtgtgtggtcgctttagagcgaatttgtgtaaaaattggttgtagctcgttgagcaaatgccagattttatttcattataaaaaaataaaaaacacaaaggggatataagattttgaggtttgactgcttgcgcccaggagcggatccagcgtgggtgccggagggactcgagtcccccttaccccactggatcaccattgacagaaggagagatgaaagagtaagaagagggagaaaatgaagagtaggggggactgaagaaggaagaaaaagatgagtctcgagtccccctttcattctggttctagatccgcccctacttgcgcctaagacaacatctttcatgtctagtctgataagatggattttcatgacaactttacacctctcccaaacaagtttcttactttatattcctattcgagaaatgtgcaggggataaatataaaacaaagaattacttgtgcacgaacatgtcaattgccatatactaccgcggaaagaaaagggaacgtcctttgcatccacgactgattcaagcacgtagtggtgctgcgtaatgatcatgtccctagctatatatactacgctgtaatcgccttttatttccctttcgtttatccccgtcagattcagcaaatcacaacagtacattggtgatcaatttctgattagacaaagtccatatcagggtagagatgcaaggttttatctcactaatccacatgactagcattacagaaccaggttgaaagctaacgcaataatattattccaggtgcttttctttgcagaccgcggttcgccaactctatatcagatagataggcatgtagccaggcaacactgcctggctggcccacagccacacgatcaacatcccacgaatacaatttctgcattgtctagtgaaagtttggttttggtgaaaagaaaagttaaggtaggttgagtcctctaagtttaatattcaagggagcctactcctccaaggaaaaaaaatagaatttagtttgtcatttttttactgatgcaagtgattatattcactaatactcctagatagaactgttaaatgtttctctaggatcaagattgacatgaactttgtaatgttcaagctggccaaccagcagatcttttgtactgtttattttgttcatgcaaaattattgaatcactgttgatgaacaagttgttgcatgcatgcataattccatatgcaagaggtgatgcattttctgcattgttgtcttgtagaccatgaaccaaaagtgttttctgcactgttgcccggacccaaaagtaactaaagattgagaaggactacacttcagggataaacaaggagctaaccaaaatgctgaaatgagatattcataagtctggggttggtgcacagcacaaatttattcgtttaaaaaatgtttattttatttttgttcacattaccgccactgtatttacatcttactaccactcacaattcacagcactgccaaaaaagaaaaaatcacaacactgcaaataccaactgcatgcatgcaagctgcaacatcagcagacacggctttattcatgtgtctggtaagtgtacaccagcgagagttgcccaaaagagtgtcaagatcgaacagcaagaatccgatcgtccagtggaagaatcacccgttgctcattgagtcatttggcatttttcaattttatgtaggaaagacgagttccttttgtttttctaatgaatgactcgaaaggcaccagctagataggcaagttagtgacacaggtgaacactagcactgctagctagctactgctggctggctggatggatcaatttgctcctaggttagtacatataccggccggctctgaattatggtgctttcggttggcgcattaacatcactcatgggggaaaaggatggacgctgttgatcctgtttggagagacggcgctaattaaacttctcacaggatgcatgacatgagatggatcatcgttaggttattgctgcctttgggcttcctcgaaatgcaggaatttttataggacttttatgtgtaagttggttcaaatgtcacaaaagtccttcatttcaagggaatccttatgttttctgaaaatatagaggggattttatggagagctggtcatgatcggtgggtatttgaagagtcggatatagcaattttagagattctagctcttagtgatgtgctctttccgtttcaggttataagactttatagcattgcccacattcatataaatgttaatgaatttaagtacacctatatgtctaaattcattaacatatatatatatatatattaatgaatatatatatatatatatatatatatatgagtgtaggcaatgctaaaaagtctttgtaatatgaaacggagaaagtatgttcttcgatgatctgactgtgacgactcatgaacaaactaaattcctgcctagaaatccacatgattcaagccttccaggacagctacttatgggttgaacctctgaattgggggaggcagagcttctaaaatggagggccactgttgggtgagatgacgtcgtcaaagcaactgttctattgctgctgcatatatctgtccgtcgacaaaacattcgctcgcattttatgacgggtgatctgaactaatcgatcgtggagctatcgatccctttgtctcggttgattggagaatgatttcgtgtagag

SEQ ID NO: 45815 - DNA, 1483 bp, Oryza sativa
ctacattgttttttttcacggttattcatgtagcatgaaaagcaagaaaatattccttgtcttgttcggtttggaggggattgaaagggattgaggaagaataatttcacatcattatagagttggaaaaaagtacccttaaattcctctcttttgggagttgacgaacaaggcttttaagaacgtgttaggttaatcctcacgagaaaggtatcggagggaattgaaatagattaattccacatctcaatagaataattccacacacctaattcttagggacggattaagtgaaaaaaaatagggatgaaattaattgatatcccccaaaaatgtcatcgtgaatatatattttttttaaaaaaaatgtcatcggaaagaaaggaggaaggtagacgattcccttgacaacaaggcccaatcaactgttcacctccagcaggcgcggccaaattctgcaagcaattgaccaagctaggaaataaacaccatatctgcagtcgaaaacgtgagactaaacaggcatcaaaagtcaggcggcggcgactacgcgcgagctgagctcttcgaagtctcgccacctcactcacacactcaccatcaaggcatatattgatcacctacttggaggctccgtgcgtcaaaaagatcagataacaacagctgctaatgctgtggaccatcatcagcaggaagagtgaaatgtagtggagctctgacgagaaacggatcgacctgctttcttcttgtctcatctcagattaattgatcagtactgtcattagcagctatgctttggcttttgcggttagtaagtcaactgagccaaccataacaagccagtttgggaaggtgtgcgtcttgtccgggccaaatgttcatgcagagttaggtgttatacactggtgttagcttgtgtctctactgtgtcttcaagactgcaatcaccgaaaggcgatggcaatcgtggccatgcaagttactagtatatcagacgttcagagggagaaaaaaaacacaaacgcactcagtttgaacagcaaattcagaagttcagtacttcagttcagtgtcactcgtgtagaatgatgattagcaaactgttctgtccaaaatgcatataaaattcagtactcctactagccatgttgagaatgcatatactttgcgttgcttcggactcaaatacaatagtcatgcacttatttcacattgcgggtcgcttcaatcataactatattagccctaaaaaataatactatctaatgactaaaaagtctaaagtgcaactcatctttttcatctagattagattatgtcttttaataaaatgttcagtgaacacatggttgtacagtgagtcagtgactacggaatgtgaatagcgaaagcatcttcttttctttctttttttttgtcattggaaaaaatcagggaaaaaccattcgaatttatgggaagaacaatattttagtagccttgg

SEQ ID NO: 45816 - DNA, 6288 bp, Oryza sativa
  unsure (1)..(6288): unsure at all n locations
caactgcgtatcagaaaccgaacacctacccggcaccaacgccgacaaccactaccgccccctccctcccctggctctaggcaccgccgccgcactgcccctccctcctctggctccggccaccgccgccgctccgtaccccaaatctggctaccgccaccgccgcccctcccttccctagctccggccaggcggccaccaccatcactctgttccctggctccggccaccgacgcccctcctctcttcgttgatgtatcccccgccggcggctcggccacgatgtgtcgctgcctcgacgcgacgcaaacgaggtcctcgatgtcgcaggagctcactgcgcggggctcgtcgccagcggccgcgtcctcccctcgccgagtgggtcttcttccccaactgcgccgaaggtcctcgtggacaggcggcagcaatctcctccacatgctcaggcgctcagctctcgcttctctttggatagcccgacggaatcccggtatgtagcattttcattcaaatttaactaggggtaaaagttttactgtgagtaaaaattttactcgagatgacgtgaatgaatcttaaacgttcatttttttttctatggtagttttcatgtttacactatatatatggttttcaggttagtaacagatctttagcctcactgaattcactttttatgtgcatccatgtgtatatatagtatttgtgagcaccaagtttcaaacactgatggatgaagttttacacccccacgattccacgaggaccacgaccacatctgtggtcttttccctatcacttaaaatctttgatccggctttaaccaaaacaaagtggctatgatttttttttgaaaagttggcatacattgataaagtattaagtatgcataagccatcctacaaattaaatctcaattacacaatgaagtttggggctgtgaatgtagtactgtatatagttatactgtcgaatttgcacccttcttttcaaagtgtgcatgtagtttgtatgaaattttacatgataggactctatagtcgatttatttttaagaatctttacaattattctgaatatgtttaaatagtaacggaacataccattaatgtttcgaaggatttttttttctctaggacttgtccttgttcggaactttagatattctttagatttgtcagtgatctggaccactatttatccaacggtggatagaagggttgcaaacttgcaacttttcaactccaggcgatctctacccatattacgtaggagtatctacgcttaccagatgtactggggccgtccaattccatctttcaccggaaatccccgccgtacgtttggtcatctcatcggaacagggttcatctgtcgttgttactactcgttgttactcggcggattaggcatggtaaaactagcagccgcgagacaaatcctgggcgaggtcacgtacgccgccttgttcgttaccagcgaggagggaaaccaccaagagacgccaactcaaagaatcgccttgtgctctcctccgcctcctccccgttgcttgccttgctccccctacccctcgatctcttcccctggccccaccacccgtaccgcgacgcaatggccgcctcctcccctatataacccgcgtctcctccatccctcacctcgcctctgctccctccagcgttcgtccagttcgtctacctcgttgccacagccattgtcatctgtcgaagctttactggtagtgcgcgttctaggggcggtcgccgtacgggaggcggtggcaatggtggacgtggaccgccggatggccggcctgtccccggcggcgcacgcggcggggctgcggcggctgtccacgcgcgccgccgcggggccctcgtcggcgtcggcctcgccgcgccacgggctccactcgttccacgcgctggcgggcgcggtgctgtcgcacctcagggcgtccggggtggccgtgctcccggggctgtccgacgcggagctggcgcgcgccgaggccgagatggggttcgcgttcccgcccgacctgcgcgcggtgctcgccatgggcctcccgtcgggtcccgggttcccggactggcggacgcgcgccgggctccggtcggcgttcgacctgcccatcgcggcggcgtcgctgcagatcgcgcgtggcgcgctgtggccgcggtgctgggggccgaggcccgccgaccccgacagggcgctccggctcgcgcgctcctccatccgccgcgcgccgctgcttgtgccgctcttcgaccgctgcttcctgccctgccgcccctgcctcgccgggaaccccatcttcttcgtcaccgacgaccgggtgctctgctgtggcctcgacatcctacacttcttcacgcgagactcctcgttccagccgctcgacctccgccccccctcgtcgtcgtcgtcggtcgccccgtcctccggcgaggcgacgccgtacatgcgccgcagcctcgacgcggcttgcggcgggaaagccccacgctggatcgagttctggagcgacgccgcgtccgaccggcgccgccgtgactcgtcctcctcggaggcctcgaccgcgtcgtcgtcatccgggtgcgcgtcgccgccggcgaggagatcgaggaccccgcactgggtcgacacctacctggacaggctcgggtcagtcctcaagagcggcgggtggagggacacggaggtgaatgagatggtcgaggtgacggcctccggtctgttcgacggcgaggaggcgccggcggtggacgccgacgcggtgctcgacgcgctcctcctgaaggccgacaggtgctcggactcgctccgccgtgccgggtggagctccgaggacgtgtccgacgcgctggggctcgacctccggcgatgcaaggagcggccgcggcccgccgttcagctaccgccggagatcgccgtcaaggtggagcggctcgcgaagtcggtagctaggcggtgacctcatcgccgccgccggagccatcggccatcactagcactagcaagcatgccgttttcctttagaaaaagttactttctttttttttccttaactttttcactatacaaggaaagaatacatgtacttttaatcaagtaaataaaaattaaccccgtgaccgtgatcatctgaatactgggatgtaatttaatgctctcatgtctcaagtggtgagagtaacttggtcaagtgagtaacggttacattgacggcgcaagcacacactttttttttcactttttttttattttgggactggtaagaatttttttcaatcttttgttagcaaacggtactttttgtcgaatctttgggggtcaaggtggatgccagtgtctgctgctaatctaccgatcatctaccgatccaccccagtctctcatttccactagcaaaacggatcctaccgtcccatgtatctaccgtactagattgaatgcaacggatcttacggaactcccagtgcaagatctagcggtgtgcttcagcaaaaggcagcgttttctctcactatagggctagtttggtttggtttcaaattgtgccctaccaattcattggcaattgtctatagtgttttttgttgtttgtattggtgccaattttaacaaaacatctcttagatggtaaaaattttggccatccaaaattgatagtgccaaaagttacccaaactttgacactaccaagattttggtatagcaccaaatcaaactggcacatagtttcttgattatttttgtcgtgcattttgcctccgtgcatgttcgaactggataatactaggagtactactactagccgacaaatcggcagtaaatggtaaatttccaccgtttttagtttttaccctcacctcacctagacggtgtgtcatgatgagtggttgggtcggatcggatagttgtgggttgggttcgtgctcatacatgcacccccgcgcttttggttgagggtgttgcagcagttgttattactgtgtgcaccgtgccgacgtgtctccgctttccgtcgacctcgcggccggccacgggtgtggcctccgaaaagaacagccttgttccgtagccagccagccgcagcggcggcagcgcacacgcgcggcttttgccctcgggagccgagcgcccgtgtcgcccgccccgcctgccatgccgcgcgctgtggcctgtggtgcccgtgcatgcagccgtacgtgcagccgcggcgcggcgcgttcccgttctcacttgctgctctcctctctcgtcgcaacaagcagctttggtgcaggcacctcgcctcgcacggttcatcaatgccgcggcgtgcgctccgtgcaggtggtggtgataaactgaacgtttcaactggtgataaactgtacagatggccaactctccgagggcccttcagtagcatagggattctttttagttccgatgggaaattaaccgttttctgtaataaaaaaaaagcgtgaaattcttgtaggaaggtgccccagcgaaatggatgtgtgcagatctcttttatctgggaggttttataaaggggagtagctatacaactgtcgacagttttttggatgaaaaactttcaaatgtaactactatataaatacattgtaactactatgtaactcgagtgtaactcaaaaaagcacgccggagcaactggttagctggacaaacctctaagttggaggtgttgggtttgatccctgctgcatgcgtctgattttttccccttttacttcactagcacaaatctcaaagcatattagacgacttaaaatttgaaagttttcacacctgttaactgtcgacagttgtatagaaaatccgtttataaagtgtacgaagggtatgtgtcatggagaccacaagcatctgtggtctcaggttgccacataggataaccccacacaaaaaccacaaatctcaaagcatattagacgacttaaaatttgaaagttttcacacctgttaactgtcgacagttgtatagaaaatccgtttataaagtgtacgaagggtatgtgtcatggagaccacaagcatctgtggtctcaggttgccacataggataaccccacacaaaaaccacgatatctataatggagatcactgctaagtgtatttttgtgtttcaatctctacctatttatgtgttagtccctatgatatttgttattaacaaattaactattttagaccttctaacatcaaaaagaaatgtacagatacccctaatctatatatagacccacactgtcagcctctcaaatcctctctctctctcatttattttctcttcctagcagcctctatcttatcctcttcctctccaaccgattcaacacctcctcctcctcctctcaacggcaccgcctcctcttccgacacagaggcgccgctccccctgctccccatctagctccggcctctcccccgcgtcttctctgcaagcggcagcggtggaagggacaacgagtggcgatggcggagccccatggcggcggcggcggatttggccgcgagctcgttggcctcttgccctcccttctctacgagcggcggcggcctcttcccacgacagtgccggatctggccgccaacttcttccctctcccccctcttctcgcagcagccgagggaccatcggcggcggcggatcctctccccctcccttcttcacgagcgtcgcatcagctggcctctcccctccatccccatgtcgcgacggtgaggggccactggcggtggtggatccggccatgagctcaccggatctggcggcggcggagagcagcggacgacgacaaccacgatgagatggggatttggggtaggtgcacggggggaccgatcagacgaggcgacgcgcggggctctgactcctccaacgcaagttctcgagccgtggcttcgcggctcccgggcccaggcgcggcgcttggagcgtttcctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcagg

SEQ ID NO: 45817 - DNA, 803 bp, Oryza sativa
gtatgaaaatttttagtgcaaaccgaaggtatcaaaatttacgctagaaaatatagtaccttccagtacgtccttaaggattgtaaaatcactcaaagaaataaagtgatgcggtaattggggtgtgccaatctttcggtgagttgcagaaaaccctaattaatgcattcttgcttccaatagcacaaaaccccccttatcccctctctctagttgtcatgctcatgcttggtcgccggcgccgtgaacgtctggtaggtcacggtgccggcgccggggaagacctcggcggcgcggcaatggcacgccaggccaagcggctccagggcttcggccaccggcgtgcagagcgacgacgcggcgctggaggtgtgggagatggagaccgagacggtggccgggcggaacgcggcgacggcgcggcggatggcggcgagcgcggcggcggcgtcgtcggtggcgcactcgaagctggcgtagcagtggccgtcctccggcgtgacgtgcacggtggcgtagcgcgcgccgtcgagcgcgttcatggagtagccgcacggcgcgaacgcgtaggcgcacaccagggagcgcgggtcattctcgtccaccacgccgccgatccccgacgccgccgtcatctcgtcgccgatggcgtggctggtccggccgtcgccggggcgctggtagaaccgcgcggccatgccgcggtccagctccgtcatgcacacctccgccgtgagccgcgccgcgccatccgcgtcggatgacgacgccgacgacgacgccgagtagacgtgccacctgtg

SEQ ID NO: 45818 - DNA, 21827 bp, Oryza sativa
  unsure (1)..(21827): unsure at all n locations
agtggggatttcgaatgagatttttctttttaacgattagcactagacaacacgactatgagaaatacccaagggtcatctggctacctctacaaggtggtaggccagatgatctgggttcaaagcctcgccccttttaattatttgatattagtctttttctaatattcatgtcttttactagacagtacgattattcatcgaatagaatatgaaaaaattacaagattaattagagacctagaagacaatagctaggaaagaagaaaaaaaatccaccaccacgcaccgacgtcatctacacacagccaaggagaaggtttagcaccggaccagtcggcgctaagcgtgaccgactgccgctaaaccaacaagggtatgggaatgaccgctaagattgcccaagtccaagctataacagccgagcatcaaacacaactctagccacatctataaaattgaggggaagaggatgagagagaagaattgaaccgctctctacgctaggccctctaacgtggccaatttgtttaaactagggcgccaccacaagaggatgagacatctaaagtgagcttgcaccagttatctatgataagatttgtcaagggggctttctagatgacgtctccagggacaggagcgacaatgacactgccgccaccatccgtcgaggtcttaaggagaactaagacaagattttcactcgataaccctacaagaggagaggggatggctcgacaacaccccgaagaagtaagatggcgcctgaagcgccagccaagaccgggctgggtttacacccgccgtcccgccacctgccgatcgaaagctgtgctccattgctacaaccaccatccatcctccgtcgcgcgtgggcaccgttgcaccgccggcccccgccggccaacctccatgcggcctcccactctttgcaccggacagttgtcaggccatcaccgtcgccgaccgccggcctttgccgctccgtcacccacgcctgccacaagccgtcggcctacgtcgcccgtgcccgtcgcaagccgctggcctctgtcgctgtctcctccggtctctagattcggcagcggctgtgccggatctaggcgcgggggagcgggggtggatgtggaggtgggggaggaaggggggcagatctggcagcggtggtgccggggacactatctcgagccgcgccgccgccatcctggcatgccgcgcggtttcaggcagcggcgaggtgggggagaaagatggagggtggcggcggtgtcgggaaactagggtttcgccccccgtgttgtccgcgcatgcacgatgcccgggggtggggtggactgccttcaattgaaaaactctagtgggaatgagatcaaattcaacttatacaagttaaaaaatttagctgtgaacatacatacacattaactagttatggtttaatttcttgtttttgctacagtttgtatgtataagttgaattttaatatgcatttttgtaaagtgatatatcacgcattagtctatcttattattattattttatatgaagacatttgaaacaaagtattgaattctatgttatcttttgcaattcctttggaatggaaaatcctatagacattttggaggaaatttagtaaggaatccaacctattggaaattttcctctgagtctatctctcttatccgattcctgcatttttcctgcggtccaatcaaagctattccgtgtttttcctatattttacaatcctctattttacacttacatttatattagaatcgtttgtttttcatgttcctgtattttttgcattcctatgatttaaagggatcctaagtaattttagtcctcgtatatagtagcgacaaaataaaaacactaaatttttatgtctttcctagttagactggataaacttgtatagtcggtcaaggattatccataggttgaccggtccgtgcggtgcctatatccttgataaagcagctttatatataggatcaaattgtgatgctcgaagacgacaaaatgaagttgacagtgaacctcgcaataatattaagaaatgacctgcgcatattatgcagacatgcagtccccttcctctctgcgtgatcatgaatcggcgcacggtttaagttaataacaacgaagcaaacaaaacaagattaatttgcaaccccattggattatgatacaattcaatgtactccttttggcctgcatgcaatgagtgggccgacacttggagtagtgtgcatatgctgccaacaccaacaattgaaatcttcctcgatcgttgcgggtcctgtttgacttatttttatatccaagattttgtgtactcaaatacgttctttgttttatactccattcgtttcacaatgtaattctttctagcattgcccacattcttttagatatagattcattaacatctatatgtatgtgggcaatgctagaaagtcttacattgtgaaacggataaaatagtataatttggtttcactttttctaaataagtttcattgaaaaatgtagcaatatttataacaccaaattagttttattgaaattaatattgaatacattttggtatgtttgttttatgtcaaaagtattaatatgttttttttataaatttgatcaaacttgaaaaaaataaacttaagaaaaagtcaaagcaatttataatatgaaatagagatacatagtgcatgaatttgaatttgtgattaagttgataatgtctggataaattatttcagacaaaatataaaattttaaaacactataatttaacatataaaattcaaaatcagtgtggatatagctgagccaaacatgaccttaattaacaacttccaatggatcaactcgttagctaagctagtgctatgcacagcacttttgggttaattcgtgatcgccatggccaacctgcaggctaaactagctaatgatcgagcgagagcatgcatgcacggaagtatgatggaacccgccgacttgcaaataattaaacacactcatgtttgactagagaattgtcgtgctctgttttgtttgaatccagcttaattacgtgcaggaacttgaattttttcccccgaaatttaaggcggatatagccgtctaaatatcgtatattactagcgtgtgtgaattatgtaatttgcatttctgttccggtgtatgaaaagggaatggctaaatttaagataatttcagtcaccttcaatctagtattggtattgggaagggaggagaggtgaaactccccactaatagtaatgacgccaaaactccgacgacatttagatttgggaaggtgactccctggcaggggcggatctatagtaccatggccagtgtcaggcgacaccgacaactttcggcagaacctatagtaaaactgtttatccatatgttataacaccgatagatacgtcatgacaccaacaaattgattttttgaatctgccactgctccctggcagtggtagtatagctagcaataagaaggttctcttttccgaagatggtaataacgtcaaaactccggcagaaaaatctgagattaggttttatggtaagagtccaaatgggagcggaggcaagggaattgagccggtttcctcaagcttaaagggatggccttatgcaatgggcccagggtagaggaggatacggagatatcaccacctgggtgtgtttggacctctaggttcccaacccaaatctctcgtttttcgcgcccacgtttttcaaactgctaaacggtacgtttttttgcaaaaagtttctatacgaaagttgctaaaaaaatcaaattaatccatttttgaaaaaagaaattagctaatacttaattaatcacgtgctaatagatcgctccgttttccgtgcggaggcactatgttcccatcatccactcgcgaacaccagaggtgacggcaacatatcgactacatgcgtgagcacggagaagaggtgactctgaaaaacttagacagacagtcccttaataaaattcatggtccgttccccattaatctctatagctagctgtaaattatctgcaggaagcaatattgtgtcggtggcatgtggcagcgtgactgtcatatgtaaatcatcctcgtacatcgcacaggcgcaacagacgttggtagagggattctaatcattcgagtaggtgctaaaaagagtatccaaaaaggaaaaaaggcaagcaagtagagacaacatatagctagcccggtacaacatgatcatgcaatgtctggtaccctaagactgtactgttgtcattaaccaacttaatttgcatctctacaatgtagatacaatgctcatcgatcgatcggaagggtccaaagattttgtcagcagatctggagcagcagcttgagtggaagtgtctatctctgatttgctgtaattagagaaacaggtgcaaagaccggtcgacatgccttgcagcgcagatcgatgattgtatgcaatcctcatgtcgggaacacatacgaacaggccggcaggccctagctagcaaaatcatgggtttttacactagatcatgtgtgcttcaccctgtactgttctaaaataattcagctttttatatcaatctaaacacaatctatattgaaattcgatcatcgtatcaaatgaaaagtaatatttagtttagattgtaaagacatattggtagccatagctctcccatgatatattgtggagattatggatatcccatatctacatggcgatactatttgggctggatataggataccgaatatgtatagaatatcttatttgtatctcgggtttgtttcttaacttgtacaacaaggaaacaccttgagacttagtcggtcacggctatatttaatctatatctgtgtattccgttagggatattgattatcttttgtaacccggactccttcccatatataaggggggtccgggcgcctctaggggcagatgttgattttctctaaatcatacaatcaataatacactcggcggattcatccccggacaggagtagggtattacttcttttataagaaggcctgaacctgtataaatcttttgtctccaaacccatacacttttccagcttgatagccacccccttttattattgccgaaatctagtttcgacagttggcgcgccaggtaggggtagcgtcaagcttttcgccgatcagtgcaatgggttccgtctccggcatcgacgacctcgtcttcccacccgggcagacgtttcggttcggcagcctcgacttcatcaccaacaacttcggcaagatctctctcctagactcggagtcaaaccagtcgggagagaaccggatttcggtcccgttcgaattcccgaacgcggctgaaagctacttcaagaccatctcaaccgagtcggcttcaaaccactcggccgagatcgcatcttctccaacgacaccagatcaagatgatggggcttacccaccagtcctgatgaagctccccgacgatttagcggccgtctccaccacgacagcgtcttcatcccgtaggcctaggcggaagtcggccttaacaccgatttcgcctagcttcagggaagtcggcgtcatcctccaaccactcggcacggtttcgacggatcagctagatgactacaacagctctcccaccgtcgactcacgtcctactgacatcgtggagtacgacgaatttagttctcgctacaacgacttcaacgacttcgacgacttcgacggaagcctagatgacaactatacccctctctactttggcgttttcatggccaataatgagacggaggagcaacgccaagcccgggagaccgaagaacgtcgccgactggaggaggagcatcaggcacaagaacaagaacggctacggcgtgagcagcaggaccgtgagcggaccgcgaaggaggctgaggatcgacgtcagcgagctttggaagcagggcgccgagcgcgtgatctcatcggccaacaagatgtcgaagggacaccggttttccgcacccctcaacagaatgcggtcgccgcgatcacccttctcgacaccctactcaaccaaaacgagctcaatcgatccgaccacgtcgtcaacatcttgaaccagacgaagaccatgattgcggcctcggtcccagttaactccgaaagcgtccacacgccgactggcagccgagttccccacttccgatctcacgactaccgtcatccaagcctcagcatcaccggcgcgggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccggatcgccgcgatgacgaccttgacggagttgcagccttcaccgacgacctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaactatttaccagtggctttagcggattccgcccgatcttggctccatggattgccccgtggtacaattggatcttgggccgaactacgcgaccacttcatcgccaacttccaaggcaccttcgagcgtcccggcacacaatatgatctttacaacgtcattcagaagtccggagaatcccttcgagattacatccggcgattttctgaacaacgtaacaagatctccgacatcaccgacgacgtcatcatcgccgcattcaccaaagggattcgccacgaagaattggtcggcaagttcgggcgcaagcctcccaggacagtcaagctcatgtttgaaaaagccaacgagtacgccaaagctgaagacgctgtcaccgcatcaaagcagtcgggtccgagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcatctacaagcaattcgcggatcaatacaccaagactgcacggaagaattctgacgaagaacaaagcacgtcaaggaagaaggacgacggtgacaccccggcaggttttcaagatcaccgcaaggagctcaaccatatctttggcggccccctggcttatgagtctaaacggaagcagaagttgactgaacgggagatcaatgctgttcagcccgacacgccccagtatcttcgatggtcagagattgcaatcaagtttgaccgctcggatcatcctgaccgagtggtccacccggggcggtaccccctggtactagacccagtggtccgtaatgtcaagcttcgcagaaccctcattgatggtggcagtgcactcaatatcctcttcgccaagaccttggatgatatgcagattcctcgctccgagctaaaaccaagcaatgcgccttttcacggagtaattccaggattatccgcaactccactcggccagatcaccctcccagtcacttttggcactcgggaaaatttccgcacagagaacatcagctttgaagtcgccaatttcgagacagcataccatgccatactcggacgcccggcgttagccaagttcatggccgtcccgcactacacttacatgatgatgaagatgtctggtccccgtggagtcctatccctacggagcgacatcaagcaagccgtcacatgcgacaaggagagttgcgacatggcccaaactcgcgagatggcgtctgcccgagaggatatccgactggctgcagccacggcgagcgaaggagaaatacctgccaccaagacttcaaaaagtggagaaagcgaagccaagactaaaaagattcccctagatccctctgatcctactaaaaccgctgtaataggcgccgagttagattgtaaataggaaagcgcgctcatcacctttcttcagaataataaagatatctttgcgtggaaaccttcggatgtgcccggtatccctagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgtcgattataccgacctcaacaagtcttgtcccaaagatccctttgggttgcctcgcattgaccaggtagtcgactcgaccgccggctgtgagcttctcagttttttggattgctactcggggtatcatcagatccgactgaaggaatccgactgcttgaagacttcattcatcacgccctttggggcatactgctacgtcaccatgccgttcggattaaaaaacgcaggagcaacttatcaacgcatgatccagagatgcttctcaacgcagatcggtcgcaacgttgaagcctatgtggatgatgtagtcgtcaagaccaagcaaaaggatgatttgatctcggatctagaagaaacctttgcgagcatccgtgctttcaggatgaaattgaaccctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactaaagaaaacagacgacttccagtggggacccgaagcacagaaggccttcgaagatttcaaaaaactcctcaccgagccaccagtcttagcctcaccacacccgcaggagccgttgttgctgtatgtatcagccacctcccaggttgtgagcactgtcttggtcgttgagcgcgaggaagaaggccatgtccagaaagtccagcgaccgatttattttgtcagcgaggtcctagccgactccaaaacgaggtaccctcaggttcagaagctgttatatggtattctaattactaccaggaagctatctcactactttcaaggtcactcggtaacggtggttacatcatttccactcggtgatatactgcacaaccgcaaagcaaacggacgtattgctaagtgggctttggagttgatgtctttggacatatcattcaagccccgaatttcaatcaagtcccaagcgttagctgattttgtcgccgaatggaccgagtgccaggaggatacccccgcggagaacatggagcactggaccatgcattttgacggatccaaacgactttcgggcactggagccggagtggttttgatttccccaactggagaaagattgagctatgtgctttggatacatttttcggcgtcccacaacgtcgccgagtatgaagccctccttcatgggctacggattgcaatttccctagggataaagcgtttaatagttcgaggcgattcacagctggttgttaaccaagttatgaaagagtggtcttgccttgacgacaacatgatggcatatcgacaagaggtacgcaaattggaagacaaatttgatggactcgagctcagtcacgttcttcgacacaacaatgaagccgccgacagacttgccaattttggatccaagcgtgaggcggcgccctcagatgttttcgtcgaacacctttatacaccgaccgtacctcataaagatactactcaagatgcggacactcatgacgtagctatggttgaagccgactggcgagagcccctcatacgatttttaacttctcaagaactcccccaagacaaagatgaagccgagcggatttcaaggcggagcaaactttatgttttgcatgaagccgagttatacaagaaaagcccttcaggaattctgcaacgctgcgtatctttagaggaagggagacaattgctaaaagacatacattctgggatatgcggaaaccatgctgctgcacgcaccattgtcggcaaagcttaccggcagggttttttctggcctactgcagtgtccgacgccgacaaaattgtgcgcacgtgcgaaggttgccaatttttcgccagacaaattcatctaccagctcaagagttgcaaacaatcccgctgtcttggccgtttgcggtttgggggctcgacatggttggcccgtttaaaaaggcagtcggcggttacacgcatctctttgtggccattgataaattctccaagtggatcgaagctaaaccggttgtcacaatcacagcggacaatgctcgagacttcttcatcagcattgtgcatagatttggagtgcccaatcggatcatcaccgataatggcacacaattcactggcggagtttttaaagacttttgtgaagactttggaattaagatttgctacgcttcagtggcacaccccatgagcaatggacaggtggagcgagccaatggcatgatacttcaagggattaaagcgcgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagaacgctacgaagaggaccgggtggatgacttgcaccgattagaagaagcccgcgaagcagctttgattcagtcggctcgatatttacaagggttgcggcgctatcataatcgcaacgttcgatctcgtgcctttttagtcggtgacctggttttgaggaaaattcaaactacacgagatcggcacaagttatctcctctatgggaagggccatttattatctctgaagtcacccggccaggttcttatcgactcaagcgcgaagacggtactcttgtcgacaactcttggaacattgaacatcttcggcgtttctacgcttaagtttatcattgtacttccctatcttgactgtcaacatcaagttttcttcttgccgttgtcagtcgggggctattatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtatagtacaaattatgcctccatttgttacaatcatgctcagtcagaatcagtcctttcatcatcagagttattgttactcggctgaaggtcattgttgcggaattgatctaccacatcgcttgcaatcttgtcagccgcattttgagcattgttgataagatcaagagcagcttcttcgcttgtcccatctgcaaatccatcaatggtgtcgatttcaattcttgggtacaaggatttggtcatcgctaatgccatgctagctcccatgcttccagctttcttgatgttcttgaagtatacatccggtgcaactcttaacttgtcaaagatttcggttgcgtcaagtgcactcggaccactgttattaaggaacatagcttggacgagtggtgtagcgacattggcgacttcgtctcttgctccttcaagcttcttgatcttaccaaccaggacatcaaactgagcttgcgatttgattttacggtctacaaaatacatttataataagaatctgctgcattaaagagaggacagttcaaattgtcagttggcagtaccttcaacctccttcaaggctgagtccctttccgcagccagttctaccttgtctcttttcaaggcttcaatctgtttctccatctgggccattctggtggcttgcgctgtttgaaatccaaatgtttgaggatccagctatgacagtataaatgggacagatctagagattaccttttgatgaaccactcagctcgaagttggagtcctggagctgtgcaattcgttcccttaattccttctccgttttcttggcatactccttggcctcgtgtagctgttccctaacggcttcaagagttcccaaatgtggaaccagcttttctaaggttgcagtcttggcctcattacgaagatggattctctgcacggtggttcatggattagttttgctaacaagaaaacaaagttattaaaggcagtcacccggaagatttacattcacaatgcgagtggcttctccaagtgctttcttcagctggcacacttcctcatcttctttttggcgatttataacaatgccggaaacttgagagttctcgtcccaccatttgagtaagatagggggacgggagtcatcagccgcctttatgcgaggaattgtttcttcgtcatcgcctagtgttcctgatgtatttccaagacattagacgagtaagctggagttattcagaacgatatcacttgagaagatgagttacctgaggatgtgcctggctgagcgcgagatgatccttgttctttatctggagagccaaccaccgagtcatttccagcctttggtccttgagaagatgtcgcttgcgcttcaacttcagggatttcttgatcaggacctacatccgactggtttccagttgggggctctcgggttgttgcagtttcagttgttgccgactggtttccagtcgacggctggtcactcggattggccttgtcatccgaagcatgggcgccagtcggctggctttcggcagtcggctggctttcagcagtcggctcagcgtctttggataaatttggttctgtcactgccggatcaggatcttttccagttggatctatgtcggacggtttcctgcgaagtatcctttcgatattcagcgtaatttctatgagagaagcatatcaaagggagttggtgccgagaggtttatacctggacgacgttctaatctttggcgtttgacggccagccagttttttcctgggcatggtatgcttcgggagtttgttgggcgtgcccttgtccccagatttgttgctgtcgtcgccctcgtcgtcatcaagcaccagctttctcttgcgaggacctgtctgcccagccggtttggaggtttgaggttgtgggtctgacctgattgtcggccctccacttccctgaatggtgtgctggcgaggagatcgtcgctgagcaattgggggatcggatttcatcaatacatattcctgaataagatgcctccatggttagttaattcaacatgaagacaagatactattttggtcataagttgaagatttcagatacatacctgcggaggcggattgaatgcattatatggcacaactggcagctggtgtgagtagctaacgacaatggcatttgagaagattttatacattctctccttcatgattttgaaatccagagagtcaggttcttcacggttaggatcatgcttgccgtcgaactcaaaagctgtacgggatctttctttaattggcgccagtcggcatttgatgaaatgccgagtaatctgctctccttgcaaaccttgttctttgagttttaacatgcggtccatcaactccaaggcttggactgcttcatctccgattggaagggagttccaggtatcttggtacaccggaggaagacaagagtacccgggaagagcaggctcaggattctgaacgtagaaccagtttgcatgccaccctttgtttgaagtcttgaagggcatagagaaatatttttggctcagagttccccttagctggaatcctgcccccccgactacgcacggtttgctcttgttcggttggggtttgaggaagaagatccggcgaaacagggcaaagtgaggcttgattcccaaaaaggcttcacaaacatggacgaaattggcgatatgcactatggaatttgggtttaggtgatgcaagctgattccatagaagttcaagatcccgcggaaaaatttcgaggtcggaagagcgaagccgccatagaagaaatgcgagaagactacgatctcatgtgtatcaggggtcggaaaagcctcaccgcacgctggccgccacccgatgatctccttggctgggagaacgccgtgcgccaccatctccttcaagttctcttccgttacgtcggatggcgcccattggccttcaaagctttctttctcctccgccatcgattttacccgaatgcgctgatttgatttgatggatggcttgggagaggtgaggaattgaggcggtggatcacgggaaggatttttaatcacttttcgaaggtggatttggacggattgatgaaccctagttcgccggcgcagctatttactgtagcaaggagtggggaaaatggcgagcgttccggcggggaagacgaagcgtcgcttggatctcggattttttgttaagggtatcggaggtgcaagtgggcctaggcctgaacagtacctcagcccaatacttttaacagcgtggcccattgtgttccttagggacttaggcatattttgctttggcaatatttatgcacacaatagtgttgcccaatgctgacaaaatcctttttatgcggtcatataattctttggagttattgcaatgcaaattaaaaggtgccctgcagaaaagcgttatgctgtttttgtaagcttttttaggctacaaaagctgtttgggttaacttggaatgacttgtttttatcatagtcatttccttggtatgttatatacctatttttattgtggtaacttgacatagcctaggctattagtctttttgttaccataatttttataatatttggtgggtaatctttatagttttatattcggatgcctgtccagtgtgttcattcgtgaaccttttcgagtgtaaaccactcggattctttttattatggctaaaaagcagtcggctagaatgcctctttaggcgccgcgtatgcttttgccatctaatgcatgattgtgttattatattgttctcaactatatgtttagtttgttaactaatcacatagttgggggctacacctaattaggtgcatctattcgatgcaccatattctttatcttttcgccctttacagtcttcgtcttcgctactcggtgggccttggcatgaataatctgaagcactcggattgctatctttgagaaggctacgatggttgactgcaaaggtctcgggggctactgtggagattatggatatcccatatctacatggcgatactatttgggctggatataggataccgaatatgtatagaatatcttatttgtatctcgggtttgtttcttaacttgtacaacaaggaaacaccttgagacttagtcggtcacggctatatttaatctatatctgtgtattccgttagggatattgattatcttttgtaacccggactccttcccatatataaggggggtccgggcgcctctaggggcagatgttgattttctctaaatcatacaatcaataatacactcggcggattcatccccggacaggagtagggtattacttcttttataagaaggcctgaacctgtataaatcttttgtctccaaacccatacacttttccagcttgatagccacccccttttattattgccgaaatctagtttcgacatatatggagtataacaaattctcacctattacctcttatcttaaccaatcataactatctcattttatttcttcatctacattttcatccgggacatctacatttttatcacaattaatcacaaccatttcttgtttaattcttgagacagaggggaactctaccatttttaagcagtgctgctataattatgtcgacacatttttttagtaaccacagtcgattttctgatcaattgatctccgttgagattggtgctacgattgaaataccaatgcactgacgtctttgcgtattgcagcgtgaagccaaacaattaaatttaattcctcatctcatcggcatgtattttcatgaaaaaaaacatattgtagggacttacatacatgctaactatttttttttcgtgaaaaaatatggtggtataaatatcggtaatccctttttaagttttttttggacgaacctccacctccccgctaatagtccgcacgtgggtccaccacaactccacaagcctgttatggcccacccaaaacaggcagcacgtccattaagccaccgtttcggcccaacaatacatgggccgcacatcgcttcaattccgttccgggccaaaccacaaacgggccacacatctgtttatttttttcccactaatttattaagatcaacttcgattcccaactacaagagatcaaaccggtcgaaatgatgaattagagctttctcgccggcgcccagccgtgccgccgccgtcgtcggcgccgtcgagctcccgcgcaggaaccccaggaggagcttgctgctggcctccacgtcggaattatagcaccttgatcgtttgacactgcatcccccatcttcttctttgtcgatctgtcgctcgatcttggcaagaaatccaagactacaactctacaagcaaattgagacttgctgtccatttacaggacaagagagctactcagtatatatctagccacagccatgcctccctaaccttccatgtccatgcagcagtccattagctaatgtttaattatattttaggttgatttattttgagacgttgagtggcagataaggcaggcaggcaggcatgcgtgtgcaaccgtttgcagcggcctttgtttcctattgagctttgcagaaaatgaaccggtttgtctattgctaacagatatatgcatggaaatttttgtggagcgattagatggagaagatgacgctaattaaaggggaaaattaacccgtgcgttcttgcggttgtgcgtcatgtgactgtctcgatctcggcgtcacatatcaaccaacaaaggcagtttgttcttgattctcatttctgaagacatgcgtcactgttccagactatctcgggctcatcttgattgtaacctcgatataatttggatgaaatggtttacttcaatttgcccccaacagcaagtatataagtttcaagaaagaagtctcgtctgaattctgaaaacggggacagtaacatcccatggaaattaaaagctattcatgaaatatgcatgcgagtttctaccttactaaaccaaaaggtaacaactttttacgattcttcgaaagttcaggttaattatgagttggaagttagaacaagaaaatagtcctagtttaaattctgaattacgatccttcaatagcttaatcctttcatcttgtcttatcctagcttaagctctgaattggggaagaacctgttatccgaacaaggtcttcaaaaaatgggaccaatctagaaaggattaaattgattttgaattaaggagggggtgaggccgtgaggctagctcgaacctggagtggtctagctcgcagcttgcgttactagccaggaagaccctgggcctttctctatccaaaccagggttttaaatttcgaaatcaacatttctgccgcaggtgagcgatagaaccgaaattttcaaaatttcggaaaaatttcgtacgaagttttttgaattttcgaaagattttgaataaatttgacaaaattcacaaaaaaaaatgcaaaaaaccgaaattttcgggcaagatgttagcatttcggtggggcgaaatttcgaaccgaaatttcaatccctgatccgaacaaggtcttgaaaacccctcaaaactcaacgaagcagtagatgattcatgcatatgagactaataaaaaaaatactcaaatataatgaaattatttagtccataaataatcatcatcacgtcgtcctaagtaggacaaataattaatacatgcaccgccatctataaagttcatcatcagttctacctggatcatgataacatggctatatatcacataattaagtagatattaaataattaagctccttatttgcagtggcggcatatacggcgagtggatcgatcgatcagaagagtttcccatcacggccggccgccgtcgccggcggcgagccggccggctgccggaaggacttggtctggttgaacaaccttgccctggtcatcttgatgaacctgtcagccttcttgttgatgtcctctttgatgctgtcgatcttcctgaaggtcggcttgggtgccaggttgtggtacaccttctgcaccgccacctcgccggcaccgccgccgccgatgccgccggcggcggcggcggtggccggagcagcagtactgcctcctcctcctgctcctcccttgcggatgatcttctggctctgccaccagctcatcttaatttgctctctaagctaagctactagctgttcttgcacttgcactaaactaatgttatttagctagctagattgctttgggatttttttgcttcttgttttttcttggcttgctttggttggattggatttgcacctagcaaatgggcgtcctttttatagccaatataatattctatattccttttgcattaaggctgcatatatgtgaaatgtcaggctttctcattgagttatttacttttttaatttcctccgaatatattggcctaacctaaccagggtcagggtgcgtgcttgtcaatcataattaagcatcaagacggtcatcaagctctgaagttatcaattttgtgtcacaaatgttttcaataaaattgtttaagacatacgaataactgatggcttttcaaaagaagtaaaaaaaatgactaacaatataaccttttattttccaggttttgatgtaggggtggataacgagccagcttagctcgtttgatctcattatcttaattaactagcatggtggcccacgcagattgcgcggctagcatcattatgttttctcccatataatagcatatatgttttctcattatattattcaaatatattaaaatgacaacataattttaaattttgcaataactttacaaaactactaatacgtaatattcatattatattttatatacgtgttagttattaattatttttaatatcaaattttagttatttgtaaattatatatatttctatatggactctagactcgtgttttaatatttcttttttttaattccgaattttctgtaaattgtatttctatatagactctatgctcttcttccaatattatttatttttatttctgaatttttattatttctaattgtatttctatctggactctaaactcatctttcaatattctttaatttttaatttcgaatttcagttacttctaaattgtattcctatagtgactttaaactcttcttcccatgtttttcttaatttcaaattttagttatttataaattgtatttttatactgactctaaactctacttttaattttattaaattttattatgtttattccaaattttagttagttttaaattcctatatggactctatactcaacttctaatattccttatttttttatttcgaatttctatttttttttcttcattgaatttctatatggactctatactctacttctaatattccttatttttaattccaaatttcagtatatggactctatactctacttctaatattccttattttgaattccgaatttcagttatttcataattgtatttctatatggactctatactctacttctaatattccttatttttaattccgaatttcagttatttcctaattgtatttctatatggactatatactctacttctaatattctttatttttaattccgaatttcagttatttatttcctaattgtatttctatatatggactctaatctcatcttctaatattccttattttttaattccgaatttcaactatttctaaattgtatttctatatggactctagtctcatcttctaagattccatattttttaattccgaatttcagctatttctaaattgtatttctatatggactctgtcttttctttttccctaattaatgtgagaatttatagaccatgagagcaaacatggaggcttctttttctattcctttaataatataatagatgagcctgcttggctcgacttgctaatgttaacaagctaaaaggttagcttgctcattaaaattataagtttgagccaattcgagccaagcattttgtcacgagctaatccaagccacgagttttgagttttttgttcacccttattttttatgtgtgcaagtcattttaaccgagagcttgaagaaacatgtaacactagctcctaatttggagttgaagttgtcagggttaacaatatctccttttcaaggtcaattaattgtcagttactccctccaattcatgttttcatgttgcaagttatgttagttttttttattatgaaaattggtttatatatatcttcggtttctataccaatatatattcaaatttgtttcgtgaaagaaaaaacagtatcaactgacgggacaagtcctcagctcctcttgaaaaatgatcgtctgaatgagatgttaaagacaaataatatagattctaacgaataattccgtaggtattatatcattatattcaaagcaagaaaaacccttaaataccaattccaaaaatatagcaccgctgtgcgtaccatccgctcctcccgtggtattatcaaagacgataactttttgtagaataagccagtttttaacataaaaagtttatcatttcgacaacatcaaatcaactaatgtagtacactggccctaaataaaaccaattttatttacatgggcattctcataagctaatttctaaaaatattttagttttgttctatatatgctatttttcaactttatgcattgaccgagtttatgaaaaatgcacgacaacaactaccatactaaattagttttgtcaaatccatcataaaatttatcttaatactaaatttatttataatctcagttaaacttatagttgttagacttaggaaaagaataaaatgtgcatgaaacgaagggattattttcgatgggcatattctaaggaagctggcgctagctgcgacaatcatcggcgccgttagtcgcagcacacggcattccatcgccatctcatcacctcatcgatgattccattggcatgcattcatacaggggcgtgatgctagtttcgtacttaagatcctgcaactaattaaccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45819 - DNA, 818 bp, Oryza sativa
aaatatatttcatattttttttataaaaaatacacggtttagcagtttgaaaaattggatcgtgaaaacttcggattagaagagcggttaaaataacaaacccttagtagtattaaaatgaaatttactcgaaactaaaattgaaaaccagcttttctccctccctctctcttttccttctctgtttttccttcttccgctgcagctgccgccggcgagggcgggggcggccagcatcctcgtggcacagccggaaccctagccgccggccgccggcgccgccacctccccgaaaatccgtcgccatcgatcatcctctcgcacaatcgaaggtaggagtgggttcccccatcccaatgcctctgtttctccctctccttcccccgtcctcatcgcctccggttctcgccgccgcggccgccgcccccctcgccggagccgcgccctatctcggtcgcccacctgcccgcacgtcgcgccactgttccgccgccgccgccgcctccgtccgcttcctctcgacaccctgatgctcgcccccccccctcctcgaagcctaggtcgccgccaccgcctctctcgccgccggcgcagctgaacccgtcatcggtcgtccttgaaccgggggaaaccgacgaccaacctttttttcgaaaaataaattagggtgagagaagggaaaagtgtttatcgtgctcgtcgatggtgtcgtttggaattaatgctgtaggaatatcttgtttgttatggatttgcaacaattttggggcaatcgagtggaagccgaaagaatctggtagtttcaccaccatgaagtc

SEQ ID NO: 45820 - DNA, 5968 bp, Oryza sativa
  unsure (1)..(5968): unsure at all n locations
tgtgcgtgcacgcattatgtcaacatgccagattgatgtgatcagtggaggcatggtgctatgagtatatatattggctacatatggtgttttctgcctatgtaagactaattggtgcaatgtccaatttactcacatttagtgcagtatctgtggtttgatcttagtaatacagggaccaaattggttgtatggtcgttcactttgcacaaattggtgtactagataagttcgatagatggcagtccattttccataatagagcatattgctgagctaaaaacaagtcatcttatttcttttcagattaatgatatgcgtgtcacagaaacagggtcctttcagtatttactggagtatcttgattacccagacgaaggtaagcaaatcattatctgagctatcatttattcgggagttgtttttctttttggaaaaatgcttttacacaattggcgatctgtgccttgacttgaaagaatctgttatacagattgtaatttaaggctattgaacgggaaacttacatttcattatgttttagtgaatagggaagttgaacagagctaacatacatgtgcaaatgaaggatattttgcatttgaatttgtctgacacttctcaacatcttctctattggggaacacatgttttcttctgtctactgataatggtttacagtttggtttgtatggtctccactatcttgtaaccctcttttgttttatgtttggtggtgattaactgatcaatcctccatattacataaaccagtattatcttgggttgagggttaaataagttgtttgtgtaaactaccaggagctatagtgtcacataaatcagtattagcatggtttaatagttaatatacttatgttttcttctcttccttgaatagtggttgtatataataacagttgcaagggcttgtctaatgatgtcatgcgcgaatgcttatcttgaaccatagaaggggcattacaagtagacatttgtaaccttgtgaagatataggcacattcttgaggcctatatattttttatctcatccattttgtccttgtatgctgacaaggcacaagcaaatattgggagaacagaaactcatcatgactaggaaattagttttgtatacacctcacgtcattactccccatgcccttcttttgcagagaaaacatggactgaagtctttgaaaagaacccagcgtatggcaaaaggaactcaaatgtggttagagaaagagaatgcatgcttcgtccttcctatcctgagttgtattggggggatcaagttcccgagcaatttccaaagagtaatgtgatagtatctgtttgtgataccccgaaagtaggtgatctggttgagtggttgtctgaaggttcttactggactgcgaaagttactaagttacttagtgaagatatggttaaggtaaacatttaataatttgcaaaaccaataaatttgttgctgcccttgtaagatatgaattcagttgttgtccgcacgtgataaatatattagtgctaatataaatttaccttgtgtaatccaacaaatttgtgtctatttgtctaatactagataatgaaagtaataaagtccaaataattcactgtcaattttaactctgaagtttgcaatcgattgttgatttgcatcttaaatgtcaagagaggttttacaattccttatgtatacttttcaactgtccggccttttcgaagtggagatctattagtatttcttgtactcccccaccaagaattgcagaaactaggaagatgtaacatacttttgttggaacatacccgaaacaatatattgatctctctgcttggccatctacttgcaggtacagctgttgaaacctcctataggtgaaggggggagttatactgcttactgcaaggacatcaggcctgctcttgattggtgcctggagaaaggttggactgtacctctttcacaggtatctacctaatgtcctgatgggaaggactctcaatacctttgttgatttcttcgtatttattttgtagtttaggaccaatgtatatataatgatctggagtgattcttggtcagtttgggctttttgatgagtctatttctgagctgaagcagttcttatagcttaaaacagtttcagctaaatttatatatatgcatctaatgatatattcatttatggcatcaggcaaatggacggtgctggcatgctgctcgtctgattcatcataaatctggtacagctgatcttttgtggattcaatatggctgtgtgtcaattaataaaaatgtggcattctgagattttaatattctttggtggtttacgatcctcttccatttcttgtaagacaagaacaaaaaagaaagtgaaaaaaaaactaataagttatgcatcgcaataaggattgtatcatgattagattgtttatccttggaatttgaaggaaacatcatgacaacttttcaagcaaattacatttcatattctacaaaaggatatgttcttcctattagacatttgaccttgacgttgaaactttaagtttgaggcaaatcttgtatgattcttttttcctctttaagaggtgtccctggtatttcaattgataaaatataaacaataaccatgatatttgccaaagttttgtcaataatggaactctagttttttctttgtctgaacaaagctgggacattcaattaatttgattcacttaaatattctttttccctcaagctttgcatagatttcttcataatgtgattctagaagttatgctctctgctatgatgtctcaatctttgtttacgcaaattatggattgcagacacagagatgagtggttcagatgaagagtcgacatctgatgacgatgaagaggaagcgcagaaatccttgaaaagagcatcaaattcgtctcaagaagctccaggctcaaacctggaaattacatcagatacaacctccagttctaggattaacagtcagacagctaccattgccacaaccaaggggatttcgagatccagcccggtatccatttccactgggccatagtcatggtgcacaagcagctgtgacttgtacagttaaccaggtacccgcagttccagcagacaattagggatataggtgcgccaacccacaaatccacttataagctatttaaccacttaaatggcctgtaagtgcgttatcttgctgacccacttgtggcatcgttgcaggtgatagacatgtccaatagcacaaatgtttcagagctggataggatctcaaacagtactatagccgctgagtctcttccaaagatctgaactggctaccccctcaaccatttgtggagaaggatccatcacgagacacaacactatataaatataagaaatataatgatgttggagtcttggagatacatcagcattcagccagtacttcatcccatgaaatggatatatgctttacacgttgttgttttcatgactgaagtgctacgttggcaggctgcaatgtttgcagcgttgccgctacttttagggacagttcatttgactgatcaatgagatttatacagctctgaaatttcagacacgttgcaacacaaactgctgacatgaacgatgattagagggaaaattcctagtttttgcattttcttaataattaggaaactggttctgtcaccaggccatacaaggaatgaaattatcaagcaaaacataccaaccgactacgtgattatcatagggatacattaaaaaattgataaataaacttaacaactgatttagaaccgatcgaaccaacacaatagaggaaagtttaaaagaaaaaaaatattttttttgaaaaaagtagtgcaaataatctgtttcaacaatccgataaataatctgaaaaaaaaaataaacctgtcaagcattcaacagctagccaaataaattagtcagcttgttgatccaataacagtgggagggaaaagaaatggaagcgctgatgcagcatcgtaagttcctacccacatatgagcacaatacttcactctcaagctcattaaattgctcaatgatcatatttcatgatgaaggaataaggaacgcaagcatagctgtgacacaacacgatgtaaacaccccaagcaacaagcatctcatcacaaagatccaacatcagcggttacaatccacggcaactagcgtgccaaacttggaacagtaaacacagctccatccatatactgaaaagagttacaatgccacagaactatcacagccatcgactgaaaatagcagacgagctaatattgataatcaaactacggtaggaggccaagcaaacaaccggaatcctacaagcaattcttgcattctaaagcaccatcatcacatggtggggagcactcagtatcttctcctcggtggggatctggagcgtcttggtgatctgacaagaacaagtgaccaaataagattataatttcatacatgtgaggatatccaatgcttacaacatgttgcactgtgaatgtatcttgtcagtggttccgacttcaacagaagtatttgatagcagggaaatagaaacagtgtaaatctttacatgtgtaattagaaaaaaaatgaaacaaaaagaaatcaatatttaggatttcacattatcacattgccactaggtcagaacaatgaccatatgtattgtaatgataaatgaattacttcgatattctgaaataccaatcagtagccatactatccatatatgataattggacaggccagtgagatcaaatatatttccgagcacatagttgagagttaaaatgaacaaataattttcagagaccgattaaataaaacaagggatggttatggcatgtattacttttagttacaaagaaaaaggccaaacaactttcctcccatgctattttccacctcacagaaatttgtaggatgattaaatggtataaagaatagtttacaacaagtgccatactcactctcaaaaagagattatgtgacaaaacctaaccctctgacagtgtgattattctgccataacaaaataaaaggggcatacaagctaacataaaacatacctcttccgaatattcctgcgcttgacagggccattactaaatgcccaatcaacacttatgatttgtgttagaagctcagttccatccaatgcttttattgcagcctgagcttcctcgaaagtttcatactcaataagagcatatccctggaaaggaaaaaacgtgaagatagaatcaagagattaaaatgttcttaagagaacatgcaacataatattttcttctaaactaaagatggtgcatagtgaaggtagcaatttgcaatattagataagaaagggacctctgaaatactgagctactttctgcagattgttttattcgttatcatggaacattttctggaatctcatttaagagaatttcctaaaaactatgactaaaagcaattttacaaggctgcaacagggctagacacattgcagtattgaaaaagacaaaccttcacgaatccagttcggcgatccaaattcaaatgcaagttcttgacctgcccaaagtcccggaaaatattgtgaagatcatcttcctgagcttcttcatgaaccccagtgactagcacaatccatccttcaatggctgtaacaagaggcaaaatatgcatgggctcagacaatgccacgaattatcttcaaacaatggaatcttccatgaagaaacaaatagcataagagatcacaatttaaatgtccaccattacagtttcattagatgatacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45821 - DNA, 1988 bp, Oryza sativa
ttaaaattttgaggatatggccccaactggcaagaaagataggccaaatagtagagaaacccagaaagcatcattgcacaagaagatagtattttgaacttttgaagtaccggaattacaaaactattccaaatattgagcatcaaagcttcattgcactgaggttgcttctaggtcaggaagatatatttacaaaccaagaactccgacataataataaatagtaaaggccaaactacacatcggatgattttttagattaatactccctcagtttcataatgtaaaactttatagcattgtccacattcatataaatgttaatgaatctaggcacacatatatatctagattcattaacatctatatgaatgtgggcaatgctagaaagtcttacattataaaacggagggagtagctcaaaactccagagaagttctagtacattaggaaatagaataaaaggggaatatcaaatttgatttgagcaacaaataaattccccaaaagaagattttggactagacatatggcatgcctttctgttactatatcccaagtatttccagaaaaacatgtttggcagagagagaatagattatttagacgaggaacatggaaacttgatattctacaattctacagaaaggtgaggttaaaagacaacaaaggaaatttaatgtgagtatttgttatttacatttgtttacattttgtttgactaacttgacctgtgttgcattaattgaaggatgtcaccttacctccaaagtgatgaagaacaatcgacgctgcaactgtaacattcaatgatgcggttccaccaccatactgagggatgtagacaaaaaagtcgcagatctcgcactccttctgcgagagtcctgtaccctactagatgcaataaaaaataggaaattataatataaagggcatgcaaattgctcttgtttattcaaaggaattacatcccacttcagttttatcctagtcatccattgaatatgatctacaaactggagaaaatgaatttaacagtataacaccatatatttaaatatagtacaatgaagtattgccctagcaagtaatggtcaccttgagttgaaacaaagcctgcagttcacacgtgtatcaagtctaaaaggtctcacactttcactattatgctagtgctagcaactcatgccaatctttcctcacccctcctgtactggcactggccttttttttcttttgagaaaactagaatagctatcacaaactgatgtttagaaaaaatacattggggacactggaacagtcccccatacagacagaaaagcctaaaaattatggaagacattgatgacattagatctgcattcattactcatcaggggtgaacaataatccacatccattgagcaacagctgaatagctcaaggcactgccgtcaatttgacattattgaaatttcctcacccaaatgccccgaaaagggtggaaccgtgacagcaacggtattttctgcggtatcaggtagtcaatcacatttgttatggtatttccataattttgtcattgtgacggcaccaatatacttctctcctctttttcactagcggtttttattgtgttttagtaaacattacgacgctcataaaactcaagtggagctaacatccactcaggattccaagggatcacaaaaaagggtcaaaattccaacagaatttggacgtgtaagtaaattggcaactgatacacatatctgcctgcaaactagtactaattccacagagtcaattgaatttgtgtcatacaagcagaagtactcaaaattaatgaggaatcatgagaaaatccgacccacccacctcattgccgaagaggaaggcggtgctccggcggaacggatgggccgtcaccggcagcgcgttgtgggtgatctccacgccgcaaatgtcacaccccctctcgttctgcacacacacgcgcgtatgtc

SEQ ID NO: 45822 - DNA, 5810 bp, Oryza sativa
acctccgccaccccgaacgccgtcgcgctccgcgccagcgtccccacgttgtgccgcttcgccacgttgtgcaccaccaccacgctctccaccgccgccgccgccgccgccgccatggccgccactcttttctcctttattttccttttttttttgcttttaattcgctctttttttctcgctgtgatgtgaagaagggtggaaatggactagggaaaatactacgcgtgagccattccactgacatgtggggttcacctggagggtccatggaaaggaagacaccgtgccttcgtcgtaggccagagatcgtctgaaaattgaagacaatgaagctcttgatgctgctgcgttgagtgtttatgatgcaaactctcatttgcaacgcaggaaatttcacagtatttcatataagaaatttcataggaatctgtttgtttatttaccaccaaaattgggagaagagctcttggaacacaatgaggtcaatggcgaatcagacaaagccacatagtacaaccagacttattaacatcatccatgaaccgaaacctcagttcagtgaggattccaggataaatggaatagctcagaagcatcaaaattcaaacacattttgatactcttacctgacaagaactagttctgattgcctgcaatgctcagcgaaaaaaagataaaccaaaaggaaaagcattcagaagacaacgctctgtacatcatgtataaccaacacccatcccattatccattatctctgcggggttttgattgatgtgcgaccaaccatgtatattattctcaaagtttaaccactctcaccaccactcattattccatccaatcttccatccatccatccaaggcaagctcagcaaatcaatcaaaaaaaacaaataaaaagagaaaacaaaatggtgtatatgaagaagtctagcaaccggcgaggcgggcgcacaccctgcgctggatgggggtccggcacgatgggcactccttcatcccttgcttgtcatggaggtcattgcatttcgcgcagaccacctggtgcgcgcaagggaggaagacgaccgacatctcctcgctcaggcacatgacgcactcccggtcacgctgtatgtcgtcaaaatcgaaatcctggggtaccgctgctatattggccaaaatttgagcgctgccattctttctcccttcagaaaggcgcaacgcgttggttctgttgtctgctccccacttgggaggggcaccaaccctcaacgagtccaaggataccttcagctgcgaaatctgctgctcgagagcacgtatctggctcttgtatctttgcgtatcgttctccgctttgagatgcaggaagttctcttccgacctcagtgatgtctcaatctgatccctctctttcttctctaagcttacacgggcaattgcctcaatctttccagcctcttcttgcctccaccttgcctggaagtattgaagatcatagaaagaccaaagatatacaagtttagtgaagacagcaatgtaaagggatgaatgaatgaatgatgttgtagagagccgcggcacaagaaggagggacgcattaaaaaaagcaaaattataatatttacagaacagtcttacctaacccacaatattaatcatcactgagcttctacttcagcaaaaacatggtatttgcaatcaactcaatatgaattcatgaaagtaatgaaatgtagactgcaagcgcataagttccatttttatgaatcctctagcagaaactaacaacatagccaaatgacagattttgtccaaaaaccatgatagtgcactcaagacagtttaaagcagtctactctatccaaagcaacaattcctatcattgatcattgccacgactcacttacaaaatatttttcatgatttccgccttaagcagaaatatgtacctggcgtctgaaagacagtgaagataaggaaggttatcattgcatggcatattcgacaaatttaagattggcaaagtgcagatgtgccagtgaataaatagcattgtttttgtacattcaagctttggaacttattgaataccatttataaagatatatcatcacatgaaatctttatttaacattgtcaacatttgacaaatcactaactagtacttgactggaaggataaaatgcaataccatgtaaagttcacaattagtatttccttaaaaagttgtgtaaaacattgcaacgtattcatgatatacaaagcatgctagagttgtcttaattaggacatccaatttagctaccaaaatttctaccttttgggcatccccaaccccttaggagtgagattcaggaaagtaaattaaaaaaaaatgtcacatgaagcttaactaacaataaaaccatgacatgtgcatatctgttaattgcccagaaacatcaccatatattaaagaaaatactgcataaatggagacatcaccgtctattaacttctttgacaagctctaagcactgttaaaaatactgttatccatatattttacaagcttctcactctctcagtgccaccttacatcagatttattcaaagagctactacacccaaaagagtaagaactaggtcaactgtttatctatacacaattaaagtcaactattctaagtggcaatgcaattctaacaactcaagattgttcagatatttcaattttacagaaaccacatgaattaaaggttgatcatatataactaatatgattcaattgtataaacttcccttcaaaagattatgaagaggtaaagataaaggctaaaccaataaatacctggatttgatccttctgctctttagcatgatgaagttgctggtggacctgagatagcttgttcctttgagcagcaagatcctcttgcaacagggctctttcagattcccaatgctgagaccttttatgactgttctcatccttctttgaaagctccaaaatatttgttgcagacactagtgcatgccgctttgcagcttccatctgtatcctgagctgttcattctcggcttcacgtctacgagcagaagattctgccttttccagctgggtgttcgccctagaaatcgcagattccatctctaaaagcttcttccgagtgctctcttccagattgtgcctctcttcttggaggcggtccgcttcttccttctctttcctaagtgaatgaagctcttccttctccttggcaagtcgacgagtgacttgcatcaccttctgctgagcccagtctgtccaatccctcatatgtgcttgcaactctttctgccgctggacaagaatcaagaccatttcatccttcttatcttgtgggatccaaaccttctgatcctcatcatatgataaattgattttgctgctagagtccataccctctgtattggcatcatgattcgaagatggagcaggactgtcatttgaggacggcaatggcaacgacaatgagagatctgtgctagcagctggtaatgggttcaagttactactcagcttggcatcaaatgatggattggagggaagggcagcaccagtaaaagaaaggtcaggtggtacttccggtcccttcatgcttgcagaaaaccctttgcctactttggatgaggccttcaaactgctagtagtagaatctgaaaacgacctgcacttcctgtccagcactgcgctacccaaagagctatgcttgcttgacctaagagatcctttagaacccagtgctcgggaactcttatcaaaactcatcaacttctgccgatgcaaggaatcccgcttagaactccccctcttactagggattggcttatcatctttcacaggttgtgtcgcagcagcaacgaatggttgctcctctgaatgatcaggcacaggatttgagttttcttttggcttaagattcgggatttcactctgcgccttacctgagacagagggtttactgctcggtacattcaggtttgctggtgttgcggatgaatcagccttggcagtattgtaagaattgggtggcactggggtaagttttccacgaaaagtgacgccagtctgtgggttggtaatagatactgataaatccgaacttggattattaggttcatagtttccaacaactggctgggcaatcacttgcgtatccactgctgggagggaagccggattgtagtccatggcacaggcattggccacattcatatccgacataagcaagcagaacatcacatcacctgtagtgtagaacggctgagcctgattgaccaacgcaatcatgccaccgagcactgcctgctcaatcttcctcatgtcttcctcggaggcgccctcactcaacatgtccccctcggtcttgagcacctcgaccgccgcctcgccgaacccagcaaggctctccctccaattgtactgcgtggcagcccgcaggacggcggcacgcgcggtgggctcggagtaacccatcgcgatgatcacacctacggcattgtcgaacgtcgcgtccaggcccttgagaaggatctcctcgagcagcgcctcgttggggtcattccaattcacatatctctggcactccagtagctcctccgccgtggggtgaatatccttgcaatcgcacgagcccgggatgaggtccaggttgacgccctcggcggccaccgcggcggcggccgccgccgccgcgatggctgccttctccggcgacatgaactcgaagcccacgcagtcggccgtcagtgggtactccagcccgaatgaccccagctcggcggacggcggctcggcgcggtacttgcgcttgttccggctcgccgccttctcctgcgccgccgccgctggccccaacggtggatgcgccgcgagagtggacatcacgatagatagctgctgcaaaaaaaaaaaaatccccccgacccaacaacaaattcatcagagaaatcacaccgcgcaatctcaatatagcacaagaaaacaaacaaaaaaattccccggatacggagaatttgcgactcacctctggttccttcctgcgcgtgcgtgcaccgaatcagggaagagagagagatagaaaaaaaaataaaccctgaaaaaacaaagagaggggaaaaatgattcagtaacaatcgggaagcaccaccgaatcaagaaccaggagaaactccccggcgcgcccccaccgcccagtgcccaggatcagatggggggaggaggggctgttcttgatccgatcgggtgtgggcggggggaggtgcgacccgggagacgggggcagcggatcgaggcgcgtacccgggggggggggggtcgtcggcggggatcgaagcggagtcgatcagaggagtggagaagagagagagagagtatggctagagagagagaggaggaggaggaagaagaagaagggggaaggaggaggaaggagatgaggagaaggaggcgcttgtctctcctcttctctaggcctgatggatggagagagagagagcacacacagcacagcagttacggttgaattttttttttaccatttcttttctctcgttttctgctgggtgctgaccccaccaatggttaggtgccacgtgtaccgtgttcttcgggtgagggctgacgtggccggtggcggtcgatgtggaataaaccagggaagggagatatgtgttgttcttggttatggaatgcgagatgtttggagatggttaggttggttttgctttgtttggtgaatggattgttgtttttatttagcatgggttttactagtgatagattagcattcagtgattac

SEQ ID NO: 45823 - DNA, 12459 bp, Oryza sativa
ggcctcgccgacgccgttgactctttccggccagccggcgaggcaggcagcggcgcggtggggtggtggtgacggtggaatcgcgcaacggcgcgaggacgggagtggtggcggcgttctgaacggggaggagaggagttagggttaggggggtctgcacgaatctttaagcgtatccagtggtccaaaattcgaatgataggaggtgggattttctatcacaagatatatagacaacctctttaatgaaagtgaaggtttatcctagaaccatgttttttttttgcagggaagaaccatgcaaattgttattcaacaatatgtaatatgtgatgttcaaatatcattttgttactattagttacacatcactctagcattgcttttaccccattaatccatatagtaaactctgcgctggtaaagttttgaagtcatatgctcccatcgaaacatacaacaactaaacttagcttacacatcatcatccaacatagataatacacacagcctcatcactaggagtatcaccacatcaggcggaacagccacattagctctacatcttgctatctattgcaattgtggtatgagatatattgcaattgtggtatgagtaagtgatttgatatcttccttatttagtagtactatgtcactagatagagcaactaatgaatagctgaatagcaaaatagtgttttatatcttcacaactgttactaatccaagttctagaaggaatttagtattattttttttcatgaagcaagtaatgacttgttgccaaacaaatgctctcaatgggattatctcgtttctttaagtttaccgttttacttgatagaataagaaatacaactatggggtgtttagatcccaccccaaaattttataccctgtcacatcgaatgtttgaacacatgtataaagtattaaatataggctaaaaaataattaattgcacagattgtgactaatttgcgagacgaatcttttaagcctaattgttccatgatttgacaatgtggtgctacagtaaatatgtgctaatgacggattaattagacttaataaattcgtcccgcggtttactgacggattctgtaattagttttttttattagtgtccgaaaacccatgcgacaccatatataatacctgatgtgacacgctaaaactttaaacccttggatctaaacaccccatatgattgtcttaaatcaattgacattagcccaatcaaacctcataattagagcaaggacaaagggaagaaaatgtgttcatttgtttgtatgattccacatctagcatacctaatcaaaagaacattattctattctttttatgcacaccgtgaccgcgaataaggtaacttcaaaggtacaatgagaaatctaaaaaaaggaaatttttattgaagatgacgaggtaataccgtaatacacacttttgcatccattaagtaagaagagcttgggctaaaaacaattattgcaaggtcgaagctcgcctcattcatcttgatacttataagggaatggacaacaaagtctaacactttcgagagtacgtgttttggaagatagagaaaagaaaatacaacaaggttggtccatttaccccaatactaatgggattttatttggttgacatgcctaaccaaagcatcaatccatgttcatgtgtgcctacatctatttggttcattcttattgatcgggcttagctaatactagcagtaaaaaaaatttagatatgatgtgaccatcaagtataggcatacaaccaagcatgagaaatataaagcattgccaaagaggatgaatggaggatgtacaggatattcaagtccaacgagttttagaatccagttcggcctccagagacatcactgacttcaaacggacctatcgccttcatgccaactacgatttgcgtgatcttggaatggaaatattatctcgtcatctttcaaatgcatccagtctcatatccaaattcatctcgagtcaacgagaatcatcaaaacaaaacagtgctattgctgaaacggaacttgggcctttggtcttgtaatagactagggccatctcagaagtgtctccctccacctccccgaattagtacttaaccctagctctagtttcccctatgaatgtctatttacaccgtctagaacaattgggttttatttagttgaattatgccaagtgctattcaccttgtctctagttcttactcgattagagcatccctaggagatacgctactacatcctccgttcgcgatttggcgtataggagtgcaaaaaccgtctccaggagatgcgccatccaatccggcaaaagtggcggatgcgccaaaaagggagagagaaaacccaaaaatagcgtgtctctctcctcgcgccaaatcacaacgatcgagctcccgcccccatccggaattccacgacgtcccctcccccgcaacctccactccatcgtcgtcatcgccggccagcgaaggggagtgcgccatgcccgtttttgatttttttttttgcaatggagggtggagagaaaggggtgtagccgtggagtgagggtggagggggataagcataccagatcagggaggagagcgccggcagcgcccaccgccatcgccctgcccgctgctgccgcctgccgccgttgcccctcgcccaggcgccgctggatttagcggtggaggattggagtagatgcggaggcccggccgccaccgccgcccgccgccgcgacacctccgcccgcgcctgcgacacggtcacctgcgcccggtcgctcatccgcccggcaaccccaccgcccgcggccgtgaccccgccgctcgcgcctcgcccgcccgcgcatgtgaccccaccaccgcccctcaccagctcgctcacgagaagaatagcagtagagagagtagtagagaaggttagttgaaagatgttataaaaaataggaggatgcgatatggatgatgtaatatagatgatctgttggagtgggaagggatatgaacgaggaatcttttttggatgggcatccatatgggcatatagaggatgatatttggatgatctgctagggatgctcttagtcgacgactatagattggcaccccccctaaatagttggtgtgttgatttacctggtcgatcagatataccacttcaatcgcaactatttctttgtgcttaatcacctattcataatatttagattgcatcttatcttgttcttgcagtgttctctcgtttgcattgcaaggatcctcaaccgcgtgcaactatttctttgtgcttaatcacctattcacaatatttagattgcatcttatcgtgttcttgcaatgttctctcgtttgcattgcagagatcctcaaccacgtgccacggttgatacgacatcgtttatggtgtagcgattgcatggcgatctagacttgttctgattggtagccatgtcgtacacgtcacactcgataaaagcgagagttatcccctaccagaagatcaggccacgagagagagcacgtcatcaagatacgtcagtatcataattgataagtagaatgagaggccatgcttacttgggagagatacatatgtcaactaatgcaacccattttttcacatatttggagtacaatttaacatctttttccctctttgaaatctctaccatctggtttattcacctaacgttgaaatgaacgaggaaaattctgcttgtgaggcaagccttagaaaaagcatgcccttgaaaagaccatgcttgatctctacacaacatgagacctaagaaaaagactttgcaacttaaaagggtgtgttcaggaggagttgggaacttctcatcaccacacgaaaacatgatagctcattaacacatggttaattaagtgtactagctaaaagaacttgaaaaatggattaatatgatttttaaaaacaactttcatatagaatttttttttaaacgcataccgtttagcagttcagaaagtgtatgcatagaaaaatgatatagtagaagttgggaaagagtagtgccgaactaagtgcaaatcatgttttgaataataatacgattatcatcttaagtaaaaacgattttgctagagatcaatcaaaagacctttttcttagccatcacaggtgggaaatcaatcccacgacctcttggttgatgccacgcggttgtaaccagatgagcaagctatcaatcctatcgtgtttaatatactccctccgtttcacaatgtaaatcattctagcatttttcatattcatatttatctagattcattaacattaatatgaatgtgggaaatactaaaatgacttacattgtgaaacagaggaagtacaaccgatgtacgatgccattataatataattaaactgtaattatattcgtgtgatttttacattgaaaaaaatattttgaacgatatctagtagccccaagtaaaaaatatatttagacccgaaacttaccattcaagccaaggccgtgtttagttcccctaaattcccaactttccatcacatcacatcacatcacatcgcatcgaaaacttttctatgcacataaactatcaactttttctccaaactaccaactttctcccaacttcccaacttttccaccatctaaacacagcccaaaaataaaagagttaatttcacaaaactataggtactttgtacaatatatcacaaaactacatatttaagagtttgtttcacaaaactacagatttattgtctccgtttatcacaaaactataggtacctgtacaatatatcacaaaactacagatttaaaaacttgtttcacaaaactatagatttagtgtatccgtttatcacagaactacacatttagtgtcttcatttattacaaagctacatatttagtgtcttcatttattacaaaactactccctccatctacttttgatagtcatatttccaaatctgaaaaatctatttttgataggcatatttcaacccaacgacctatcctcttaatgactttctcggatttaatgcatgactctccattattccacacaagattggctacatgggcatcgagaaatgtaaatattaataaatctcttgtttacgaggaataactagtagcatgtttaaatggatgataagtagaattacttatccttgtctgtgtgtcaagatgaaatatgactatcaacagtagatagagggagtacatatttagtgtcttcgttatcacaaaactacaatttttgcattaaaacctgtagttttgtgataacgaagacactgaacctatagttctgtgacaaatgaagaaattaaatttgtagtcttgtgaaacaagttttaaatctatagttttgtgatatattgtgtaaagtacctgtagttttatgaaataagtttataaatctgtagttttgtgatatatggtacaaagtatttgtattttttgaaatttactcaaaataaaacctgagtaagaagatcatcccggcccggactcagcccagccggtccacaaacatgcaataccacatttcccttttcttaatttttctaacacgaaaaaaggccccgaatgggtgggaggggcccgttcgtcttctccagtaacgcaggagggaggagctcgtggcggcggcgccgccaccgcaccggccggcggtggggacgcacggcgagggacccggtcaatttttcccaaaacaaaaagcgttcaaatcctcaccacctcccatctctctctctcttgacctcacgaatcccctttgccgcgagcaacccgcgacctccctccctccgcggccacacgaggtacgcgcgctttcccccttaccatctcgagataatccccgaatcgattgatttcgacgccgatttgcggcgatttccacaggcaggtttgctcgcgtccctctctgctctcgattgattcgttgggggttcggggggttgagtgctcgatcgttttggttgcgtgagtcgcggtcgaatttagggtagtattgcttggcgattcgtttgcgcggactggatgggggctttgattggatggggaggtgggaaaatcgctatgcatgcttgttgattggaattggattttccatgtgtgggcgttgcttgtttacattgggattgatttgcagagttggacttcatctgattgcgttggaagcaagcgaatgtgtcgtgagattgaataatgtgatatacattttcagatgttaggtgccatgtgttaaaaacaccctcgggtcgtaggtttgatctccatttatgatttgagtgagccggggagccacagcttaagatgccatatgtgtcatatgttgtttggggagagaacggaattggattgataggttttacatacaacaccgcattgctgaatttataaaatgcacagtagcgaaggaagcaaaacaatgtatcatacatacccccctggtgtcattttccatgacatgctgcctaagtttttccttgtcgttttgcatcaccgggatagttgttcccatcttgtgcatagttagccacctgaaaatcacaaattatcagtttgcgcctggcaagtaagccaaccaccaacaaaatttcctatctagaaatctgacagcgatattcttcctgaacctgaagggctaggaataatatgtctgcagtactgcaataatcataaactcaggttaaactagttgtgtttcgggcatattgcacctgggattattccaatatattgccaaaattttaaaatgacatgtttcggttatttttccttgtttttggaggaaataggtggaggatacctttagatcagcagaatccccctttgggagctaaaaactgaggagtctatgtgaaaagaaagattactgggaaaatcgtaaaaacttagacatgttagtatgttcagcgtccttcttcatagaaccataccatctgtttcatcttaagcttcaatggtcatgtaaaaggtcctttgaatgactgcaagcaccttccataggaagcattctgatgttggtttcagatcatgttcatatgatggaggttaaaagcaatccatactttatcaatccagtagaacaataaagtagtttttaatttttggaatattcagaattggcagtccatatatgttgagaattttctcaatatggaacgaagattccaatttcctaatccagtgctggtgctctacagttgacttcaaatcccactgaattatttgtgagcaataagtcagtgctagttccttgctaagccctttctagtgttgaaattttagtgtttaattctgtgaacttctagggagggaggatgatgtttttaagaaataaaaaatggagaaaaatactcttgatttcaccacttcctttttcaatcttgcatatctcctgcagtaagcataatctcctgcacatatgctgcttttccaggattctaccttttcttccgcagctgtctatctaccgccatggagcactgaagccccaagcatccaaatcacattgaaatccttccatttagatcaccgtaagtgataactgttgaaacttatgctcaccaagtcaaccacgcacataatagctgccctgtaaagcaatgttttgtttgttaaatcccattggaagtccatgctctctgcaacaatatcctggtagacatgttgcctcctgttgatccagttgagcgcagaaaacacaatcaacattcccatcacatcctgctcggctttttcttggttgcaaggactaaccgctgaaggatctgatcattaattggaactggaagaccccatcatttctatacttcttcagggatgtattcatatcattatatcaaatttaaaaacctatatggtaaatctacatattctgcaggctgtattcataggaattacaacaagctgtgcaatatatccggaaaacattccttgttttcttagtggtccgctgatatggccatacatacctcataggaaattaggtggataaatttagaacattcaattattttagtctcaaagatggaaatagatttgcaaaatgcagcgtgttgcactacctcttagtgttaacatagcattctgaaaataagaagattattgagtattgacactgctattagcatttgttgataatattatatgaatttctttctttctttttatcagtgtagatatttgcatcatctggactcaagactccattccattttgcagtggccttttgctttcaactcaatctcaagagtgtaattaacttggaaataaagacaggtgacttattggtaagcattatgtcctgcttttgcacttttcttgtttaattattaccatttgtttctccagttattttgtgcatttgactgttttagtggcttccatagtccctcatatttgtgttgcttgcgttctagtgtcccttacgttttatagtttggcattgtggaattataactctcgagcaccatttcaatgatatgccgctaaagtacttgtatgtgcagttctagactgtaaccagataatcctgctttaaaaaactaagttaaattgccataaaaaacaatgttctgattttaggttggttctaattttctattgagctacaatttggtattgtggggcttgttttgtttgataccaacttattgccctaccaaaattttggtaacttcaatagtagcaagtgcatgtttggtttgctaccaaattttacccgcatcagttcaaattcaatactacccaatttggtagtgccaaaacttgccaaggttttggcattaccaagattttgatagggcaaaattgattccaaaccaaacaagcccgtggtttatgagccctacaattaatacttaatgtaggaggatacctaacatgcaatctatttatacagttctactattttattggagaagaaccatgtaactatgtagtggtgaaggcagggagccaattgctatttgatagtgcaactacattacagaactcctcaaattaaactacttgaacatatactacataaattgatgttactaggctgttcagatttacctttggggatttctggttgagagttgtgtcataggaaaaactgtgggaagaggagctcatggaatgataaaggggatttaagtgtggtaggaagaagggaagaaaatggcatgagcgtaaatgaggggttttggatagggacatagttcggctgcaccatcatcgaatactatcactctttggtgcacataatactggcatatgctagtctgcaatggatatgcattttatggtaggaaggtgcgtgaatgtgagtggctgacactaaaatcttgggagggtgacagaaaaatattcacatatgactcgtagaaataagcaatgagaaaagaccttctagcagatatcacagcttgcatctttatgaaaactttaatctgctatttgagttgtgttatgccatacttctccagtagcacgaagatggtgttgagatatatttgacttgatattgctcagtggtcagcaccaatagaaacaaatattgcatactcctgatcctttccccaatcattatgccctttttgagtgcattaccagtcagacttaagtgcttgcatgatccataaaatctggttatattcatgtgtaggggccaatggactcccacttggccattcactttgtctattaaaagtcattataaatgatatgatgaattgcattgggtgcattgaaggctatagtatagtgcttgatgtgtgtcatctctctctaccaacagagaaaaacagagctaatgttcctttttaggcttatgtactctttgtttgctgccatgaaagccaaagtttgccaagggaaattttgttatcaccgcccaaatttggtctttgttttgatgccacatatcaggaaggttccgtacaaatggttttggttactctgtttagttcactcttgagttttgactccaaactaccaagatcaggacagcctttcatgcgcaattttagctttgaaaccaaatatacccttgatgcctcgagaagattggtctccctgatcaattggaactctttatgctattctcacccttttttctggcctcccatcacaatggctcattttgctcaaggtctgttgaatgcaacaacttaaaatcataatggaccatccacagatttttttttttcgtgtccatcaagaaatgaacagaagagtccgagtgataaccacaccaaaagacaggattgatctaaaccctaccaagcgctagctgagtaggatccagtacaataaagcaaccggagtttcataaacattaaagtgtgtttagcgtgtcaaaacgctaaacgtactttattgttgaaactgtcagtgctttgctggcctttgattctatgttacttctcgagaagacatgggctgttcatttcgtaccatgaggccccaaacctagaagcctagatgcatcgaacatgcagacttccattgttagatcgcatcagtattcacaccagagtcacgtgaaaaccagccttgtccgattaaattgattttagcactgttcgaggcccataaatcattttgtcattccttctgcactgcttatcttcttccttgtagattgctagttagttgccccaaaatccatgtagacatcactgcatcagatgctggtttcggtcgctttcatcagaaacaaaaaaaatgatcctttgctctttgaagtgttaaaaaatgcaataacattccagtctttacttaaacagatattcagggaggtaaagtagcccaaaacatgggataaaaagtgagctgaaacttctctgcaatccgagctgtatccattatcttatttggtagtggtaccgtggattgggggcttggaacaccacatgagatgttcttcttccttaggggagaagactgtgtcctcaagactgaaaagctttgtcaaccttttgggagcatgtgatggatgtcctctaaacacccagcttaaccatggcctacaaatacaatatttgatttcttattgtcatctgtcccagaaacatgcttgcaccggcatgcttcgtgttgcttctgtgtgaataccaaatttttgtcaaaaaaaaaaaagaagcaaagctttaaagcaatctatattccttattgctagtagctttgagcaaattgagctggacatcatcatcactcatagctcccccttaaacaatgttttgtttgcatcctatgcactcctagtagtgtacacgttgctttacttcatggttgttactcaccatctttctggaaaagcaaagcttcctttgtgtgcctgttactacttgttaacacagttacactgtcaagttgcagatacatttttttttttactttgcatcatcttttgactgtcactgtgcccccttagctagatatctggacactgttggccattgatgctacatatcagattcaggtcagtatcagtataggtaggtggtatgccatcgacgagtagggttcttacgtccaaagggtgtgttaggaggtgtgctaccatcagccacatggataaattcctggaagaagccggaatgcatcaccatcagagtaccgagtgccaccaatgccatgataggatgaacccaagacgtgtagtactagttgcaccgtagcagcagcacatagcaaggccgtgtggttggcgatcgattgccgtgtgggtgtgcgcgtgtgtgcgccctgataatgcaccgactcttgcagaagaacaggagagttgcttggctgattccggttggaggatagtagtgatgattttccattaggatttaggaatcgtgcgccgactagtggactagtaatgcttcacggagaggagaagcagaagcagaagcagcagcatgggtggtgccggtgatgtaagtacgatacgctaagcatcctatcgcaagttcgaagcacctttgcaccgcgttttgtgaggccccacactaaaagaaatcatgtcatgtgccccccgtgtttgctttaatttgatgggcccttaggtccttttttttattaagatacatatttttatcttaattttaattcgagtactcctagctgctagacagtatatttcgtaaaaaactttctatatataagttactttaaaatatcaactaaatcaaaatttcaagtataaaataattaaaacataattaattgtatgctaatatatttttttcgtgtccacaccccatctttatatgctattttctcaaacggggccttaataagaaacttagaaacttgctcttcctatttctgctaaaatttgtactgtttgttcctttgagaaatccattactaattcatttctgtagaacatccagacaagaggttactgaaatgtagcataacgaatctt

SEQ ID NO: 45824 - DNA, 2546 bp, Oryza sativa
cctcccccctccccctcccttgtttatataaacccgaccgcaccctggcgccagccatgtcatcatcatccacccccaccggagcagcagccgacgatctcgccgccgccaacgccaacgccaaggagtgcgtgttctgcgagatgacgcggcagcaccacccgcaatgcgcgcggcggctcccgaagcggatcatcctggtgcgccacggcgagagccaggggaacctcgacatgtccgcctacaccaccacgcccgactaccgcatcccgctcaccccgctcggcgtcgaccaggcccgcgccgccgggaagggcatcctcgacgtcgtctcctccgccgccaactggaaggtctacttctacgtctccccctacgagcgcacccgcgccacgctccgcgagatcggcgccgccttcccccgccaccgcgtcatcggcgcccgcgaggagtgccgcgtccgcgagcaggacttcggcaacttccaggtcgaggagcgcatgcgcgccgtcaaggagacccgcgaccgcttcggccgcttcttcttccgcttccccgagggcgagtccgccgccgacgtcttcgaccgcgtcgccagtatgtccccatctcatttcaattcaattccattctcccattcttcttgcaattcaaaacgatttctgatgaaattcaatccaattcaattcttgttcaggtttcttggagtcgctgtggagggacatagacatggggaggctggagcaggacgcgagctgcgagaccaacctggtgatcgtctcccatggcctcacctcgcgggtcttcctcatgaagtggttcaagtggacggtggaccagttcgagcgcctcaacaacttcgacaactgcgagttcagggtcatgcagctcggccccgccggcgagtacagcctcctcatccaccacaccaaggaggagctccagcgctggggcctctccccggagatgatcgccgaccagcagtggcgcgcctccgccaaccgccgcagctgggccgacgagtgctcctccttcctcgccaccttcttcgaccactggaacgaagacgacaatgacgacgacgacgatggcaaggaggaaaatggcaagaccaacaagttgctcgagtaataatcttgctgcttgcctctacttgctctttctttagaaattccgtttaaaattctttggaatttgattcgattggtactactagtgtatttctccattggggcgatgcaatgtactcccctttgctgattcttttctgtttgatctgtagcctgttcatacatagttgctagatactacattgataaatactatatatgatttggggaaatgaagcaaacgatttgactatcaaaaggaatcattgcctatattctgataaacacataggataaatctcgagggtttgttctgaatctcattcctattacttgactgtcattaaaggggatctttgcctctcttctgtaactaaacacagccccttttgtttcacctaactttgtttaactactaataatagataggtcacattaattcgagcttttgttgacagtgatatatgagattatggatttctctgtgaaaaacactttacttttggggcaaatgcagcatgttgttagcagatcacctgggaaggccagatacgcctccatgctttcgttcaatttggttcttgttttccctgattattttactcctagatatggccatggcctctttactattttttgtcggggtgaccgaaggaggtcatccaatgtaattaagatggaggaaacctctttactattacaatgtgctttgtttagctaataaagataggtaatattttacatcttcggtttacaatttgtttttacaaggttatgtatttttgtcaaaaaaagggggggaacttagcatttcgtgtggttgcattcttcctttttgtgacgggagaaaaatggtagtatctgttattcatgtatagctagacacacactccagttttcacatgcatatgtcatcagaaacaggtgcaaatgcaaagattccttccttgctactagttggcatgttcatccttgactacacactatacatctagatgttgcaatttcgtgcagtgcactacaagtaggagtacttcttttctccctttttcttgttattttatcttttattttattttctaaaaaaatcagaagtactagaattgtggaaccacaaacagagcactgtccttcctggctggtccagcaaacttgcccatctgacaatctgagtactaggatccatgtgatcctattctaatcaatggctatcagcctatcacatctaaaagaagggagaaaaaaaatagctccctttgaatcaaaggatttaggtaggaattttataggatttaaatcctatagaaaattttcctatttggccctttgatttaaaagattgaagatttttaaatcctatgaaattcctatggaatggcacattgcatgtggattttggaggaaatatagcaagagcttcaacctcttggaaaattt

SEQ ID NO: 45825 - DNA, 13449 bp, Oryza sativa
ttaccaagaggttgaagctcttgctaaatttcctccaaaatctctataggattgtccattccataggaatttgaaaggattggataggattcaatcctttgtttcaaagtgctttataggaaattttcctataggattgaaatcctccaaaattcctatgaatttcctttgaatcaaagttgattttagatatttccaatgtagttttattttcatcattagtttttaagtagctaagtttacgcgtaaaaaagttattttttaatcgttaataagtcattttgacttgtaatcaactcatgtccaactgatgggtccttcatgtcctgcaaagtgtgctgcagtatgaacttcagatgttcttctccttgtataagttcccatgaactgcatatgagcatatcagcagtctgaatattttttgagcaattggggcgagatccccaaatgctgggtgaggtgtagtcttgaccatcttttttttttcttctaaagatggatcaattcccatcagggcttggatttcattaataagcatgaaacttgctggtgatattttgttacatgatggcaattcaacagggcagtgacctacatgttgtacattggaatataagaacaacttgtcctgacatgtgtagattgcgcatctaatttcgctaatgtttgatcctttcagctgccatgaacatgcttcatcactcattcactccgatgtttaatattccctccagtattttatttcccatttttctaattctctgaagtcaaaggggtgccattttgattactactcactctgatcctatttactactctctccacgggaaagtattttctacacctagatattatgacaactaggtatatgcatatagtttaaatagctatataaaaattcataaaattgataagatactttatgataatataagatactatacaaacatacaggtttaaattcgatctatacataaaaaacaaaaacaacaaaattatttgcaatgtagaaggtatttcataatgtaaggcatggtcaaacttagtacggtctctaaaactaatctttgacttataatttctcgtatactataaagtttgtagcaacaaaattataaccatatgaaaatatattgaaataccaatttaatgttattattttcagcaaataaaatttaatttataatatactaatcattagtctttttttaaagttaaaccttaaaatgtgtacgtgttttacattatggaatggggcctaagtatttcgatataggggttgtaatttctttaaggatgattttttatttgcccatgtaaaatactctcttcatgtggatgtgtcacatccacccaaaatcctttatattatgggacgggagaagtgtacgtgaatcgttgttttcatgtaatgagtcaattagggatcgggtcaactttctagggtaaataaaatataatatttttttgtcccttcacatacagttgaatataatttaggccgagtttagttctgtcgaaactagatttcggcaataataaaaggaggtggctatcaagctagaaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaaacccgagatacagataagatattctatctacattaggtatcctgtacccagttcgaataccatcgccgtgtagatatgggatacccataatctccacagtagcccccgagtcctttgcagtcgaccatcgtagccctctcaaagatgataatccgagtacttcaaactcttcaagccaaaacctgccgagtggactgtaaagggcgaaaagataaagaatatggtgcatcgaatagatgcacctaattaggtgtaacccccaactatgtgattagttaacaaactaaacatatagttgaaagacaaaataataacacaattgtgcattatatgacaaaagcgtacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctaaagtactgttcaggcctaggcccattagcacctccgatacccttaactgaaaaatccgatatccaagcgacgcttcgtcttccccgccggaactctcgccattttccccactccctgctacagtgcaaagctgcgccgacgaactagggttcacaactccggccaaatccacctccgaaaagtgcatcaaaatccttcccgtgatccaccgcctcaatccctcacctctcccaagccatccctcgaatcaaatcagcacatttgagtgaaaccgatggcggaagagagagaaagcttcgaaggccaatgggcgtcatccgacgtaacggaggagaatcttaaggagatggtggcgcacggcgttctccctgccaaggagatcatcaggtggcgaccagcgcacggtgaggctttcccgtctccggatactcatgagattgtggtcttctcgcatttcttctacggcggctttgctcttccgacctcaaaatttttccgcgggatcttgaacttctatggaatcagcttgcatcacctaaacccgaattccatagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtactcttgtcttcctccagtgtaccaagatacttggaactctcttccaatcggagatgaagcagtacaagccttggagttgttggatcgtatgttaaatcttaaagaacaaggcttacagggagagcagatcactcggcacttcatcaaatgccgactggcgccaatcaaggaaagatcccgcacagcattcgagttcgacggcaaacatgatcccaaccgtgaagaaccagattccctggatttcaaaatcatgaaggagaggatgtataaaatcttctcaaatgcaattgtagtcagctactctcatcaactgccagttgtgccatataatgcattcaatccgcctccacaggtatgcatcggaaaccctcaaaccgtgatcagaacataattttatcttcatgcttagttgactaactatggaagcatcttgttcaggaatatgcattgatgaagtcagatctaccagtcactcagcaccggtctcctcgccaacacaccgctcagggaggtggagggccaacgatcagaccagatccgcaacctcagacctccaaattgactggtcaaacaggtcctcgcaagagaaagctagtacttgatgatgatgaaggcgacgatgataaatctggggataagggctcgcctaataaacccccaaaacgtaccatgcccaggaaaaaactagctggccgtgcaatgccaaagatcagaacatcttccaggtattagatctctcggtatgatttccgcttcggcatgttttccgatgaaaataatgctaaatactgaaagaacactctgcaggaaaccatctgatatagatccatctggaaaagaccccgatcctgccatgacagagcaaaatatatccaaggaccccgagccgactgctgaaaaccagccgactgctgaaagccagccgactggcgcccatgcttcgggcgatagggccaatccgagtgacctgccgccgactggaaaccagtcggcaacaactgaaacggcaacaactcaagagcccccgactggaaaccagtcggacgcaggccctgatcaagagatccccgaagtagaagcgcagacgacgacttcgcaaggaccagaggctggtaacgactcgatagctgggtcttcaggtaaagaacaaagatcacctcacgctcagctaggtacatcttcaggttagttgtcttctcaaacaatggcgatttaaataacctcagtatatccgtctaatgtcttggaaacgcatcaggaccatcaggtgatgacggagaagaaatccctcgcataaaggcgaccgacgactctcgtcctcctatcttgatcaaatggtgggacgagaactcacaagccgccggcatagtcataaaccgtcaaaaagaagatgaagaagtgtgccagctgaagaaagcgctcggagaagccactcgtattgtaaatgtaagtcttccgagtgacggccttcggtaactttgttttctttttagcagaactgaaccatgatccatcatgcagagaatccatcttcgcaatgaggccaagactacaactttggaaaagctggttcctcatttgggaactctagaagcagttagggaccagctgcatgaggccaaggagtgcgccaaaaagacagagaaagagttaagggaccgaatcgcccagctccaggatgcaaacttcgaactaagtggttcatcaaaaggtaatcacccagatctgttccattgatttatgctgtcataattgcatcctcaaccatctggatttcaaacagcgcaagccgccaggatggaacagatggcgaagcaaattgaagccctggagagagacaagacaggactggctgcgcaaagggactcagccttgaaggaagtcgaaggtaacgccggctaacaatctgagcttctctccttataatgcaacagatgctcatcataaatgtgttttgcagatcgcaagatcaaatctcaagctcagttcgacgtcctggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtatccgagaattgaagtcgacaccattgatggatttgcagacgggacaagtgaagaagctgcccttgatctcatcagcagtgcgcaaaatgcggctgacaaaattgtgagtgatgttgtagagcaatttcgcaacaacgacctccagccgagtaatgaagactctgatgatgaaaggactgattctgactgagtttgagtgtaatacatggaggctcaatttgtacaatactggtgtatttatgctgtgcttgatgattcttgcgaagtttttgatttcttaaaagtttttgctaaactttcttgagcctaaaacccaaagaagctattaaaaactttcagtcctcgcaaactaagtagaaaaaccaaacaaggcaatgataaaccaagtaagcaaactgaattgataaaaaatcacactccattattatgatgatagcccccgactgacaacttcaaggagaaaacttgatgtttgacagtcaaaatagggaaatacaatgataaagttaagcgtagaaacgacgaatatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcggtgcaagtcgtccactcggtcttcttcatagcgttcttcacggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcataaggtttaagccggtcaaaaactcgagctttaatcctttgaagtatcatgccgttggccctctccacctgtccattgctcatggggtgtgccactgaggcgtagcaaatcttaattccaaagtcctcacaaaagtctttaaaaactccgccagtgaattgtgtgccattatcagtgattatccgattgggcactccaaatctatgcacaatgttgatgaagaagtcgcgagcattatctgctgtgattgtgacaaccggtttagcttcaatccacttggagaatttatcaatggccataaagagatgcgtgtaaccgccaactgcctttttaaacgggccgaccatgtcaagcccccaaaccgcaaacggccaagacagcgggatagtctgcaactcttgagctggtagatgaatttgtctggcgaaaaattggcaaccttcacatgtgcgcacaattttgtcggcgtcggacactgcagtaggccagaaaaaaccctgccggtaagctttgccaacaatggtgcgcgctgcagcatggtttccgcatatcccagaatgtatgtccttcagcaattgtctcccttcctctaaagatacgcagcgttgcagaattcctgaagggcttttcttgtataactcggcttcatgcataacataaagtttgctccgccttgaaatccgctcggcctcatctttgtattgagggagttcttgagaagtcaaaaatcgtatgaggggctctcgccagtcggcttcaaccatagctatgtcatgagtgtccgcaacttgagtagcatctttgtgaggtactgtcggcgaataaaggtgttcgacgaaaacatcagatggcgctgcctcgcgcttggatccaaagttggcaagtctgtcggcagcttcattgttgtgtcgaagaacatggctgagctcaagtccatcgaacttatcctccagtttgcgtacctcttgtcgatatgccatcatgttgtcgtcaatgcaggaccactctttcataacttggttgacaaccagctgtgaatcacctcgaacaattagacgctttatccctagggaaattgcaatccgtagcccatgaaggagcgcctcatactcggcgacgttgtgagacgccgaaaaatgtatccaaagtacataacttagtctttctccggtcggggaaattaaaaccactccagctccagtgcccgaaagtctttttgacccgtcaaaatgcatggtccagtgctctattttctccacgggggtatcctcttggcactcggtccactcggcgacaaaatcagctaacgcttgagacttgattgaagtgcggggcttgaatgatatgtccaaagacatcaactccaaagcccacttagcaatccgcccatttgcttcgcggttgtgcagtacatcgccgagtggaaatgatgtgaccaccgttaccgagtgaccttgaaagtaatgagacagcttcctggtagtaattagaataccatataacagcttctgaacctgagggtacctcgttttggagtcagccaggacctcgctgacgaagtagattggtcgctgaactttctggacatggccttcttcctcacgctcgacaaccaagactgtgctcacgacctgggaggtggctgatacatacagcaacaacggctcctgcgggtgtggtgaagctaagaccggtggcttggtgaggagttgtttgaaatcttcgaaggccttctgtgcttcgggtccccattggaaattatctgttttcttcagtagcttgaagaagggcatcccccgctcgccagtcttgaaacgaatcggctgagcgccgccatgcatccagtcagcttctgaacatctttctgggtgcttggcggtttcatgttgaggatagcagtaactttctccgggttggcttggatgcccctatgagacaccataaaaccaagcagcttccctgacggtactccgaaggtgcacttttcaggatttaacttcatcctgaaggcgcggatgctcgcgaaggtttcttctagatccaagatcagatcatccttttgcttggtcttgacgactacgtcatccacataggcttcaacgttgcggccgatctgtgttgaaaagcatctctggatcatgcgttgataggttgctcccgcgttctttaatccaaacggcatggtgacgtagcagtatgccccaaaaggcgtgatgaatgaagtcttcaagcagtcggattccttcagtcggatctgatgataccccgagtagcaatccagaaaactgagaagctcgcagccggcggttgagtcaactacctggtcaatgcgaggcaacccgaaaggatcttttgggcaagatttgttaaggtcagtgtaatcgacacacatgcgccattgccctgttttcttccgaactagaaccgggtttgccagccagtcgggatgaaggacttctttgatgaagcctgctgctaacagcttggtcaattcctccttgatcgcgtccttcctgtcttgtgcaaatcggcggagtcgttgtttaataggtttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtttcggcttcggtttccccactttttgaaatcttggcagcgggcacttctccttcgctcaccgtggttgcagccagtcggatttcctctcgggcagacgccatctcgcgggtttgggccatgtcgcaactttccttgtcgcatgtgacagcttgcttgatgtcgctccgtagggttaggactcctcggggaccaggcatcttcatcatcatgtacgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccggaagagtgatctggccgagtggagttgcggataatcctggaattactccatgaaaaggcgcattgcttgattttaactcggagcgagggatctgcatatcatccaaagtcttggcgaagaggatattgagtgcactgccgccatcaatgagggttctgcgaagcttgacgttacggaccactgggtctagtaccagggggtaccgccccgggtggaccactcggtcaggatgatccgagcggtcaaacctgattgcgatctctgaccatcgaagatattggggcgtgtcgggctgaacagcattgatctcccgttcggtcagcttttgcttccttttagactcataagccatggggccgccgaaaatgtggttgagctccttgcggtggtcttgaaatccagccggggtgtcgccgtcgtccttcttccttgacgtgctttgtttctcgtcggagttcttccgagtagacttggtgtactgctccgcgaactgcttgtagatgaagcattctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttgcgttgttcagaaaatcgtcggatatactctcgaagggattctccggatttctggataacgttgtaaagatcatattgtgtgccaggacgctcgaaggtgccttggaagttggcgatgaagtggtcgcgtaattcggcccaagatccgatcgtaccacggggcagtccatggagccaagatcgggcggaatctgccaaagccactggtaaataattcgccatggccttattgtctcctcctgctgcgcggattgcgagaccgtagacggtgagccacgattctgggttagtggtaccgtcgtacttctctattccagtcggtttgaagccggctggccaatccactcgacgcaggtcgtcggtgaaggctgctaccccatcaaggtcgtcgtcgtagcggtctggcgagtggtgacggcctcgagctgctcggcgctgcatgatcgtgtcgcgaagatcgatggggcggcgacgaggcggtgaacgtggccgttctactcggcgctccccacggtagtcgggaggcgagtgcacggaccgctcgtcgtgacccctgctcctgcgattggatcctgcgccggtgatgctgaggcttggatgacggtagtcctgagatcggaagtgtggaactcggctaccagtcggcgtgtggacgctttcggagttaactggaaccgaggccgcaatcatggtcttggtctggttcaagatgttgatgacatgatcagattggttgtgctcgttttccttgaggggggtgtcgaggagggtgatcgcggcaaccgcattctgctgaggggtacggaaaaccggtatcccttcaacatcctgctggccgatgagatcacgcgctcggcgcccagcttccaaggttcgctgccgtcggtcttcagcctccttcgcgttccgctcgtgcacctgctgctcccgccgtagcgcgctcttgctcttgtgcttggcgctcctgctccagtcggcggcgctcgatctcgcaacgtgtttcggcttcccgggcttggcgctgctcctccgtttcattgtcggccataaagacgccgaagaaaagaggagtgcagttgtcttctaggcttccgtcgaagtcgtcaagatccgcgtcgtcgtagtagcgagaaccaaactcatcgtattccacgatttcggtgggacgtgagtcgacggtgggagagctgtagtagccatccagttggtccgtcgaaaccgtgccgagtggttggaggatgacgccgacttccctgaagctaggcgaaatcggtgttaagaccgacttccgcccaggcctacgggatggagacggcgtggcggtggagacggctgccgaatcgtcagggagctgcatcaagatcgatgggtaaggctcatcatcttgatctggcgttgttggagtagatgcgatctcggccgagtggtttgaagccgactcgatcgagatggtcttgaagtaactttctgccgcgtttgggaatccaaacgggactggaagtcgattatctcccgactggtctgattccgagtcaaggagagaaatcttgccgaagttgttggtgacgaagtcgaggctgccgaaccgaaacgtctgcccgggtggaaagacgaagtcgtcgatgccggtgacggaacccatcgcactgatcggcgaaaagcttgacgctacccctacctggcgcgccaactgtcgaaactagatttcggcaataataaaagggggtggctatcaagctagaaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaaacccgagatacagataagatattctatctacattaggtatcctgtacccagttcgaataccatcgccgtgtagatatgggatacccataatctccacaagttccaatctttttcttcaaactttcaactttttaatcacatcaaaacttttctatacacacaaacttctaacttttccgttacatcgttccaatttcaactaaacttccaattttagcgtgaactaaacacacccttagagaagtgtaaaagtgcaatgctttgttcgtaacaaatctacccctgccaccgccatgtataaaaaaaaaggagaaaaagatcatgcatatgatgcattgaacctacagaaagctagcaatctactccctccatctgaaaaaaagacaacctcctagtacaatgtctacatttgttctactaggaagggtcacatcccattttaagttatctttttttttggacggatggagtagacgcctcatgtgatggatctttgatcgacagaaacctgacattttcatatctgaaactgtagtcgacattctagcagagaccaaatctcctctccttaaaggcataatccttatgcatgatcactgcaccccaagtgatgctaccacagcacgcgcgcctccactgcacactccaccactccccaaattcacccccaatccatgcattttgcacatttgcattcttcctactcgatcgatcgcccatag

SEQ ID NO: 45826 - DNA, 1656 bp, Oryza sativa
ttcctgcagcccaaattactacgcataataattacgtgcatgaagatgcgttttccgtagaaattttgtgtgtgctgtgtgcaagtgtggtttcgtaggcgtactattttacccgatttcaagttaaacggtgtaaaatgtttatagaattagagttgatttttcaatatattgatgtgcaaagttggtgtattctatgctctgacttgtaagccttttacaagtttggcgaaaagttgatttttcatactccaataatataggagtatttgagagtcagagagtggaaggataataaaactaactttctccttattccaaaattcaatactccctccatccctaaatattaaacgccgttgacttttttaaatatgtttggccgttcgtcttattaaaaaaatttgtgaaatatgcaaaactatatatatacataaaaatatatttaacaatgaatcaaatgatagaaaaaaattaataattacttaatttttttaaataacacgaaaggtcaaatatgtttaaaaaagtcaacggcgtcaattatttagagacggagggagtatatttgagagccagaactttggagcaagtactatcactacttgtttgtagctaattaccaatattattgcaaacgctggccatggccatggagaagcagcagcttcgcttctccgtgcgccggcgagagcccgagctcgtcggccccgccgcgccgacacctcgcgagaccaagcggctgtccgacctcgacgaccacgagacgctgcgtgtccaggtcaagttcgctttcttctaccgcgccggcggcgagcacgacgcggcgggcgtcgtccggcgcgcgctcggcgaggcgctggtgccgtactacccactcgccgggcgcgtccgggaggtggaggagcggaagcttgtcgtcgactgcaccggcgagggcgtgctgttcgtcgaggccgacgccgacgtgcggctggaggagctggaggaggacggtgacggcggcggtgagctgaggccgccgttcccgtccatggaccagctgctgctcgacgtcgagggctccggcggcggcgtgctcggctcgccgttgctgctcgtgcaggtgacccggctgctctgcggcggcttcgtcctcgcggtccgcgtcaaccacaccatgtgcgacgccatcggcgccgcgcagttcctgctcgccgtcggcgagctcgcccgcgggctccccgccccgacggtgcggcctgcatggtgccgcgagctcctcgacgcgcgtagcccaccggcgccgtcgtttcctcaccgcgagttcgacgtcgtgccgccgccgccgccgcccggcgacctcgtgacacgcaccttcaccttcacggccgccgacgtcgccgcgatcagggaaggcctcccaccgcgcctccgcggcacggcgaagacgttcgaggcgctcacggcgttcctctggagagcccgcacggcggcgctggagctccccgacggcgaggacgcgcgcctggtggtgatcgcgaacctcaggggcgtcgccgagctgaacctccccggcggctactacggcaacgcgtgcgtcgccccgacggcgatcaccaccggcgaggcgctgctgccgcgcgggtcgctgggcgacgcggcggagatggtgcg

SEQ ID NO: 45827 - DNA, 2402 bp, Oryza sativa
ggcaatggagcggttcgcgtcggagatggagaagctgtacacgcggcccaactaatccatccttaagtgggcctggcccatttaggaccacaaggaattcggatcgccaattggcccataatagttcagacatgggtccacgaagcaagagagttttgtacaccttaagtaccgacgaagcacctagtatgtacgaggttcaaatagttgtatacaaattccacaaaatttgagaagctatatagattgtaatgatacaagtcaatccacaaacaagcaaatataaattcatcgacacaatggagaagctgtacactcggcccaactaggcccatctggttctcgcgaagagggcctggcacagaaaggttgagatttggactttcaactaggagaaagctgttcaacctgctgttgctccttgcaatatttgaaggtattgtgtctatgaattacctgtacctaaaagcatccttgtgcttcatttagttaaatctgggatctgatcacttaatacctagtaattgaaggtgaggtggtacaccttttttttttcttttttttacttttgggtatcaatggttcctgcttgtcataccaattcagtcttttccaggaataatgagttaacgacaattaacaatgatttatatctcgtttcccattataacctcggtgtgaagcattgtttactgagtcatcctatggaattcgtcctacaagaatcctttgctatgaattattctgaaatgttgcagcaagatcctgagataaatttgctaatcaagtggtaaagatgataaaagcaaatatgcgactataacaaggatgatgcctttgaggttgatttcaataactactccctctgtccctaaatatttacgacgttgactattttaaacatgtttgactgttcgtcttattcaaaaaatttaagtaattattaattcttttcctatcatttgatttattgttaaatatacttttatgtatacatatagttttacatatttcacaacatgtttaaaaaagtcaacggcttcaaatatttagggacgaagggagtacatcatagaagcatttgttttttaaaaaatgtataatacagtgatgaatattgtttttggaatgaacttaaatactgtaacatacatcaatacatttttttcaatcacataattaagttttttttgggtatatattcatggtatttcttctttgacataagttgcagttactacttcctcatcggagcagctaacacaggcatatgcacttgagcggctgtgccaatcgaggaagaagatcggtgtccgcctattgaatttcacatcactatttcacaatacctctgctggatgtctttggttcttaaaagagcccacagtcagaaacatccagggatcttccggctagctttacaaggtggtagggtagatgacctgggtaccccttctaattatttgatactagtttattccctaatattcgtgttttttaaaagagccctacaattttggagatatccgtgagattgacattcacgatttagtttttttttttcataattgagtgcactcttgaaatctagtctcatattagggactagaatgcattgcgcaatagatcacccacataggattgacagaacatgcaggccagaagatttggagttatcagtaagaaaaatctgaacatgagactctggcattatacttctgtatgattactgctgatgcagcccaaaataaccgaattttctgttcctcctacttatttgatctttgtatattttttctgttactactatggcaagattgtaatgttgcaggtagacattatcttttgccatgttgtgtatgatgcaattgagataaatagatattcaaattgcgttaacaattttgtctgcataggaatttgcacggtgcacggtcccaaaagaacacaaagggtagcatttttctcaatttcatagaaattttaggggcaattattttcttctctttaaagccaaaggcaaaaatgttcccttcttccgatggtgaaaccgggaatgcgtaatgtattctttccctactaattattactaaaattttatcattttgtttgaaatcttttttttacctctaagtgaagaaaagtttttagttgggcttgtatcctgatgatctaataactgttattttagtttttccgttgtaacgcatgggtatcctcctagtaatttctaaaaatacttgtcttagaaatatggagatcatatgtataggttagtattaagaaaaatgtttgagcgtaccaatcatatagtagaaaatagtggttaaagttattttttgaagagtgcatctttatccaaaacaataattgttatcaaactggaggagtatatgccgtta

SEQ ID NO: 45828 - DNA, 25194 bp, Oryza sativa
ttattgttgttcggtcggatgggggccttggtaaatctgtccataacattttttaaagttaaataaaaatgttgttcgaggcatctgtatataattcacggtggaataagaagcaaagcatgcaaggcttatggagccttaaagttagcaaacgcctttggttatttcttttctcgttgaagattagttattaatgaggctgggttgtgctttcttaaaagcagggctccaggccttttctcttaaaaaggaaaagaaaaagattgtctccttaacggcaccttgcttgcttacagtccgaggtactattctaaatagcttgcgaggaacaaaagatctactgggcatgcagcttgccggaaaaaaaattaagatagagattaaagattttctcttagtcacttcggtgatcaagttttaaatcgtttagatttccttccaagcaactcattggccaaagatatatagtttttcgtacattgatatcaatgctccaaaaattttatatcgtggtacaaattttaaatacaaaaaatacaaaatactattatgcatgagaatgacacgtggagcatagccgagcctccatatcaataaccggtactccctccatcacattttaaatgcaattgtgggtttccgtgtccgacgtttaaaataagacgaagggagtatagcacattcgatggctttttttcttccgatggtacgtaccaaagagattggcccctatatatatagtagtagattgctatcagctgacacagtcgtgtagtgtgtagcctgctagggtaattgaaagaaattacaccatggatgaatcaacatctgctttggatggtgatgagaagaggaggtcgaggaaggagagcccgctgccggaagagaagttcaacatcttcctactctgcactgctttcgtgtacagggtgatgaatggcctcgcacactggccactatctgggcgaccgtcgttctgctcggtggattctccaccctcgtcaagaagcaggatttctggtacgtcaccgtcatcgccttcgtccaatccatcgggtatgtatatatattttttcactcttccttcgatcgcttctaacttgtctgaattagacaaattttaaagtactgaccctaaagagtacttcttcagtcaaaaaaaaaaaaaaagctcaacctactttaaaatttgtacgaatctaggttgagtcttttttaggacggaaggaatacgtactttaagattgaaatagcacatcaattttttttggagacatgcctccctccccctgtattgcttgaatccataatacgtgctgttttgtatttttcatcccatgctccatttgtttggtttttgtgttctttaggcctctagtggttgaaatcgttccccccacccccaattttcttcaaactgagataaagaaatattgtctataaacaccatcacagtatccaaactttattctatacaacattaagatgcagttaagttcaaaaggtccacccaacgaaaatgccaagcagtatgtttcacatgtgaattataattcatcaaaactatcgagtccaacaggaaaatattatgcagtacattacctgaattgcatagaccacacagcattgatccaatagaaaaggcggcccaagcccatcatttgacattgcatgcgcctagtggaaaaaaaatatcagaaattagcaggtgcgaaaaaaaaaggcactggtcaatgaaatgtcacaagaaactacaaagcagtgaaagcacaagccaggctagcacctgacaataaatctcggcccagaatagaagcgaaattgcgtatgtccgtgaagaatgtgagcccaggcatatctacaagaacatttttgaagtatttgcggcagaacattgctcaagatcataacttgaatgaattctagcaccaatcaaatcatcaaattagccgcaattcagaaacctctggatgtagtggcaagctgatgtgtatgtgccgttgcatagaagagtctgcaatatgacgcttgttcatttaaggcctagaaccaaaacaaggtgacttcattaggacgctgaccaccaaaatacaaagcataactaaaaaaaggtcgttacacagataatccaaactgaattagcagcttgtacagtgacaaaaaaaaaatgtccaaaccaaaagtacacagccacactagatttctgaactaaaaagaaacctagagttatataagctctgatgaatctgtgccatgctgattcaaggaaatattcaattgtagtagtatgtctgaacttttctgcaagttccatcagtaaacagggcatactaatgctgtaactagagaaacacataggactaacattacaaaaaatgttagcgattaaattcagagattgtactagttcaccactcatacactaaaaacatctagtcttacaaaagttctggatgttacaaaagttctgacgagatgcacctaatagtacagtggcaaaaggtatgtggttttcaactctaaggtcccgtgttcaatccccatcacacataatttcttcttaaaaaaagtttggagggacgtctctccctccaaatctccttttcttttttttttccaaaattctgactaaaaatcatgtgatttgctccggtgaggtactggtatttcacgataccaaatcgtttccgttcattatctcaaaaatcatttctaggcttacaagcttctgtatgaaatgaaatatctaaccaaaaagaatggagcttcaatgattatgaaaaaaaaatcattgatcatgcaacacgatgcatcgcacaatctatgatgggctgattttaagagtaaattaccctgtcaccatcactgattttaagagtaatttactcttaaaatcagcacatcataggaaacaaactcttgattgccatagttttgatagttaccctgtgatggtgataaaatccatgaacacagtgatcacaatgacatgcagtgctttgctgctcagtttcacaattagtttgccaaatcactcctgtcaagcattggaatggaaacttagaattcacaactacgcacaagacacagaaacatagcataaaagtaaagggtgatggcatccataaaaaaacaacccaggatcgatgcctttcttcgatgcgaatggcaactgcaggtagtctaaggctttccagactcagcaccacattaccaatattatttcctccacagaacatatacaactaaaaaactaaatcaccgtgtgagagacaacaaataaccacaaaaaaaaagtgcaaatgtgatcatcaactctaagaaaattagctagtcattagtacaaacacaaatcatcatcatgttcagagaaaatctgaaaagttcttttgaaaaaagaagctctagatacataaacatgacagcaaaaaaacagcacattccaatcgacttgttaacttgtagaggcccccattcacttgtaggtatcgttagctcaaaagctgaaaatattactcagtaaattcaagtctagaaacagagaatgccagctccttgaaacaaaatttagaaaatctgaaatttctaagcaaacaaatggatatataatgtgcctattcagagacttgaacatctaggcatggtactgaatgcttcgtaaaagagaacttttaaaatttacattgctattagtaaatggaggtaaaatgaaattgttatcagtgaaattaacctcagagaagtcatccgaactaagtactataattgaacttaaataaaacactgcagtattcacatatgttacaaaaagaccatgctgtcaatcacacatgtattcagacagaacagaactagcagagtacacaagtgccaactctcaattatataccactcacaacctcactgatagcacaactaaacaccactagacaaacatatattggaaaaaatgcatatccgagaaaaaagtaagcttcatctaaataggaaaattggatgtgtacatccttttcacggatgttgaggccaggttttttaatccattatctaaaaaaatataaataggaacaaactaaatacataaatatgacatgaacaaaaccaaaagataaccacctatatgctttatgggtgaactccattggtcattatgtcacatagtaaaaacaaaatcaaagatcaacaaacataatgttgattatttgatgaaacaatatgtcttttggagcacatttgaataaaagggcatacatgtcatagagtagtactgactgagtcagatagttcagtatgaaaaatgtaaatatgtacagccaataacaaagaaagccatgttcacaggacaaagcaaattaagagatggatttctagccttctagattcttaccaaattctaacaaaacctcgggaattgcaagttcagacctacaaacagataatgccgcctttaaagttctgcatgcagtgaaatatcaaacataacaatatggtaggttgaaacaactaaattaatggaaactacatacaaaatggtaggcgaaattaatgaaaccatgcatacaaaactaacaaataatacttatatgctaatctatatcctcaaaccaagaattagctaactatgaactagcatataatacttgtatgctaatttatacataacttaaaaaactaggtactatctgctttctctatcaaaaatcaacccagggcttttacttgcagaaattatctagatgattgaagtttcctaacaaaactactcatgttccatgtgaacaaaacaattctaatttcctaaacaaaactgtccatgttcaatgtgaacaaaacatagtatacatagttgcttgttttgaaaaaaaattaaggacgaatgagaaagactgtaacaccttaaatgagagacatggggagagtggaaaggtggtttgggggcgggggtgggggggggggtaataaagtgagaaatttgaatgagagttgattggttggacaacaagtactctagaattccttacattgtaggacaaaattcaaatgcttggatcccttatattacgggatggaggcagtagatatcgagaatgcatataatattgcttctcatttaaggaaaggatattgctcaagtaaactgacacaggagatttctctgaacattcttaactaataaaagatatgttatcaagtaaaattgtcaattgatacaaaactagagcaaaatatatagtttccctagacaaaaaggagaccaacatgattttgctaaaaggagttatgagtaactggagcaaaatgtccttgtactatacaaaatatgaaactaaagttagactaaacttatcaaaatatgaaactgaaacttgtactgtacaaactaaatcatttttgtatcaaaatttatgtaaatttatccgctatgaatgatttgtacaatttaaaatattgttcatataaaaaatgtatataactttttccgctggaaattatataacttttatatcactatcggttcttgagaagaaccggtagggatttcaatggttctccttatgattaaaaccggtagtgatattatgggttcttcctatgaactggtagcttaagaaaggtcgggatgactcttttcctaacagtgatagtgatatgtgaagctcacagaagtatacattgcaatgcattgacaggattttgggtggttacgaggatcctgcacatcaaattttcttgcacgcaccagaagcactaataaagaacagggaggccgaagcttgggagcgacgaaagagttggtggaggcgcagaggaacacagcagcagcagcaacaacaacccagaggaaggcccagaagaagaaaacaagaggagaaagcacggaagtggtgcgacgacatctatgggttccaagccttccttgggattgccatctacgtcgccatgtggttgggcaaggtcgccgctgtggccacctgcatagctctatcctcgaagcgtctcgagaagcaagactatctggaatccggggacaatgagaaaggtgaccaccagaacatcaggtggtccctcaatatcttctacagtctggtgcttgcccagggaatcatcttcatctgcatgctactgaacccactgactgtttattttgtgcttaaggtccgaaggaagtacaagctatttgagccctctggtctcaagataatctaccgttacaagaagtacaattacctggggttcattgctggcaatgtacgtgccaccctcaacatgcacctggtcacctttgccaagaatttggcagtgtccaacacgatcgatgaccagttagctggtgttcgggccatggaccgcatcctcatgtcagtggagtttagaagcctggcccttaggaggcttcgagcttccatggaacccgacgatttggggaagctgatcgatatgctaggcttcgtcagtaccatggaggaggaacagaatatcatcagaggccatgctgcaagagttgtgctcaaattcagtcctgaccttatgcttcagagttatcctcaaatcctctacctcatttcctcttccctgctcagcacatccaacaagagggtgtgcaagtgcaacatggactctgacttagtctggtttggcctgcacatcctggacaagctcacggacaacccagaaaattgcaggaaagccaaagacgatgacagtgatctattattgcccatgattatagacctagccaacctttgtggacatggtcatggcaacagcgtaaggagtaacactaccatttctgactcttggattgaacaagagattattcctttgcttcaaaaagaagatgatattcctcttcctttcatcaacaagattgaccaagaaattattgttggcatggcactcaacatcttgagcaagctgatcgctgtgccgggtgaggctggggaaaaactaaggaaagaaacctcaaaagacttgcacttcctgacaaacactgggatgatcatggagcatgtcgaagcaacaagagtcatatcatgcttagctgtggataaggaagcacggcaagacattggcaagttgcctgagatcatcaagaaacttaaggattgtctactttccaagacaccatatgtaaatatgacgaaagtagctgccaagttgttgcttatggagtacaccagtgaggaattattaaaccgtgttctgcttttcatcgaggaaaatcgtactgtagaagatcaaagcttttcactaccaatttcagccttcatagaagaactttatcttgatcaacttccccagagcgtggtacagagacttgatctggaagatgtactttcctcgccacgggtgaatcactctgaagcagctgctaaagcattaattctgctcactacaggatgtgaaaacaatgttgaagctttcctaaaagggatcaatgaaaaggagttgaacaagatagtgaatgtgctctcttcagaagacagagataaagaaaagagaagggcgctggcacaatttgaaggacgacatcatctggacccagaaacattgcgcatagtcaaaaaaataatcttggctgagggtgaagaacaggaaacaagtatgcatgcaaaactcctgcagaatttgcgtgcctactcaggaccaaaagaatttgatgagtacatgaaattaatagatgcagcactgccaaaggtaattttgttttaattctagccatcatctttggatgtaatctactcaacatatatattttgtatgtatgcatcagctcagaataatgcctcatcaccattttactttatcacgacaatattcattgactaagcaatatggtgacaatgatcgatatatctatctgaaaatttaattatataggtgctcaaagcagtcgtagatgcagtggcgactttggaggatccatcatcatcagaaaatctgaaccatgtaagaaaatagtagctgttttcccttacctactgactacttcatttgcacctagtctaacttcccaattcacaaaagaaacaattttctttggatatatatgtaggtaaaggatgacctgtggatcaaacaaggcaaagtactagagagctttataggcctcgcagtgcagatttgtaggtccccgaacgcaacgagtgatttctccactgcactaaaagatgccaatcttactgtgcacacattcatcaagaagcttaagaagatattagaagtctacaggtctccaagtactgattttccatgcataagggtatccacacttgagttaattacttggatggtcgaagaaaacagcagctacagggaaatactcctaaaatgtggaatatatgaggaactgaatgaagtggcaaggactgctagaaaacttgagagcttcaagctgtttcactgcggtgttgggattcctacggatggtccaattgaatgcatctcttcccgcgcaactgaattacaagaaaagcttcagcaaagccccaattttgagaaaaggtactgtttatgcccttttagttaaaacatcagttcaaacatacttagactcctcttggagaattcgtaaacccaaacttaaatgtttgcctttaatctgccaattgtcaaggactctgccatgtactcccttcgtcacaaaatataaggtattttgaccggatggggcatatcctagtactacgaatctagatagagagtccgttccagatttttagtattagaatatgtctcattcggtcaaaataccttatattttgggatggagggagtagtaaacagttcccaagttggctgtgatttcatctaaaatgacttccttacttgttcttgcagatacatctgctatggagaacatgcaagcagcatatctgttttaattgcttagaacagtcatttgcttggttctttctgaccaccaacaccatcatcatccttttgtgtttgtgccaaccaaatttcgtgtttgagtgcttgtgttttcatttgcttggttatttctgaccaccaacatcatcaccatccttttgtgtttgtgccaaccaaaattcgtgtctgagtgcttgtgttttcatttggatagtgtgtcggaatggttgtgtttttaaacccagtgtcagaattttgtgagactataataatttccatggataccatcaaatcaccatggcatgctacaaggttgtgcaagtttcttgtatgttcgtatgatttttttttctgcaaaatatccatcacaaaacaccatatcaataacctcatatcatagatgaactcaccgacattgtaactagtgtgtctaccttgtttcatatcgaccatgttcaactgcgtgtgccctaaagaatgaggcgatcaagcaaattcgcagtataatattcaagcatgatccaaacagagccgtaaagctaatccgcaccagatattccctaaaccatgattaagccaccaaataaaccaaggagaccatcaaaaagttgatttacacgcatcgcattcatagcgcgcagaaatcctcagatagattttcccctcctccgctatttagaatttcatacattaggttagattaactaactacaaccaggcacaaactttccaacccagcagcatcctccaatctagcttggaaccaaatcggtaactcgcccaaaaataaaaagggggcaaaaatgcagcgaggaggagaggatgagagagcgtacgagctagtgcaggctccatccgcccggtcgccacgctcgtcggccgtcggccaccccgctttctccgccgtcgccgtcgccgtcgccgtcgcggcgccttcccatggcttggaggaactcgagcctgctccatttggattcgccgcagtagggaggggatttgggaggcccatgggccggtctgggtgttaattagtagcaggtaaggcccactttgatttaaaggaaggaattagttcactttaggtcccttactttgtcgccgagtccaaaattcgtccctggaccgaacgcatcccccaacttactgaaaaccaatgcaaacgagagctctcttagtagtattgtcgccagttttgactgacgtagctcatttgactaggccttcgccctatgtagtattgacatgacgtttacatgttaattcgatcctggaaaataataaaaattgttgggccacatgttagggcctgtttggcacagctccagctccagctccacccctcctgaagctggagctcagccaaacagtttcagctccaccaaaactgggagtggagttgggtggagctctctcacaaaatgtactagagttgtggagctgagtttaggcagctccacaactccactccagactcaactcctggagttatatttaggagttggagctgtaccaaacaggcccttagttacacacatagaatagtaaaaatggcagggcccatgtgttagatgtgcaactatttttttttatatcctacaataaatacacgttcttgcggtgtatatctatctcaaaataaaccactctagaattggatgggacattaccccgtaaaatgaatctggataagagcatgtccaaattcattgtatgaggtaacatcccgtctaattttagattgatttattttacaatggaggagtaaataaaagtccgagttgtgagccgctgaatggaatagttccatttcttagatgacaccctaatgatgtgctcctaacagctaattctcgctgtttggttggatggggaccgtggtaaatctgtccatattttctttatttttaaaagaaaagaaaaaaaaaaggcgtggaggcacctgcatatatcacgtcggaataagaactaaagcatgcaaggcttatggaaggcttaaagttaccaaactcctttggttatttctttaattttatcgttgaagatttaatgtctctgtatgtgtgctttattaaaagcagggctcttcggtcttttcttaaaagcaaaaaaaaatgtctgtctgtctccttgacaacaccttgctttcatattgtttttggtatattttttttacaattacacggtaaattcacacacgcacacaccactacacacgtaacaccatattcacacatccgtgaccgtgaatggggcttctaacacacgttcaaaaagaataaaaccaactatacatccctaacctcactaattaagtttccgctgaaaacacatgtttaaagagaatacacatcgatgatctaattaacggtcccattgtttcacttattcgtgaaataagccaaacgatagatttgtaagcgaaatgtaatctgtgaataaaatttttatatacgtgcttttagcgatctaaaagaaaaggctgaaaaataaacttcaataaaaaaaactttaaaatcagcttcaattttaaggttgaaaatttaaattttggctgataagtataagcgaaaagatgaggtctttcacgaccattgcatacgtttacgagcactgggaataaatatcaggatttaaattcagacgggttaaatcatacacccacaatttcatgaccgtaccacttgtgtttccttgttcctaggaactactccctccatattttaatatatgacaccgttgatttttcaaacaacgtttgatcattcgtcttattcaaatttttttgcaaatataaaaatatttatgttatacttaaagaatatttgatgataaattaagccacaataaaataaatgataattacattattttttgaataagatgaatggtcaaatgttgattaaaaagttaacggcgtcatacatattttaatatggagggagtacttattattctaaatagcttgtaagaaacaaaagatcgcctggccaagctttcattgccttaaaaaggctagcgacacacaaaactactggccattagtgcaacacaaacactgtgcctagtttagggtaatagccatagccaacgtacgatcgacgaccaatatggattcatctgctgcggatggtgagacgaaggaggagtcgtcgaaagtgaagatgttgctgccggaagatttcctcaacaccgtcctcctctgcactgctttcttgtacaaggcgatgaataccatcggcacgctggccaccatctgggcgaccgtcgtcctgctcggtggattctccaccctcatcaagaaggaggacttttggtacgtcaccgtcatcgccttcgtccaatccatcgggtaagcaccctaagatcctaagttaataggagcgaatttcagattgggttatttaacggctaagtccctagttggatatagaggccgggtaaaaaaaacccttctcttaaaaaaagtataattaattaagtacatcctcctccggagtattagcttgaataaaccaactttaatttcggtttagaatactggttaagcagtaattactccttccgttctttttttatttgacactgttaattaatattccctccatttcaaaatgtttgacaccgttgactttttagcacatgtttgatcattcgtcttattcaaaataatttgtgaaatatgtaaaactatatgtgtacatgaaagtatatttaacaatgaatcaaatgatatgaaaagaataaataattattttttgaataaaacgaatggtcaaatacatactgaaaagtcaacggtgtaaaatattttgaaacgaagggagggagtatataactagtgggatgactttatctcaatttgaccagtgggaacttttagttatgatgttttgatgaacttattagagatagtataatattatatctaagcatgtaaagtatactttgataatacatctttttaagtatatttcttaaaaaagtaagatgatcaatcaaagtttgtatattattaaactagcttataaaactctgtaacaaggtaaagggcaaaggagcgacgcaactaccaataggtgcccgatttttagaaaaaaaaatctgacactccgctcctctcctactagcctatgcgtcgtgactgtactatatctactgtttctactccagtaaattagcacatgtaagaaacctatatgcttgtgcacgcatggctgtatggttgtagcccttatctcaaccatacttttcatttctttaaatattttttcttctaaattaattatccgattttcaccattaaacttgttgcagttaaatctttataacaagatctcatacggttgtattttgatatggaaaatcaagcgttgtttcaccacttatagaaaattattttaccgtttgctaaatattccaactcactctataaaatgattcagagaaatatagcattcaaaaaatactaactgcaatacgaacaaccattatataaaacattgattctcgtgagacataaaaaatatataaaagatacaatatatttgtaaatatgtactattattaaaatatttttataacattgtataaaacattaagttgttacttttgacacattataaaatactaattggaacattcaaataacaacacgtgcaacatttacaaattaaatagcgaagcatagtataaatgctagttgaaacatttatataaaaccatgtgtaacatttaaaataataaaaaaagctaaaaaatcattggaatatagctacgtgtaatcttgttgtaaacatttaattgcaataaatttaatggtatgaccagattgtagattggagaagtaatttagggaaaaaatcatttaaatatatagagatgtatgcgtgcatggttagataagagcaaggataatagtaggctataagtaagctatatgcttatgtggaagagagagataaacaaaagtggggagtgttggctctcatgcaagagctaactgcacacaaactccaagaaatatgcattaaattcatggtgagagaaagagagaggatgaagaaaataaagataaccttatagccaatctactatatatgttagctttaatattgactaatagtaaatagtgagctctattattaaacttgctctaaagtgatatgcatggaggcaataaagtggacatgattatgcgcgtgatgatgagaatccgatattttgctagagcgtcaggcatccgacgcagagcattctcggaaaacaaggggtatataacacacgagaaactttttccgtttccatatcgaggccaatccagatgatgaggcttctctcactaacctcgttcagtttacggttatatcattaaattaatactatagttatgtcattgacatgtgggtcatagtaaaataagacgtacccacgtatcactaacacacggttagtgactccactgcaatctgcacaaagttactagatattcactttcgaccaatccatgtgacagtaaaagtcatagagaaagtgggatattggatcatggtacatccgttcagacgtctcgtgtcagtgacatgtggggttttcttggatcacatgtgggttaggagggtaagcctgtgtttagttcagtttaagcttccaaaaattccgtaacatcaaatatttaaacacatacatgaagcattaaatttggacgaaaaaaaaccaattacagtttgcatgtaaattacgagacgaatattttgagcctaattacgccatgatttgacaatatgatgctacagtaaacatttgctaatgacagattaattagacttaatagattcgtctcgcagtttataggcgaaatctataatttattttgttattagtctacatttaatactttaaatgttgtccgtatacttcaaaattttttctgaaaagtaactaaacacggcctaaatcctcaatttcaatccaataaatagagggtatatgatcaaattttgctataaaacccaacgatgtacaatgtttttttatgagatctcataaacattcgacgggcaaaagcgaagtagcacatataccaattgagattctcattgatgcaatgcaagtatattccaaacagcaaattatagtttaagctccttctcgacattgaattagctttatgttccatctcaacatcgaattatccaaactctgtatctatataaacttgtcctgcattttgatcaccatctccgctgctatcaccgtcgatcactgtaatcgttctcacggttagctgcacgggagtttgcagtactgactcgtcatcttctgatcctgaccatgctgatctcttctgttccatggcaaactgaggatgtccctagtccctacgtgcataaagagaaaatagatcagcaaatttacatgaaagtttctggaaatataggttggagaggctaaacacaatgaaagtagagggcaaaagctaaatataacaaggaaaatgtactgttagctatgttggtaaagaaaaaaaaatgtgtacaggctatgtaaaaatgagctataaaaatgttatagctaattttaacagaactcatgcatcttatataacgagtttgatcacaattaggcaataataggcatcacataatctatgctacttaaaaaatgcttgcgatgattatggataataatggatagatatatattctgtcaggagcaagaagattccctaaattttttcgcgaacgctagattccctaaatttaattgatccaccaatctttctaattcatttgtgggactggtcaaacaaaggaagccacattagcttctggataaacgttaaatttgctgacagaaactaattccaacttcgaataaaaaaggattagaaaaataatggaaactggcagctggcaagtgttgcaaggataatccaccaattaaataaacttgaagtcagttcatgcctgaactgagaagctaattagaccctatttattcctgcttctttgcaaattcagaatatacaaagatacctgaactgagcagcaggtagccgctcgctcggataatgcccgatctccatatatagctctcctctcccactccccgttgggcagcagggagttgcatggctgtaacatcaccttacctgtgtccctcgtgcaccattgccactgctttcggagtcggaggcaaggcaccctgcaacacaacagcaattttttagtcttatataaaggtagctagcttattggaaactgtgtgagtaaaacaaactctcatctatccagcctagctgaatccagacaattatttccggcacatgaattcattgtcatgccttattgttcctgtaatggaatacttcctccgtttcacaatgtaagtcattctagcattaacatcaatatgaatatgggaaatgttagaatgacttacattgtgaaacggagggagtatatggcatgagttttaaaactaataatttcagtactacttgtaacagagctagaaagagcatatacaaagcacgcaatgcagtagatcgatccacatgttcatgtgttgatgctacacaattgcacaagcagctatctaaattttggtagagtcatcttccgaaagaaacaaagaatcctctgaacccctagataattagtaatttaaaaagtggaaagcccaaaaggatgaaacaacatcgtcaagcgaactgcagaagacttcgcagcacatggtgggatggcagttgactgcatggtgatggacttcgatcatgagcgttagcacccccaaagattccctctacaatattataaatctaatcttgcaactctaatcagccgctgaagcaattagggaaatataactcatgttgtgatgccaaaaccactgaaacaaaatttcaagtgtattgcaatgccattggttgacgctagcaccatcagacatcaacacacaaactgtaaaagatgttgataatttccattttcgaataaattgatcgtttccccaaaatttaatgccgagaaatgtgaatgtcctgcatgccttgtgattgcttctcctgcatgtatagatggccaaaaggcctgggcccgacggcccggcccacagcacgggtttggcccggcccaggcacggcacgacccgactagtgtagagcccatgcctaggcctctgcctcggtacggaaggccggccggtgggctttcgtgccttggagccggcccagcacggcctgagtcttattaggccgtgcctgggccattgatgcagcccgtgggcgggcacggttcagcccggctgtaggtcgggtcgtgtcggcccgactgatctcgggcccaggcctggtcgtgctcgggccgagcggcccatttcactcactaatagctcttttcactcactaatcagcaaacctaaaaaatacatactagcactaatgtacagcattctcgagatgttcaacttgttaaaaaaaacttaaccaagtctatcactatgtcacgtggccaaaaccacctataaaaacacactatggggttatttgaacatgtttctatatttcaagggatagaataccctgtttcctactttatggggttaagtagaccaacattaatacttcaggggataaagtagaacttttcctagatagatttatacaaattaaaatattgtttatacaaaaggtttttattcaccgaaaaattgtatcacttttatatcactgtcaccagggttcttgagaaaataaaagcagtcagtacgtatttcagtggttttcctataaaacccggcagatagtgacattgcgggttctttgtatgaattggtagtttaatattaagaagggctaggatgactctttttgtagtagtgttatatgaagctcaccgcagtacaattcattgacaggtttttgggtggttacgaggatcctgcacagcaaattttcctgcgcgcaccagaagcactaatgaagtacaaaaggacctcaactttgaagggattaagttggtggaggcgcagaggaacacagcagcagcagcaagaacccacaagaaggaccagaggaggaagaaggcacaaagaggagaaaatatggtacctgtgcagcatctatgggtgccaagccttgctcgggatgaccatccttgccgccgtgtggttggccagggtggccgctgtggtcactgtcttagccctatcctggaagcgtctcaagaagcaagactacttgaatcccggggacatcatgaatgaccaaaaccagaacatcacgtggtccctcaacatcttctacagcttggtgtttgcccagggaatcatgttcgtcaccatactgctcaacccactgagctattattttctgttcaatgccgggatcaagtacaaactatttgacccctccggtctcaagataattttgaattacaagaggtgcaattacctggaattcattgccgggaatgtgaaagcaaccttgcaaatgcacctggtcaccttcgccaagaaactagcggtatccaacatggccgatgacaagttacttggtgtcggtgccatggaccgcatcctcaggtcgatggagttcagaagcctagctcttaggaagcttcgagctttcatggaacccgacgagctggggaagctggttaacatgctaggttacgacaagagccacaaaaacaagaccacggaggaggaggatatcagaggccataccgcaagagtggtgctgaaacttagtccagatcttctggttcagagttatcctcagatcctctatgccatatcttcttccctgctcagcacatccaagtccaacaacaagagggtgtgcaagtgcaacatggattctgacttggtctggtttggcctgcgtatcctagacaagctcacggacaacccagaaaactgtaggaaagccaccaacgacgagagcggtggtgatctattgtccaccatcatagacctcaccatcccatgttgtcatggtcatggtcatggccgcagcatgaggagtaacactagtaccatttctgattcttggattgaacaggagattatccctttgcttcaaacagaaaacgagattcctcttcctttcatcgacaagcttgaccaagaaattattgttggcatggcactcaacatcttgagcaagctggtcgctgcaccggatgaggctggggagaaactcagaaaagaaacatcaaagcatgtgcatttcctgaccaacactgggatgatcttggaccatgtccaggcaacaagagtcatatcatgcttagcagtggataaggaaggccgagaatatatcggcaagtttcctgagatcatcaagaaacttaaggattgtctactttccaagacaccatacgtaaatataactaaagtagctgccaagctgttggttctggagtgcactggtgatgagcaattgttaaaccaaatccagcttttcattgaggaaaatcgtaccgtggaagatcaaagcttttcactaccaatttcagccttcattgaagaacttgattttgatcaacttcaccagccatggatatggaattttgtacagagccttgatgtggaagatgcacttttcgcgccacgggtgaatcactctgacgcagctgctaaagcattaattttgctcaccacagaatgtgcgagcaatgttgaagctttcctacaagggatcaataaagaagagttgaacaagatagtgaatgcactctcttctgaagatggagacaaagagaagagaagggcgctggcacaatttgaaggacgacgtaatctggacccagaaacattgcgcagagtcaaaaaaataatattggctgagggtgaagaacaggcaacaggtatgcatgcaaaactcctgcagaatttgcgtgcctattcaggaccaaaagaatttgatgagtacatgaaattgatagatgcagcactgccaaaggtaatttcgttttagttctagccattctctttggatgtagtctactaaatatatatattatgtatatatgcataggctcagaattaacgcatcatcaccattttccttcaccgcaactatattcattgactaaagcaatatggtaacaacgaccaatatatctctctgaaaattgaattatataggtgctcaaagcagtcgtagatgcagtggcaactttggaggatccatcatcagcagaaaatctggaccatgtaagaaaatagtagttgttttcccttacctcctgactacttcatttgcacctagtctaacttcccaattcacaaacaattttctttggatatatatatgtaggtgaaggatgacatgtggatcaaacaaggcaaagtactagagagctttataggcctcgcagtgcagatttgtaggtccccgaacaaaagaagtgatttctccactgcactgaaatatgccaatcttactgcggacacattgatcaagaagcttaagaagatattagaagtgtacatgtctccaagtactgattttccatgcataagggtatccacacttgagttaattacttggatggtcgaagaaaacaacagctactgggaaatactcctacaatgtggagtatatgaggaactgaatgaagtggcaaggactgctagaaaacttgagagcttcaagctgtttcactgcggtatcgggattcctacggaaagaactatcgaatgcatctcttccctcgcaactaaattacaagaaaagcttaagaaaatccccgatttcgaaagaaggtattgtttttgcccttttaggcaaaatgtcagttcaaacatacttagactcctcaaggagaattcgtaaatccaaacttaaatgtttgtctttaatctgccaattgtcaagggctctgccatgtactccctccgtttcacaatgtaagtcattctagcatttcccacattcatattgatgttaatgaatctagacatatatatctatctagattcattaacaacaatatgaatgtgggaaatgttagaatgacttacattatgaaacggaggaagtagtaaacagtaaaagacttaatatgatgtgtcaaatttcccaagctggctatgatttcatctaaaatgactttcttacttgttcttacagataccgctatggagaacatgcaagccgcatatctgttttaattgcttaaaacagtcatctgcttggtactttttgaccaccaatataggcatcatctttttgtgtttgtcccaaccaaaattcatgtctgagtgcttgagttttcatttgcttggttctttctaaccaccaacattatcatcatcctttcgtgtttgtgccaaccaaaatccatgtctgagtgcttgtgttttcattgggataatgtgtcagaatggttgtgtttttaaacccagtgtaacaattttgtatgactacaataatttccccactagctgcgtcattgccccaagcgcaaagataccatcagatcaccatgggatgctacaagtgttgtgcaaggtagtgcatgtatcatgtgtttcttgtatgctcgtatgatttgtctgttaaatatgcatcacatcacactactacagaatgtcatgtccataacctcataacatagaccatatccataacctcgtaacatagaccgactcaccgctatctataaagataccatagacggtttctcaaagtggcttatgttggtacatggttcgtaactagtggcttttagggataaattaaacactaaaggcaacatggtaaataagaactgggacaacaaccctcactgtgacatctgctctgcccagcaatagaaacataagaccatattattctatgatgcaaggctgctacagtcttatgggagaaattaggacttctagacctagctaattcgtcagagtcggcctcaattttcttagaagcagttattgacagccatcacaacattcagggtatagaacccatttggtttgcagcttgtgcacacacaattttggaaagcaagaaacattaggaattttgaagggcaacaagccagactttcaaacacaactcaataaatggttcataagtagtgcgtctaccttatttcatatcgaccatatttagcacttatatgaactataggatcatatggatactataattttcaggaactccagactaccatcccaactgcgtgtgcccaaaagaagaagggtgatggcattcttttgcataaagggaaagaaccaaatgaaaaaatataaatggataatcagaagagtgacaaaaatgagaaactactacttaaataaaactgaatctttataaaagcacaggacaggagcctgtgggtaatcaaattagcttagttgcatgaagctcgtagctttttgaaaattgtatgtattcttctctaagaatcagaaaccttggccgctgactcatatcgacaatattattggttaatgaaaaaggaacaaatcaattgagacacaacatgcattacaagcgaagatgaagctttttgctactgttgtgataaagatattcgcttgaatggaatttaattggtaaggaagagcatacacaatcagattgaaatcacaatgggataaatcagaacatatataggagaggctttgctaccatgaaacaggctctctctagctcaagatctagatggaaaagatttagcgagggtttaaaggtaggtcgtaattttggtgtacctcctcccaatatagtattcaacgcattctgtaaacagatctctaaagcaaattcgcaccagatactccctaaaccagctactaatcgacctaataaaccaacgagaccatcccaaaagttgatttacacgtatcgcattcggattcatagcagaaatcctcagatggattcccactctcgcgctatttagaattcatacattaggttagattaactaactccaaccaggcacacacacaaaataataaaaaagaaaaaggcaaaaatgcagcgaggagggggagagggatggaggatgagagagcgtacgaaatcatctgattgaatcggagcgccatgcgggctccggctcgaggcagcgagctccctccgcccgccaccctcatccgccgtcggccaccccgctttctcggccgccgccgccgccaccgcgctgtcttgcgatgactcgtcctccctcccatggcgacctcgagtcttctccatttggatttttggattcgccgccatggcaccgcaatagggacggtttttcttttcctttttttttgatttgggggcgacggacttgctatggtcccgacggatttggggttgggcgaagattaaaatttgtgtgccatgtttgttactctgtcaaacggtctacttcgtatgaatactttctatacgacatatcgtcttacgtaaaaaagattaatcttgtctttatcttcagaagaaagaaacaccacctatatttgctactacagtgctatatttcatttcttttcttttgatgaggatacgtgctcagtagaggaaagaagattgcagttaagataaattttaaatgtttgaagttattgtattttgtggatttttgattatatgagaatgtggttgtgccatagccaataaaaataaggccttattcggatcggagggaaaaatgaaggacatgtgatcattcgtttcatactccctccatccaaaaaaaaagccaacttagatggggatgggacaccatctaggacaatgaatctggacatgtctagattcgttgtctcgttgttctaggtggtgacccatccgcatctaagttagctttttttaaggacagggggagtatgaagtagtcacatgaatgcccaaggaattaggaatttttcccgtgctacagattttaagtgagaaacacatgaatttttccattcactctgaacttatttttctattcatttgcgtaggatccagacaaacatgcagctaatccaaacaccttcatatgtttttcaattatctgttttgcatttatattcttatcatatttctatgtttttttatgtttctgtattttttttttcaatgatgcgttccgaataagccctctgcaagcagcaggtaacaatgggttgcaacagtcactgtcatagctgaagcctcggcgagcgacatgttcggaacggagcagaatgaatagtgtgctacctaatgattacattattcgagtagcaccttaagatcttaaatttaaccgatttggctatatctcactcgaaagatttttttcttatctcactcgattttctcactcaaatttacagggtattttcttgtaaattacagtgtaacttatgaaacttacattgtaatttttgtaagttgcagtgtaattttttaatctttgcatgtaagttttaaaatttatattggatttggtctttttcttgaagatatggtaatttattgtccattatggtgtttcttagttgctttttatcttttactgtgtctattggattttaatccaaaaattaaaaatctgtgtgatatggtcataaaaatcttttgaaagatgcataggtactcccaatttaattcttcatccgagcgaattttaaggcttagttaaagaaaaaaaaacttactaataaaggcccaccaataaaaccacgcgcgatcggaataagttcacttcgtcacccttaactgtgatcgaaatctaatccatgaccctaaaccacaaaaccagatatatcgacccccaaacttatgggcgccggcaactagcaaggagaggatggcacggaggaaggcccgcccgccgccgtcgtcgccgcctccgctcgggcctccctggcgcccatcgctatcgcctctgctcgatcctcctctggcaccaccgccgctcgagtcgggtggccgccgccgtttgggatgccccgtcgcccggcgtcgtcgcctctgctcgagccgagcggcctccgcccatgaggcgcgcggcgaggctaggtgtgcgcggcgtgttggcctcggagggtggcgcggacggcctgggccgcgcgagagcgccagaggccggctcgatctggacgccgatctggatgtcgccgcggaggaggttggcgtcgaggtcgaggctgttgcgtggcgcctggaggcctccgtcgtttgtgccgccccgtcgcccgacgccgtcacctccgctcgacctgcctctagcgccgccgccgctctaccgggtggccgccgccgtttggcctccccgttgcccggcgccatcgcccatcaccgcctgtgggagacgtaggggaagaaggggggagaga

SEQ ID NO: 45829 - DNA, 5271 bp, Oryza sativa
cgaggcctaccgctgtggctaagcggcggcgtgtgccagcccaacccccgacgacgacgacgcgtggcgacggccgccgcgacacccgccgccacgtcgccccgccacgcgccgccccccggcgagctcctcctcctcttttataatcccagcctcgtctcccccgcgatgaccacccccctcgccgcgccacgtacgccgcatcgcatgcgcgcgctttccctcgccagagcaagtagcccgccgcctcttcttcttcacctccgacgagcccttgcacccgcgtcgtcgtcttctccggcgccggtgctgttgctgcgtcctgcggtttcttgttcttctttgtttgttagcgacagggcggcggcggctcgccggagcagcggcagcagcaggagaagcatggcgtcgcagcagttcccgccgcagaatcaggagacgcagccggggaaggagcacgccatggatccccgccccgaggccatcatccagagctacaagccagccaacaagctgaaggtcagtttactacttgatttgctgttcttctccgttcatgtcacgttcatgtcgtcgttcgtcggtgcaggacaaggtggcgatcgtgaccggcggcgactccggcatcgggcgggcggtgtgcctgtgcttcgcgctggagggcgcgacggtggcgttcacgtacgtgaaggggcaggaggagaaggacgcggaggagacgctccgcgcgctgcgcgacatcagggcgcgcaccggcgccaaggaccccatggcgatccccgccgacctcgggtacgacgacaactgccgcaaggtggtcgacgaggtcgccggcgcgtacggcggcgccatcgacatcctcgtcaacaacgccgccgagcagtacgagcgcccctccatcaccgacatcaccgaggacgacctggaacgcgtgttccgcaccaacatcttctcctacttcttcatgtcgaagcacgccgtgaagcggatgcgcgatcgccgcggcggcgccggcgccggcgggtgcagcatcatcaacacgtcgtcgatcaacgcgtacaaggggaacaagacgctgctggactacacggcgaccaagggcgccatcgtggcgttcacgagggcgctggcgctgcagctggcggaggaggggatccgggtgaacggcgtcgcgccggggccgatctggacgccgctgatcccggcgtcgttcgcggaggagaaggtgaggcagttcggctcccaggtgcccatgggccgcgccggccagccgtcggaggtggcgcccagcttcgtcttcctcgccagcgacgacgcctcctacatgtccggccagatgctgcacgtcaacggcggcgtcatcgtcaacggctagtttttcacttgtcccatctcgccgccggcgggcgagctcgccgtcgccggccgccgtgtctgtcttggcttttgctgtgggcatgtgcccacgtgtttgcagtgcgagtccaccacgtgtcagtcagtagtagcttgtgatcctgtgatactgtgatgagtagagttgcagttgttgtctgtgtactaagcttgcaactcaatctgcaaggaagaagatgaataaaaacgtcccatctcatcgctacctgtgatcttgcatttccttcctattttacacaaacttgatttgtactctaaaaaccctcacaaaaaaaggtgattaaatttatcctatttaagaaaatttcgcagcagtttcatggcaagtataaataaataatggtaatgtttgccacttaaatgttctacaagtgattttcctacaaaattgttattattaccaaaattgttctctcaataaaaatttgtcaaattgttaccaaaatacgtacttctctggatataattcgtccaaattcttgacttgaaatatattcatttactggcccagctggcgaattaaggccgtgtaatattgggccgattcagcattgaatcttgtattttgggccggtcttgtagtttcatctgggccatggaattaataaagagctaattaatcacgccgctttattacaaatacggatataaaaatacaaatcaaacggaagatcaaccgcatctctcgggtgtttcggtttccaaagcaggaggaaaccctagccgccagcctttaaatctaagagcaaaacctctcgccgatttgttcttcatttggcattgtcgtcgaaggagttcgttcgagtaggtgagtacctatgttttgtgttgatttctttggtttgttgttgatttattcaccttggttttgatttctttcggatgatgatttcctatatctatagttggcttggatctaatttatctagttttgagtgattttggtttttacaagatgaatacgtctggcctttgtaccaaagactgatttgttattcggaatctccaattgttggtgttgctttcttatgtagatatattgatttatcttcataggatcattgttttgtctttttatgttttctacgtaaaattttatacactttagataagattcaccaattttgaaagatcttcagatatattttccaaagctgatttgtctcgagccatcttattgggccacatggcggtgttaaattttgagataaatctaagaaaattatgcatcttattgggccacatggcggtgttaaattttgagataaatctaaagaaattatgcataagagaaaataaccaaaaggaaaagacacaaatccaatttctagatatttcccaatgagccacatggcagtgttaaattttgagataaatctaaggaattatgcataagagaaaataaaccaaaagaaaagaaaagacgcaaatctaatttctagagacttcccaatgatctatcatctttgagataaatccaatttctagatacttcccaatgatctatcctctttgagataaatctagagaatatccataataaaagaaattgagaaggaaacaaaaggcataaccgggaagcaaaccattccatactaaaagagaagcaaacaaaaggcataacattccatactaaaagaaattccatactaaaagaaatatcgagaagcaaacaaaaggcaaaacattctgattctatctcattatacattattatgatacattattcggacaaaaggcaaaacattcggattctatctcatgatacattcggattctatctcataatggttggattctatctcataatggatggtttcgtgccagctgattggctgctctcaacatcatttagttgagcgacacgtggcgagatacaagctcgaaaagagcgccagttaagaaaccctctataaaactagccaacgtgattgaaaaacgatggaagagtcgctccattaggttattaattctatctcatgatacattattcgaacaaaaggcaaaacattcggattctatctcatgatacattcggattctatctcataatggttggattctatctcataatggttggtttcagaggttggtttcatgccagctgattggctgctctcaacatcatttagttgagcgacacgtggcgagatacaagctcgaaaagagcgccggttaagaaaccctcactataaaactagccaacgtgattgaaaaacaatggaagagtcgctccattaggttattaatgaaaacggatggttgagatttcttatatgcatacattgatttatgataataggattattgttttgtgtttgtatgtgctaaaaaccaactttcttacaacgattttgctatatctcactcgaaagatttttttttctttatctctcactcgattttcttactcaaatttagagtgtattttcttgtaagttacagcataatttatgaaacttacattgcaacttttgtaagttaacagtgcaatttttgaatcttcgcatgtaagttttgaaatttagattggatttatggtgtttcttagttgctttttgccttttaccgtgtctattagatttaaattcaaagattaaaaaactgtgtgatatgatcaaaagatgcatagatactaattagaggtttattcgaggatgaaattttatcccgtaaccggtgcggggtgcgtactaccaccactacgtaccacaatttctcctttgctatgtaaaattctatactttagataagattaaccaaattttaaagattaaatcattaaatttgtatcaaaataaatttataaaatataataatattatgattaaattcgtcttatccatattcataggatatagagcatttagtaccgatgctagattcatcctttttggcctatcactactattgaatttgcacataatagccatacaacatatatatcaatatatatgatatcatactatatcatacgagagtcagtgtcggtcttggatttattgcctaaaagggtgtaggaaaaagtgccggtcttagatttattgcctaaaagggtgtaagagaaagagagaaacaaaatgggcacctgacgcctaattttcctaaatgttgttgcccgatattatccatgtaaaaggttgccatacatacctttatgaggctccaactttttgcagtgaagaacaacgtatcaagactttatgtacggtccaattcttcacagtgaagaacaacccagagaagaggaggagttcacagtacagaacaacccagataagaggaggacttcacagtacataacaagccagagaagagtacagaacaacctagagaagaggatggactaactctttatagtgaagaacaacccagaagagaagatgatggactttatctacgggtcgactttatcaacggatccaactcttcatagtgaagaacaacccgggtccaactcttcgtagtgaagaacaacccagagaagaggaggtacctattggctctattggcgtgtacatcaaatccctgatccctgatgtctcaaactcctagtttatgcatacgcaagcaataatgctctagctagtttctcaggaagattgtggagaaagagagacaaaatgacaaagccagtttctcgggaagattgtggagaaagagagagacaaagtttctcgggaagattgtgaagaaagagagagacacaatggtgtaggagagggtgggaagattatggagagggtgtttctcggaaagattgtggagaaagagagagacaaaatggtgtaggagagggtgggaagattatggagaaagagagttagggaaggggatgaaaattggagagtgtgg

SEQ ID NO: 45830 - DNA, 2634 bp, Oryza sativa
  unsure (1)..(2634): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtccacatttatttctgcagaattttggcacgctagcttacagaatactgatatgaattatgaagtgctatatgattcgttaaatgctgttacttccactagcaaatgaagaaattctggttgaagtgctgaaacaagtagtgatccactgatagtgtgtggttctagcgggcttattcattgtgctgatgctaggaagccaatggttctgctgttgttagctatgtaaaataaccagttgatcattcctgctctgcagagtgacagtgagtacatgtcagggcagctgtcagcgtttggatatgcgatcactgaagagcccgaaggagcggatttgtggctaattaacacgtatggttttagtttctttcttctcttatttgtttctttccatctattacctcctgacgttcattaaaagtacacatgagttgaatttaacctgtgatggtttcaaactggtgctgctctggatttgtgttgtggaaaactagctacgctattttttgcactagaatatgccatgagctgtgtaaacttgggataataagcataaatccaacttgcagtgccgaagagtgagatatatattgacacgtaggggcaaaccttcaaattaacttcagaggtgaagaatatattgtgaccgacacctattttgccatttcagatgcactgtgaaaaacccaagtcagtctgccatgacaactctcatatcgaagtgcaagagtgcaaacaagcctttggttgtggctggatgtgtaccacaaggaagccgggatctgaaagagcttgaaggtattagcgttattggagtgcaacagattgaccgcgttgttgaagttgttgaagaaaccttaaaaggccatgaggttcggttgttgagtcggaaaacactgccctcacttgatttacctaaggtacaactcatatttctgtacatgatgttatatgtatcaatcttttatggctagtatagtgccaatgttatgtgctattacctttttaccactgacagatgtaatatactaatatcattcctgatgactgaccacagctacaatttccaggtaaggaagaacaaatttatcgagattcttcctattaatgttgggtgtttgggtgcttgcacatactgcaagacaaagcatgctcgtggtcatcttggaagctatactatagaaagtttggtacgttcatagatgttttgtttcctgtaggaagttttgcttatttatttaaatctcaagcatgaaaattggtttgctactctaggtagatcgtgtgaaaattgttgtctctgaaggtgtccgagaaatatggttgagtagtgaggatactggtgcttatggtaataccattgtccagatctttttggattccttctgagagataagccatagaattattatggcaatttgctcctctgactttgcgaggttttcaggcagggatatcggtacaaatcttccaaatctattaaatggaattgctgctgagcttcctgcggacagaagcacgatgcttcgcattggcatgaccaatcctcctttcatattggagcatttgaaggagattgctagtgttttgtgccatccctgtgtttattctttcctccacgttcctgtacaatcaggaagtgatgcagttttaacggtatgcttgaacttacagcaacatatggatataaaacccaaatataattgggtaattatttgcttgtaacctatctgtagtgtttgcgcctggccctgacttattccacaactatacatctcaggcaatgaatcgtgaatacactgtgagtgaattcaggagggtagttgacactctttgtgagcttgtccctggaatgcaaattgctacagatattatttgtggattccccggtaaaataaatatcttggtttagctattcaaccttacttaaagtgatcatttatgaataaccttcatctttgtttattaaatcattcaaagatgtcgatagtagtttaagctaaagtataatcttgccatttttcaggtgagactgatgaggatttctctcaaactgttaaccttgtaaaacaatatctattccctcaggttcacatatcacaattctaccccagaccaggtatctttttctaacttttgttttctagaaatattcttcatcagttttcccccatgtctttgtctataatgttgtttctttgtgttctgtaggaacacctgctgctaggatgaaaaaggttccaagcgttgaagtgaagaaaaggagccgtgaattgacctcagttttcgagtcattttcaccctaccaaggaatggaaggcaaagtagagaggatatggatcactgaaatagctactgatggtgttcatttggtaagcgtgtcattattgctggcaatcttatcatcgatggtgtttgtgcgagttgccacatttatagtcacataaactttttcctgaaattatcttttgctgcacag

SEQ ID NO: 45831 - DNA, 15264 bp, Oryza sativa
aagttctctaataacctttccccccgacctttctaaataactagaagatacaattagtatttttaagattaatgatgaacaaggagagttggtgatctaactcgtaattgcgtttatctgagctcgaagaaaagccttatcttttcgcttatgcttatgcttatcaactaaaatttgaattttcaaccttaaatttagagcaaattttaaggtttttcatcgaagtttattttttaacctttgcttttagatcgctaagaacatgtatataaaagttttatttacaaaatactttcgtttgcaaatatgctatttcgcttattccgtaaataagtgaaacgatggctctgttctggcttcctgcatttaaaaagcaatggaagtagtcatggtgttcttggcttgcaccatgaaggatttgaacatttgatacatgcgttctttagaaactcgctacattccaggttgtggttggcacaggacggtctctgaaaggaccaagggattggagtgagcctctcaagtcatttggtagtcgtactagtagtcatttgctcaagggagacgctctgccagtctgatgaagtaatgatgatgagtaggagtacttgctagtccttttcttttaagaaaaaaaaaagagttattgcgtactccctccgtcctttaaaaaaaaaaagacaagtcacacataaaatactcaacgtttgatcgtccgtcttatttgaaaaaattataaaaataattgaaaagacaagtcacgcataaaatattaattatgttttatcatttaacaacaataaaaatacgaattataaaaaaatttaatataagacggacaatcaaaattgaacacggaaactcagggtttgccttttttttttggacggagggagtattgacaatgtccagattctagtacaaattatcaagaaattggatttcatctgcaattcatcatggccacaccaatatctgtactcgtagaagtacaacttttcggaaaatttcactttgcgtaactttttattaccgttgttttgttttgtactgtcttttaactaatatttttactttagattgggttatcttacctttattttattttggaccaccctaaagtattttatgtatatgcatccacttgtcatatgtcagaacaatagtttaaatgtattattggagttcagtgataaataggagccgacatactcgaaatcattcatatgaaaatattggttaaagaatgatctaaaatgagacaccgataataaaatattaaaagataacctaaactaaaatttacaaacttttatgttttttcttttgttctccttccctccaaaacgggttctgttttggatgttagcaatgccatcgttttcctttttgcaggaatcatatagtacatttatttatcgagttaactaggagcgattaagatcaaaattacactcatccagattcacccagttaacgcatctgatgggagtaaaacttgccaaacatcagaatttgcatgacaaaccaaaaacgttgttgcagaagtgcagaattcagtacaagaaaaggcgaacagcaagttagcaaggcagaggagtaaaaaaaaagatcaattatcagagccgggtttcgatcctgagacctgtgggttatgggcccaccacgcttccgctgcgccactctgatgttgttgtactaagcagcaaggaaacaattttgtcctgttcttactaaacgatcaccatagcgtggcaaatgccttcgcctgtagtactagcaaacacgcggcgaggcgagcaacgagccaagcgcccaggccgggtcaccacgtggcgttggcgacgcaaagccggcaaggcaacggccgctcgctcatctcacctaccaccgcctgcacagctcgtactactacttattactggtaagctcggcgcctctatatccaaatccggcaagtaattgttttaaccgcgcgcaggcaaatcctgcatgtgtgcatgccctcgcggtgccttcccggagtggacacagcggtggcgcgcacatgtcgtcgcgacgtcgattttcgattcgcaccgcgcgccgcatcggcctacgctacgtacgtcgcgcgtgtgtcggccactgggagagactagagagcgcgcgggtgacagggccgggcacacacggacgcagctagacaccgtagcttggctcgaactcgaaggccatgccacccacccaccccgcgcgttcccgagaacggaaaggccgcgcgcgcgcgcaaggcaaacggccgacgcgcgtacgtacgcccgcgcggcccgtgcatcggccattccgccccccaatccccaccaccagtgtgggttccacgtacgtctttgacggacaccaccgcgtgctgcgtgcatcgtgcggcttgcccttcgcttcgctttcgcgaatttccagctgccgcctgccggatgcatggccgcggcttcgcaggggagagcagtgcgcaccagggtttacgatttctaagatggccttccatttcagggctctggcagaacgacggtttctgtgaaatccgataaaaagccggtagattccaaacaaatttcataaaccaaaatttgaatacagattccttgagtttaccgataagctcgcgaaaatcggtcggctttgacgaaattctgagcgaaatcatcgaaatttcaatcattaactagaaaaagagataaactgaaattgtttttcttttttttaagttcgttattcttttatttcctacttcaaatttcagtaaatacacggaatacatcaattttttttttgaaaatttatatccaatagattttatgaatattatactatttataagattttatttgattttttttcttttatttatcaatttaaatttgaatttggatgaaactcatcgaaatctcagacagcttttactttcgagccttatcgaaacctcaaaattttgcggaattcgaccggttttcgttggaatcatgaaccctggtgcgcacccgcatcgtacgtttgccatcgatcggccgccccgccaaagatggcgacgcacccatatctcaggcgtggccacatgctggaagggatgaggaaataagagatgactggcctttttttctctctctctttctaatttcaaccggccgtcaatttaaatgtatatagtttaaggaagaaaaataaaccagtaataatttcaagtaggtttgtattacggctagtagttccatggagtatatataagagaaatatactcccctcttggttgataattcattcttatcgttttaaacaatgacacggtctctaaaaaacaactttgaccaatatttttcattataatatatataaaagggttaacaaatatataattttattaaagtactttttaagattaatctatacatgtattcaccatatttgaaagacaaatattttaaaaattattcataatcaaagattctaaaatttgatctcgactttatctaaaataacaagtattatcgctccagaggaagtacctatcttaaagtcatggcatgacacggcacaagatacgttttgagtaagatgtcttggtatgaaccttagtttagtgacttagaattgttgctaaccatgaatgccctctattactaaaaaaaggggtgaaatttgaagtaattccatattaatgataggttgacttttaaaatctgggcttttagtatttcttttctacttgctcggtaagtcaaataaccacaaccgatcgaacaattatcattacattttatcgatcatatggtctggtatgaactatgccgagacgtggcatataaatattcgaatcttaatccatctatctctctttagcttgatgcccaagtcagaacatggaagtagcaaccaaatgtagaggtcgcatgtatcatgcaacgtattagaatctgaatccattggtggagaaatgctctttactcctgatttagaaccttttgtagtcccggttttccaaccgggattatgaatccgggactaaagatcgctatatttagttccgatttaaatacatgagattaaagatcgatctttagtcccgattagtaacaccaaccgagagtaaagtagggaatctttagtccggttggtaactggactaaagagggggtagcggcagtccctcgaggtccctttttcttcttcttttttcattgttgatttgctaatggctagagttaatccctgtattttatgcacatcccgaatcagcatcctaaatcttaagttacttatacacactgacggagcgtggggctcctcactgggagaccgcgcgggcccccctttgccggttcggccggggacgctaggtgaggttctaagccctcgatttgtggaatgtttcgcgagagagcaaatgcacaagacacgggcgatgtagacaggttcgggccgctgagaagcgtaataccctactcctgtgttctggtggatctgtgtatgaaggagttacaaagagctggagagcaagagagttcaaactctagagaccctctccctctctctctcctctatgagctccgctcttccttttacgagctctccttttcttctcccttttcttttcctctttctccttttttttctttctcctctcttggtaggcatggtcctccttttatatctcaaggggataccacatacaccatttctacctatccttcttttgggtggggacccattctactttgaccaaaacatggctcatgccttcgcctcacaccgggataaccctgtccttccttcatttatgggcggagatttgcaatggctgctgtccgaatgaccctccgatgggatgggtcataccaacctccagatgacggaggcaggtgcaacgtgggagcacggttgtttgctgatgacgtgaccggcgtcagaccagtcacaaaccggtcattcttgtctaccacgcgtcagtttagcatgccacgcgttagcccttcttcataaaatgacttccttgtaatggttgcgatgaagcctggtatgaatctagccgggaccgacgtgctaactccaggagttcccacgccagctccgtctagggacgagtgcctagaggctctcatcattccgacgggacggggcgaggcgtgcgacaggccgcctgttgccacctaacccgcgatctgaccggtctgtgaccggtcacatgccgcgactggtcacaaaccggataagcatgcgctgcgccgcattgaatgcggcgtgacgcgctcgtctaacccgctataaatgtggttaggtgagggccgctatgctcacctaacccacacacgtggcgccaacaccacagggggttggggcgccccagccctcggggccgaaacgggagcggcccgacccctcggggagacagagggaggggtggccatgtcaccgtcgggcccgaccccctcggggggtcgggccacgtgagtgatcgcggctacccaagcctctagtcacgatacccccggccccatgtcaccgacagtagcccccggcgtcacgccagggcgaccgcccccctcgagggaggcgatcgggcgagatgccactccttaggcccggtgacaggtggggccggtccccacaggcgggcagaaacccaacggtcgcaaatcgcgcgcatcggcaagggagaaaccgatcgacaataatgagcggcctcttcaagaccgctacattacttgagtagcgcgcgaatcgggacgaaccggttcgtttcgcctagtgatgtgatgatggtgcatcggtcagcgagcgtagttaacgcgcgcacgatatgtcccatcttgactgccacggccgcacatccgcctcgtgcgccgcaaacgggcgaacgggattagtggaggagtgggcgcgagaaacgagggggcgagatagtgggagcgggaagcgaggagccgggcatagcgttggcaagggtataaagacgccgaggaagagatttgtttccttcctctcgccactcttccccttgccttcgccacttgtgctctgacactccgtttcctgcgccctacccttgccatactcactcgctctcaagctcctcctccgccggggagtacaccgggtccgaggactacatgaggacccaccaggggcgcaaatgggactgggaccctgaggacttcaggatagtggtccaacgggtgctgaatctcagctccgtggaggcatccctcatccctcaaggcgttctccccctctgcagcgatccagagcgcgctaacatcctgaccatcatgcaggcggtcggggcgtcaggggagcgggctcctcgaggccacgatggcgcgagcgggagccgcaggggggaacaatctacctcgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcacccggagggtgctgcgccgacgtcgtagcccgagggggagcgaaaaaaaaagcggctccgcaagatgggggggggaccgaaccatgccggggaaacctcatctcccccccaaggtggtcgtttagccgacctcctcgcaggttcgtccccgcgcccactgcggccgtattcattctcccatctcccaaggcaagttttcactcacctgtttttcgtcttctggtttttcttctgcctcagcgagatcccgtcgcgcccttcccgccattccaagtccggccggtctgaggccgaggagacggtgaccgcggaggcccggaggcgggaagctgaccggcgagaagccgcaaactgcctccgggaagccgaggaagctgcccaggaggctgtccgggctcgccaggctgaggaagccgctcgggaggaggccagactccgccgggccgaggagtccgtccgggagacggaggcggcacacgcacgcagggcggcctgccaagcccccgacccgactccacccgaggcgacaacgacttccgaggccgcccacgacgaggccgcgggcgcgccgctcgggcccgacccctcgggcgacgttcgggacgagcccgcttcgggggacgcccccgagttcggcacgtcgatcggtgggccgagccgtgcggcatccttaccgaggcggctctcccccacgccttccgctgccccactgagcgcggagccccttctgcaggccttggccgccgcgaacaccacggtgttggacgggttaagtgcccagatggaggtcctgcaggcagagcgggcggagctcgacgcggcgtgggcgcgtgtcgaagaggggcgacgctcggtggaggccatggtggaggcgggccgcaaggcacaccgccggcacgcctcagagctcgaggcccgtcgtagggacctggcggagatcgccagggaggtggaggaggagcgggagactgccctcattgccaccgccgtgttcaacacggcacgggacgacctctgcctccaatacgggagccgggcggcggagctagagaagaagctcgacgcgtcccggcagcgcgaagaggcccttgaggctcgcgccacggtgctggaggagctcgcccgcaccctggacacgaaggagagggaactggtgggtcgcgaggccgccgtcgccatccgggaggcaacgctggcggtgcacgaggccgcctgcgccgaagaggagtccgcactccgcctccgcgaggacgagctcactgagcgggagcgagctctcaaggaggccgaggtcgcggcgcagctgcgggaggagcaggcgcgcctcaatctggaaggcgcccgcgccgagagggccgcactggatgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctggcaatcaaaaataaacagtagcggactagcgggcctacggctccatcttcacaggcgttcaactggggtataagccaggactccacctaagacatcttctccaaagcttctcttactgaagaggggaaagattgagcaagaatgagtacaaccacagtactcagcaagccacaccggagatgcataattaatgcaagggagtacaaggggataataatataggggttaacttttgcagtaaacagcatttagaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtccctagccatcccaggacaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggcaggcagaattgagccccctagcagcaggacactggccctgtgccatgacatctcgactaccgggccacagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccggggtgctacttcccacaactagcatgcacccaaaccccaccgaaaaacaggttttaggggctttgaaagaggaagagaggggtatgtccaattccacaataagccaaccattccatagtatccaagtgatatgagaattccccaagtctaaagttataaaaccacctaatgttgcgtaattaaacagcgaagcatctacctaaattcatactagtggaaccatgaatagagtgtccactagttggggttttgtttattctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacagaagctacgcgaagcacacaagcaaagctacaagcctataaagaagcaataacaacacataaaaagaaagcacacagttctttaggttataacaaacattaagagacttgaacgggtcgattcggagctcgtatgaccaagatatgatcatccgaagtttaatgctgttatatggagatttgcggattattataattaagctttgcaactataaaacatgtgtaagcgctagcctggaaaagacaggaaggctgcgccgttgacatgcggaccccacatgtcaacctaaaggaccgcggtaaactgagtacacagagacggtccacgggtcgacggaagcagatcccgtgtgtcaaccgaggcgagtggccgacaaacggactccactagacaccacacgggctgcacgcgtggaaaccacgcggctaccgagcgggcacactaacacggtcaccacacgcacaagcgaacgactaccgacaccggtacacaggtaccggggtcgacaaccgcacgacagacacgggcgacaccgaaaggacgaggacggggcagcgagggagagggatccttaccaccacgcgacgaggcgtgggaacgacaacgacgaacgggcgcggcggagacggccgggaacgacagagacgaacggcgaggggacgacttcagcggcgatccttggacaaaggcgagacgcggctggcacgaggcttgacgacgcagagccgaggacgaagacgacgacggggcctgcagcgaccttgacgaaacaccgaggacggacgagaacggctcgatggagggacgaacgccacgacgaccgggaacgacgagaggacgacgacgatgatgaccggggccggcgaggaggcgacgagggcagctggcagcggctgcacggagacgaggacggcgtgttccacgccgctgcaatgccgacgacagaggcggcgccgcgagatgacgagccggcgaggaggaacgatgatgacgacgacgaacaccggcggggttcggtcgaaggggaggcgaggccgagggcgaccttgctgcagcgatgccggaggtggagatggcgacgtcggccggcgcacgggccggcggaagaggctgccgaaggcgacgtcgacgaggaggaaggagaggccggcgcgggcgacggcgttccggtgaaacagaggagcagctggaggagaggacaacgctgcgacgtcgatggaggagacggcgacgtacaggagccgaccgaagacggggaggtactggacgccgacgaggaggccactccggcgagcttcgggcgaggaggaggtgatgccggggatgagggcggcgtcgcggagccgagggaggtggtggcgacgtcgaccggcgctcaggcagggagacagaggcggctggaggtggtacagtggcggcaacgccactggacaacggcgggaacgcgcctccggtggtcaccgcgcgaaacggagggcaggccgggggagaggaggcggctgcgacgccgcggaaggcgacggcacggccggccggcgcacggtcgaggagggagaggcggctggaagcgcccggcgcggggaaaagagaagggcgacggcggggaggtggctagggaccacgggagatcgcgggaaggggctaaaacgagagaacggggcgagggggttccattttataggagaggagagggagccggccacgggggaggtcggaacggcggcggtaaaggcggccggcggccatggaagttggccggagttggcgcgggcgttcccggcgattgggggcacgattcaagggggaaattgggggcaactgaagaggattcaatggggattaaaaccccccaattaatttggaaagagccggcttgaatggggcggatttggaggaggaacggcgctaggtttgcacgggagagagaagaggccggctgggggaggaagacgggtccgacaggcgggacccgcctgccaggcgcggtcaacgcgcgtgggcgcgcgcgtgacaggcgcgtgcgcacgcgggaggagggcggctcgggcaggggcgcggcgtgggccgggcggccggcccaggaggagaggaggggaggggtggcccggggagagagggaggaggagggagtgggccggggaaggaggaagggcggcccaagagagagagagggaaggaaaaagagagggaggagggaaggacttcggccgcgggccgggggagagagagggaggctttgggccagacttggcccaaaggagggagagggattattcttaggtttttctttttaataaactttgataattgtttttgttgtttaataaatatttccggtgctctgaaaattcaagtaaaatttgagggctccttttagaccaaggagaatttaacaaaaattctccgggccacattcgaatttttctggcacgtattttagtgtttgccaatttcttttcgacttttaattaattctattattccttttagagaatgaattttatttcggaatgaatttatcaggacgtgacactggatcagcgggccgctgaattcgaggcgcgggcgaaggagctggacgcgagagcgcgcagcggcggggcggccgcgggcgacggcgacctagccgcccgcctcgcagccgccgaacacaccatcgccgagctgcagggcgcgctggactcgtccgccggggaggtcgaagccctccgcttgatgggcgaggtagggcctggcatgcttcgggacgccgtctcccgtctagaccgcgccgggcggcaggcgggcctctggggcgggcggaccgcgaaatatgccgccaaccaggggggcctcgcccagcgcctctcagagatggctgggaccatccagcggctccccgaggagctcgaggagacgatcaagtcatcctcgagggacctcgcccggggggcggtggagctcgtactggcaagctaccaggccagggaccctgacttctccccgtaggcagcgctggacgagttccctcctggaaccgaggatggcgcgcgcgcacaggtccgggatgccgccgaccacatcgtccacagcttcgagggtacggcccctcggctcgcgttcgccctcgactccgacgaggagggcgatgacggtggtgcggacgacagcgacgacgaggccggcagcccgggcgcgtcggcgtgagcccccaggcccccgccaatcttaaatagctttttctttcttcttctgaggccttcgggctcccttcttgtataaactaattcaatctgcaatcaaataaagaggaaatttttgtgtcagctctgtttgttgtgtgtatgagacgaggatggtctgtgccgcggtccttctgtgtcttggcttgaacgagggctcgtgcccaggtcccagcctcaaatggcgcgggtcggggctagtgcctggggagatccgcgtgtcgagactggccaggccgggaacgtggtgaccgagggttatggatgacccgattgtgggcctttgccgattctcccccggagttcaccacgccccggggcacggctcggttctgggccccgtttggcgattttagccggcccgggccaccgagggcaggatcgagcacgagcatgctaattcaagccaagattcttcgaaaggaaacaatggcacagacacagtccttaggaaatcgaaaatgcttttattgaaatacggaagaaaaaaatataagcttatgcatgtggaagcccccggccaaccctgcacgcccgggggggtgcggggttggcccgagcccgagacctgacacccgacccccactaggggtagaagcgacgaaggtgttcgatgttccacggattaggcagctctgtgccgtcacccgtggctagccgaacggagcccggccggggaacgccgatcactcgatacggaccctcccacattggtgagagtttgctcagtccagcacgcgtttggacgcggcgtaggacgaggtcgtcgacgcagagtgatcgggcccggacgtggcgctgatggtagcaccgcaggctctgctggtagcgcgcggctcggagggccgcgcgccgccttcgctcttccaagtagtcgaggtcatctctgcgaagctgatcttgatcagcctcgcagtacatggtggcccgaggggacctcagggtgagctcggatgggagaaccgcctccgcgccgtagacgaggaagaaaggtgtttccccggttgctcggcttggcgtggttcggttcgcccagagcaccgctggcaactcctcgatccacgagtcgccgtgcttcttgaggatgttgaaggttttggttttgaggcccttgaggatttctgcgttggcgcgctccacttggccattgcttctggggtgggtgggagaggcgaagcagagcttgatgcccatatctttgcagtagtcaccgaagagttcactagtgaactgggtgccgttatccgtaatgatatgattaggcaccctaaaccgagcagtaatgcccctgatgaatttaagcgcggagtgcttatcgatcttgatgaccgggtaagcctcgggccacttagtgaacttgtcgacagcgacatacagatattcgaacccgcccggggcccgcctaaacggacctaggatatcgagcccccagacagcaaacggccatgaaagaggtatggtctgcagggcctgggccggctgatgggtttgctttgcgtggaactggcacgccctgcaccgccggaccaggtcaaccgcatcgttgagagccgtcggccaatagaaaccctggcgaaaggccttgccaaccaaggtgcgtgaggcggagtgggctctgcactcgccttcatggatatcggcaagaagctcgacaccttgttcccgaggaatgcacttcaggaggactccgttagccgcgcgccgatagagggtctcttccaccagcacgtagcgcttggagatgcgctggacgcgttcactcccttcgcggtcctcgggtagagtcttatctgtgaggtacgcctggatctcagtgatccaagcaatcaatctaagggagctgggagcgctcccctcgggtcccgaggcctggacttcgacgggcctcgggggccgttcaggcgcgtccgtctcccctagggggtcgggtcgcaccgacggctgggcaagcctttcttcaaaggcgcctggtggggtctgggctcacgaggaagcgagccttgagagctcgtcggcgaccgcgttatcccgcctgggcacgtgccgaagctctatcccgtcaaaatggcgctccatacgccgaacctggcgcacgtaagcgtccatctgcgggtcagagcactggtactccttggagacctggttgacgaccaactgggagtcgcctaacaccaggaggcggcggatccccagtccagctaccactctgagtcccgcaaggagtccctcgtactccgccatattattggtcgcccgaaaatcgaggcgaaccatgtatctgaggacgtctaagctcggcgaggtcaacgtgccccccgcaccggtgccttgaagagacaaggagccgtcgaactgcatcacccagtaggcggtgtgaggcagctgcgaggggcccaagctggcctcgggggcggagacgtgctcaggggccggggtccactctgccacaaagtcggcgagggcctggctcttgatcgcgtggcgtggttcaaagtgcaaatcgaactcagagagttcgattgcccat

SEQ ID NO: 45832 - DNA, 11564 bp, Oryza sativa
acgccgcgctgaccacctgcggggtttccgccaggtagagtagcaatggctcatctggctccggggcgaccaggactgggggagaactgaggtacgccttcaactgagtgaaggcccgctcagcctcctccgtccagataaacggcccggagcgtttgaggagcttaaataggggtagcgtcttctctcccagcctcgatatgaaccgacttagaacggccatgcagccggtgacgcattgcacatccctaagcttgctggggggggcgcatccgctctatagctcgtatcttctcggggttggcctcgatgcctcgggcagagaccaagaacccgagaagctagcccgcaggcacgccgaacacgcacttatcggggttcagctttatgcgggcggagcggagactttcgaaagtttccgctagatccaagagtaaggtctcttggttgcgcgtcttcacaaccaagtcatcaacataggcctcaacattacgtcctatttggctacccaaagaaattcgagtagtacgctgaaaagtaggacctgcattctttaacccgaaaggcattgtcgtataacaataagttcctataggggtaatgaatgcaattttttcctcatcctccctagccatgcgaatctgatgataaccagagtatgcatctagaaaacacaaaaggtcgcaccccgcggtggagtcaacaatctgatctatgcgtggcagggggtaagggtccttaggacatgccttgttaaggtcggttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacctttgagaatttgataaaacagttaagtaattaaacaatattaatccaacgctatacaacatgccctgttgtataggcccaaccattctgaacaaccaccccggctgcacagttctatctccaaaccaggaatgtaccattccaaaccaggagctaaacaaattattaccagtttaagcatctcttacaatgatgagaggtgtgagactaatcacgaaagacattgttagacccgcccataaccgcgggcacggctattcgaatagttttactttggccagaggtgtaccactgtacccacaagacacaaccccacatcatgtcaccatgtgcctcaataccaccacggtacctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcaataagccatcattaaataatagtgagtcattagttatcccgaatgtgtactaatgtttctaagcagggctaagcaattatatctaatatctagttgaaccaatataaataaagctcaactagtcaaattataataacccatggtatcaaggaataaggtaatcaagaacaaaagggctataacaaacaataggttaattccacccaatgacattcgaaaataaatgcaatagttgaaaagaaacaatagctttaaataggatcaacatgctcaaagggttgtttgggatctgtgtgacttgccttgctggccttggaattcttcaaactcttcttctgcgaaaacggactctccggaaacgacagaatctaagcagaaaagagcaaaatcaccaaaacagcacataaacaagcatgaacagtacatgtggatatttttaatgtgtagatctcaattttagaaaaaattagagacttgaaccgactaaatcggagctaagatgaattagttatgaatttttaaagattaaaccggattaaaacacttaaatcggtttaaattgaattacgacgcaataatgaattatttttgaaaaggaaaaggggatttattgcgtcagcggctagggtttgggtggactcgggcgcacgggcggcggttcacgcgaacggacggccgatatcgatccatccaaaacggacggacgagatcgatcgggtccactgcggctgatggcggacgaccccgatgacatcagcgacgacctctgccacagcggcggcggttcggcggagaagacggctcgaacggcgcacgctcgccggcgaacggcggcgcgaggacgcatacggagggcaccaagacgtagaggacaactcggcgaactcaccggtgacctaaactgcggtggaagaccaacagacggcgacggcgactaggaggaagcggctggaaccttcgggtctacgactgataatctgctccggtgatctccggcgacagcgaaggggcggacgaggacggcgacaacttggcgagcacgatggtggtcttcccgagcgacggcgacggctgaaacgacggcggcgcacggctggagcggcggcggcgacggcgaagctagggcacacggcgctagagcgattccgacgactagaggcgaaggcgagggtggcgacgggaagaggagactccgggggtccttttaaaggggctcggaggcggcggcgaaggcccacggcgacggcaacggcgaaggaaagctcgggaagaacaaatccgagacgaactcgaatccaactctttccaaaacgatttagccaaagattccaaaggagaaaaggtagaggagatcccgaggatcatttcccctctttcaattcggccggagaaggaaaggaacggccggatttggaaaggaaacggcggcggcgcgaaactagggtttcggcggcggcggccgaaggtagacgacgactgacaggtgggccccacctgtcagcgagcgagggcgcgcgcgggcggcggactgggccggctgggtcgaggagagagaagagaggttttgggccgactttcggcccaaagccaaaagaagactttttaaaacctttttcaattaaaattatttcttaaatgcaattccatttattaaaaatacttccttagctcaaataaatcccagaaaaatctaggaattatagaattaagcaaagtatttaatgaaattttatctggcccaattttatattggaatttattaattaaaacttaggttttcttttcaagacttttaaaattaattctaaaaattccatttaaacaacaatttatatattttgaattttcagggtgtgacatcggtgtagtcgatgcacatccgaagcttgccgttcgccttgggaacgacgatcgggttcgccagccactccggatggatgacctcacggatgaatccggcctccagaagtcgcgccacctcctcgcggatgaaggcttgacgttccggggcctgccgccgcactttctgccggaccggccttgcgcccgtctgcacggcgagacggtgctcaatcaccttcctggggaccccgggcatgtccgccggtctccaggcgaagacgtcggcgtttgcccgcaggaaggagacgagcgcgtcttcctatttgccgtccagaagaccaccgattcgtgtggtcttggacgggccgtcgcccagggcaacctccttgaccgggacctcgtcgcacgtgatcatccgctgcctcggggcggctgggacggaggtgctgagcctctcgttgccaccctcgggcttggacgcggcggcgaggtggtccgcgcgctgctccatacaagcaagcgcgactttgaggtcgccatggacagagatggggccaccggggcccggcatcttcatctggaggtaggcatagtggaccgccgccatgaacttcaccaacgcgggcctcccaggaccgcgttgtaaggcagactgaggtccgccacatcgaagttcacccgctccgtgcggaagttggcggatccaccgaaggtgaccgggaggtcgatatgacctagcggccaagtgtgccccggcgtcacaccgataatcggctgggacggccgaagcaccatccccgggaccttgatggcgtcaaaggctgcgggggaaaggatgttgagggctgcacccccgtctatgaggacacgccccaacttcatgttgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccgacgagaagcgtgagcgcacgctcctccatcgacggtggcgatggtggccccaggctcctggaaccctaggtcatcgtcgtcatcgtcgacgtcctcggcgggggccttctgcttggcctcacttcgccggttgccggagggagccgccggggccttgccctcacggcgctcctgcctcctctcctcctcccacttcctcgtccgctcagccaaacttttgaccgcgcggcagtccgtgaggtcgtggagggaggtgttgtgcacggtgcaacagggagcgccggcctccttctatttgtcgctcgcaggcctcccctttcgggtggcccgcgaagcgccctcgacggcgaggacgtgtctctcgtcgtcggaatgggccgacctcttcttcctcctcctgtcccgccgtcctgaccgagcggcggatccgggggcggccgaagctgccacaccggaaccggtggagttccaggtccaggcctcctccttgcgagccacacggtccgcgagctgaaaaagctccgcagtggtctggggctccttggaggcgatcttttcgagcatgcggttgtgccgcacgcccccccctgaacgtgtagatcaccgcgtgtgcggggatgcatggtatggtgttgcggacctgacagaaccgctgaatgtacgagcgaagagactcatcgtcccttcgctgtaccgcatgcaagtccgcttcttcatctgggcgcggatatgtgccttggaagttcatggtgaactgctggcacaaatcctcccaagagtggaccgacacgggcggcaagttcattagccaaccccgcgcctgtcccttcagggccatggggaagaagttcgccatgaccctgtcgtcacccccggcggcctcgatcccggtcgtgtagacctagagaaactcggccaggtcccgatagaggtggcggcgggctagaagtccgagaggcggaggaggattacaatgttggcagcggccctatgggcagcagaggcttaggaattcgacgaagcatatcctttcagctcgcgtctggtcggctagttctgactggacgacaatggatgaaggtggactacccggcggcgtgtggcatcggcttacttgaagcagatgaagatggcaccagtggagattcgctgcgataacgcactaggggcggtggcgactagacgactttcaatcgtcgatttcgactgtttcatgagagaatgttgggatgcagggatgtgttgaggttgtaggtttttcggttttttggttgtattctcctctttgctgaggtctgagtctcagtgctctcgtatccttttggctgtgtatatccctcatagatatagaggccagattaataaaaatcctttatctaaaaaaaatcggacacaatgaacataagtaatacatagctgtatcggacccacaaaataattttatacatacagtcataaccattatcagtggctagcaataaaccttgctcatgccctatacccatacccgcaagcgccatgtgattatccatattcatgctgatttacccattagagataggatttcatccccacaacatacctacagatataacaaagaactacctgatactagggtcatttacccacgatcaaacgggtttatagggcgtgattgccattcctaaccagaatgccaaccaaacaaattacatgtactcccttcgtttcataatataataatttaatattggatatgatattttatagtacagcgaatctggacaggaggatgtctagattcattatactataaaatatcccatcatataggttactatactatgtgacggagggagtaggttgttttttaaatgctcaacaacacctaggttttgatatatcaatagccgcactgaaccacatatgatagggtgggcgatcgaaaaacaagtactcctaccaacacaatggtcttgtttagctgggggaaatttttgggtttagttatcacatcgaatatgtgtacagacatttgaagtattaaacgtagtctaataacaaaacaaattacagattccgccaggaaactgcgagacgaatttattaagcttaattaatctgttattagcaaatgtttactgtagcactacattgtcaaatcatggcacagttaggcttaaaagattcgtctagcaagttatacgcaatctgtgtaattttttccccctatatttaatactacatgtatgtgtccaaacatttgatgttacagcatgaaaatttttgttttgagaactaagcagggtgtgtttggttgctcgcatcactcctagcctggcccgtgtgagccatccaggctctccagggcctgggtgagtaggtgcgaaagggtttgttcggtagatggtatgagatagtgtttgcttggttgtacaacggatgctgttcatcagagtttttgtttggttgattgcatatgggctgagtttggttacctcatgtttcttatgtggtgagattaccccttgcaattccatgaaaaaaaaatagggtgcatagcatattttaaccgacagttgagaactaaaattggtgaattccctacatcaatcatagcaaggcccaatcaaaactttcggtatatgttgaccggtcaggaaaaaaatgaaaatgaaatcaaaacttacggtatatgttgaccggtcaaggaaaataggaaaaataaaaaggaaaatgaaagaaaaaagtggatatcgtcgcccaatgactcggacgaggcgacctccatcgctgccacatcgctactctgcgcagccgacttccaccgctgctgcgatctctccacctcatttgcgccaccccgttcttccttctaccacgccagttgcagccctcctcagccacgctgctctccatattcccctccaccctctgtcgcttgctaccgttggtggacagatccgacggctgtgagctcgtagccgccggatccggcggtctggcgactagagaagggaggggagggcggtggcaatgacggggaccgctcttctcgctccatgcagttcgtcaccgtcatcggggatctagaagccgaagctcgttgtttttggaatctggtgcgtgggtgggagctcatcaagggaggaagcaaccggcgaggaagacggtgccgccgacggtgaggatgggaagagaaaggcaatggaggctgtggcggcggcgccccttgacctcgagtgtctagatacatcatcgacttcttcatcttccttcttcctactgaatcgtgtgtgagcaaatgtgagaaggtggtgaggggatgcaagccggccctgcctgcgttcctcctcggcctggctcggagaggcaattttgcacccgcccatcctggctcgctcctccgtccaggcaaccaaacagtgagctcgctgcatgcaccgtaccggtgcgagccaccgttgatgcgggcaaccaaacacatcctacatgttcatgttcaacagtcaaaatcccgcccacatagaaagctcccagacccgttctcatggatccacgtgatccgtcagcagtcatcagacggccagagtaccacccaacatccatccaagcgtcaaaacacccctgccacccgtcgtacgcaagtacgcaccacatgtaaaacacaccacaccaccccctccggaggcccccacccactgacaagcacacgtaaaacggaggcggatccgtttgcgccgcttgcctttgacacagggacagagagagagagagagagagagaggagttttgagcgcgcgtcccggagcagagtgagtgaagtgccttcactgttcggttcggtggtggtgagagtgacgaggagcgaggcgaggcggcaacttccatggagaggaggagttggcggtagattaactcccaccacctgaccggaggaggagacgaggccgccggacgagagggatcaacgccgccgcttcctgccgctgccgcgagcagaggcacaggtacgcgacgcccacccgcgcgccctcctctgctcgtcgccattgcagccgccgcaccgcagcgcgggttttttttttccttgcttgttcctggtggcatatatatgccgggggcggttaatttgttcccgcggtgaatacgcgcgggtttcgtttcctatcatcaggtggcggttggttgcatcgttgcgttatattgtgtgtgtttttctctctcggttttgttgatggataaggttgggggagggagatttggaggaaatgtgcgttttggtctaatcgggatgtggagttgattcgtggcgcgaggcgattaaggacgatgcgttgggtagacaagttcttgggttttttctttctttttttgttcttattattgttttggatttatatagtaggtgcctgatgcatttctgagctctctcgtgggggtcattgtgttgtgattctttccattggaatgcttatcatctgatctatgatttcagtgatgaaatgttatctgtctgcgccgaggtaatttcagataaaagaagaagaaaagggttccacactcaactcatctatgtggtgtggcttcagtgtgtttgttttattttaaaaaagattttaactttttttttgtaatagcaaagaagaaaagatttcaacttcttttttgtgttcctggaaggacgcaaatgcaactgctaccagcctatcatttctggttcatgattcatccagttcactccggttgcagttgccatttttagttaggcggctatgcttttcatgggtggactgacgtggtaaaagcttctatttttggatatcgttgtttatctcgtttggtgcttcaggtggccattttctgcatttcgcgactgacgagttcgggtagtgtctcaatatggcattattagttggaattgtcatgctttcattttttttttcagtctgcattgtcagatatggactgatgttgcactttttttttttgctctgatttttcttcatcatttctcattttcgtcttgcctttgtgaactgatgctcatatgtttactctttcattgcagtctgatcgcttcgatcatcgcggtgattgccggagcttggttcgacctgcattgtagtactcttgctgcttactttcgtaaagaatcaggactgcttgccttttgggttcaagctctggctagtaatcaacagaatggatgcgaaagacttggtggaaataggcatgaaggaggaggacattacaacaatgctgtttggaaagaaggttatcgagctgacggaagacgcatttgatggttcgaaagaagaaaggaagatctttgaggagctcttctgcagaacaggcactagcggagcaagcacccgccatccacgccgggatggaaagagcagttcactgagagatgcaagcaaagaattgatatcaactaacacaccttcgagctctgcctccaatcacaagtcggcgcgctgccgtgtggttgagtcttttacatatggcaacttatcaagctatcttgtgttctgcaacaatgacaaacaaaaaatgcagaagacagtgggctttccggatatggccagtgcttctgatctcgtgatacagtggacaccgccttccgttgagagggtgtacacccgtagggcagtggctcgcaggaaccaaagagcaaaactttgcagtgttcttgatctggagagggttgacattaccagtgttagacagcgtagggacagagggcagcataagtatggccacagccatgcagtgctttgggatcatctccgtctacacgctaatcttctgatgatggatgctgggtggaagattgatggcaaggaaagatgggacaagagtaaggttgatcatatttatgagtcacctgacaaagtaatgcgcctgttttctcttcccagggcatggaaatgctttggccagtggttgcttattaattcatccggctttggtggaaatgactacggtcggatatggttcaacatccatgactttctgagtgatttgaagaatacactgctatgcttagaatatgaagtccggctcccgaagcaatctctatcttttctcaaccagtggcagctccttgaccctttcatggcagtagtttgcattgataagaaggttagagccctgaagaagggagtagcactgaaagctgtaaacagcactgttacatttgtcagctgcatcgagagtgagctgtcaaatccccggaatgccgacaatccacttggtctaaaccattcgaacaattttaacagcacacatcccaggtcacggaaaaatcttctgccactgcttcaatctgatgacctcgatggaaattcttcgcgcagcaaacatccttctactgttggaaaacgtaaatctagccaatataaaatggatgaaagattgccaatcatggcagaaatacaagaaaaaagcatcagaagtactgctcatcgtatagtgatgggtctccaagattcaacagcttttcctggttcaaggactagtttaaatatgaaaaataagccttcatacagcaagtctaatttgacacagagcattcaagacaaatctgatccactatattttccacctaattattctcccagtgatcttgttgaaaatgctgaaataaatgatccgagttttcatgcctatgacatgatagaatctgcaaacgtggacaattctgcagatagtcctgacgagttgctcctaggagcaaacttactgttttctcacgaagtggacgagatgctccttgacgacagggctgcaggaa

SEQ ID NO: 45833 - DNA, 1636 bp, Oryza sativa
  unsure (1)..(1636): unsure at all n locations
ctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgatcagatccgtcaaaatagaagtgtaacttttgctcagattatcgagccttcacgatctctctcactttcactggatcgtcgaggaaacgcaagcacttctccttgaggccatcgcaatggtgctcccgggcgaatgcaagcatggaaacaaccgttctcccgttcacgtactcgcacagtttgtgctcgcacaccagcctcagcctctccatcttgtacctgctcgccgccgcgaccaggtccgggagcatcgccgccgcgtcccctcctcctttcgtcgtctctggctccggcagcgagtcggtgtacatgtagcggagcagagcctcgaagtcccgcgcctccatgtcgtcgatgcgtatggcggtgtgatccaccgcgccgccggtcgtggcacccagctccttgcttggcccaaaaagctctgcacggaacaccggagaccgggccgcgagcaccagcctgtgtgccgcgaacgtcttcccgctgacctcgaacgtcacgtcggcgccctccccggtggcgaggaggcctccgaggtgccggtgcaggtccgacggtgggaccaccaccgtaggcggcggcggcggcggcggcgttgcggtgtctacgtcgatgtcctccgtctgcagctccatgaagacggtgaggtcgcacacgatcgtgaggcagtcgtcccggagatactccgatttctccagcacgtccctccggatgaaactcacaaacccccacccgctgcttttgaaggcgtgcgggttgcctcccggcacggtcgagcaagctaaacttgaactgagctttcacgtctacatcgtcgtcgaggttgaggaagatggagatgcagttagctttgtccgagtcgttgccgctgggatagtagctgatgtgccaactatggcctccgacgcggaaagatcgggacttgacgttgctgccgggggtcgggagcttgtccttggtgtgggagtagccgtcgatcttgagaaggtgctggccgctctccgtgccggctatgatggtggaggcagaccgcaccggtttgcggctgccagtggaggttggcatagctatggagattacgcttgattatttatgatcacgagggccacaattcttgctgttcaaggctgcatatgtgtgcggaattaagcaattagtaagggtgacacgcttaattatatagattactccctcgatccgtttcacattatgagtcgtttgacttttttcttagtcaaaacttttagaaaacaatagtaacatttatagcaccaaattagttttattaaatttagcattaaatatattttgacaatatgtttattttgtattaaatatattttcctataaacttgggctgcagga

SEQ ID NO: 45834 - DNA, 2102 bp, Oryza sativa
ctattatggacgtaattaatcaatggttgtgtagatttatgagcaactatatatggatggagatttagcaatagtatttccttatgactatgttattcctctctgtatgttgaagtgtttgtgattctttgttatcttatggattttatacattggtagtcttaattatgggctgcaaattatgtaataagtggttgtaaattgaagtaaaggccgagattcccattaactaaaagaactattaatcaatggttgcagatgatgttttttaaaatgttgttactatgaatgcgacctaaattatgctgggtcagcctgggattttatccgaattacgaattacctgggtatatagatgaatatcgaacggatggacaatggaagtaagtgtgagagacaaaactgaatgtctggttaggtgtaaaaaaagaagaagcaaattgtcaaattatccatccattttttcaaaaatagatcaagctgcatatccttttaatttgcttttgcaatgattctactgaaagacagaaagacttctcgcgcggaacttcatggagtacaaataatgcataacacacaaaaatagaagtagaagaagaagggatacaataaaaagtttgagcgtcaaagtcaccaaatgcggccaattaatcatggagcgcaaatgtacaatggatatgtcatcttgatgaagctttgaggcatcaacgaatcagtcaccgtgcaaattaatctagcagagtttcaataggcatatatgaggttcaaacaaagaaaggattttacacacacctgaaggaccatccgaatcaggtcagacttcagagacagagatatgtcgttgattttgtcttggctggagatggtttgatccagctaggattagctgctgttgcagggtcggcagatgtggcatctatcgacacagatttatatcggaagcaacagagagaggaaaaaaaaaggtcattgcttagctaatttaatttgttgttgaatctccagcttccttgcaagctaccgtctactcctagctcacatggatacacgcctgcaagtaatccaaggaatctgggaacctctgcaggtctgcaatcctttgctcccgacaacgggttcctcttcctcctttggtcagggcaaaaacttgggaactcactgagaatgagtataataatacagtaagttaattatagttgggaaaactgatccaaccactagaagggaagaactgattcagatggaccagatattgttggcctcatcagtttgttgttgttttttctgtgtgtttatttttttaaaaaaaaactgttgtggaaacaaaaacacatcactgaacatgtttgtcagagatgcatacaaagactggcacacataaacaaaaaaaatgctggaggaaattccaaatttacactaaaacaaacatggcagataaattttactacttccaaccaaaaattaccatgtttatccattttcttggattccatagaagatgcacacatacacatatcactatgcagtatacacacacacacaccccatacatccaaacaagtgctcctcctagcatatgttcaaagagggaccgacgacaaatcttgatctcgataaatttctattgaaatacattcgcgtgtagtacttgtgttggagttgtattacaatgcctgttttcttttatcattccatttaataatttattttccctcttcttaattactactatatacatatatacatgttgacacatggctacattagaggactcccaaactggttgcatatttaggcccactgtagctcagctagctacgtttagtacagcagcgagcttggcaattaggtcctttaaaatagaagggtaacttttgctcagattctctagtccctctgccttcacgatttccctcaattttactgtatcatcgaggaaatgcaagcaatcggagaatattaaggacggcgggatgggcgctcgctcgttgcgtccacgtcggattttgctacagtagctacggtgcgcacggggtggaaattatgcgaaaaagccctccgatttttcgtaataatgtataggtccctagcgtcctgtgttt

SEQ ID NO: 45835 - DNA, 14837 bp, Oryza sativa
tgtccaccccctcgccctgtccacgtcgccgagcgccgcctccgccccctcgcgccgccgcctccactcctgccgccgccgctgccgccgcagagcgccgccgccgctctccttgtcccgcgccgccaccgagtgcctgccatctcaccctctccctcttcttctcccgccgccgccgccgctgccgccgtcaccgagtgcagccgtctccacctccgccaccgccatcgccgtcgccgagcgccaccgctgccgctccctgctatccctttctcaccccgcctgcctccggtccccctgcttaccccgcctacctcccccatgatgcggcggcggcggtggcgacgacgacgacggtcgatggggtcatttcctccccacagaggtaggggtccacgctggctgcggcaaatttagtttgttcgcgctgttcagaaacggtggtcgcgtttcatgtgtacgggctgcgtttattggtgcatgtgaaggcacgtgtctttgagtgtgtctgtggcagcttgggcggttcatccgtggtaaagagggaaggggacggcgtggcattttctggatgcactcgcatttcctcttcgtcgttggccgcgccattccgtgcgatttttgctccgatatcagcggctccattgttttgcccccctgatttggtattgaatcgatgctctttctatctcagtgccgaatctgcatgtctggtgtgatttcttcctccttatacattttctccctggtaatggatggccagttaattggtgttggatgtttgcttgttgttcttcctcacttgtcgctgcatatcagagcatggtacaaatcgttcagggtgcccgctcacaccactcaagatgctctgattgggccattgtggcgtatgccagtcgagtctcgtcgctgcgggaggatcccgccagtgcggccagtgtcaggtgcactcaccaccactcgtcgttcgagggcgggacggagagctcgagcatgcctggtcaatggcagccggtcgtcggggctgcgaggtggttggtggtgtctgtgcgtgttccggcgagtggtcggtcccacggctatagccaatcatgctccgctgctgttcgggccccacgtagtcgtggtccatgccaattgcagttggccgctgtagcaggctccgccgatgtgccctttgtccggcgcagtgttactgctcggcgttcgaggcgaacacggagagctcgaggatggcctccgttagagcactgatgtgttacgtcgtatgctgtggctgaccgatggccctgtcatctgtggggtcctattgacagcctctgagtatgttgttttttatgttacatatttttttgttttgtttaccagtataagtagctcattgcctgccaatcttctctttcccttctgctttttcaccatttcctttgcattgccttttggtgcccgttcgctgtttttcttgtcgtctgttctagcccattctccgctgttgtgctttcttcgttcgatcatggaccctggggggtgaacgcgtgtgctggtgggttttctgtatctggcctagctgccttcctttctgtctgtgccgtgtgtttcctttttatcctgtaattaggcttggtgcatttcaggtagccatgtattggcctgtttgttgcacgggacttactgtcacagagtttttaggttttaggcgattttccccgtgttcatgtttcccttttgacagtggatcattgcttatctctgttgttcttctttcagtatatacttctttcagtaaatagatggtggctattacatagatgaagcacacggtcgttagttaatgacaaatatcattgttttttttattcctggttctgattcattattggatcatgtttcaccattcagagtgtgtcccgtggtgttttcttttcgtgcagaaccatgtggttcatttgtatttttgagtctttccttaagtgcatctctgtacgtttacatgtttttttttttgtcccttcatatcgattttttttggcgcaggtgcttattgtcgcggtcaggtccgtgcgatacgtttgttgctgttgtgctgctgttccctttaccatcagctcctgttcaggtgagctttgtttctttgctatttctttgggctgacatcctttttgttttttagtttatttgtgccttgtggtttggtgtatgttctttcttttatctgatatctagcttaaattacattcttattccctgcaggttgcggaccgcatcttctgtgcctgtacatgtcagctaaggtataacaattggcctctgatttcaccgccgtttgggatcgcgtccctgacgcgggagtagccctccgtcttgagcaggtgctgcccgctctcggtgccggcaacgacggcggaggctgaccgcagaggtggcctacggctgccgccggtggtggacatggcctggccggagtcgatcgttctctgttcgttcactgaatgtacctgggaaaattggcagattgttttcacgcctgaagtgaacgttgctttaatttatttcttaaagtaaaatgcaaatagcgatgaattacgataggtatcaatgcaatcatgcatatactccctccttttgtttcatattataagtcgcttttatttttatcctaatcaaaccattttaggtttaaccaaatttatagaaaaataaaacaatattttcaatacaaaataaatatattattaaaatatattcaatgtaatgaaactaatttgatattataaattgttggtaatttttctgtaaatttgattaaacttaaatatgtttgaataggataaagtcaaaacgacttataatatgaaatgcagagagtaaatttgaggtgtaagttcgaccaaccatcaaagacaaaaaaaaaatccactatgaacaatatttgcactttttatcaccatgttttatatatatttgtcttttactttgtaggtcaagtttaaatttaaaatttaggggagtgaatgtctgcgatcgtttctccaacaactcttgaatgaaattttggatacttgtggcacgtttttttcaaaatgctaaacgatatgtttcgtgtgaaaaatttctatatgaaagtttctctaaaatatcatattaatccatttttcaagtatataataattaaaactcaattaatcgcacgttattaccacctcgttttacgtgaaacacttaatgtttatcttcatcttcatgagattcaaacatgcatgtgctctacgtttccctttttttctgtatttttcattgccttttggattgcatttgtgaagtaaaggtacgcaaaagattatccttctagggatgaaaacaaaatggaataaaattacctggccgaatgtttcggctaggccctgttaaaaaatggagcaattagtttgtattttccccaacattttggcaaattgaccgttcaaaaaactaattgcaaaacatatcgtaccaaaatctacctgaaaaatagattgtttgcgcagtacaaactttgatgaatctgagctataatattttagcaatattaacattggcactaaggtattatttgaggtggcacgactttacagtatactgatttagcaccaactgccatcacattggtgctgctcgcagccttctatggacagctaccgtcacattcggttcaaaacccctggtccatagttttttttttttcacttacccggtttttagcttgttctttaaggtttttttaaaataaaaaaaatcacatattctcaaaaaatcattttattttcaaattggaagttgaacttaacttatataatatttgtattttttttgttttttctctaatttttttaaatcacgtgttttattttggtgtctattgaaggacacgcatttatctggtggcatcatttttccaaaatgatccaagctcattgccaccacaactctacccactcgaataaatgtgtgtccttttaatataaaaaaacatgtgattttttatctcatagctagataaaatgaatcttttgcatcaaaactaaaaggataaaatgaattctgaaaacatgtgatttttttagtacatactccctctatcctacaataaatcaaaccctagcttcccaatgtagaattagtgagaaagataatggaccaaaatatccctaattaatagagaagttagtcaaacctagcttcccaatgtagaattagtgagaaagataatggaccaaatatccctaattaatagagaagttaggtgaggggtattaaaggaacaaaatttctcgatctacggtctgacggtagataagaaggtaggagttgatttattttagtacaaattcaaactttagaagttgatttattttgtaatggagggagtctatgtttgtgatgattctaccgaaatgggatgtgcaagctgccatagcatgcagcggctgcagcagttcaaactagctgcaattgacaaccatttacaaatgcagtagctgcagcggttgtgacagttcgcatagcggaacatgcccagtaattgcaatactttcatggaatacaatacaatataaatgaattaggaaccctaacaataaacctactcatcaccctatgccattactgcacccagcataacaaaatgtatatattctatcaggctgaatcattggcatatataaatgattttcagtcagtatacacatttagcagacccaattggtgtaaagtacaaacaaacaaagaaaagatttgcacacctgaaggaccctaatcggatcagctcagagatagtatggttagcttagccggagataaatcagactgttgtggcagggttattagcagagaaccagacacatttatacaggacacgagttagaaaaagaaagaagagacgaacaccaagacaggatcacaggatgtgtgtccagtcattgcctggcttatttgccacaaaaaattctccagatttcttgcacgctaccgtctatatcgtgcaaaatgaacgcatctgaacgtactccctcccacaagtatgtatgtaacccaaggaagagagagctagtaccaaaggcaaattcttggaaaccatgcaacaactgcaagcctgcaaaatcctttgctcccgataacggggtcctcatcaatcgaatattcatgccaaacttggcagctcagctaggccacatggaaaaacccaattttcacaagaatcggaaaaaagaaactagacccccagcctttttttcttttagagcaagtttaatagtaatatggataaaatcccttatatatatatattttaggatggaggtagtaatgtttttgtaaaaaggtaaattcctgatttagactagaaccctgaagtccgaacctatccgcttccactaagatttgatattcacttacatgcatcaatccgtttttaaaaaaagtcgacggtagtgtaaaaaaagaagtcgatgattcagaacagtttagttttatctcgatgatcagttgccttatttaattaggacaaaatatatgtgcaacaaccttttacaactcaacagatttatttatactggacatgttatctctactacttaaaaagttcgtagtggtggtcttgattcctgacacagcagacgcatgtgacagacacgcctaatctcaaccatccgtttgccatatccaatgatcgatctcctccccacgctcgctcctctctcgatccaagagatcactccccacgcccactcctccttctcccacgccgccttctcgccgcctttttcgccctcctccctgtatcgcgccagcgctgcgtcgcctcctcatctcgcggctgcgtcgcctcctcacctcgccgcaaacgccgccgccgtcgactccgctccagatccccgcgtcgcctcctcacctcgccaccaacgccgccgccgtcgactccgcaccaaatccccgcgacctcgccccatccgccccagccggcggcggccgactgccagatccccgcatcgcctcctcacctcgccgccaacgccgccgccggcgacgttgccgctgcccacccgccccagccggcgacgctgccgctgcccacccacaagtaagtctgttctgtaccagtacactgcaagtaagcattgctgaatcaaaagaggtcaaaaacatggttgtcaataccagacagttgtttttctttctcttcttccgttggggtgggaaataaatttattcaaaaagaaataaatttaatgttatgcattatgtgggggaatagggcaattgacagtttactctaccgaggtgctgctgctgaatttgtaaactaccgtggtgctgctgctgaattttattttgaaagcactttgcaatctgtgagatggggaaggaggttagcctagatcttactcataaagacgacttctctaacccaacaattaggagttactacaaagtttttgttgaggtaattatcccctgcatgaaatgactgacaagtagtacttgcattatacacataacataatttgaacataatgtatccttgtatttgataaacttaggttcggctgtaaatactgaataattgatgcaattttcgattggatgaaattgaatgtaccatgcactcctgctcactatcgcgactgagtatttcttcgcagttataatgacattgcaatcaagtagaaatatccattagttaaatattgacttagctgcctccctaatttgtttccaacatgcattatccaccaaatttaaattacaaatctgactaggtagattacaagtttttatgctttctagctttgcactcccaaaggaaaatctccgattggctatcaaggacccatgttagtatgcaaatgtaaaactgcaatcgattccgattaaatccaatgattttctactatgcgtgtagggggttatttttgcccttttttttaatcttccttcctcttttcctctttgtgtaaaaatataagatacgtctcaaaatatattgttttttttttgtcatcagtcattccttgtttgctaaacgaatagtatgtcatcgacctcgccgtgtcatctcgatgacttgcatatatagaggatgcaggaagggcctgtaactaactataggggtgccatgcataattggattggatttcttttacctttacagaacaatatttttgaacaaaaggaatattactttattttgatatcatcttttcttgtattgcaggttttggattcttaaactcgtagcgtttgctgtctatgtttagatggtatattactgatttgcagtatgagctaagcatcggtcatcttttcatttcattcttgcctctgaagataggtactgtgccattgaagatacatgtttgtgtgcaagctaaatcacacttatgcatttatgcatggttaattacattgtttgctctgttaatctacacaacatgatggcgttctctgcaatcttaagggatttatagttttatgcatgattatgcttttcaggtctttagtaaaaaaatggtggtcagggatttagtaagaaatgctggagcactaattgatcctctgctcaaattgatcaaatagtactgtccatttatgcctactcttttctgatcacatggtattgtgtcaaataaatttgatatttagctttggtgtccttaaatggcatggttgttttataagaccctgtgattttctacatgtcaccttaacaatcagtaggctctgttggatttgtgtggactcataaagaagaggtgcttgtgtttgctggttcatcaaacagctccatcaaagcggtagggcgtgggagaagccaaaggtttggctgtgctgctactactactagcatccattcacattcattactctgtagatcaatagtaccatttttatttgcggatcagcagtagggttctggacttacattgccgatcaaatgatttgcggatgcaaataatgaatttccatatgtacacctgtagtgggccgtatgataataatatatctggtacattgcagaaatggctttgtagtccaaaattgctcatataattaagttgtcaaattatgtgcacggacaatgcacctgatttgtctgcgataacaggtaatgacgtgccaaattgctcttcagcttctgcatccgatgtaatcacgtttctgtcaagtgacatttgatacttagatgctaataaactaaatctgtatgacaacagttacgggttgaatcaactaattttctgacagtacatgtgcttaagtgcacaacctaaaatttctttaattcagaagaacatgtaaccacattaggtataaaatttgcaagatatcgatcttaatggcctggtgctgctaggtgtatgcattaattctggtgcgctagatatagtttgcttgcctccaggattatatgataagttagatgtattttgttggcctgctggatgtatgcattcagctcctgacttattcttgatttatttgtgcatgccggatccatggaagaatcaacccactaaagtctgaactctgaaataaggcttttggtatactgtggcctatatattctgcacgtcatatagctttcatgtcacagtatatgtacaggttagcactggatggaaattaatacctcatttgttttctatcttttcaagaactttgctcagggttggtataaatcaccacttaagtaactttgtgatggcatccatctagccctatggccatttacatagagcaataactatgcatttatccgcttttcttcttatgtaagtgaaatgatctggtggtatatgattctgttattctctaagtcaatatcttggatgatcttatactgctttttgtctgcaggcttcggggaaggttgagtattcaagccttggtcaagagttttttttttcttatatggtttgacaaaatagatatttggttgtatcgctgacaaaaatgtttgatatagcatattcttgattcatgtagattgacaaatgatttcacaagcaaatgaaagagtatgtgttttagacatttagtacacacgctattatctactgatgtcacgggcaaggatgttggtggaaggattgcggcgaagcgagtatttgaaggacgttgcaggacgtggccctggacctcgtcggcgcggcagagccgtgatcggcgacgcaccagcgaggcagggagataaactagattggactcaaaattgattgctctatttcctggcctcaatcggcttaaataatacatgaactgtaatgctaacaaactcaagagattaagatgctaacaaactcaggataaagcctaataacaaactctagaaaagaactcaatcctaacaactgttggtcgcccagttgttgccgccgcgcggcacctcgcctccttgcatacgtgagtccccacatgacaactgaggagctgttttcacagcttatctacaatgagtcaaaatttaaagtcaacatcatagctacaatgctagattaaatagggttatgaatatctgctcagaaatatttttgtatactcgtttttattttatgccaaaaattttgtattgatgtctcattgaaattgtttatatataggaatcatatgtttattttcactatgaattccctgatttatcctgcactttcttcagaaatttgggtgtaatactctaatttcttttgaatcctattgttacttgggcactgttgaggaaggagggtgttggaactgccacggaggccgagctccaagtggtctacgcgtattcattggcaagatcggtctcaagctgcaattctggaggtttacatattaactaccatcctacgggcttgttgacttggtgttgtatcatattctgttatcaatatttttttaattaacctataagtcaagactgattgattatgtaaaactaaattatttctagctttgttttgtcggtgctaaatatggtgattaatgcgatccgtaactttggtcattgcaatgtaagatagcaacagatatatggagacaatatataatgcatatataaaattagatttcagctatttggtccttgacatctgatgcttttgtttggaaaaaaaaaagaaagattaactataactggcaactaatcaatatggcattcttgcttaaaaaatcacaaaagcaaacctgaattaaataaactgaatatattttaatgaaatgaatacttttttaataacatgggttctacatatcgccgtagcgttagcacgggcaaattactggtataagagaagtcgttaaccagcaaatataaaattaccaccgggcacaactacggttttgtagcaaacatggcaattagatccttcaaaacaaaggggtagcttttcgtcagatgctcaagaccttcagtctccacgatgttcctcaaatttgctggatcttcgagtagctgcaagcacttcttctcaagctcggggcattggtgttccccagcaaacgccaacatggctgccacggttctcacagttacatactcacatagcttatcttcacagaccaaccttagtctctccatcttatacctgttagccgccgcgaccaggtctgggagcatcgccactgcgtctccacctttcatctccggcaacgagtcggtgtatatgaagtggagcagagcctcgaagtcctgcgcctccatgtcgtcgacgcgtatgatgacaccggcaccgccagtcgcggcattccccttctccgttagggagaaaagctcttggtggaacactggggatcgggccgcgagcacattccgatgcgccaagaacgtcttgccgtcgacctcgaacgtcacgtcggcgcccactccggtggcgaggaggccgccgaggtgccgggccaggtccgacggtggcagggttacccgcctgccgccagtgtcctttgcctcgggattcttcatgaccgtgatgtcacacctgatcgtgaagcggttgtcccggaggtactccgatctctccagtacggccttctggatgaaacgcagagatccccgatagcggccgtagccatcgaaaatttgcaacccatggctgtagatgtaggatgtcactggctcccgttcttggtcgagtaagctcaacgtgagctctgctctcacgattgagcgaccgtaatagtagtcgtgggcctcgtggccgtccaagacgaggtagatggatatgcaatcggaaacgttcgagttgaagccgttggggtagtagcggatgtaccaatcgtggccgccaacgcggaaatgccgagactggacgcagttgccgatggagacggcgtccttgatgctggagtagccgttgatctcgagcaggtgctggccgctctccgtgccgcctacaatcgcagaggcggaacgcagcagtttgccgccggcgacggtgggcgcggtggccattggcatatatatggctttaatttgggacggacaaatagtatcgagctgcagaatttcagataacaggagttttgacatcagtggtcgttattcggttaaagctgaatggaatcatcaagtgaggctgtgtttagttcagcgcaaagtttgcattttggttgaaattggagatgatgtgactgaaaagttgtgtgtgtatgacagattgatgtgatggaaaaggactgaagtttggatctaaactttggatctaaacacagcctgaatacatgagagagaatatacggccgagcttaagtcggtcaaaacctctctcatttttatacgcacgtttttcaaactgctaaacgatatatattgttttttaaaaaaacaatcatagaaaaattgttttagaaaatcatattaatccattttcaaattttttaaactaatacttaattaatcatgcgctaatatattgtttcattttgcgtgtcaaggggaaaggttcctaacatagaaaaattatgtagcacaagcacatatatagtaaaaatctagaaaataccgttggattcaaaaatagacctttgagatttgttcatgtcactaagattaaaaaatttactcgtatattctaccatgagagaaaattttattgcgagtaaaattttactcttgatgtcgtggataaatcttacacgttcatttttcaatccaatgatagttttcagatttcactacatatgtgatttgcactatttatttcccactatcatagcctatcaatcacaacatctgttccaccgtgaaatgagcagaggcagagtctcacactgtttgaaagttgaggggtaccagtttcattcaattttgatttgaggattaaagagctgaggaacgagaaataaaaattttcataattcttagcacaatatgttattagtggacatcgctagtccctcaggtattgagagatacggagtactgaacatacatcaaagatataggagtgaaaaatgaacatccgattagatgcattgtaaaatttgtcgagtaccaacctaacaaatacttttctcaagaatagaacaaacttcgtcctaagtcctaactttacgttgaggttcctcacttgaaatctattcagggaactccatttttccaatttagagatatgttcgagtagtgatcgattctacgtactgaaaaagtatttctttagggaagaattaagattataccaaaagagtgtttgcaacacctcatgtaacagattcactaataaaaaaacttcacgaaataaattgttttaaataaagggaaccttcaacaatgtgagtccgttgctctatcagactcagtttgctatgggaaactatgatggataaccccgataatgtcttgggatcaactatatatcttgaacatgaatatcttagcatattgaaatagtataaacaacacgatcaactcacctagatcaatcgaatcagcttatagagctgagctggagatcatatggtagatgatttgacaaaagatcacaatgatatgcatgagcgaggttgcgagtactacacatatatttatacttggttccagaaaggccttgataatgtaaggagaaagacctgaaggtgggaaccacttatctggtagaggtgtggtgcatgatttcattcattagggtttgaagtcttatgtcatctttgttgtgtaaaacttctacctatgtggctggcaaattttaccaaccgagaggctaggttattagttcatgccataattgtgacataccgacttcctagcttggcaatgagtccactcgctataaacacatttctttgtcacaaattgtcacatttaataagttgttagtcgaatgtaagtggagcaggtaagcaggtttttttttatcataattttatttaatatttttcttcacaattttatactagcaaatggaaatgaaccatgaagtgggtttttatgagagttattaagcatgaaacacttggcaaagatttttatggtgaattccacacactgccaaatattttaaggcaaagtatgaaaggcaaaaaaaatattttacaaagtgtggatgatatccaacagttcattaatgcttttatttgcactctctgagttccttctagtaaatcttttgtaagattaaggatttattaaaaggataccttgtagcagtacacacagtcatgtacatgtgtggtggtatttgcgtcttttcgcagtggaaagataaaagtcataggctgtgtttagttccctttaaacttccaaaaattccgtcacatcaaacgtttggacacatgcatggagcattaaatgtagacgaaaaaaagaaccaattgtacagtttgcatgtaaattgcgagacgaatcttttgagcctacttacgccatgatttgacaatgttgtgctacagtaaatatttgctaatgacggattaattaggcttaattgattcgtctcgcagtttacaggtagaatctgtaatttgttttgttattagtctatgtttaatactttaaatgtgtgttcatatacttaaaaaaaattgaaaaggagctaaacaaatggtaattatatctaactaagcaaatatgtgggcaccggcctatccgctagtagttactagttagtataaaaacaaaacgattaacacacctggatcaactgaatattagcttatagagctaggatggagaattctcttggagataaattgaccgagattatatgactaagataggaggtcgttacacatatttatacccaaggccaacaaagcatcaaggagaagcgttgtaatgcattgatttaatttgtcctacttctaggagtgtttttttttttcgaacacgcaaaaggattactacttctaggagtctagaactccctatttcccctatcgtgtagctagggctcattaagaacaaactaaatgaaaactagaggaattttggatgattttattcctacaaaagaatttctaatacgtggcctctggaacaaacaatagcctcacaaattcttttgatttttttatggaatgggctatttcaaaggaagttggagaaaatctagcataaggttctaccttatatttttttttcttccaatggcacaagttttatgtgttttcctgtgtgttatccaaacggtagttttggaatttttctatgtttttaatttctataggaatttaatgggcatgacaatattcatacgtttttcttttcatgtttctgtgttttcccaatcctacattttaaaggagcccttaaatatctctctcccagtatgtgcaaagcttgagaaatgatgtatatatccatactgtgaaagtttaatagggga

SEQ ID NO: 45836 - DNA, 8455 bp, Oryza sativa
aatctcggctaaatttgtgcttgtttttttttcgaaatttattatgaaagggggcggccaaaattcaatttgcgtgagtgacacagtagttgggggtataattttgccttgtgaagcaatttagcctggggttagcgtgcaatcggcccattgcagtaaagaccaaagaggctagcaaattagcgaatcgtattatatgtctgagtctctgagaatgtttagcctgggatgctgtagggtctctgatggtgtagacaaatatgctctccgttttggaattattcagggcagtagggcacaatgagcacttgatttttgatatttctcttctctagatgagtctaagcggtctgtcactttgtttactcaagttcttccacctcgggattaggggatttatatgcaatgtcatgatcttgttctcaatattactagcatggctgtttttctgttccatctgattagtaccctttctaaaataactcttacactttatagcttgttaaccctaaaatcggtggtcattccaatcctttcgtggatactgcctggggattgcagtcagttgcaagggcagcatctgtgtgatcacacagtagctgtagcgacctattcatttctacgctctgttcttattcaaatattctatgtaagttcttctctttatgcattgaaatatattaaggatactgattgtgttgctttttttcaaataaatgtataattattatttaacttctgctgagactagaaggttatcaattactccctcagtcccaaaatataagaagttttagagttggacacggttattaagaaagtaggtagaagtgaatggtggagggttgtaattggatgagtagtggaggtaggtgggaaaaatgaatggtggagggttgtgattggttgggaggagaatgttggtggagaagttgttatattttgggacaaatcctgagggttaaaagttgttatattttgggacggagggagtagaaaatagcaattgaatgatacaccatggtaacttgtcttttcagtagtgcacttaaactttaatattataacttcagtaggtggttgcagaactcatgacttctgttacaatgatggttaaaaaggccggaagcctcaattatatttcccaatgacatcttgatgctttatatgaaaactcctagatgcaaaataagagtagtttttttcccctgattccctggaaataacttgtgttttctgtcaatttacctccccaccatgaccttcagtactttatatagtttagtaccttaatttatatattttcattattacatacttgacaaataaaaaggagaaaatcaaagtgttgtatatttctgttaaatgtgggtttcttataacagaatatccttttcaggtattatggttttatccactttacatcttcagcttcgtgttgagtacactttggtacgtttagtctctgtccacactggatatcttacttcccttgttgaccatactagtggtttacttttcctttaaagagcaaacacatggtttgagttgataacagaattacctagcagcacttgatatagtatatatttttatagtaagtaaatagagaaagacagaatgatcataacaatggtactatgcatgtatgagcctatcataccacaattaaatcagtgaatttctgttgaactttagtgcttctaaatgtcagtattacaatatttggttcagaagttacccattttcaatttgtggtatgctctgggattatgagctcaaacataaaatatttcagtaagccttctcagggcattatcataaattgcaaaactttctgttggatatacgacgacacccactttctgtttcttttatcacctcattgatggtgttttgcatagtttcatttggtaaaacccacctgtcttgtaagatgttactgcagaattaagaatcactgagtaatcaaatcaaaagtgttactgtaatcttgtatagacatttgtattagcaacatagcttgaaaatatttagatgggtttgtaactcctatatttttgcaacatgcagatgtaattactctctttatgctttcatttctctaaatcttaagtgagttctctgtgttgcagtccttgggtttcaacactaaattgtgatgaataaaatctaaacttcgatttactcataggcacatatttacaatttctctatggaaagctcaattcttgattttttttttctgcattgttacattattacaggtatggactattgttttaccatcctcaagattcccgtatttcatatactaaacagtggtgggcccaattgtaccttttgtaacattggccatctcacgtcaggtataatgacattgctaagcatgctttggatgttgtgaaaagaaagagcctagatgcaactaaagcattggatgctcacaccatatctgaatcaacagagaaacctgaagggtttgatgagtaggttcacatgaaaactcgttgattgcttgttgtttttacatgttctgcatgttgacatgctattgttagggttgcaattggtattggagaacaggtctattcaattcttcttttaactattttctttattgaggtatgtttctttgctcatgtttttccatttgtcatgactcacttcacatctaatttcacagaacatgttttgttggcacctcatgctcatttaagcttatctagtgctattcttttatgctatctttttccactgatatttaagttgatgctgtacaggtttcagtaattggttacataccttactttgggaagcctatgaatttcctgctattatctttgatgtatgcctactactgcttcgagtatgtacatcttaatgtctttaagcattctttcaactccctatgtcttatacatttgccaggttacgttattgttgtaaatttattgaactattcttgtcaggtacaagtggaacttctttgcagtgagcctgaatgagcggcttgatttctttgagtcaaattgggccttttttgctggattcggtatgttgataatcattcattgcatatggtgcaaaatatatgcttttgccttcttaggccatgatgccctgcctgtttcagctttggactgtaatgcaaagtgattttgcattttaaagttttgatttttaagaataattttaggtagatttttacttgtattcttagcaatctcgagaagagaactggacaaaagtcacaaagagaactcctaaaatccttatggttatgcaaatgtaattgttggaaagtaatctaaactataaacctttttgtttcttgtgcatatgttcttggcaagaaatacatgcatctctaatcgtctttatggaaagtgttggtacttatgggatcttaattctctcaacttgtggtcatcatgcttggcagttagcagataagtcatctattggaagtaatcctgtaccaagctgaacgttgagcattttcttgtaattttcatggacaaatatatctcggataggttctcaggcagtcctagctatttgcggcatgcatgttccttataaagtttgcaggatcctatataactgacagttgttgatctgttttgatgtacctttataaatggcatatgttactatgtaattctgtttctgtacattcttcgacttactccgtgtatgctagcatttatgtgattgacatgttctttgataccatttttatataggtagtccatgtgtacttccaattttcttcttctctcctcttacaagttatggtgtaatggcaatactttatccactggtatggagaaacactcactagcagcattttttgtttccatttaaacagcatgcagacatacttgctcttgtaaaataggcatagaagctagacatggaaaatcccttaaaagcactaactcataatgccattcccaattcttatttgggccaatttgtttggttccatcacaaaaaacacaagagttggaaaataccgtcgcacgtgtcattgacaggtgggtccagacaccacatgtcaattgtcattcttacatatgatgttaaattttaactcatttatctctacgatggtatttttccaaattctcttattaaaaagaactcaatccgcaattctacatccagtccttttctccaccgaaactggtgtggaaactggatgagaaaaaacagtatcttcctttgttcccttccatctaataatatttcccatccaacatattctgagtgcagttatgcaatgttgtctgttgcagtttgtattgactgctgcaggtacccaagcagaaaaagtaattgatcaactgaaaccttcgcatggagggaaactgcagagaatacctgttttcttcatagctaagcgactaacgtaagcactcatcatatcactcattcaagaaaattgcattgttatatcattcaaggcttcacaggaatcatgccattttcttgtatagaattagctaccggtgctaatgatgtgagaatagttaattgctattgtttgatatattatcttttaaccatatccttccaagtaaaaattggtattggttatttaattcttattttcatcttcttatagtcttaatctgaattagaattcagtacagtatgctgagtgctagtattcagaatttcagattaatttccttttagggattatcacagttttcctgcaccactgctactttgcttcccttgggtgcactataatgtattgaaacttgtctgaacctgtatgtgcaggactcaagtgctgcaattgtttccagaggtacacaaagaacaatgaaaggatccacataaccatagcaaaggaaacaaacgctgtgctgggctttatcacagtgctgctgttgaagttacacccgaagggtgtataaccagaactgtaaaactgtaaatattccgccattgcgattgtatatatggggataaagggaattaaaaaaaaaactatacttgtgcaatgatgtcattcatatttgtgtacataagtacataacaacagcaacatctctttgttctacgaaatgttatagccagcagaaaggttaatgccattactagtgctaacttctaaagtgattctcgttggttctacccttgtaggtttctaggttcactttgtgtattcgagatttgcatgaacgcgtggcacatttgacatgaacacagcccaagtcgttaggaatttaagacgtcaactaatactttgacatattcatgtatacctctttttttttcctttttggcaatgatatattgcgtaattcaggacccgggaatacgccgtgtacctgcttgacttgcgtgtacatactccatgaaagcgagcgtgcgtattttgtgttaaccactgtagcttaagactgtttatcactagtactatttattaagccgaattgccgaattgacgtgtaaaggctaaccatgttcattaattcatggattatctaaccacgtgagtcgtgactaggtctcacacgaatattgagcgcatttttttttcacatcagaaatttcaattgacccgaacgatttctctatgtacaagagccaataccaagatgtaatattaatattagtattagcttaaaaatatgaacatcattagcctatttttttcatggaagcagcctttaagattgtatgagaccggttttgtacttttgtaaggtgctagacaaatttccatgatttcatcggcgcagcattattagctggtagtttgtcctcttgtaattcttttctcagtacatgaccatccataccctcatgtcttctccattttgaattagcatattagcatgcagtcatgtacacaatagtacaatacagctagatgtgtacaatgacaattctaaatactagagtactattactactatcattgcttagaaacgaccaaaacaaaggcagctgaaccccgatcagcgactaacttgccatcaacaataatcaactatattttctcccccaatcaaagcatgcatggtagtctgctttcttcctggcaattttgtctgccatcttccttcagtttctatcatgaatattatacataaagcattttcctacaaatgtgtaaacatttttttatatgaaaatgattggatggtgcagatgaactggactttcatgataataattcacatctcacacaaggacgaaaaagttggtactttatgagttacacctccgtaaaaaaaataatacagaaggcaacttaaaaataatttataggtaatttttatatatatttatattgttcgtagcttaaaagctagtgttgaaaaatataccgccatataacagaaaaaatactaaaattaaattaatgttttaaaatttaaattttggttgtggctgataaaccaccgagcatttgtgttttcttttaattaatgcattctgtggccggtgatcggattgaacagtctttatttaatgcatcccctgtttcaactaagaagagttggctgctatgagctgcaccctaaattttgtatggcaactggagcagttccaattcttccttgtggatttgcacaattctcccatttcgtgcatgagtgcctgtcatccttgcacagcatcattgcttgatgttgtgttgccacctaactcattagcataaacaaaaggatgaacaggagctaagcatcttacccactataggagcattacttgatgccattgccatgtactccattactacaccaatgcaaatacaaagaacataagtactcagtttcatcatgattactaaattttctgtggtgtctctggccaaaatttaccgtcagctatgatttgccaaaatttggtacaccctctgaatgtttgctgtctctttacaagaactcttctgtgttacttagtgatagatattgagtttattggcattgtaggggatgtaataatcgttaatgattaatcattatatatggttcatataataccagacgaatgagcattaattggtcgttattacgaacccctcgagctaatcaatatctcagatgcaacttagatctcatgatggattggtggagccgaagctgcagtggatgtagctctcagcttcctggaccagtactaccactgcccttgtgctgggttcactgatccttttaagaatgttgagctagctagctagttcatcttggcaagcaacaacttcatcttcaatgcacttgcattacttgcattgtgttatgatctcttgtctttttggcaagcttgttggtgcgaaggtgaccggccctgtcgtccggtgcgtgtatcatcaccattccatcgaatccatgttatgatgtgaagtcaacttaggcaaaaaaatagggtcatttggacatgcttatgtttgatgagatgtcttgttgcaaagtaggccaccttcatgtcaagatatatatttacagtgtaaatggcaagattcccagtattatggtagaggaagtttgcctcagatgaacttgaatgttacaatgattttcgaagaaattgttggtttcccttttcgccgcgtttggaacgagggaatttcttctgtgttttattgcgggaattgaaccttttttcctatgaaatctattcaatactttcaccaagcattactctacaagagagatgcaatcaaatatatggtagtacatattaacaggcagaccttttttcctgttggttgtcaacattattgttttgattccgtcgacccacaaattaatcaatttcttgcttttcttgaagactaaaatttcttgctcattatgatgctggttgaaaacccctgtttgcgcaactaacccatagcgtatatgttatcccaatcggtgttaggatgagcgtctacatccattaccaagtaaaaggatcattccccaattggatacaggtaaaataaaggaaatattactgaccgaataataagcaatgcaattaagcaaatataatttctgttataattcctgttactttcttgcagtggcactgctcatcatcagtgcaatggttgtagtgctgtactaggcttgtgtaaagcgccgaaatgcagctgtgttcctcttcttctttttcagacaacagaagctctgtctcctcgccgtgccggtttgtccctcttttccactcgtgcatgcatgtactagaaaagatggaatcatggaacaatatggtacaattaattaaacttatactaactcttacaattattgtgccttttctatcaaaaaaagataggagtatattcaatctacagaaagttactgaaagccgaatattattagcctagaattcagcgaagaagctccaccacgaaactcctacatttattcgaaatggcttttttcaaatttgcctcgcttttgcagatcaatgattcgaagaggagaatttgtca

SEQ ID NO: 45837 - DNA, 9402 bp, Oryza sativa
  unsure (1)..(9402): unsure at all n locations
gtgcgcattgcaccacggaaaaaccaaaggaatcggaaaaaaaattctatgaaaattccttctttttagcttctgcaaagggaatgaattgcaattaagaaaggtttttcctttttctttgagataatggaataaaacttcagcctttactcaacgagttacagccaattattacataaatttacccgataacgagcacacaccagaaagtccataaaagcacacccaaatactagcaaacacaaactaatatgcaccaacactagataaagatctcacaattattgaatcttatttgtgaaccttcgttcgaagttgacgaaaaactgcatgatcattgactcaaattaagagatgcagtatttattaactcgatgttttcattacaccttcttagccattacattgccctgaaaattatatgtatatgtatgtttttttaatatgatttgccctaaaaattaagaaaggtttggagtgagctagctagaaatcgatctgttgataattggtcgattcgtacaatttgattaggacttaggagttttgatgatgctctgtgttgttgcacagtgcactagtggaagccggcacagtggcgtctctgtgactggcacgttgatgacatggcacctactgcgtgtgtgccatggctgcctttgatttgtttctggccagtggtaatcagtgcatgcgtggttgctttggattgaatatgatgcttaatttggtgtagagcaattaagcaagcctagttgacatctcagttggtgcatgtaatgtactatagtacagtatactttcgtgtgcttaatcagtactacgcctggccagttgaatttattctggtttatgcatgcaaaaaacaaaaaccaagggtccttgaatttgagcacagaaatggaattttcgctctatgactccttccttttgaaccaggacatgatttccaaacttttgaactgctcagttttttaagaacctttttgagcatttaatttttccaagttttaaatagttaatccattcgtttgcatgctcaaatattatcacgaaatcagataatgcatcactcgttctaaacaaaagaattgagcatatagtggaattttcgtactattcatgtcaaatatatataatttgatgaaatggcactgaccccacaatgtggaaattcatgtaagtagcactttacggatttttctatgattggcatagtgaaatgacactatcacaccaacccctcgtacgtggtgtggtaatgttaattcggtacaccagtatgccaatcagatcgatatcaaaagttcaccgcgctagttagattagcgtggcaagacaatactgttgaaagatgttgcaggtggcgtgacaatgttttttcatcgtgtcagagaaatgccaaggggtttttcagctagttacataagatggtaggctagacaacctgagttcgaagccttacctcttctaattatttgatattagatctttccctaatattcgcgtctttttaaattggcgtgataaaagattcagatgtaaaaatattttttaggagtatttacttttaaaacttaaaaagttttattaaaatttcgcagcttgcaacactgatgaccatacaagttagaatcagcataaatcgtaattacgagatggttggttgttagagtagctggaacagatgattagatgcaacaataggcatgtaatccgacaaatcaaccgatcatttgcgacctttgcgtcgtaaacaaacggtgtgaattggccaggggtcaatcggcggcgggttagtgcgtccaaatctccgtttataaaatagtcatgagaaaatcatactgtttttcatccgtatcaactgatggtttcgatcgaccaanaaagacaagaagtactggagtttgaaggacgctggagggtgccaactctgttttacttggttccgtcgttacctccccgtgtctagtccacatctaatttattgacaaatgtttttttatagtacatcaagttggtaactaaagtttcctggaattgaaattggcttatgcatgcatatgttccatttatatgacaaatgcgtttatttctcgtgtcaactggtatttacgttaaaaggagaactaaattttcagttgaatatatggcctcagctcattgagatatcctcttctaactgtagttgtttctttccgtatattttgaattcagtcccatcattttttcctacagctgactataggccgtaacacttattagggaacaagaaataatttataggtaattttatatgtgatgttattagtgacttaaaagctagtgatgaaaaataaattacaacaagaaacattaaaatcaactataaaattaaatttttggtagcggttgataagcttatagagtattaatcatcatataaagtttttcattaggaacaagaaagacttaactaccgtatattttatttaatatgagtatgtggtaagaaagaatcaataaacattctccatatacacaggaaacaagtgtttaactacttctaaatgcatagattacgataatgttgcacatcaaaataaaggattaaggttatatgatatgataatcagtatggaacggagcgagtagtatataatttgatacctcatgataacggcgtactaataatcggcaaattttgctacaaaacaccacgaacccactttaaaaatatgcctaataaaactggacactcttcattggtatacacgcttgaaagattcacatatgtttacctatgctgcgaaggattacattaccatctcaagtgacagatcctcatactcctctgctgacgtgtacagagcatgccagctcagcatccacgtcacgcaactccccgatcccacgtggtcaccgcgacctctctactcgactactccataaaaacccaagcgaactcacgcctacgcctccaaaactccacccacccacccacaccgtcgccatgcccaccgacgccgccgccgccgccgccgcctcgtcgccgtcgccgctccttcctccggcgccaccttccgccgctcgccgccggcgccgtcgcctcctcacgtccccgaacccctcggtctcctcgacctcgacgtcgtcgtcatcgtcgtcgtcgtcgncgncgnncgccagcctctccttcccgttcgctcccttctcgccggcgccctcgccgttccaccaccgcttcctctccccgctccgcgcctccgccgtgcccttctcctgggagcaccgcccaggcatccccaagacgcccgcgcgccagcaccagcaccaccgcggcggctgcggcggcgggaaggtctactccacgccgctgcccctcccgccgtccctcctctccagcaaggtggtggtcgccgacgaagaccgcggcggcgccgaccgcctcgccgtctccgacgacgacgacgacgcgaaggccgcgaggaggaggagtcggcggcggcataggcggaggctgctgcagcggccgcggcggccggcggcgctggccgccgccctgacggactggctcgccgtgctgagcctgtaccggtcgtgcacgaggtccgtcgactgcctcgccgacgccggccagccgccgacgacgacgacgacgacgccggcggcgaaggccgggtgagaattgagatacgtactttgcgttgcgtggacgggtgggtgcgattaagagtgtgatttgcggcggattaatcaataatcacgtcgatttgtgcgacactgtaattaattaaggtgggttttcttttcttgtctgtgtgcatgtgcttgctccaacataattagtggatggattaattcgacacgattagtacagtaggctgctaaatgactgtatgtattagtgctgctgctgttgcgattggtccatttttcttctttttcttcttcttttcctttttaagaaatgtaatttggtcagtttggtcgctcatgtcatgctaatagtaatccattctgctcaatgtgtggtgttgcacgtttactattactccaagcctgtttggagaagtttctaaccgtttaaattttaactcaggtttttagaagttgtagttgtagaagccaagagttgggttttccggcttctccagattttcaccaactgtttttcataattttaaactcccctaatggggcctctgttagtatggactgtggttaaggtacatctgccactggctggtgggttcactaagggcctgttaactttgatgccaaaaaaaaccttaccaaattttagcaattttgacaactatgccaaaattttggtaggatttcttacatagttatcaaaatttagcagcaaattaaatgtagccacttttttagcaattttaccaatatttggtaaggttgaaaatgacatcaaagtgaacaggccctgaatataattttctcctcgcactctaaaataaacattacaatatgtgtttttttacaaagacatgcataaaataattcacattttctttgataattaagttcacatattggacctaccaacatagatactgcttggttctcgttttacaattctaaacgatttaaatttttaagttagattttaaagaagaattatatatgaagatattttacttgagctatgcaatgaaagtgacagaaaaaacatcttaatgtcgtccgaaattcaggtgctttggatttcgattataatataaagatttaccatgcaggacctagagttattcaccaaggatatataaaaaaatgtaaatatttttttaattatctaaccaaactatatatatgaccaacagttcagctgagatctctagcgaatggaatagaaatgttccatgcatttttttttttcttctacatttggtcactggctcactgctaattatgcaagcattagtttaggttggctgatcagcacatgcagtcggcggtttgaaacaggctgcagctctgcataaaaggataattaatttgtgcaaaaaaattcctcccacgtgcaaatatgtatactacttatttcgttcgtattataaattgctttgacttttataaagttaaattcttttgattaagtttatataaaaatatactataaacatttatagcactaaattagttttattaaatctaatatttaatatattttgatagtctctttttctatattgaaaatattgtttttttatgaacttgtcaaagtttaagaattttgaaaaaaaaagatcaaaacaacttattgtatggattatataaaacgtggtactagtaccgcagtatgggatgttccaatgttttatagtttccccttaacgtgacaatgcacgaataagcttgttgacttgacagcatattaatcaaatggatgtccaaatctagtcaccaaacattcaaaataattacaaataagcagtatcatggcccgggttataagcacaatttacatacaccctaaattgcaaatcctaaaaatactagctctgtgcctagctatgtaaactggtacggttcaaaattaatttacggcaaattatttttaaagaaaaacaatcgtcaccagttaagttattttgaatacatgcgtgcgcacaaagaatggaaggcaagtagtagagatattttgatgaaattatattttgtatagtttgaccatgagaatgtgctgtacttcacgctcgtctatcggactatcggaggctcggagcgaccattttcaaggttcaaatcaaaatctccaacaactcacatgtttacaatgaaccttcgactgtgaccaaaactgtaatttaaaccaaaaatatgataaaccgcaagacaaagataactagataagcataaaaatgttttttttttgacaaactcatacaaacaaaaaaaaactaaccaaataaacagttgtaataaaacaatactaaacttcacaacaatcttgaataaccgacaagtagaaaagaaaagtagtagcaaaaaaacaaaaccagtgttttctactgtgtcactaattttgttttaaccggacgattacatacaaaccaaacctcgtttttgtcaagtactcatcgcaatcaattagtgagtgcgaggtttaagaaaaaaaaaggattagccagtacgatattaatgtctcgatcagacgatcagctcactaatcactcagccttatgtcacagagtataaaaatgcaaattataataagctgcttccttcgtttaaaaatgtttgacaccgttgactttttagcatatgtttgaccgttcggtttattccaaaaaatttgtgaaatatgtaaaactatacgtgtacataaaagtatatttaataatgaatcaaatgatatgaaaagaataaataattatttaaattttttgaataagacgaatgatcaaacacgtactaaaaagttaacggtgtcaaatattttgaaacggagggagtactactaccagcaattgcaagatgcacagtaaacaggcaaagctagctgtagcattagcactagcagcagtggatgcagagacagcgagacagggcgttcgttgggtcgcgtccctcgctcgtcttgaccacgaaagagccttccattggcagatgctgctggtacaaccgcatgctaattggagtaattaaagtcatctgcaagaactagctactcagctggttgatgttgaattcgagctgaatttcctattaaattcctgtgaatttggtgtttaactccagcaacagtgcagagctcgcctggttagagcatccgcaatggtaaagtaaggtgctctctataaaatatgtatatcttagcaatagactagattaatagtaaaccacctcaataatatgtctacatgggtatctatagctctctcatgtattgcctcgtttttctctatagactatctctaaattagtagatagctttgctctctctctcttcatttaatatcttccatgtaggaaaatatgctgacatggatctcttgtagagagtctatagataaccattgtgggtgcccttaggttaggtgatgatgaacattggacagggctatgtagccatttgtgccactcaaagtcaaatcgcgatcgggaaagtaggttaaggctatgtttagttcaacacaaagtttgaattttggttgaaattgaagatgatgtgactgaaaagttgtgtgtgtatgacaggttgatgtgatggagaaggactgaagtttggatccaaactttgcatctaaacacagcctaagcagcatcggtgcaggtgtgacactgtttctaccaaatcgctctcagatctgcgtgagtaaccaaattgatcgatcggcgtcagatctgggcagatggactgatggatagcaaccactctgacatcatggtcttcagtaattcagggagtatactgtactgtacttctgctgaattggatcaatcggaagaggtaacttgacgctaaagctactactactgctgatgagctacagcttcgtcaaccacgcatgcgttattcaccttggccgaggtgaaagtgaattcctcgtttgactgtaacaaagagttaatcctgcttggagtgcaagggaattcatggcagaatgcagattaatcgatactactagtcactgatccagtagtcgacactggtttccaaaagtcagcgcaaagtctctctctttctttctctctctctcgtattttgtccgtttcatataaaaaacctattatcaaatatgagatatcttaatattataaatctgaatagaaatagcttatattcagattcgtaataccaagttagtaatcctgagttagtgtaatagtttgattttctggggacgaagagagcaagctagcaaccctacatgtgcaatatgcacatgtgcaatcgatcgatgagtgcttgttgccgtcacgtcgggctgtcgctgattgatccatactatgcctgtctggataaaagcttttcaacgcagaactgtgcatgtgtttgcaaatgtcatgggtgaataatgctgccatgtcattgccggggctgggtcccgggaagaactgcactgactgcgttcttgcgttagtggcttcatgcctgtttcgcgaaaaaagaatttctagttgtcacattggatgtttgacctgatgtcggaagggattcttagatacgagtaaaaaaaactaatttaataactcgtctggaaaccgcgagacgaatctttagagcctaattaaactgtcattagcacatgtggattaatgtagcacttatggctattatggactaattaggcttaaaagatttgtctcgtgatttccatgtaaactgtacaatagttttttgtttttatctatatttaatgcttcatacatgtgtccaaagattccatgtgacgttttgaaaaaaaaattggaaactaaaccaagcctcagataacaataaatagccaataattggaggaccttttctcctgtaagagcaggtgcaatagcagattttgaaccagctataaacacattccgatgagataaaagatgagagagaagagtagcgggctataaattcttagtcagctgcagcatggactccaagatacatgtgtgtatgataagtgggaccagatattaattgtgtagtatatatttataggtaactattggctattaagttgactatagatgatttggagccagcgattggctattaaacttgctctaagagcaagtttaatagtatagcccactactggctccaatttatctatagccaattcatacaatagttgcttactatactattaatatatggtcccacatgtcatacacacattgcgtcttggagtccgtgctatagctggctataaatctgtagcccgctgctcttctctcttatcgtttatctcattaaaatatgtttatagctaactaatagcctgctattgtacatgctctaagagctctgaagatagccgggccctgtttagatgggactaaaacttttaagtccctatcacatcggatgtttgaatattaattataaatattaaacgtagactattaataaaacccatccataatcttggactaattcgcgagacgaatctattgagcctaactaatccatgattagcctatgtgatgctacagtaaacattctctaattatggattaattaggcttaaaaaatttgtctcgtgaattagctttcatttatgtaattaattttttaagtagtctatatttaatactctaaattagtgtctaaagacagggactaaagttaactccctgatccaaacatcacctaagactgtgagattttgtgtcatcgatttgagtagtagtactagatgatatgtcttgagatttgcgagttgacattgttcctaattcgct

SEQ ID NO: 45838 - DNA, 1784 bp, Oryza sativa
agatttacgtgttagatttatttatttggggataaagagagtatgtatatcgacatgtttttttttagaacgtggaaatttggtattaattgtttggtctcttcgtgcacttatctgaagctagcttcatactccttccatcatattttaagtgcagccatactttttcgtgctcaattttgatcgtctatctgaaaaaaatttaaaaacataagtcgcgcataaagtactattcatattttatcatctcataacaacaaaaatactaattataaaaaaaatttaaataagacgaacgattaaagttagatagggaaactcatgatctcaatggatggagtaccagcgaggcgtattttatcgtttgttttcctcgagttatctgaagattttaggtacggtcaagtgggtcatacagtatgtactagtagtacaatctgctggtggcgtcagtagagatactcagcagagcagagcagagcggtgcagtaaattggctacaggttgggccggcagttctacgtacggtgtgctatctgtctaaacggctgtttgtctgcagcaaactaatcaatcagggttctggtataagatggaggcaataatccgatgaatgatccagtttggccggtctataaactactccctccgtccaaaaaaaggcaaaccataggtttccgtgtccaactttgactgtccgtcttatatgaattttttttataatttgtattttcattgttgctagatgataaaacatgattaatattttatgcgtgatttgtctttttaatttttttcgtatttttttcaaataagacgaacggtcaaatattggacacggaaaccagggtttgtctttttttttttgacgaagggagtaaatggtaagaccggtttattgtcgtccttgtcaaattttatttttattttttacgattacacgacagacgcaggcctacacatatataccactctatactcacaccgacgaatacgtccccacatattccgagagatgaaaactaccggcacatctctcattccgggaatgcgccctcaccaatttgttacatggttgatcgatcgcggccatatataaccaaacatgcattcagcaaagctagtataaaagacacaaccaggatcgatcacgtacggtgccggccggtcacgagcgccatcgccaaataataatgcgcctaattcgatagctgcgtgctgtagctacacattcattcgcctcgcatgcaggcgtacgtggctggctcgattatattgaccgtgcggttgagggcggccaccacgtacgatgataagaagaagatgcacggatgcaatgcatatgcagctgcaggtgttgattcgaccgaccagatcgacgacgatgtaatggatcatgtatggataagtcatcatccgaatcgatcgatgatcgatccccacatgacatgcatgatcctgcaatttcctgccgaccattttgccctaccccactatcaattacgggtggtcgatcaaatgaaatctttctcgcgctccctcgacctagtttaagagcatacttgcatgcatgaaaggtttcttctaattttcagtttggacaagaacaataaaaatgagcgatttgaacagcttgaaaactaacattccaaaaacggaacgaaacattagcatataattaattaagtagtacagtattagctactacctccgttttttaataaatgacgccgttgactttttctcacatatttgaccattcgtcttattcaaaaaatttacgt

SEQ ID NO: 45839 - DNA, 2424 bp, Oryza sativa
gcataaaatttttgaataagacgaatggtcaaacatgtgagaaaaagtcaacggcgtcatctattaaaaaatagagggagtaatttttttaaaaaaattaatataacatttttaaaacaactttagtacgataacttttttaaaaaaattcaccgtttaaccgtttgaaaaacttgggttggaaaactcagctgcggaacacaggctgagtagtaatatctgtctaggccctttaatttcacgcttcatatgcatatgtatagcctcttattcttctttttttttttttgagaatttgtatagcctcttcgatcgtataattaaccagcgttgcgtttggagaacggccgagcacacaagagtgtgtcctagcctgccgtggccgtgcgtacgcacgtatacacgtacacatgcgtgtgcgtgcacgctgctgggtggtggtggtggtatatagtggatacatcagccggccacgtacgaaacacgactactgccctccaggtagctagctgaaattgcgacgacgacgacaccaattaattcgcatcgcacccgtacgtacgcgagcaatcgcaattcgcaatcgacgacatacatccaacactggtcgcgcgcgctactgatgcaacggcgcgatagcacgtacgtacatacgtcggtacgtgcgagatttatttcttcgacgtacggcgcgtgttaattaattttgctgtgtacatatagcagtacacagcttacgtgcattatcattccgttctttttctccaacaaaaattaaatgaagattaaagttttcgttctttttctccaacaaaagttaaatgaagattaaaatttttgtggcacgttttctaaactgctaaacggtgcgtttcgtacgaaaactttctatataaaagttactctaaaatactatattaatctatttttcaagtttgtaataattaaaactcaatcaatcatacgttaataccattttattttacgtaaaaaacttaatttttctctttatttttatctttaggagaaaatagcatcaccgtatatgacagtagtggtgtatctgcagtgccgtgtcggactcatcatcgtcgacctgaagggcccatatatgtgtagtgcagatgtatggctacaaggcccatggaagcgaaactttcactagcgtttttttagtcccacctcggggagcctagcgcacgggcgcggggtaataacatctccagggcgagctggtggcgtgcccaaatgaaggcacacccggcgcaaccatgcgcggtatgcgcatttagcaattgaaaatgctacgcatacgatcttgttacgataagacgcaacggcacggacggcaacagcaaaacgtcacgcacggcgcagtctaagcgtacttatgagccctaaagcccagttcacctctaaacctaactttacgttcactactccaaaccctaaatctgactttcatgttctgatctaatctgcaagtgtgaaactaatccaatagcatacgcatcgaagacgaaggtatggcatcttatttacttgattttctttagcttcacaatcatctttttttttacattattctctctttcttttttttcaaggaacatatttgtatgcgtaatttgcttaaccatgccacatgataaattcaatgttgagtgctaagtacaattactatatacagtaagatattaagaagaggattgcttaagatatgattgaaaagaaaattgctttggttggctcattggctctccaagcaagccaaccagatagcaggccaggacgtcaagagcttgggcttggatataggatcaactgaggcctgagggatccgtttgattgtacaaccatcgtacgaaataattcgtacgtatagcagcgctgggtatgaaggcacacccggcgcaaccatgcgcggtatgcgcatttagcaatacctaaaccaaagttaagtaattggagtcgctgcagggtgacagtgcgagcgtatgacacatacgcttagcaaaaagtaacaacttttttattgagatttcttttccgcattagcactcggggctggttcactttgtagctattttgaactctactaaaatttagacaaattttgatatattttggcattaccaatttttttacgaattacacccccccgaactatcgcggtcaaccgaattacccccataaaccacaaaaccggatattcttcaccctcaactatgtaaaccggacgaattaccaccctcgacccaatccacggtggttttggtctatatagcgtacgcgtggcagtccagtcagcattctatattaaaaaaaacatgagacccacctatcatactcctcttcctctctctctccctctctcccagcattctatattaaaaaactatgagacccacctatcatactcct

SEQ ID NO: 45840 - DNA, 16998 bp, Oryza sativa
taaatccccatcctctctctctctctctctctctctctctctctctctctctgctgcagcgagcggcggcggccagccggcaaggcgcgcacggcggcgcgccctctctctcctcccttcctttgctgcggcgagcggcggtggctgacggcccagcaccgcacgatagtggtgcttccgcggcgccctggtccggtcgctgcccgggcggctgctcgccgccatcgccgtcgtcttctctgaccggttcaccttggccctcttcgacggcggcggtgtcgttgcagcggcggcacctcgctttgacgatagccgccccacgcttctcttcggcgtggctagtgagctggtgagggaagggagcaaagagagagagtgggattagggatagagagatagagaggtggcgaactgacaggtgggcccaccgattttttattaaaagaattgctgactgtactaccatgtagaacaaaaccaccgcggattgggtcgaggggggtaatttttccggtttgcatagttgggggtgaagaatgtccggttttgtggtttaggggggtaattcggtcgaccgcgatagttcggggggataattcgtacttttttcttcttttttttgcggggtacttttttccaaattttaaaagtgatggatgtgtttagtttaaaactttactaaaatttggtacaatttttgagaatggaaacttctggaattgtcaaagtttggtagggtgatattggcaagtatatatgtttagtttgttgtaatttggtgctttcaaaatttgataagattgaaactagcgataaagtgaaaaagttattaataagcccataaatgccattacgccattgccacgaaacacaaaatccccgtgcaacgaggcccgaacgggggcgaatgggcgatcgatctcatcgcccgctctgcgccaagcaaacaacaggcaaagccgcggggacgacgttacgttacgttgttgtttagtcccataccggggagctaagcccaagcgctacgggtgataagaggggtggaccgaatgggaggcgtgcccaatgcaggcacacccggatacacacgagacgactactcgtgctgtggtgggaccacgtgtggaatgcacgtgtagccgaaatcattcaggaattcaaaaatccaccggcgagtgacggtgcgagcgcatgacacatgcgcttaagcgatctccatactttttttaaatttttttttgggtccatcaatagatggtttccatgcttgtttcatcaatgtcgtttcaaggccatgcttgtttcatttcatcaatgtcgtgcacagttatcttggccatttctgttcgttcaattaattggattcggtttatttaaggacatgtccagcgcagcgaaatcgatctgattttgccacggctccagatccaggctagtggcccaaccgttgtggcctggtgggctcgtcgcacacacgggtgcagatggaccgacctgatatgatcgggcccaaagaagagaacacatgtgatatataaaaggaaaatgaacaggacgaaatggcaacatctgagtgaatcaaatcaaatcaaatccactgtataagcagaagagttgttcatgtttggctctttgccatggatgaccaaccatgatttattgcaccttttccccttcgtacaaaacgcgacaaccatacggcggctgcacgcgctccgggatgaccaaattatctgagaaaaaggggctctcctgatcgacttcttctacctatacttggctggtgtacagagcgcaatgcataccagccagtgagacagatcgcatcacaagattaggacaacagtaagaagcttgatgccttgattagcttccattttcaaacctacaaaaatgcccagatcaaacaatctgcaagtatacgaacctctcgggagagaaatgccagaccactctattcgtaatgccacgggacacgcacagtactccaccctgcagcaaagcaaagccagcaacgacggggaggagaatgtttagtcccgtaccggggagcttggcgcgtgcgctccgggtgataagagggcctgaccgagtgggaggagtgccaggatgaaggcggcacacccggatacacacgaggtgagtcctcgtgctgtggtgggatcacgtgcggtatgcacgtgtagcaacaaaaaaatcttggtcatgacgaatcaatccacccagaggtgcgattgactgcgcgggcgcatgacacatgcgctttggcaatctccccccaaccctttttatttttcccctttttgggtatacattcccggttcgaacaaaggtactggaggaaatggcaacacgtatcagtgaatcaaatcttttttttttcagcttctcagttcgaacaaaaagatggaatcaaaccatatactgatatgctaaacccataacgttggacgtcaaacaaaaatgaaaaagaaatggagggagtatttttgactctttttctatgaatcaccagccttttattgcatcttccccttcgtacaacatgtgacaaccgaatggctgcaacaatgaaattatagaaccctctctgtaacgaccaaataatcggagagaaaaaaaaaaggctcctcatttctactacctacttgactgatgtacatgtacagagcgcaacgcatgcccacgtcgccaccacaagttttaggacaacagcaagaagcctagcttccatttacaacctacaaacaatgcccacatcaaacaatcggacaggtcacaggcgtcgtctggtgttttgctcttgtcggctgctgtgcagtgcggtgcagtgcagtgcagtgcagtgctattcttgttgtgccttgtcaagatcagatttggttagaggtgaggtggactgctctttgtctttgtcttttgcatttgccggccggttactctggttgacaaggtggtgaagccagacaaccaggtccagaatgtagtcctcggtcttcgccttgtccgcatggtagagcgtctcgaccacgtccggttggcctggcctccttccaaccctctcagtcctgaatgaaaacagcatacgaaaccaaaaatgtaaatgccatgtgtgaaggaaatcttagtttgcacaacgaactcgtagggcattcgataatgtagttcttaccctgatctcgcccattcgctaaaccgcaagaagcctcgggcactggagttcaattaaagaattcatgcaaacagagcataaaagtagttataatcctgaacgctcgaaaagctaaaattcaatgaagcttaagacattcattactacgtaacaaagcacagtaccacgtggtattgatggccattggaacaagccatttcaatgttttatccattgtagccctaatttgatcaatattgagctgcaacagaaaatcaggatttcagaatacaaatttttatataaccatagttctgtcattgtgtagtggtatcacctcctgaggcactgacgaagttcttaatctattaggtagtgccgatctcactcttggtggcaatccttggtagagagcatctcttgtatttggtggtatatatcctgatcgagaaaccttaaacagacaaaatttagtaaaatagctacatgcaaatactagctagtgggctttgctgaaaataccaattacgctctttggtgctctgccactcttatgttaagtgggtacaatatacatatgctaaacctacagacaaatgtgtagtagtttccaattgatctatgataagatagccaaatcatgccaaatcttgggcagacgtcgcaggcaaaatctgagggaacttacaacgctatagatctgtatgataatatttgcatagtgtaatgcaagtccggcaggtcctagtctctgacagtcttcagtagattcagaactcaattcaccttcatctacaaatatattacaaggatcagtggatagtcctgtatgatcgattctaacatgagaagtaggaccatgaaagtaccagaagatccaaaagaagcgttgatctcaaaatgcaagtactgcacgatgtctacaagcttctcaacaatctataaaaagaaatgaatcttatatgttataaacaaaaggaaaggtcaacagagaatataaagggaattccacagtaaattgttctcacatcttccaatgtcttggaccacaaagatcttttcttcaagcttttcacatagttcctttgactcttcaattctattctcacgacctcaatattttctcctggaagattatctggacacagtgccgaaattccaaaagattaaaagtggcattgctctgacaacttaactgaaatagatatggatattgaaaatacaaagaaataacatttttcccttagcttgagcaatccacataagtcatttgtttgggtcatgaatatcatttggttaggtaatgggcacagaactattgacacaaatatttgtcactctgtccaagaaatagctagaggattttgtaaaataggtatcatacctttctgatatgaatttccctttaccgtcagcttgcagcgataatcttgctcaaatctatccaacgcatgcagctcgtgatacaaatcctggaaaaaaacagccaaaatgagcaaaacctagattaatcaaatgatatattgaactacagcacaatgcttacagttgtacgatgaacaagatccatcaacttttgcatctctgcaactgctgtttcttttagctgcttctgtggtggattttccgattctagcctagattccgaagtaacaagtatgattaaggtctaatctttataacgattgccacatgcaaaaacatgaaaactcttacttgacaaaatagcggtccaggttatgccattggggatctttacaacggttgccaaatctgacaatctcttgtgaaaatattttcagctcttccctgcaaatattagccagagtgcacaaaacagttattgggttgtcagatggtaacaatgaaacattgagaacaaccatcaatcatctcttcaaccttttgtcattggctacaatccgcatcaacacactcatgtcactggaaattaaattctgcacgccttcagaaggaagcaccacttgtttgaagtatgtaacagtgtcttccgaaagagattgcataatagtagcacctttcaatatcgtgtttgcaacctcaaaagcaagaattgatatcggacatcctttggttttagccctggaaataaagccgccatctgtgctaaggcttgttgttaccaagcagcctatagtgtctaaaatatcaactgccttcccaaatccagccatgccggctgttccaagcactcttagtctgggaacctgcaaggaaatgtcggggatttaaggatatcgtaatttctactaagaaagttaaacatttcaggaattgtacatttcattttgtaatgctcttaaggtaaaacaagcaagatataaaagttagcatagtatttatgaacagagacaaacaagatataaaaagttacccactagttcaagaaaacacaactgcttgtgaaaggaaaattgccttcacttttgtccacaacttaccctgcttgatccattgcttccaggcctgtctgttgtcgactcgggcaatccctgtttcccaggcaaatctatatcttctgatgcggaaattcccagcttactgctcccggaaagaagaaaatcatcactattggagaagagattggattgactatccaattccagcttccccagcatggcttcctcggcaccagtgaccatctgtttgtgtgcagcggcgctcatcgcgtcggggaatccgctgatgccatccgcaccatcatccacggaccacgcatcggcgacaccaacgagccttcttgatttcagcactgccaaacagaaaccaaaccaaccgtgagcacagagcggaatcctccacctccaatcctatagcagcagcaagatccaaaaagaagagcacgtagacgcgtactgtagcaatccatccgcaagctgaggcccgtgcccgcaaggacggcatgaaagggtggctcccaacaaacccaattaacgccgccacccaacaaccgcccccccgctcggccgctcccctccccagcccacaacagctcgagccgcacggaaggtgctcgacgaaatgctcccctcccccaacaagaagtcaagaacacgaaatggggacgcagtcacacaatccggccaaagaacaactagaaacctcagcaagcgcagcagctaaccaacccaaccagcagaaacccaaaaaaatctctcacgcagcagacgcgcccaccaagaacggggagaaaaacacaccacagcggaaaagaaaaaacgaaaccgatttctccgacgcgggatgagcaggcgacgcgaggaggagagtagccgcgcttgtagcttgcttgaggatggagatcgggaggggaatggagtggatcaatcggtcgcccgccccagctgcggatggagatgggagcgatcgatttctttttcagctctactttttctttctttcttttttttttcctgggagccagcgagacagcgccgagtccacgcgctgaccctgtcttttgcgggggtttttttccagggggttgtcgtttggttgccggcgccaggattcgttctctgcgattggccggccgtcattgcttcgaatttttaaaatttttaattttaaaaagaaactattccaaaaacttagaccctgtttagatcccccacaccctaaaatttttcaatacatcacatcgaacgtttgaacacctgcataaagtattaaatataggctaaaaaataactaattgcacatattgcgactaatttgcgagacgaatcttttaagcctaattgctacatgattttgaaatgtggtgctacagtaaacatatgctaataacagattaattatgcttaataaattcgtctcgcggtttattaacggattctataattaattttttttattagtgcccgaacacccaccctatataataactgatatgacaagccaaaactttacaccccctgatctaaacacccccttatttatagaatctgatcatttgggctatgtacagtccatctaacgtggcaaaataacaccgacacgtcgcacacagggggagtgacagttttgtcttatcatgctagctagggtgtcatggtcaaatacgctgccacgtcagtcagaatgtgcgtggcactgttattttgccactctgttcaaatattgaaaataggttttaaaaagatttgtttttgaatttaaaaattcagaaagataaaaaaaatacgattgcgtcggaggctggatcaaccgcgtttttggtgatcatagggtatttgtttaccagctggtgatgagtacactccagatgcagagtgatggtcgtcacgttctttcaccgatcctctttcccgatgcgtacacatggatgcagttttatttttgttgatttgtctatatcgatatgtaagggcgtaaagattgtgtttggtccccagttcatttttttggtctggctcgactgttttttttctcttttctggttcgaaacgtagaaaggcttcagtctgcatcgatgcatcagttttcggcactgctgatcctggccctgctgccctgaggcccctgactcctcaaactgatctgcggccgtttgccgactgtgactcgggccgggattcccagtggggccacgcaggagaaaacggacaagtggaatcgtcacgcagggcttacaagttagtacaagttactcctacatccctgtagatgtagtataacctgtgaatattctggcagctcgcaagtcgcaaacgagcagcatccttttgtctcagttctcacaacaacaacagcaagaaaacaaagctccacgttccgaccagcgcgtcccgtcaagcccgtcgctgcgaccgcgagagcgagagcgagacgtggtggtggtggtggtggaaccgtacgtgagcgcgacgacctacctgcaccgcgcgatcccgacgcatcagctcggctcgggctcgcaggttggcgacgcggcagccaccccggccacccgcacgcacgccttcggcgtacgacccgcaagcctcggcgtacgaggcggatgtgggtggatcgcgggggtcgccgcgccgtgacggcgtcgttgggtggctcgcgcgaggaagcggtacaggttggttttccttgcgcgggcggaggaaataatcgagccggacgaccgtgcgaagtgctcatgtggtggtggttggtcgggtactcggggttggttttggtccttcctttcgattatgatatatgtggacagagacatctgtcctcacaccacatatgccactgggggatgttgaatctgagccgcgcatatcagttgactttaacaaaatcgttgatcgaacagggagtgtagccataattttcttaggactcaacttgcataaattacgtaattttgcctatatctttcgtattttttgcatttatcttttatatcttggggttttgacacgtaatttttactccctccgtaatataaaaacatagaatgagataggactgaaacgagtgctacgaatctagacataagagtctcatttggtttagacggagaaaataatatatatttaggcttaggagtatggttataactctagctgccttacttctattttcaccacggttccttaatccatattgataatttgattaacacaataaattaatatttttaatataaactttgtaaatactagcttgtaattagttgaatgcttgtgctttgctacgggtaatagaaagtatattagaatatcatctaaaataaattaaaatatgttttatattgattatgttaactatcctttgccatagggaatactgagcgtaatttgatcttattcgtgggcatcatttagattcattgccaccaccattagcttcttttaaagaagtatagagatctttcgagaaaccatgggctgatttggtttgaagccttaccaaaatgttggtagtaaattttggcactaccaaatttgatagagtagatttattattagttaggcaaaaaatagtcacaatccaaatgttatcaaagtactatttaaagctaccaaaatattggcatggtacaaattggcactaatctaaatatgcctcatatttttgaaagcgtggagcaaatacaaggtggaagaggtacggaaaccagccaggtttgctttgtcaactcgtgcctggcgccgacacttctacgggactactgcgcgagaacatttctcctgtgctacaactccctacccatatagaaaaagaaaaactatagaagattggttgtccacgtaacaaggtcaaatctaaacttgatttagaaaacaaaatcagttgaaaaagaaataataaaccctatataggaaggaattttcatgactttctaaaggcactttcgcagcaacgttttaccgacgattgtactgccagctctcatcgtaacttcatcgaatttcattataaatggccaatttgtttgcgggtggatgaggcgtgatctgagcaaatcctgacagaactgcaattttaatgaccaccttcagaaaactccatctgaaacagcaaatggagaaaatgtacacttacgagatgtcgagatccctatataagctaaattagagcaattggtcagacagtagaaggattctgcacgattgagtaaaacgacagagatttgaacttcttcaatgggtcatccgtgacgtcagcgctcaaactgaaaggtggagctagaaatgtatgtacccacgtctggtctcatgatgatgcagcatgcttcaagattcagagacaaatagtgctactgagtgaacaaacaaataaggcaacgcttctacttgaccacaaacaaatcgtaattcgtttttcggctcaatggtcgaagatggcaatagaatcaagcccacaggccacagtacattgtacaaggctctcatcaacatcagaataaaaaaacaagcgtaaggctcatctataaataatcaacttacagcagtactaggacctttcgatgtccacttcctgaagctgttgacatcaaaatttgccatagtaatatcatgttagttacatgcgctacgggaactatactgaaaaggactactaccatatatgttcagaagcaacctaacatgtggtctggttggtgccatcttacaagtagttggcccaaggcctacataaagctcaatggggttagcctaggatcctacttaatgcatataaattcttcacataaattagaaactactagggggtgttaaccctaggctattctggcggactgccacgcaggtaaaaccctaccagaagccacaggcttttgtacactgtatggcacttcattgacttgttcacaaccatctagctcaagatctatgtagcggacgtcctggacgatgctggcagcatcagatatttcctgccttgtacgtgtctttgcagcgcgtttcttggactggaccgtgcgttcctcaaagtcgtcacagttggtagaggtgttggtgacggagaagcctcttcgcttcttgaccgcctcgctgtgctcgttgctgccgccgctgctggttttcctggtcgcatttggatatctggcgaggaaatcctctatggttgcaagcacacggtccccgtacttgttcagcttgttcctggatgaaaagcatgtgaaaaacaaatataattcttgctctacttctgaaaactgcttgtcaaaattacattgtgccatggggtagagtcattacttgccgatgccatttatctccacaagttcctctttcgttcttggcattcggttgctgatttccttcaatgtctcgtttctgtaggttaaaaaataagaaccacgttataagtcagtgagttctgtgccacaacaaaatgcataacatataacttacttaaatatgtggtatgccaataattgtggattttcatccattatctgagtcctaaggcattgcaaagcttcataaagctcggctgcaaggctctgcaattaatgaaaatagccattatagcataacaaaaacaattactgacaaaaatactgaagtagtagcttttataactaaagagccacagccactaccccgtccacttgactctgttgattagtcttattaattcgtggaactgacgattcatcgagtacacccatcttaggagccttctcaggagtggggaacctgcaagataagaggataaagaaattactctaaaaaaagtagattgtagtttacaaactattttttggtcacccagaatgcaaaattgtattcgttaaataacacaagggaacaacaccctgcatcatggaaacataagcaactctagagacttttatacacacactttcccttgtgaatttgcaacagtaatcagttaggcaacaagataactatatcattcaatgagggcaagtggaataaatatatggctgcttgtattgaagaccccaaagcagtcaaaattgcaaaaccataatgaactcggatgttcaaacctaggatgaactaggaaagctcctaatactatctccagtcataaataagtgatgttttggaatgtgttaacatgtttaaactttgacaatcaattgcgcttttaaatactttgattcaacttttgaaaatgtttttgttatattcatcttcaaaatttgtttcaaaacattatacctttgatatattttttcataagttttaaactagtaattagtaatagaagtgtattagtgaccgtgccattgtccaaaacaacacttatttgtggccctggcgggagtaacagtcaaaacaactctttaccagtatcaagctgtacatctaattttttttaaaaaaaaataacatgggattaaattccaacagattttagatgtgaagttcatatgcaaaagaaagatgtgattaaaaaaggataattttcagcaatatgtgtcgagcaaaatgagaaaaggacaaacaattttcagtaatatgttttaggaagaaaacaaacttgaggacaacgttgtgcttgccagagagaagatcaccacttttcttatgattagtctgcttaacaaacattcacaaaagaaaactatgtattagaccaaggtagagactagaagattaaagaaaaggaaaaacctagtaaatttgtctcaaagtaaaccattataggtgcagggtatatttcacctttaagacagatgatacagatccatagttttcgctctttttgacatcctcaatgagtatttcctcaattactagatggcgcaatattctcgctgcttcacctttagctagatgctttccagctccatgaagactcaaagtatcatggcggtgcttcttgacctgattagtagtaacagataaatttcaaataatggactagtatgtggttttccctgccaacatgacatatccggcagtaaaccaagatgtgttgtggaccatggagatatttccatggcactaaaagtagcctctggtgatgttatcataacaatgaacctcagaaccaaatgacattaattacttgcataatacatacattttggtttactgaacctctgtatacttcgagaatatgagtagttgaatatgtttgctttgtcatcattaccagatcaacctaaagaaacaatgtgagaatgtcagtttcagacaaaggtctgtgcatgtgttaggttgtttagaaggggcacagagctcagctgaccacataccaattgtctagcaatgttggtcacatctttttcgacccatctcaactctttcaagcaattatcacatgtttttgcacaacatgaaggattaaacatctctccaaagtggatcagctgtagtagacgtctgcagtccacatcattttcgcagtaactaacctacagacagaatatggcattgttatgatggcttccaaacttcaagcatgcagaagcatctgtaagatatgatagataccattcgcaggagattttccttatgcgtttcaagcgcttgttcctgcgaagaacctcctcgtggtgctgatgttccttgctccgcaaatccttgggtaaccatgtgtttgagacgaatctagaaaattttacgaggaaaatacttattaatggttagatatgaaaatagtgaaatactgataataaaaagaatctcttaactcacataatcagaataattgtagaacaggacacaagttgaaagctgactgtcacgaccagcacgtccacactcctaaaaggataacagtcatcaaacacagctaagtttatgccattttgatgtgcacacattggcgaaacttatgtcattgaaaatacctgatgatatccttcaattgatttgggcagggaatgatggataacaaaacggacatcaggtttattaatacctgcaatcctgcacaattagcacgaggcaccaataaacaacaaatatatgtgcacactatgaaaatcaagttacccatcccaaatgcaactgtagcacatattatgttgatcctatccttgctccactgtttctggatatttgctctatcctcaggatccatgctaccatgataatgtgatgccgtgtgcccatattcctgggtagaaaagcagtaaacagtcagaagttacagtggcacaggtctatagttccatggtgcatgaaattcaaactaagcacttgcaattacttagccatcaaagtcccataatctgatcaaatccaaatccaaacacatcacccaacaatctattcaacatgtccattattttggaacatcaagaattaaaacaactgccagtgtaggcggctaacaagactaggatacaaaaccgtaaactttatgcctgcacccactggcttaggtttcaagcaaccattgatttagtattgctttctcctaatttgattcaacgctctatttctcttaactccaaacaacagactaggaaatactacccaatcaagaaatggaaccctagaacatgtgagtatgggtacagccgtacaggaccactattacccataagtaaaactggtaaccaactggttactacccttgttatcaagcccgtacatctagtcacgactagtcatcagctagtcggccagggagcatgactcgatttgttggcggcagcagacacaataaaacaaagaaaacaacaatgaaccacctcggaggtctggtccatcaggcattattactgggtgaaagggagatggaggagagctccaccaggtccatcaagcacagcatgacgcagcagactagcagtaaaagcaactgctatgtaataatagtctgatagactagtcaactcaatgagtagtcttcaactagttgcgactagtcgccaagtcactagatggtaactcaagtagactttacaacttaaaaactatggtcactgctgcaatcttaaaccctaaatgggaccatgacacacaaatgggataacatacaatttcctaaatactcaaaacttctattaccaactagtatcatgtagtaaccaaaccttctatttacccacttgcttccttgtctcttttcgccttctattttttgtacttgtattcttcacagtattgattaaggatgattgaagagattacacattacaggcaaactaaattcaacaggtacatagtagttaatgttttgcaatattctaaacataagtagctaaaggttggcacataagtagtaattttagtcaagaaacttgagtaatacagaaacaagtaatatgttcttatattaccaaactgcaactttattacatatggggggctctgcttaattaaccagcatgtggaagtagtgcagaataacttcatttgagaaattccagataaaaaagaggaatggccctaattagatttaaaattatatcctagaacaatacttcctccgccccagaatgtaaccatttttggggtaggcacgggtattaagaaaatactgtagaaatgattgaagtagtattgtcattggtgaagaagagaaagtaggtgaagagaatagttgtgattgattgagatgaaagggtaggtggagaaatagcttcattttgggacaagttactgtgttagaaatagctacattttggaacggaggtagtacatctagattctgacagtattgaggactaagttaattcacagaataagataagaattttaatgcttaaacattgaaaagtacagcaggcttgaacaatttatagtttcaagaactaacccttaatttagcagccactttctcacaatccatcctcgaaaggcaatatatgatgccgcattctttattatgatttgcatgtataaagttatggatatcctcgaggcacttctttgtcttgggccatacaaaatacctgcaaaagttgggctgagatggtctggtgcaattggagttgaatgtcaatgtcttctgaattctgatagacttacctcagatttggacgattaaaactttgtctgaaaataatgcagtttgcaaggcctagaacttgcacgacatcttccttgacacttgcagttgctgttgcagtcaaggccaggactggcgtctgcgggaacttctgttttaaaatgcctagatgctgatggataaagaactggattaaaaggttgtcaattatttaacatgaaaatctgcttcctgacagaaagtacctggtaatcaggtcggaaatcatgaccccactggctaacacagtgggcttcatcaatgacaattctagagagatggcctcgcgaatataaattttccaattgtctcaacagagcatcactcctgtactcaggaaattaatgtgagttaggcacatgaattggcaaagcacacgtcacaaaagaaaggactaattgtgtgagaagctaatacaagctaaaggtgttgaatcttcataaagaaaaacaaagaaatgtaaccaatagtccaatactagtgatctggaaatgcgaactgctgcatagtgacagcaggtcattatgagcttacttatactatatcagaaaagactacctttcaaatagtcaagaaatcatataacatgactacgaatcaacagcagaattccacttacttggctatcttttcaggcgtaacatacagtaacttgtacgtgcatgtaggagacattaattctcttaatatctcctgctgttctgaccactccatgctggcgctaaggtaagctgcagaaatatttgcctgtgataaacaacacgtgagcaattagaaaatcatcaagaaataagtagaaggaaacaaaacaaccctttacctgcaataaatgcatgatctggtcttggatgagcgatacgagaggagaaactaccaatgtaacgccattacaaatgagtgctggaagctgcaaagtaattgatgagttttttttttctttttggacgaaaaagctgtatgaaaggatcctacggtatatactcatatattaagtaatgtacatatttacatgaaaaaccaaaacaatgactctttctaattcctgtccatccacttcttaataagaggacaatacctctctctctctctctcttgctctatggataaccatggcaattgaaatctaaagaaagcacgggaaaacttgtagtatgggattgacatctctgaagattttattatttcttataatccagatgctccaaggtaacacaagcaatagaatcttaaatattaacatagtactacatccgtcccaaagtatagctatttctagcacagtgacttgtcccaaaatgaagctatttctgcacctaccacctcctttcaaccaatcacaaccattcttcatttaatttcttcacctactttttcttctcaaccaatcataaccttcctccaatcat

SEQ ID NO: 45841 - DNA, 8213 bp, Oryza sativa
attcctgcagccctactccactgtttatcaccagaaccttcagtgtaactgatatcaatagcccttggagtgtaatctctctgaacagacggtaatggcatgcttaaaccatccatataggaatatggagcagaagaaaagcataaaccactttccccaggttcattcctggtgtaaatcggtgattggaatatattggtatcctttacaaaagagctacttaggatgctagtggggtgatggccctgatgagctgttgtggaggccatagaatgagattgctgtcgctcttcatcttgggttaacctcgccgtatactccccaagcagctcaatctgcttctttaggagtgctctgcagagtgtaacagtaacattgcatcagaactgctggtagtcaaaaggagctaccaaatgcacgttgcaagagtcaaacttcatattttgaaccagaaatgccatcgttgggttcataatacggtcaagattatgtagttttcctccttttttattggaattgtgagcaatacattgtgagagaaattagctgtcaaagctcaagtttggagatcacaccgaatcaaattagatgtcaatggtgtaaggaaatattagttagtcagaccagaaaacaaacctcttttgatgaagatcatcagattgttgagggctgagttgaccgtcaataagctcatgggatattgcaagcaagttatccttcatttcaagcaaatgagacttcgcctctgggcaaaaagctagctatacaagtatagtagcaagtagcaactagtgagcttacatgctgaaatagctactagtctaaagaacaatgatgatgatttaattgctgcttggcttaccttgctaccgtggtcacacattatagagagttcttgtggtaaattattctcatcaaatccattgaagttgcacttctctaatggagatttggatgaccctctgggtgtatttgttgcttgataatgttccatgactattcggtccacatcaatactctgaaacgtaaaccaagagttaaaaattcaaagaagagaagtggatccattacaattatgacatagtagttataataattgcagacctgcagttgataagataaaaaatcatgaggcgaaagcacataccgctagaagctcatcctcatccatggcatctaatttagcatcatcacacatgttgtcaataaaaggagcagtcttgaataattcaggaccagttcttgcaagactttgatttgttgttgtaatggtatctgcctgcaccacatgattgttcaggtaagtccttgtacaggacttggtgcctgcaggcagatggctactgttcttctccatagtaccactttcagtcgtctgatgcatactttcctgggtgggattcctatttctggacacactgtccattttgttaacattatatgaagaacttgtcccataagtatgagcatggtcgctatcacaatctttcacttttccagataaaccaggtcttaaataattcttccgtgcaacctgagtgttgcgtagagaacgccaggcctgccataagaatgttcttagaataccaaaaagctcacagaagtaaacaagaatgtattaaaaacagtgagttttaggttaatgctttcttaacaaaggggtaaagataaaagaatgagaccaactaggatttgagttttctgataacgcgtcaagggttaactggacctattatatggaatgttagatgatacacctttggtggacagtttacaaggttataatgcaattatcctacctgatagctccagattggagttaggggaacccatcttttcaacaggatttattatatgggagcacatatatggttgcaaaggaaactgaataattagctaaacttacaagttcaaatgataagtgactatgcaactatctcatttttatgcaagtgatgacaaataccatgtacagtattactgtcgtaactcataccttctcaatggatggagcttgaagacgctctaggccttgaattctgcaagcagcagacctgaaatatataggtaatgatttgccattattctggtaaacaagtatcttttgctagaagaataccaaaggttacgaacaacaaagggtgaatagctaatttagtccttcaagtttcaccaaaggctcaatttggtccttcacgtttcattttgtccacatagctcctctaaatatttgttttggcttgacatcatccttgggcccacttaatatgccatatggctatttttagtcaatatttctattagaaaatgtcccttttacccttaatttatatacaactatatataaaaaggagaaatcaagattaataaataacattgcagatatactttccattatttcaacatgtgcacatgaaacttaagcaattgctatcgtatatacttgccagtacataatttattttcgttttacataatttactatacattatctataaaaaaattcaagcatacaatttttctcttatatatgtgaatgatgggggtataagtgtcatttatcaagagagttgttggttcaaggataagtttgaactaaaatgaaaacttgaaggaccaatatggatagattgaaacatcaaggactaaactgagcctcagatgaaacttagaggaccactttagctattcacccaacaacaaaatactctattgtataagaaagtagactgtaccttaaaggaagcattcccgtacaatctgcttcctgattaggcctttgtgttggtaaagagaacaaaaaacttgaactcaggaattcatctttgatacaggagctttgaacagcatttgcatgatccgaccagttgacccttggctttatcatggcaggtggacccaacggtgaggctatttctcccttgcatccaccatggcaacaattaacacatgcgaacctgttgaatgttggttcttgatgacctcgcgagctggatcaagaatgaggcatgtaccgggactgtaatctctgcgatgagagtgataagtctcagcatggttcaaatgaggaactattgaaagcttaactatgaataacacaagtgacagacatatacatatacacataataagttgacaaccgcacgcagtttagaagtagaaataatcgtgtgtttaatgtacaagttatgtactctctggcatctatttgaacaaaaattgtacagttcaccaaaacagaaaaggaatagtgagatttgcggataaccacctttcagttagacagcataatgggctttcactaggaaaaagaaaactcaaggccatgttcggttaatcccaagtgggactgggagggattggagggaatttgttccatgcctattgcggtgtggaacgattccccctcaatccccttcaattctcttcaatccccaccaaaccgaacaagacctaagggggtgaagcaaccaaatgtcagtagttgattgtgcaaatgctgacggctgccccttcgcggctgtgaactgtaagactgaactcgctgctcctcggttggagcaacgccctcatcaccgcggccacctgcctcacgccctcgccaccgcgcgctcccagaccctagaccgccccccccccccgatcccccgcccatctcactgaaaccccgcttcacgcattccgccgaacacctacccctaacccccaacatcccacgcaaccatccgaagacaactcaccctcgaccctcgccggcaccccctccgcgctagggcacaaggccaaaacgtcccacagaattagcctcgaaaaatcacccaaaaaacaaaaaaccccagccatcaagggcgcgccgcgactggaccagagactagggaatcacctgagagaccgaccaagctggcgccgccgggaggaggacgcccgcgcggcagccgccgcagcagcagagacgcggcggtggccggcgaggaagacggggagttggggtttggggattttgggggtttctgcggaaatggacgaggccaatattattttggttcgtgagcgggagaggaggggattaaaacttgaaaaaacccccgcttggagggaaaccaatcgcggtttcgggctgatcagggagccggccgtcggatctgcctcgagattcgcgccgggtcttcccaaatcgcaacaagagccccgccctccccctccaacgggtagaaagaacagtggaagtggcaggtcgccctttttggttccacgtggcccgtgggccatggcacacttttcattcagaaccaaaagttttgcttcttttgggttttacgtatagttgtcgtagtagtctctttcttttttttcttggtttttcttgtttttctcttttctctcttcatttggtataaatcggtttggttaattatgttgtgtaaataaactctcttctcctttcatctaatattgacgtgcaattctttttcgctttcgcgaaaaaaaaaagttttggagttttgaatcccttcgaaatagcactcgcatcctttgtaacggaaagaatttgactgcttttttttacaggatctgagctgaaatcctgcaaaattcatgcaagagtcatgcaagagaagcattgctcggaccctgtttagatgggactatccctatcacatcggatgtttggaaattaattataaatattaaacgtagactattaataaaacacatccataattttggactaattcgcgagacgaatctattgagcctaattattccatgattagcctatgtgatactacagtaaacattctctaattatagattaattatgcttaaaaattttgtctcgcaaattagctttaatttatgtaattagttttgtaagtagtttatttttaatactctaaattaatgtctaaatataaagaataaagttaagtccatggatccaaacaccaccttggtctccggtcattcatgtcagttaccagtaggaaatctgagacagattcaggacattcaagaatgttcagcgacaccgagtcaacattgagaagttcaggttctcgtcggcgacagtagatcagagttcacagacggcgcactagtcgctaacggccactagcatccaacaggcctttcatacaaggtactagctgaatttacagtagttttgccaagacgacgacgattttcacaggacgaattgatcttcaaactccgcagctcgtcggcgaggctgtccactgcacaagaaaccggcgagcgatcctcaaacggcctctgctgtccagcatccgcagccgtcaccgccaccgaccgatcgacgaacgcgagattctccttgctaccaccaccaccaccaccaccacccgctgtgattcatctcatttggcaaatgtcatgttcagaattaccgtcgcggtttttcctggcagagcgtgagtaaactttgaagggttcagggtttcgcagctcacccgcattggtgcccggacactcgtacaggttcctcttcagtagaacggtccccgggaccgacaccagcctcagcctgctgagattcttcctgtcgaggtcgtctatcggtacgaacccgaacgccatcgtccatgtgtcgactaggctaggtatcgcggatagaagaagcatctctaccttcagagatttcagcatctgttgagaaaacatcaggtaggtttaagttctagagtggcaaatatcttaactagtagtaagtggtacacatgaagcatagaaatagtctgcacacgataagcaatgatgcaaaataacattctcttcgcttagaatttgtcccaaactataacaatttctccactaacattctcttctcaaccaatcacaacccttcaccgttcactttttccacacacctccacttctcaaccaatcacaacatctccccgtttaattctacctatttttttaataaacgtgtctaactctaaaacttcttatattctgggatggatggagtattattgtgtgataaattattgattggttcttaatttccaagctcagttttatatacaagcatgttaatctacctttgatctaaagaaaattccaagctcagacatgtacttcaagaggagaagactgaatcgattgttaagtttgaacaggatataggctagagagtaagtcggatgcagatagcaaatatttggtagaaatacaggtggaaattttcaggtccttaagaaggatacggtggggaataagtcagatactcggtgactcggatatgatgcttagggagtaagcatgacatgattctttgggtgatctttttaataaagaatccaaagtagactacaaaagcatcagtatccagctatctactacctgttcaatgtaatccatgagacgcctgcacatcccttgttgacgattctcaaggcaagtagctattagaggcatctccgccacaactgtaccatgtaacctgcataaaaatctgtgttaatcccagagtctgaaatattagataatctgaccaattttagggtgttgatttcgaacatacgaaaattgaactccgtaagtgtcagaacttttgaacgtgcagtacctgatggatgccacagaaatgatcctgtcatcattttccaatactacagtatagaaccccttgtaatccaaatgaacaaagtcagacctggaaaagaaatacaaaggaataaatgagtgcctgaaaatacatggaactaaaaaaaagagagataaaagcaaatattcgttaataacattaagaggacaactgattaatttggaaaggaaatagtcggtctcacctccaattatatagtataggtgggataatatctattcctgttcgtgcgtctattataggtaagaagcattcttccattatactcaaggcaatcactaatttcatgttgcactcagcgaggattgcaatatctgcagctgtagagacccgttgatcaccgttgttccggagaacagtgcaagagaagccatcaattgtgtgaatggggatcccaacacgagatcgcaaattcatataaatctgccaatatcagagcacagtgagttaggcataagccagtctggctgatggctgattgctttgtgtaacaaaaactcttttcctgctaatatattgacgtgcaatccttttgcgcgttcgcaaaaaatcagagcacagtgaggctgcttcaagtaaacattttcgctgtctctgttaaatatatggctagcattagtgaaggtcgaattttaggattatacctgctggcatcttcttccacaaaaccaggcacaaggtccaccttcctcgttgcacaaaagtttaccatatatgcattttgcatgatctggagagaaacaatgtaatgaacgagcatgtggcataagatttcaagcaatgctaaatcttgcggtggatttgggcaatataaggagctcagaaactgtgataagaagcatcacaaaatcaaagagtgaattatagttgaattaacagatctccttataagggtaaacattgcatgtaactgcattaacatatgcacaactactagagtaaattaaattgctaaaatgttctatgctatacaaacaaacaatcataagtgtgcgtggtaagttatgaaactagagcacaggaatagtgtgctgttaaaacaagaagcagcaatttatatggaaggtctaaagacaaatcttgctagcaaataaccagacatggtacggtggcaatgaagatgtgaagtgagacattacattggcgttcacactgtgcgcattctaaagcaggcagggaacttctgagctccttcaaatttatcacttccccacatatatcgcaaaggcatctatagcaataccagctgccatctggaatatcctgaaaaggtagaaagtgaatcagtaacatgaatgcaaacattgctgttgaagatgtcaagattgacggtctgaaacgttagctttacagcagtagaaataaaatgaagtagaggttgataaacaaatggcaagatcagttgttctgtaacgctggtgcaaaagatgaccaccctaactgataaaatgctatgtcatctccacagtaaaactacatagcaactcttaactaagcagtgtaatgcacacatgattaaacagatgcggtaatgactgcattttgctgtgagttattctggaagcagcatggcacagcacaa

SEQ ID NO: 45842 - DNA, 1088 bp, Oryza sativa
cctttaggaaacgtcttcctgtcacgtctctcttcactcttccagcgacatctaggtagacgtttgaaaccagatttcttggcgagccttcggctaaaacgattcctgtagcgtgcagttaacttatgtatgacagctgtcaccagaagatcattgtcgtcaaacttgcatttatgccgcgatgatgccttttgccgtttgacatcttttttggtagttttttctggcacaatcttttctgctgacccaatgcgtactctggcttgatcattgtcactattttttatgggaacttgctgattcatgtcattgctatttccaggcaacaagtttaatgaaacctgctcagtgcttgctgaacctatctgttctttatcattgctaattaaacagccagcaggattctcagttgtatggtccatatattgaccaattgcgcagtaacttacaggaacatcatttaccttctgtttcttttgactgcctttgtcttcaatatttgcagctttcttggaccttttccgattgtttttgctcgagtctaattttgacgtttgcttcggtccagaagttaacatcccacactccatgttcatttcaccatgaagttcagatgcctttgagattggttcagaacagatcaactgcctaggaggttctgggtttaggaccgtccaacaaattggagaaccctcattgtcaaggtataggaatccccgaatcaaacttgcttcatatactgaggattggatgcctagctgcacgttagtccccatggtgccatttgaagcattgaggcaactccgcatctcttggctgcacatactatcattcatgaaagaaagggttccatcatgaggggacacaaacaataactgtggctccgatatcaccatcgcattgttggtgccttcacatgataactgccctccttttgtcatctcttctgagctcatctcattaccttccaaaactgtatccatcgttggtagaaatgacagtgcaccagcaggtctatccatcacatctgtatttgccaattgggactcagcgacaactccatcatcatgctgttcgggctgcaggaa

SEQ ID NO: 45843 - DNA, 1743 bp, Oryza sativa
gaaaaatagttgaaaataaacttaaaaagttaatacttaggaattatgataatttagctttgtaattattgattatttttatattaatttgttagttaaaagacatgggagaaaggaattgaatgggagaggaaaggaggggtgagctagaggcgatatggcacatgtgaaagagcgtttatgctcctagtgggttttggtttatttatgacaaatgattaagggactaatgcacttattgagtgtataagcaagtgattagtccaatgaaaaagctaggaaatggacttatagatggatgagaattaaagagaagatattgaaaatgcgggtatgaagtgactacctatggcaagacggtgaagcgcaagcgacgctcagctgcgatggaccatgtggtggtgaagggaaagcaaggggcttggcaccgacgaaccgaaaccggtggtgaagggcgagtgaaaattgtgtcgtgatgaaccttgcgaggccatttgaagccatggattatacgcatcaatcatttgagaaatggaagatgaaatgtcaaagatcaagaagatgagatcttcccgatgatcaaatgaccttgacgttggtaaccctccaagtgaagaaataatatggtgtgaaggtactcctattggtataactttgccttttaaatttgagtttaggatactgtactattaagagggataccacatgcatataattggttgaatactagtgctcaaaatgcttcatctttgtgtgagttgaaaaacctaagctaaaatttcaatcctgagttgtttcacttgtcacaacacttacactgggtttctttgcaagtttttcatattctcttgaaggttttggaccatattttatgttgggtttgatagcccacgaaactagctttccatagagtccaagatcttcaaaatcggagttcggagtaaaaagttattgcatttttacttgagcaacatcagactatccgatttgaaatcagactatccgatgtatcggactattcgatttttcacagaactttactctctgtctttgtttgaacaatcctttcgagtgagtttttctaagtgtcggagtatccgatgtttgaggatgaagtttttgcttctaaaatatcatatactccgatttaacataaaatagttcgatgtctcggaaagtccgaaatttcatgtaacttcgttctctgtttctcgttgccttggaggtttaaaatatcggactatccaatcttgtatcggactatccgacgtgggctgaaagattcccctccaacggtcacattttgggggatctatataaacccccaccaacccttttctagggttgcccaaactgatttcattccaatcttgctttgggtagagctttgtgctaagtgctttgaatttttgagctctctccctctctatctcaaatcccccttgttctttgtgactttgatctttgtgtgtggatttggagtttgggagcctagtgtgtgtttcttttgatcttgagcactaggatttgtccaagagttgtgtggtgtttattactcttggaggttaaggactcctagacggctaggtgtcgttcttgggccaccgatctacgtgtggttggccaagagaagtttgtgaaggccggatctcgcctccgcaaggaaagagatacccttagtggaaggaggagtgcatttgtgcaacctcacgagaatagggttgaaaaagggctgcaggaatt

SEQ ID NO: 45844 - DNA, 867 bp, Oryza sativa
gtgattagctgagggttgtgaagcatcaagcaaccccatcaaacaattgttggacaagccagcaagatactgctagaagcaatgcaatgggctgcaacatgtttgatgtcttttggtcaggataaggtgacagagcaaagcaggcactcaccaggtgtgccttggcccagacttctgaggtgacttgtagaaagagggtgttcagctgtggccagccacaccacactctctctggccctggtctcactctcaagtctcaactgcatgttttgtggcaagcaatcacttgagtgaaagctttcatcactgattgggcttgccttagaagtggggtagtacttttatgtggctagttgggcatttcacattcgtgtggactccgagagtaataagcttatttttgtaatgcataattacagtccctccgttactttctataagacatagtgtaaatatattatactacctccgttttttaaatagatgacgccattgactttttctcatatgtttaaccattcatcttatttaaaaaatttacataattataatttattttcttatgagttgttttatcactcatagtactttaagtgtgatttatatattatacatttgcataaaattttttaataagacgaatggtcaaacatgtgagaaaaagtcaacggcgtcatctattaaaaaacggaggaagtatgtcttaggatatccaaaatttatcttcacaatatgtatatagtaaattggaactcacatttagaataatggttaggtggaatagagaatgagagagaagagagttttaatatttttaagtgcttgttaccatgtagtataactattgctggatgggctgcaggaatt

SEQ ID NO: 45845 - DNA, 16768 bp, Oryza sativa
  unsure (1)..(16768): unsure at all n locations
cccactttttatacacattttggtatgtgaaattacaatgcaagagagatatcggtagatgaacactgtaaaactatgtctttggatgatacgaaattcatatatgttgagaaaatatagggaagaaaattatttatttactgaagtttgactgctttaccacattatgaaattgacttacattttagaattttacacgtttttataatactctctttgttccagaatatagcttacctttaacttaactatgaaataagctatgaatttgaacaagtatagaaggtgttcagatttataggtaaaagtagctatatatttgagacagagggagtgacacacgctcacatcacattttttggattttttaaaagcatatatttttactatagccttttggaacaaaggatttatgcaggaattttgtaccatcctgtaagaaaatttcctatatggccctttggaagagaagactgtagcttttcaagtaatgtaaaattccaagttaggaataatacatagtgtgaggattttggaaaaaaaatagttaccatgaggtcaatttcttgaaaaatatatttgaagtctatttatttcatctaatttctttgtttttttctatagcctattcaaacggttattcaaatatcccttgttcttctatttgtgtgttttgccatttttgtatttcaaataggcctaagtgttatgcacgttttcattgaattggtgcttgtatcctgctagttttttttcttttttatttattttaaatcacttctaaatttcaaattcacataagtatatagaggcttttggagctattttgtgcagaattaaattccactcttcagttaatatatgaggcacatttcagattctttgaaaaaaaacagaattttagatgatctttcactggaaatacactgtttgtacagtttcaattttcgagagcgattgagcacatatactccctccgtcccatagtataagggattttagtgggatgtgacgcatcctaatactgtgaacttgtctaaatttatagtattaggatatgtcaaatcctactaaactatattcaaaaagatcatctcaagatttattgtcgatgggtttttctcgagtggagtagaaaaacaactcagatttgtttcactgacgtgtgtcccgcttggtagtgagcccatatattactggctcattttagagggaagtagtatacaaatttacgttttgattgagacaaggaaaaaatcgagaaaatacataaaacgagataaataattaagtattaattattttttattagaagaccatttaacggtttaaaaattatgcgcaccgaaactagagactttctcctcgtccccgaatagagattatactatggttaattggcgatgtttttgttggagtggaggagtacaccagcagtacaaagttgatgtcgatttccggtgcgtgagctcagctccctcataatttcagtacctgctacactaattgcgcaaatttctcgaagtcacgtcaaatcttttggggtaccatagcgctgaccataaatcttacaccgcacagcacacgaggctcacactgtgatgaatgcatttgtgtttgccagggtgggtttcaaattcggataaggctttccgttcggtttacagaattgaattgaacatgatgaattgcattgcggtacaagggatcctctggaacgaacgattgttgaagtaataacgttttgaggaagggtgtgtttagtttacgttaaaactagaagtttggttgaaattggaacgatgtaacaaaaaagttagaagtttgtgtgtaggaaagttttgatgtgatggaaaagttgaaaatttgaagaaaaagtttggaactaaactcggcccaaatcctttgaattaaggctgtgtttagttcagcgtaaagtttagattttggttaaaattggagatgatgtgactgaaaagctgtatgtgtatgacatgttgatgtgatggaaaagaagtaaagtttggatccaaactttggatctaaacacagcctaagggttaattcgatccataccattgcaactttatcaatttacaaaaaaaaaaataccattactgttcacgatatcggctgagtgtcactgaaattttgcaaaattaaaaccacgtcatcgccatcacattttctattcccctttcatcttctttcttcttccttctctttgtctcttctcctccccgtgtgccactcgtgcctgcgggtcttcgatgaaccaccgccacgcctgttgctccttcccccacctccccggcatgctcaccggccagtaccaccagcatcttcaactcctcctcgcgcaagctccgacaagactggatccaagcgcatgtgcttctcggccgatgtcaccgccatcttcaccacctcctcctcgcgtgtgctctgaggaggctggatccaagcgcccccgccatattctcttcacctcatcctcctcgcatcagctctagagaagctggatctaggcacgcgtgctccctgggcggtgtcaccgccatcttcaccacctcctcctcacgcgagccctgggaggccagatccaagcgttgcatattcatcacctcctcctcctcctcgcacgagttctgaggaggctagatctaggctccgccgccatcgaccggatcctggcgccactgcaatgttcaccacctactcctcaccgctaatggagaggtgatggtggtcaccactggggtcgctttctactccacctccatgttcttcatgggcatcggctgttgccctcatagcttactgctccgccgtccctgacgttgtcctcaccgcgtgatccctctctgccgttgacctctcccactccctgggctttggcagcggcggccttgcccacttctccggggctcgctggccggcctccgacctctctcactccctaggctttggcgccgctagccttgctcgcttcgccggaacttgctggttggcctccttgcagccgaccctcgacggggagaagaaggaagaagacagaagggatggaaaatgtgacggcgatggcacgatttcaattttgcaaaatttcgatggcactcagccaatatcgcaaatagtaatggtggttttctaaatcggtaaagttgcaatgtgtcggagggtgaactcctcaagcggggggcagagaggccctccttgttagttcgaccaggggcagcgggtgaaaatcaagaacttggtggaatgtgtggtgtagagggcctagggcccctcgtgagcaatgagacaaaagtggtttatacaggttcgggccgctaagaagcgtaataccctactcttatacttgattgatcgaccaaggaatataggcgcttgaatcaatgagaaccaagcgtgagttagccaaagaaacgatctcccccccccccaaaccaggcctggacctccttttatatctcaaggggctgccacataggcctcgaaacctgcctaggggagagggaggataattacattaaatgcacgtcttgttgcttgccttagaagccattcacacaccgaccatggcgtggggcctgtcaattccatccggctgacacgggggacacgcatgtcattcactatttaatggaggaagacttttgggtcctcacttgtgtcgagaaacagaaaccctgctctggttgggttagatgagttgactccggctgtgatgagaggctaaacagcctctcatcatcatgacgtgacaagggatgccaggtggcacaccgcctgacatgcaaccagtgcacaggcgcactaccctggtcacatcggtcattcgaccagtctcagaccggtcacagattggtcaggcacactacacgccgcataaaatgccttaaatgcggttaggtcggtgttgtgggcgtccacctaaccccgtacatgcggcgtcatgcggagggggtaggggcagcccaatcccctggcatggatggggtggccgccgccctacctcgggcctgacccccctcgggggagcgccgcgtgggtactagggacagcctcctccctctgagcttgataccaccggaccgtatcaccgacacaatgtcatggatcaaattaactcttgaattaaaggaatagccataaaagaaatcatatcaaatttctttggatagactcaaaacattgcaatattggaggaattttgatattagatccaacctcttggaaaaaatattttgtttttatatctcttttcttattcgtgcatttttcatgtactctatctatacgatgattcctacattttttttctcaatcgataagatttggagtaaagttccaggatactccgatcctgtatttttcatgttcttatattttgatcatgagttccaaaagactaaactttccatcaacgaaaatccggtagaaacgaaagtgggttgcaattcaatttccctttttggttcacaagcaaattttcttcaaatgaaaattgttacatataaggatggtttggtttgctaccattgtggcaacatacattattgtggaagccaaacatggtctagttggcaaatttgggtagtaaaccaaacatggtctgttcaacttgccaacattttcgctaattgcggaagccctagtgatgataacatacatgaaacaattagacaaactttgatagcatagcttgaagatggaatagtgccacaaacacaaggcagctgcgggctgcggcagccgtaagctgtaggactggctaccgaacaggtccgatgaattctagaatttgatgttaggattttaggggcttcgttgttaggccctgttttgttcattggtgaaaagttgttgcgtgtaacattggatatatggacacatatttgaagtattaaacgcagtctaataacaaaacaaattacaaattccacatgtaaactgcgagacgaatttattaagtctaattaatatgtcttagcaaatgtttactgtatcactatattgttaaattatgacgtaattaggcttaaaagattggtgtcacaatttacgcgcaatctctgtaattagtttttttatctatatttaatactccatacatatggcaaaacatacgatgtgacccagtaaaaactaaaaagtttttgtttcggaactaaattgtctagttctccttagcgactgttaaagaagataaagtaaaaacttatagctaatctattgttaaaactcaaactttaaattcaaattcactttgagtgaaatgccagcgaaagtccattggaaagatcgtgcttgaattcataggcggaccttagttaccctggcttgttgacctaccagtgctaccacagtacaaagtataacacgttgaggccaagtttagatctgaagtttttcttcaaacatccaacttttccatcatataaaaattttcctacacacaaacttctaacttttctatcacatcgtttcaatttcaaccaaacttttaattttaacgtggactaaacacaccctgaatctgatcgtttgagctttattttttcaggggaatcgagctttggttaataggccgtcgagaaaaggaatgataaaactaaagtaatgtatggttatatttgtattatcaatggtttaacatgcaaatctgcagaataaaccacgatgaagaaagtacaaatcaatcaattataaagttttaaaatttaattttaaattttggctgaaatgaagagaggctaatgcgtaattaaggtcaaattcatcttaaatacagaagtaactgaaattactattttccatacaccatcatctattttttttaaacaccacagaaggtattgcaatttgcacatgccaaagtacagaaaacaagctgctactggagtaccgtatttttttttctaaaaaagcatcaagttatatgtaactaaggcctggtttagtccccaacttttccttcaaatttccaacttttccatcacatcaaaattttcctacacacaaactttcaatttttctatcacatcgttttaatttcaatcaaacttccaattttagcgtgaagtaaacacactcactctaagagtgaaccaatcactcttaaaaacttatcctctccatccaaaaactctaatctaattcaagatagaatatatactactacctaatcctatgaatacgtccagattcattagatgaggtaatatctcatttcaactatagattgagtttttttttacggagtatataccccacctgtcagatgccataccgccatgtcagactgcatgcggataagaacgtccacgtcggatgccacgatgccattcctgccacgtcagcgtcccccgctcctatactcctttaaaacccggtcccttctcctcgtcctcttcccccaaaattccacaacaaaaaaacacccccaaaaaagatcaaaaaaccctaacctccgatcgaatcatcgccaccctccgccgccgccgccgcccgccgtctccggccatgtccccgtcaatcgccgcctcccaggatcgcgtctcccggtgattactcccccgcgccctcgtctccattttcttgtgctggtatgagggccgccgccgcccccgatccgtccccggcgccggcgaggtcgatgctgaagcggctgttcgatcgccagctgctgcgcgtctcccccgccgagcggattgtggcggtgggcgggggggagaaggatgaggtggagccgagctccgtgtgcctggatggcatggtgcgcagcttcttggaggacgggagcggcgtgggcgcggctgtcgagcgggctggcggccatggcgcgcggcgctgcaactgcttccatggcggcgggagctccgacgacgacgacgacgaggacgacgccgccgcgtcctccgacgtcgccgagacgatcaaggtaggtggggtgggcgaggaggaggagaacgacttgtggtcttttattttacttttctccggtggccgcgccatggcgtgcaaggacactgacctcgccgcgtgtcgtgcaggggctcgtgcactgcgccacgctccgggagcgcaacctcctcgccgacgtctgcggccacgtggagcggcaccgggcgggcggggcaaggaggcgggagctcctcggcctggtggcggcgtcgctccgcgcggcggggcacgacgccgccgtgtgcgtctcccgctgggacaagtcccccacccaccccgccggcgagcacgcctacgtcgacgtgctcctcccgccggcctccgaccgcggcgcgcgcgagcgcgtcctggtcgacgtcgacttccgctccgccttcgaggtcgcccgccccaccaaggcctaccgcgcgctgctgcagcgcctccccgcggtgttcgtcggcaaggacgaccgcctccgcctcctcgtcgccgcctccgccgacgccgcgcgcgccagcctcaggaagcgcggcctccacctcccgccatggcgcaagcccgagtacatgcgcgccaagtggctgtccccctacgaccgcgagccagcgccgcccgacgaggcctccgcctccgccgccgcggccgaggtcgctggagaggaagcccccgccgccgcgtaaacaagaggtgccgcttggaattttcaaccttcaggagggcctaaatgcaaagttaaatttcttcgattttaacacttttttttggggaatctcgagtattttggggagtgagaagagtatgtattacgcgaaatggagacagcaatatgtagtgtagttttagtattaggagaaaacaagaagtacaaaaaaaaagaagaaatcttttggttaggatcagatcaggttagcatccacttttggtcccaaattaagcctataatatttcataagtagtagtactagctagaagcttgatcatgatagtatggtgagattatggccattaggctcctgtttgttttcatttttgtaagcaaaatgttgcccagcagacaagttgaggcgagagatgagtacatcatacacggagcttttgattttgatttggattttgagttttgatccccacaaattagaattgtgcaatattttgtaggattatatgtttaatatatacatgttttatgaactgtttggaaatgagcacttatattatgtacaaagatttgtatataatgtttggaggaagaccgaattggagggtatgcttcccatttaaaacctcttgagtctgaatcttttcagacaaattcacgccttcgttaaaaaaaggcttgatttttttgtttggcttcctggatataataatctacttaaattgaagtgattcgtgtaaactttacagtagtatggctcgaagtcaagctggtttgtggtctttctctcagtttctagaacagtctctagtcttggtttctttttttaatttaaaaaagagaacagttttagataacgacgaagagcaatagacgcaagataaacacatggatattatcatattactccctccgaaataataatacttgtcgttttagaaaagggtgagattaaattttagaatctttgattataaatcatttttaaaatatttgtctttcaaatatagtgattatatgtatagattcgtcttaaaaagtactttaataaaataatatatttgttaacacttttttacatattataatagaaaataatggtcaaagttgttttttttgaaaccgtgcccttatccaaaatgataagtattatcaacccggagggagtattagttttcatttggtcaaaatatattactaacaagggaagatttcaaactgttgaccatacatatatttatcattcagaaaaggatgtaatagaagttatagccaaaaagaaaaaagaaaaaaaaaactgaatcctctcacgatcaataaattactaacggagtgtttccccccactaataattcaaggtaagtggctgtcttatcacctaaaaggaatatgctttatgtggtgaaaaaaaaggaaaagatattctccatcatctctcttaaaaagttaagaatagagttttaatactactaaaattcaaggtggttgtacagtggaagcaaccaggtgccggttgttgcaagggagacaagggcaagtggcagatataggatttttattttctttagttctttctgttcgttttgtgtgccaaaaacttaaaaccaaatctgcatgaaaagattatctgcagaggttggttgggttggattagaggatggacctgtaggtttgataattaattgccatttgtttatccagtaggacaatcttgttctagaggattctctgtggagtttggactgtgccaattctagggagtcagacagatggataatgccaagctttttagagaaaaattacaatttctacaacataaaattagttttattaaatccatcattaaatatagcatatctgctttgtgtttaaaatgttacatttctctataaactttattaagtacaaactcgaaacgttttataatacgtaatgaagggtgagctcttttttttttccattgaagactgataggggaaaatgatatgaaaagaaagatggaattatagaccctttttgcccaaatcttattttaacattttactcacttcatcccaaaataaattttacacatgacaacctactactcatctcgcatagagtacaagaagatttttagggtgaacaaccgtagtactccctccgttttgaaataaaacgatctaggatgagatgagatatatcgtaatataacgaatctggacaatgtctagattcattatattaggatatatcctatccatattcgttataccatgatatatctcatctcatcatgagttgctttattttggatcgaagtattagaaaggaactgaaaaatgagaaaaaatacagctagtatgaggcggaggggcccttttgattcacggaaatagaaaaaccaatattttaatagaaatgcaagtgcaaaataaatgattgcaaatataacaaacaaaaataaccgtttgattggaacgcacgaataatgatagatagactcaagagaaaatttctaggaggttgaagttcttgctaaatttccttcaaactatctatatgattgtccgttccataggaatttaaagaataagatatgattcaattctttgtttcaaaaaccttcatagaatatttttctactatagagttaaaatccttcaattttttttatcttttcctccaaatcaggcccctttgattcaaaggaaattcatatgaatttttgaggatttcattactatagtaacttttcctatatgtccctttgaattaaagaaatgaatactatagaattctaatatattacctattcccataaaagttttagaaaaaaattaacatgagctaaaagctccttaaaagaattctttgagtttttaccgcttctcaaattccagtgttcttcatagggcctaatcaacatttctatgtttttctgtgttctacggttatctattttacacttacatttctaccaaaataccatgttttttctatttctctatttttcattcatgtgattaattaaagaggtctcaacatctactagtactactctctttgtcccatcaaaaatcaaccagtactgaatctatacatacatctgaccacattcgtcatactgtattttgtcttattcagttccaaaatttatttttttatagaacgaagaaagtagtacgcccttcccggaatcccgggctgtaaatcgctgccgtacaagtacgggagaggcgatgagatgatcacgggcaaggagcgaggagtacgacgcgtggggtacgtgagcggcgggcccgatgtgtcgcgtcgccggtgaccgctcgcctcgccctcgcctgaccactgtttttactcctcactccgccgctccatggcgggccagcagcagcagtgtttattactactgcgctgcaccgtgtactactactgcttctgctgccaaacgctgttgctcccgttttattgcacgccaaaattcacagctcctccgtttactcccgtcctaaccagggtgtgatgtgttgtttcagtaccttatcttcacattcgtgtgtacaaaagttagttttttttttgccgagtttagttccaaactattttttcaaacttctaacttttctattacatcaaaacttttttacacacacttccaactttttcgtcacatcgttacaatttcaactaaacttctaattttgacgtgaactaaacatacccaaatgttttaaagaagaagttaaacaacaatggtattgattttaacacagaaaataatttatcaatattttgtagaaaaagtataatcttaacttatacgacctttacatatttatactaattttttaataagacgaatgttcaaacgttatacgaaaagttaacggtgtcgtacataaatgaagtagtatatagcaatgccatgtaatcctagtaaaagaataaagtaaagaaaacgtagggcatcaatgaatcaattgtttagagttcagacaagtacacaatacaagttatatgtacagcgctgcagctactcggagtcgtcgggccgctgtcaatccttacattgggtccttttctaaataggcattgatcactggattgatcaaagataacacggcagctagattgtgacgtccgatgatggatcgatcggtatgcacggagaaactttcctaagtatacttgtttcaaaaattcaatgggaatgtacaattctcccatatatgttgtaagcttaaactgtagaggctaaacattctcccttctttgtttatttttcatcacgaaaaaattgcaccgcctgtgggttaattttcaaagtgagctttcaaaacaattgaaaacagtttgcgagcataccttaattgggtgtgccagcaagagagttcattctcacgatcgatgagacaattttttgcagacgaatggtttctttcaaatcctacatggaatagttggattctataaattaaattaaatctttataacaaaataaaatgaaccaaggacacgtttcccaagaggtgttgtgtcataggagatcattagctctagattgtctctatgggcacactccctgtaaggatattagaatgatcaactatcgcttgaattaatgagggaaaagaaacgttgcagataatccatatattccaataaagccccacttaatttaaaggcttcgtttcatatgaagtttgcacatttgaaggccaaaggaggggcattctgcagaatttgtggcaaccatgagtaggatcataaaaaccatccaaattaattaaaacgagatgtggggcattcagaactggtggagagaacaggataatgacatcctctcagttggatctatctaccagttacatgcacatggacagaaaaccagggacagaatttttctagaaatcactaaacaaacaaaccttccatgattacaactaattaaacaaatatcaaggattggttagctagcagcatcagttcagtaaacaacagtccactggccttgttgttcagttggttgagtcgatgagctatcacatgcttttgctgatgagactactaatctatgggtttcggatacgattaatcagcaattaggagtagcaccctaggaggaatcatgcatagtttactcctaattatgttgctttagttgagacctccaatcaaccaacttgctatcagtggccaaaggcgttaggggacacacatacacacacaaacaaatatcttaggttatgtccaaactaatgatagtacaggtatgacaacccatggctaagagcacacacatgcacccacaatccaatcaattatttttcaaataaaggaactcttgtgttgattttgttgaatttttataagagatttgttgatttaatcgtactcacgtttccattgcaattatattttaggattattggatttagaattaactttgtcttttctcccccatgaattcgaaataattgttaccgtgcaaagcaaactagccatgtgtgcatctaacaatacttatcacatccttgtctgtaggtcgaatttatataagcatatatattacctgctaataagtccaaatgctcaatcatttggcacaaagaacaaattaaattgtaggggttgcaaattgcaatcaaggagaaagaaggataggtatccgattaagttcctcacgattaggtaaactgaaagttacactagcttgataggagagaatcttagggtggtccttcatttgatgttgcactagcaccaaaagttgccaaagcttctttctttttccaacttttttttttcttttgttgctgttcttcttttttccttttgccatgctcaatttttgagactaccatacatttttgggttataggacttcagtgttgctgttgtcgtctttttcgtctcttgacgccttntcaattcgatccgattccgactgaaaatatggtaggaaaagtatacggaaaaggatatgtagaaaaaaaagaacacttgtcattcggagttggaaatcgacaattcagtttcatggctccttttgttcagtaatcgaaggatggattcttcacggatgaaaatttggaggcggcacacaagaacaatcgtccacaaattatgtgcctcataataataatgggttgtggaatcttgcattagcaccagtactagtgtccgctttacccgtttaatagagaattaagtaatatcaaattatagttaattaatttggaatgctgttcgaaatccaaatttgaaagcgcaaggcatgaattcaaaggctgttattggcttattgcagcatgagactggccaatatcctctgggcccttttcctgagcttgctaggttttgtaaagtcaaacgatgctcgggccatatctgatcgttttggagtggagaaagtccactttacatccctcatataggttgagtttcatttgtgctcgtgaatagcaaaacagagcgttcgtcaatcatcaaaactagtgtaaatctagtccttagcgattttaaatggtggttttgtgtatacatattttatggcccatcgatttttagggtatatgtggtgtgttgacttgttcttcatcccatatgacttctacacacactaatatacaacaagacaaaaaaaaatcaattaagctcgcatgtcagtcataaaaagaaaatggtttacccacatgtcagtcgagcctctttctccatggccctggataaatggtgttgacagcgattttgaccgaaatggctttttgaccctgtttacatttaacgtggcgtttatattgctatgaggatatacatgaaatatatggttttcgttccactatcactaccttctccgccatcgtcaaccctctgcaactacaagcacgagagttaacagaccgtttggttggagggagtttttaggagggattaggagtttagagggatgaggctattaattgttttgtttggttgggagacatgcgaatttaggtgggatgggatggggaattgaggaatgaactctctttttttcaataactgggtaggggtggtaacttggagggacgctcgacatagaattttgcggttgacatcgagacctagaatggactttttcctattgtagtagcccatacctgggccgttcgatgtggcccacaatttgtttctcttttccagcccctttttgttgggcccttgatgggcaacgtaccgcagttcttctgcgtcatgggccgtactcactatgcgtgtggttttgtgtaaaaaaagaatctatacatgggtcatgcgtgtggtccttatttacatttaagagttcttttaaatattatttgttgataggcttctgatgatatttttcgaaaaaaaatttactctaaatacatagccgtgatatagtatttcacagcgtggtaagctaagtatagattttttttgcagtacaattttagtggctctacggaccaagcatccttttcctaaatcctattcctacgtgacaacctacgccgcgacaaatcccacagtgctacgaacgtaccgcagggcacgccctttaaaccgcaggattagaaaaaaaaaaggaagaaataggaaaaatataggattgacagaaatataagtgtaaaacatagcattgcaaaacactgaaaaaacacatgaatacttgtttaattgggctgcaggaaaaaaacgcaggaatcggataagagaggtgaactcaaagaaatttttccaaaaggttggacctctcgctaagtttccttcaaaacctatatgcaatgaattgtataggaattgaaaaactctaattctttgaatcaaaggaccaaatagaaaaatttcctatagaaatataaaattcctccataaatcctttgattcaaaggggccctaatgtcatacatacgtaccatcatttctaagggttctagtttaattcctataaatttttgtcgctcttaacgtgttgtctttcattactaaaagtagtatttttttcatgcgatcaaaacctaattttacatgtggtggttgagccgtccgtctacccggaggtgtatgcaaaatcgttagtttttcatgtgggtggctcatctgcacgcgaaaatcaaattttcgtgggcgggtgcttatgttgtttgcctgtgaaaataaaaaacagaaaaaatatcccaaaaaaaatcgaaacacaaaaccttagctaagcttccatccgccggtgacgttgttgccacagtctgccaccgatcgtggtcaccgtcgccgagtccccgtagctcatcaccaccatcacccctccttgtgcctccatcactgcccctccgtaccccaatgacggtggcggcacatatccaccagatctgcctatcgtagggccgatggcggtggatccacccattatggcaccgtagtcgctgtcgccattgttgttgctgagcccggtaatgcccagtccgttgcggctccgcttgagcccgtcgtctgccactccacatgaggccacctctagacatactcaaccctgctcgcgctcacacaaggtcctcgctactacccgctggccactcctcgggaaaggaagtcgagggagagataagaggttagaaatgagaggggtggaggatagggagtgagacataatatgagtagaagatgtgagggagagaaggtgaggaagataaggatgaacacttaattttttctttttgaagatgttgagtgggagaacaggagtgaggtcagacttgtaggtgggtatttaagaggtccgcttataaaaatgtattttcgcatggggccgcttaagaggcccatttagaaaaataagtctatgttacactgaaaatatttgccgtattcatgtaattacaaccctatctatacatattttattgtcggacccaaaaagttaatatgtattaattcacctttgaatttctctcatgctttgatcacaaccccacatgtcatgtgattttacagtgcagttcttatcactgtaaatatcaacatatatcgagccacattcaccttgaaataatactaaccattggacctttctcatgctcgatcataatcattgatgcctcgttcgatgtggcgttttggagatagatttttgttggacgtaatgagaaacctcattatcatatgattaattaa

SEQ ID NO: 45846 - DNA, 3777 bp, Oryza sativa
caaccccctcctccgaacacagcctaactcctatagaccttaaaatattactccctttgatcatcatattttcaaaaaacaaaaatccatatttagctgtcatattaggtggggttgtgacagaaatgtttcgtacgctacgttgcatgcatgccttgcagctccattggcagaaatttgatcaaacatttaatgcaatcacaactaaggcactgttctattctttaactttaaaatttaactttctcgtttttcgttagcacactttttaaactgataaatggtgtattattttaaaaatatttctatatagaagttgttttaaaaaataaataaatacatttttcaaagttataatatttaatgcttaattaatcaagtgctaatgatgttgcttgttttgtgtgccataaaaatttgtcttgagttggggagatcgaacggggcttaattgggcagtccattagccatgcaaggatatgaaatgttgatagtgctaattgatgtttatcttggtatcgttgtacaagccaaatatgacgataaaaaatgaacggatgggtattgttttagacattaagagtttatatatttttattactttattgtaagtattattaaatttcttatggcaatgcgtggatattcactattttacattgatataagaggtcatgttcgtttcaatgtttgggtcattaagctgtttgcctaccagagaaaacactaaatattaagtggagtattaactattaaaaagcttgaattttccttttagtttttaagaaacttcttcatagactttttttctaaaattatattagcggcttaaagatcatgctcgtaatgagtggggaaaagatggaattggtgacagatggaggtggaaaagaacaccgcgtggcagttatgggccataactgttctaagattggcgctagcctttttatggaaactagaaaaaagctcgcgcaaatgcgcgggcatcttatttattgttttgtttatagaaataatgctattagaattaagtcatatctcatcaaatagatttaaaaaattatagattttatctcataataacaaaaatctatattgtgaaatagatcataaactttaatataaatgataagaatgtctcttagatttaaaaaatcacttttatccgggttacatgtaaacttgcctattatcaccattatttattatcatttttcttaaaaggtatatatctttttaataaatggaacttaatttgtaccaccaaataaacttaatacgccattaatacataagacatttatttccactacatacctaaatatttatctcaacacttatttctaaacctattaataaatattctaaaactaccgcttttattaacctattggttaataggataacgtcattaagaaataggcatgaatgcccctctaatgggtggaaccatcaaagctttatttatccgctgccttcaagcatgagtcgacatagtcgtgcctctcacagttagtgtggagcataattttaattaatcatagttagttatcggcacccttaaaagaagattgcattgataagtaggaaagttgagcactcttatcaatggtggcctcctctgggcttgcttcaactcaaccatatgtgtgccccctgctatacttgtggtagcatagcaagttctgttattcatgctcggtgcccttcatggaaacaaagagaatatgatgtgatgaaaatagttcttcatttattcccataaaaaatagtttctttatgttttgtatgagacacctttactaattctaaatgtatttattttctcaaaattatttataataattaatttgttgaagtgcagttatagttacatcagtgggctgtttggcgtacatttatcaattatcacttatgctgaacatattataatttctcaagtgtaagaaaatatatcatgagtagttttatggacatgttataagattgttcatttgttaccaaacctatttggcaaaaaaaatgtaaatgaccatattttttgtgatggattaaggagttgtattgtagcatgatcattgcctgtgcatacctatcaaataattctgaaaaatccaaaaaaattaagaatcttaatctcacaaaaattaaaataaagtcagatataattgacaaaacataacgttgtttcattttcatgcatgtagatttcagttagtgttatataattatcaaatgatatttgaccataaaatataatgtgatattatttcaaacattatcatagaattaactattatatgtcacacaaattatttgaaaagtgttttgaattaaattattatatgtcggctccatgtgtggtaatgtatttagcactataatataactatgataagtcatcaacatttgaatacaccttattataagttgactatataattgaaaataatttttaaaaatgggtgtttaaatgcatttagtttgtttttatattaatatagtttaacctgcatatttatctttagagtaataaattttattttatagtatagaaaatcctattctgaagaacatctatatttttttttgaaggttgtaccaacttatatatgtattttttttgggatttatagctttattatcgtatgtacatatgtttctttgtgaatatccggtacacagtttctctcgtatatgcaggggattaagaggaagcgggctaatctaatgatttaaaataatgggtccattatttcaaatgaaagttgacagcaaaattataaagtgccatgtggcggtctaagagtgcttgtagaaacaccacatgatcatatttgtggagtaataaattttgtttttatagtatagaaaatcctagtttaaaaagaccgtctatttttttttctaccgacgtatatatattttttaagggtcttatagcttttcttttcacccctacataagtacgtaccttttttcaagtgaacaatatctaaagtttttttttgtttgatggttttttttatcgtacttacgtactcttatatatgtatttttttgggctttatagatttattatcatatgcacgtatatttctttctttgttttgtttcaatcgaacatcggtaaacaatttctctcgtatacccatgaaactaagactaataatctataaaataggtccatcattttaaataaaaattgacatctaaattataaagtgccatgtggcggtaagagtacatgtaggaacgccacgtgatcatatttgtggaataaattttatttttattgtacagaaaatcatattttaaaaagatcactgtctatttttttctacctatgtacataaatatgtgataataaatgaaaatattattaataggaaaacatcaataaacatattaaaaaaatattcaaaggctcttttctttttttggggtctatatatatatttatatttttttgttattttttcaagtgaacagtttcctttttctgttttatagttttttatcgtacgtaactactaagtacgttcgtttttttaaaggaacagcactaaacgtacctttagtttttttttccaaatacgtaccgacggtaattttttttcccggtataaaaggcatgcatctaagcaaatagatctaatttaatggtctaaaataataggtccaccaatttaaataaaaattaacggtgaaattataaaatgctacgtggcgatctataggagcgccacatggcggcttaggaggggctgcaggaat

SEQ ID NO: 45847 - DNA, 1492 bp, Oryza sativa
cgaatctttgaacatatgcatgaagcattaaatatagataaaaagaaaaactaattgcacagttaggggggaaattgcgagacgaatcttttgagcctaattagtccatgattagccataagtgctacagtaacccacatgtgctaatgacggattaattaggctcaaaagattcatctcgcggtttcgagacgagttatgaaattagttttttcattcgtgtctgaaaactccttccgacatccggtcaaacgtccgatgtgacacctaaaaattttcatttcgcgaactaaacggggccttaatgcagtaaacaaaactggtgttcaatcattacatctaattttatgtttttttacgaagaaagtactatactactttttttgatgtagtacaatctttgctattgaatttacacgcccccggtcctatccacgtcaccatcgtccctaccaatcgttttctcgttctcgcaacgctgtacccttttatgacgtgcaagtgtgtaaaccccccatgccgtgtatatccacaaccggtggccgccgttcaccggagtccggcttgccgcgcgtgacaaaaaaaaaacgtacaacagcgacgcgccatggccggagcagccgctcgtctttcgctcggacgagatcaagacaacacacccaaggaatatccggttccaccgacggtggggcccacccacgaggtggtccccagctgtcagcgtctctctacagtctatgccacctacctagtgataatgaagcaccgggatactaatttagggtgtgtttagttctttgggtgtaaaatttttgaagtatacggacacacatttgaagaattaaatgcagactaataacaaaacaaattacagattccgcatgtaaactgcgagacgaattattaagcctaattaatccgtcattagtaaatatttactgtagcatcacatggtcaaatttttcccacatttaatatcccatgtatatgtccaaacatttaatgtgacgttttggctaaaattttttaggatctaaacaaggccttacttcttatcttatgatgagaggagagtaggaagaacacatcatctattcataaaggtaatgcagagcattcccattgtttcattgttcatatgacaaaatgtaatccatacgaagaatttccaacacgacgcgaaaaaaaaaagaggaagaaatctcgagtatagctttttaaacacaagaaaccggtgtactgcatatgagttataacgacaggaagaacggctgttgttgttctgaaaggttgcaagatttccaagaagaattcatttctgtgagctatctgtagcgaagtaaggtatggccacgatcaagctgagaggagctgattgatcttcatggtgtagcagctttgaaattactccttgccatcggcagcacggagggagcccagctgaaccggggcctgggtggacaccaccttggatgagccgtaacccgcgatg

SEQ ID NO: 45848 - DNA, 1346 bp, Oryza sativa
aattggttaaacttctacctttccatgttccaaaggggccatatatgttgtggaagcggccaacacggcactcaatgccaaagtccttggtgtagtgcttgcagagctcctcagttgcaagcttctccaaaccataggcatcttgaggctggacagtagttaaaacagtaggaaatcaacttctggttttactaaaacataacactaaagcctaaaattattttgatggacaaacctcagcaggccaggcatcagattccttcaggctaacgttagtttcaagctgcttgaattcagggtaaatgcatgcacttgaggcatagaagaacctgtaggaccattagttgtaacaaatgaattgatatggataaaacaagctcaggctaagctgagatataacagtaaaaatatgtaaaaaaaaaagagagagccggacctcttcacaccattgatacgtgcagcctcgagcatgttgaaactgatcatggtgttgttgtacatgatcacagagtggttggactgaatgaaccccataccacccatatcagcggcaaggttgaacacatggtcgacgccgttggtgaccttgaggcagttgtccatgaccctaaggtcaacaaggtggaactcatggcagaacatgtcctcagtcatgtgctcattcttcttccagtcggaggcgatgatgtaatgcccctcgctcttcagacggcgagcaatgtgggatccaatgaaaccaccagctccggtgatcgatatcctcagcttctcagacggccagtactgctccctctccagttcagcataggtgtactcgccataagcagttccgttcttctccgagctccccattctgtcaaagaaggaatctgaatcaatatgcaaaagaggatatatatgcaagaaatttagtgagttggccaaaacattgatagctaagtttagcaccaaaataatttttttttcatggaccacatgagaaaaaaaagcgtaaaattcagacaaggatacgtcaatcgaaagatcagtagcaccgttttttttttgacagagagaatgataaagggaacatgacaagccgccttattaattctacacgtccatccaatttctgaaagagtgaatcactgattcttttctcacatgtcacacataattcatggaaagagaacacaaaggcataaccaatagctactcggggagaggaatctttgaaactaatgatgaacaaaaaaaaaataaatccagcacgtcaacggccaataatggtcacatgcactcagtccctaatctttataagttaaatattcctgtagatccagctcattccaacagttagcatatgg

SEQ ID NO: 45849 - DNA, 11432 bp, Oryza sativa
aattcctgcagccctgagcactgcctttttgacaagacaaactccaaaaacacagcaaaaagattatacagggcaatatcagcctgttcaagcatggagcaaccaataatcttcttgccaccatgatctctgatggaaatattacaagcagaccatctcaactactcctaagagtaacaagtaacagtagcagcaagtgcagagctcatccggaaacaccatctcaactactcctaacagcgcggggcaaggcaagctagagaccccccgcatatttcgtattcagacaacacaatagcaggcaggcatgcatgcatgtgggtttcagcacttgagctccaatcctctgaataaaatctaccggaaacaaacctctaatcgccccccggaaggatggacccgtcccgaggagaaaaaaacaagaagaagaaaaacccaggatttacggattggattttcttcccccctaacaacaaacagaggatgaacaccatcaccaccaccaccaccaccaccaagcacggaggaggatcaggagagggaaataccttggaggcggcgcttggtcggtcggagagggatcggaagcggccgccgcgcggggtggagagagagagagaggggggagaaggggatagggaggaggaggatgatgatgatgatgagagggagagatctcctcctccaatggtgcgttatttatactggtctccgttgggacggaggaggagaggagcggctttattttcttttcttctcttttgggaggacccacacaaatctcaagattttgatctccctttgttgcttgaaaaggcaaaaagtttgtactactaaattgtttatcattatcatatccttggttttttataaagggtttatcatttccttgttgataagagatttattagcttccttgtttagctatgttagaggtgtttcggttttagtatgcatgtgttggctagtgaatatttttagtgtcagttttatgtttacattttataaagtggtcatggctataaatttttgctacgaccaaaatttttgaacgtgatagtactgtgtagtattacgattctggtttaccctatacgatagtgcagcttggattagcttcatcaccaacgccttcagtatggtgacgtctataaatttaaatttgttgaccatggggaagtcgctcgcgtttgatgatattgtttgctccgtatagttatgccatctatataattctaacggaaaatttataaagggttagcctatatttatatggtacgtcaatattctctagaacatatgatttaataatagaaaatctacgctagtataagagaagtgtaaaaccacatcttagctcttacataatgggtgtgttcggtggacatagctgcggctgtacagccacagcatttacaacaaatgcagtaaaatttgtaaagataatattgtactgcatccagccacattcacgactagttgcaatttagcccaagccaacaagcccaacatctatcacacgtcctagtgatatgtgaaaaaaaaggagacgctaaaaattgcgaaaaaaaaatcggatgagtaccgaaagtttttcttgaaaaagaattatggttaagagctttaattattttccgaaacggaaggagccagctaggctcctccaatcaaccgtggacatatgtcgtccgtccaaatatcattaatccctttctcgaccaaaaaaaaaagcattcgtcacagtgccaacactcccatccagctgagtagaaaagaaaataaaacaattcgtgagtctccggaaaagaataaagaattaattgtccggaaaaatgagagagaattcgtgagcaaccacccctctggttgactttccctcagagcctcctcgggagacgagccaggcaggcagggtcagacaggcgcgtgcgagcgagcggtggagacgggccgggctgggccgggcccacggggcggaagtaacgtgacacgaggtgggcctcacgtcggccggcggcggtcaaacgtgaggaagcccgtgcgcgtgcggcggcggtgggtaggtggcgctggctggtgcctggtgcctgcctgatggagtggtgggtgtgggtcagctcacgtactcattttgagttgacgcgggtattcaggttacagagaagtttaatagtatagtccactactggctccaagtcatctagacaacgtaataaccaatttatacaatagatgcttactatactattaatatctagtcccacctgtcatacttacattacgtcttggagtccgtgctgcagctggttacaaatctgtagcccgctgctcttctctcttcctttatatctttaaaatatgcttatagctggcttatagcctgctattgtacctgctcttaatgtatcacgtcgctgttaacttttcacgtaacgtttaattattatattagttaaatatttagtgtaaatatttaaaagtataagttaagagtatagtttctttcatgataaaaaaccataacaaatagatgatatttatataatctttttaataagacaaatgataaaaaatcacattgtgaaaggggctgtagcctagtggttacaagagactcagtagcacctgaggtcctgggtttgacttcttatgggagcgaattttccaagatttaatggcattgtgcttttaatagtaggtgacatatcctcaaggatttgccggcccggtccagttttcaaaagatgcttatatgggtagggttaaatggcttcattaaaatgaaaaactagattgataacaacattaactccgaaggcaattagttactatctacaggagcgagcagaggttgacaaagctactccctccatcccaaaatatgaggcacaaccacttttttctgtctcataatataaggcgtgcgtgtatacatgcatacattaattattccaatcacattgcttgaatatatagatatgattcaatcaaggaggtgattaaattctttcttggtctttgtgttaggagtagttgtaccttaggacacccacaatggtaaaataaggtgctctctataaaatatgtacatctcagcaatagactagattaatagtaaaccacctcaatagtatgtctacatgggtatctatagctctctaatccattgcctcgtttttctctatagactatctccaggttagtagatagctttgcgcgctctctctcttcatttaatctcttccaagtagaaaaatatgctgacatagatctcttgtagatagcctatagataatcattgcgggtgcccttatattttaggatggatggagtaataaaaataggaagaaaagaccaccgaaactgaggtaggatgaagagcattggcattggcaccgattagattatcgtgcttggtggcgaagaacctcatagagtctgcggtgcaaggacgctctgagctcgcattcatcgtcacgggcattggaagaattgttttcagggaatagggaagtgatcatcgcgaagattcagcgaaatcaaaataatgttagccatactctagctaatagaacccggtgtgaatctcttactgagttctggccggatgataaatgtaatttcatctcacattttgtttgtgaggacttatttgccacgtctaaagttttttttactagttttgggacgtgctacctccattccatatgaattgggacccaccttgttgattcctagtaaagtttttgtcaaatatatgtactacaacttataaattggagttataatactccctctttcccaaacataattatttctctattttcgtaactaaaaatcattatattttaggatagaggtagtatgtgtttaataaaattagagtcaaacactattcttgctctcttttaaaacatacacacatgttataaatgtgtggtgacggtagcatatgtgcgggtacgattggtcaacggcctagccggtcgaggatcatgacacttcgtcgattggtcaacggcctatattaagagaggagcttccataatcaatgcttcgaggatgtggggatgttggcttcaactaaaacctcgttaataaatattgtgtctaagtatcgtcatgtttagattttttatgatgctctttcacgttttgatctcaatgtaggttttttttttaacaattcaatgccacaaatgtacactgtaggagaaaaattttgagtgctaaaactgcacttaatataggacagatatggtatttaagtatatatcactggaatataatgcatttactacttcatggagatgaattactaactgtaagttcgtgggaaacttgttttcacagttgctgccgactgggttaaattagcccatctggggtttatatttagtactactaccagcccagaatctcgcatgccatagagccacttgtcatttttgttcatcctaagtctcaactctcaaccacggatactttgcgtcttgtctttcaaaagtggtacttaaccgagttagtaattaactaattattagggggtaggagtacagaggaaacaaagcccctgaccagatctaccttcttcaaaacgtcaacgttgaattttaatgtattacgttgggcgaagttttttaattcaattttgcatggtatctaagtaaccctttgtcctaggatggtttttagggaaattaagaaagtacagtaaaagattatgattgtttaagaatgaaattatgtgaaaaaactataaaagaaaaatagtggtaattggttgagacgatggataggtgaataaatagatactccctctgttaggagaaaaaaaaccatagttttagcctaatgtacacttcttcctcgtattatctctcttatcattttttttcaattttatgatggacactatagttttttaacctattgtttatatttttttagacggatggagtatttactatctccattggtttaagagtaccattttaaccgtcacaatccacgtagtaatatctaattctcgatccagatcactgatcggtgaagtgacctgtcaacgtagctagcttctctccacatgcattcagtttctacacgaatcatatcaaaactaacgaacgtgcacactgctgaagtataccgccttgaaaacctggttattggttgaacaaaacgaaacagggtgtacatgcgaatcttgattgaattaattaacaatatataccgagaattattagagtgcagtggaagtgcatgatcccatgtatcattatttgtcttggagttggttgatgcattgactgcacatgtattcagattatttcagagctgcaacacacagcaactttgattgtagcagtggtagattccagctgcagaggcaagcgttgaatgattgcaaagcagcttgttgacatgtactgtagaagcagtccctatcgtagcatgcacgatcattgaacaagccaaaagtataattagtatagcgcaatgcaattaattagttaattaattaatggctagctctgttcctgtgttccatgtggaagtttctcaagcaagttcttcgttcctgggtaattagtttgttaattaatttcatggtgacgaacacctttgccaagatacgaggcatgcttcttctgaatgttttctagaacaagggatatatacttgttctcctcctgaaaaataacaatcaattggtgttcgggaatgatggatcacttccgataagaaatctagtgattctcttctaaaggcatggttggttcaatggggcgatgagagctgtaacgtgtaatggactaatggtcacaagatgaggaattgagaaatcagaatgtattcttgtgatcccttttccctaatcttgttgggccagtgactcggctgttgcatcaaccataagaaacttggggagtaagtccacttcaactccttaaatatatgttcaatctgattcatgtcactcaatcatatcttgactccccaccattaaaataggtataaaacgatctcctcaatgattttaagggtggttttcattgaagtgactcgctgacttagtctaatcattgagtcagcatatggggcccacatgccatccccctttctctcctccacccctctctctccctcaatcccttgtcttctggctaggggtgggtgttcggtcagaccgaaaaattcggtctcggtcttccgttattcggttagttcggtcattggaaactcaggaccgaatttcatccaaaaaaatctcaggaccgataaattctgtctcggtctcgatctgaccgatttttttcacagccgctggagagtggagacggaggcgacgccgaggcggaggcggaggcggcaccggcgccggtgctggaggcggaggcggcggagggcggaggcggctagggatgaaaacggagcggatagtttccgtccgctccggacaaaaacggatacggataccttttggatcggataattctcggatatttcggatacggatacgaatacggatattttctctcggatacgaatacgaatatggtatcagggtttccgtcggatatagataataattcggatatccggtgaacagtgctattcggatatccgcagtacccatgagacataccccatttctttctaactctataaccttcaatatacctttatagattttaatagtagtttatctcttaacactagtccatactattaatattatttaaattttaaaaaatatttataaattataccacattttatataaaatgagctaattatatatgttgatatttatttctattagacgttgagttggttttcgtgttccgagaaaaatttgtttccgtattcgtgtctgattatattcgattcttattcgtattcgagataatccatatttgtttccgtattcgagctatccgtattcgttttcatatccggtaaaaaaatatgaaaacgaatatggtatgagcattatccgtccgtatccgctccgttttcatccctagaggcggcgcacacggcggggccctagaggcggagacgacgcacagggcagctgcgcggaggtgacagactgcgggagctccaccgtcgccgtcggtgtcaccagcacgggggagaaggggatggggatgggaagggctcgatggatggaggaggatactggtggtggttggttggataaggttgtgggtggataaggttggttttgctgaggaggtattgggcctaataggccaatgctatatttcggttttttcggtcaattcggttaactgagccctaaaaccgaattgctcgaactaaattcggttagtagaaagtgctgaccgaatttttcggtctcggtctcagtcatttcggttcggtctttttctgcccacccctacttctggctttggcggcaccagtaatggccagcgcgatgcttgggtggagggaggttgaggagaaggcaacggctaatgggcagggagggggatgtaaaagcaggcggtgctagagcctgttgtcgtgagcctcagtgaggaggagaccaaggtcactgccgccttgtctccgcctctccatctaggaaggctagtgtcatccacctcaaggctggcggggacacgttcaccttttcctccttggtcgctccacttcgaggctgcatccctgccgtccaagccgctaaatgtcatccccgattttgctacaccctcggttagggccgtcccgtcaaatttgggggccatgtgcgaagtcataaagaaggataaaaacttaattgataattgatgatataatatgacaataatttatactccataatatatttgatagcaatgtaaaatggtctaaaataatatacctgtgcataatattcacttgaaaagcgacattcttttagtgtttcttgaaataaaatcttcaatgatagctttatattgattctccccagcataccaccctcaagtgctatgatagccaaaccattaagtctttcttgtgacattgtagatcgcaagtatgacttcaatagcttcaatttagaaaaactccattctgccgatgcaatagtcacaggaatggtcaataaaattctatatgcaatagttgcattgggaaaacaatcatgccgcttcaaaaacttcaaaatttcaacagggcccaacttttcttgggaaatgaaactttggagaaaaatcaactcgacatgcaattcagtagcatcaatatcaaattttccatcctttttaagtgcagcctcgagacgatcacaggaagatttcaagtcattgctatcctttgatagcaatgtgtcagaagtaaacaagaagccaaaaatcttttgataaccttgatattgttcaaatctcctggtgagagaggaaatagcttgatcaataacatgaataaaatagttgattctaaatgaatcctctgcagtttgtgaggcaacactttcttcacctcggttctcatcaaaatgtctctttcttttaatttcacgctttttatgaaatgttgtaccaatattcatttcaagtgcaatttctttagacatcttcaatgcatttaagaagccagtttctctataacctttgaagaaagaaatcagcccctgcactttctcaactgcaacatcaataagcatatcctttccttgcaagctcttacttactaaattaactgcatataaaacttcataccagataactatcgccaccaaaaattcatactctccaagttcattatttgccaaacctttagcttcactactagttaatggttcattatcactttcagatacttggagtagagcctcacgtatctttgcacattgaaatctaatagcttttacactttcaacacgactctcccaccgagtagttgacactgacttgagaatcaatcctgtcatattatcttttagaatatgccatttcttagtagaattagcaaaagtagtatagatccattatatgattgcaaaaaggtctttagccttaccacgagtctttgacatatcacagagtgccaagttgaggctatggcaaccgcaagaagaatagaaagctctaggatttatatccaaaagattcttttgtaccccttgatgttttcctttcatatttgacccattgtcatagccttgtcctctcatatcatcaatatctagatcaagatcctttagttatctctctagcacatcaaaaattccttgcccaattgtatcatttatattcaaaaaacctaggaaggattcctcaatggaaacattaccttaagataaatcaacatatattataattaaagacatttgttctcggtggcttgcatctggagtacaatctagtatgaccgagaaatattttgcgctctttattttcttcataatttcaaccttaacatcacaagcaagcaaatgtatcaactcattttgaatcctaggtccgagaaaatgaacatgagtttcctcatttgtaatacgccgaatatgttcttgaataaccgagtcaaactcagccaacatttctaccatgcccaagaaatttccattgctatcttcatacagtttgctattagaaccacggaatgctaaattatgcttagctaggaattttacaattacaagaattcttaacaaaacctttctccaatgatccttttctttctcaagttgtcgttgtgcagctttatcaatagtttgatccttctgcaatctattacacaattcataccaattggtcatatttgaaacatgatttggacttgtttcatgttctctaagtctagaactcaaatgtgaccagtcattgaacccctcatttgccaactgacctttgatagcgatgctctcttccttttgtaaataatttgcaacagaaacagaatactctatcaagttccttggaataaacaagccaatctctatcatacttctctctgtttgataggattctggtgtataataatgcagatctcctaaacaatctatctttaggacctttctgaattgataagtcccttttaggacctaattgagcaagaatgtcaagttgtttagcatcaagagaatcccaacaccttggatcaaaaatttcaggctgaaaagcagtgtctgaactgtccaaatcgatatggacactactgtcatcaacattatcaccatcaccatgattttccacttgttcatgtgtgctctcactaagaacatcgtcaacagtggtttctatctctgtttcaccatcattaggttcattggcaacatcactatcaagtgtctgatcaccggatggaccttgtgattcttttgtaatatacctaaacatagcccctctctgagattgagttagatcttctattcttttttttcttattacgcttttcatagtcggagtcatatttcctattccgatttttcaagacatgtcttcaaaattaaaatacaggatgtaactatgtaaagaaaaaaattgatttaatgtatacagtagatgaacctaaaagcctaataatctatacatgatacactaaaattagagaatagggattagtggattacattaccagattgctgattagagtaggcgaccagccagtagccgactaggcataggggacaggggcgtcggcactcaggccgtcaggcgctgcagccggcaaggacttactccctccgtcccaaaaaaaggcaaaccctgggtttcgtgccaacgtttgactgtctgtcttatatgaaatttttttataattagtattttcattgttgttagatgacaaaacatgattaatactttatgcgtgacttatctttttaattttttcataattttttcaaataagacggacggtcaaacgttggacacggaaaccagggtttgtcttttttttgggacggagggagtaggcaggcataggcaggtaggctcgccgacgatgggtcacaggcgacaggcgtcagtttctcagttctatcctccaggcggcgacgacgacatggcgtcaggacttagcgatgacaccgcggcaatgtgcaggatgtgaacggagagagagagagaggcgaggcgtcatttcgttttctgtgcgatgccgcgatcgaaggcggaacaacgtaaacaaaagaagaaacaaataacagattttcagggctaattgggctaccaaattacttattgggctacatctatatacatatatagtgttggagttttgggccaaggaggccctgaaaattgggggccctatgcaggcgtgctggccgcaaagccccagggacatgcctgccctgggttgggagagagatagagagagcgggggagggggagtgctcgtcaccagccgccgctacccccctcgcccctcgtgacttgccagttgccatcaccaccaccagtgtggagaagagaaacatgatg

SEQ ID NO: 45850 - DNA, 2332 bp, Oryza sativa
ccgaaatttttgtttttttttttgcaattttttatgaatttggtcaaattttattcaaattcatttcaaatttcaaataattacggccaaaaaaattcaaaatttccgaaatttcaatgcctccgatagaaatagcaattttgaattttaaaaccctgatcgttccccactttgagagcgttacgtacatgggcgcctactcctcatccgccagaccgaacggcacggcgtggtcgtgattgtcgccgtcgtcgtcatcatccgccaccaccagtcgctacgctggtgagggctccggctccggctcggcagccgtcgctgtaaggtcgagcgggcaccacgtgttcgagatacgcgactactccatcctcaaggcgatcacccccaacaccaagtgcgtcaagtccggctcgtcaacgccgaggagcgtgtccggccgctcccgtcgctagccgttggggtgagagaggtgttgggggagaggggaggtgaaaatgcggacgagaggtggtgggggagaggagatggtgagagatgagtgaggaagtaaagagagggagatgagtagaggacttgacgttgggagggaggagacaaaaggagagggatatgacgtctccttatcttgtgcgggccaaaatctaccgccggcaaaaatcccttcttcgcatgtagatctcttatgaattttcacaaacgatctttactactccctccgttttaggttataagacgttttgactttggacaaagtcaaactattctaagtttgactaattttatataaaaaatagtaatatttttaaccaaagacaatatattatgaaaatttattcaattatatatttaatgaaacttatactggtgttgtaaatattactacttttttctacagagttaggcaaacttagagtagtttgactttaaccaaaatcaaaacgtcttataacctgaaacggagagagtagacattatctaaatctttttacatacaatattttttttaacccaactagtctaggaaaaacaaaaggggaaatgttcgcaaaaaatgttttttaagtaatgccacacataccatgtacaccaagtcaatcaatgatacgtagtgcatttcatctttaacacgcccacagctaaagagtgtgggtggccggacgcaaagactaattgaaccgaaacaactgaacaggaaatctggatataggacggcctttggtcattgattcattgctgcaaaactgatgcgatgaagagacggggtaaaaacggtattgaaatttcccgaccgtaccgataccgtttccgcaaaactaatataataataatatttttaccgatgttaccgttttcaaaatttagtttttttaatttctatcagcgtagcattgaagttgacattaaatagatgaatttataaatatggaaatttcccgatcttttccgttcgttttcgaaaaaataataaaataatataccgtttccgaccatttccgaccgttttcatccctagatgaagtcacgttgtgaaatcatgtgtgatgaataattagtaaaagtaattattgtttggttcaagttgggagaaatcattactaatgttaaatttagggccttcttgatcacttctattacccagagctcgatcttttctcataacagcttagagaacaagtaaatatctatctattatatactaaaagtccattaaacttcctacaaacgctcctaattcgccacgtgtcatcttataaacgttcctaagtcgccacgtggcactataataaattagagaaatttctaaaagttccctagcaattgattttcattaaattaggtggacccattatttaccaccattagatttatcaaaaaaaaaattgcctaaccccagaccaggtccaccttgggcatgtacttatattactactagcaaaagtacccgtgcgttgcaccgggtgattacggagtgtgtatattgaccaaaagtgttgtttggtttagcaaaagtgtccgtccgttgcaccgggaagcgtacagatcagaaaaatatgcaattaattaaaatacagattcgctgaaatatttggtatttttaagtaggtatgtgtataattaaataaatttacaagtaaagcaagtgtgagaaataaaatgatatggttaaatttaattttattaaattctccatgattagttgcgctctttgaaattttattggaattttgagagctaaattgctaattttaataatacaaacatcatttaacaattatttaattagaaaaagaaagaaaatacttccttttaggtttgcttcaaaataaacaca

SEQ ID NO: 45851 - DNA, 12531 bp, Oryza sativa
gtggcggcgcccttttcccatgctagcggccacggcttcccccacggcgagcgcggcggcgcccttcaccacgctagcggcagtggcggcggtggctctccttcccatctcgccgacacgacgcagcgacggcggggtgcggcggagacggcggcgacggccgtccctctccctctccccgtcggcgtcaacagcgacgtcggcttcgtccgaaggtggatccatcagcggtggcggccaccgcgggcggatccgacagcggcgctcccttcggcggcggtggtggcgtcggcggccgccctttttttttgcaatttttttccatggctattgctaaccgaatcagattgagcacgtggacgaatgggacgaaaatagatgtgacgaaaggaaaaatatgaatatttatattagttatagattatagaaaaaatgccagtgcgttgcaacgagtaaactaaaattatattaaatataaaaatattagatgattaggatttagttttacatgatatgagctctttaagaaaatctattcctaatgaaataaaaaaaagttcaatttaagggacctcaagtgaacttattccatgcggagtagaacaaattcgggacagctttagggacattaagtaaacttattctgtgacaagcggcccaatagtgtgggcggcctgggaaggcccgacgagggagaagctgagcggttcgatctgatggatggtactgattgatcgcgccctatatataaaagttgaaagatcaaaccctaaccctaaaaacattccccaccccctccctctctctcagtggcaccgcctctctccctccgccgctcctccaccccccccccggcggcgccgctccccctccccctccacggcggcgcctctcccctccccctccacagtggcgccgctccccctccccctcgccctccacagcggcgcctctaccccctctttctcgcctccctcgtgcgacggatccggcgtcggcggtgaccgtgggtggatccggccgtggtggtggcggccgaggacagatccggcggcggcggctcccttcaacccctctcgcctccctcccgcggtggatctgacggaagtggtggcgtcgacgccgaccgcatgtgggctcggcggctgctgctccccctccccggtgtggcgacgcggctgggagcggcggtgggctcgagagccggtcgcggcggaaggcggcgatatcgacgacgacgacggacgacggcgacaatggcagcgacgacggcgaccatgaggagggcggctccggtaggcagctagggttagggtttggattttatttttgatttgggatattgattttgtcgagattgatggttttgatttgggattgcaattgagtgattttgtgattcatatagtttgagaattgggggcaaaaggtttgggaacaatcatgaatttttttttatctgactgggattttttgggggtgggggagggacaaaaaatcccctggcggacgatgtgatgaccggaaaaatacgaatatttatattagttatagatatgtatgtacgaaccgttttttttccaccttaagccggcctgtacgtattatgtatgcacgtttgttttaaggataatacgtacgtacgttactttcacctcttcttctctcaatttcttcatatttttacacatatttcttctcctattatcatactttattagttagaaaatatttttttctgttaaacaattcaacagctataacatctaaattatgggtatgtttagatcccaaaaatttttagccaaaaatgttacatcaaatatttggacacatgtatggagcattaaatatggatgaaaagaactaattgtacagtttgcatgtaaattgcgagacgaatctttcgagcctggttgcgccatgatttgagaatgtgatgctacagtaaacatttgctaatggcagattaattacgcttaataaattcgtctcgcagtttacatgcggaatctataatttgttttttattagtctacgtttaatacttcaaatgtgtgcccgtatacttcaaaaaagttttggccaaagaactaaacacggcctatactactaattttcaatccgctcatatctttcaatttatttatgactaaatttatagctaactataacatataaataaacactataaaatgtataaaacataattatatgtgtgcgtactttctcttcttcttttctctcgctcaactcttccgtcttataatttttaactaattaacaacataatataaaaataatcaataattacaaaagctaaataattatgattcttacgtcatatatgatttttaaaagtttatttgaattgttaatgtattcataattaaataaataatttaagatctatattattcatatttcactgtataaaaataaacaccacctgagcttgcacacctatcctttatgcatcataaccaaatagaagaaacaaagcattatgaaaaattaaataagtaatatatcacctcaaatcattgtatatcctctgtagcgcacttaagacgtacatcacatgtacatcataattaaaaacaaaaccttagaaactgtaagaaaagatatctactcgtaagtttcatttaataggtggatccattatttttaaccaatagatataattttagaatcttaagccatcatgtgttgcatcttaaaatttagaaaaatcagaaatcagaaatttgataaaataaggaccaacatgcatattttttaagttgcacatataatttctaatctaactattgctctattcataactaaaccaataatttaaagatccataacccctatattttgagctggtataaaataaaactaaaaaaataacatatcaataggcactaaattgaactatttggagaaaaataaaataagtttgtactttgcactaaaattggaccaaccattacatgtttcatttttataataatttttaaatgcttacatattaatggccttgcatctatcctatacatattaatgcttacatatttgctactattaaatttaattttttggacccatattgactatattttcttatagatatagatcataaatattacaaggaagcgatgatctttgatatgtgtttgttaatttatatgtaagtatgtaacaacttgcgtaaatctgaaccaactaaaaacagaaataacttgatggtacaaatagttttatttactaacaacaatagttctttaggatttgtggaaaaataccactaaacattcaattaaacaagacaaaacattgtacttttaatttacgtttaatttgtagattgttttctaaacaaattaaaaatagatacttttgaaacatggcaggtttttatatggaccatagataattatttatacgaatgaattaaatattatatattttaaaaggtaacaaaaagtttgaataaattatctaagaaatgccgatgagaaaaattatagagaaatagtacttttgaaacatggtagttttatcccgttgatatttcgtttatataagtttttcaaacgcagtataaaatacatgcccacgcaatgcgcgggttctaaagacaatttcgaacttgctggtatgaaacagtagttatatacataaaaatcggagaagcatctcagcccatgtttcattcattgatttcagctatcaaatctcaaaaatgaataaaagaatggagtgtacatatatacacttcacagaatcaaattcaatcccctctgtgtcaaaattgttcccggacaaaatcaaatcctctccgagcagaagctactatacatacgatcgatcgaaactcctcctcacacggcggcgacgtcgtcgtagacgacgacggcctgcgcggtgtcaaactcgaagtcgaaccccgacggcgcggtggcgcggaagccgcggtcctcccatgccgccgccgccgccatggcgccggcggacgacgacgacaccgcctcgaacctgaagccggccgccaccacctgcttgcctgctgcagcgccgccgtgatccgccgtggtctgcggcggcttgtagtacatgcgcgccgtgtgcgggcagtgggagtggaacctcgccgcgatgcgcacccccatgtccagcatctccacgtaccgcgacgacatctcctgatcgatcgatatgatttccttccaaagcaagcaagcaaacgcggctctgttcagctcgctcttgatctaagcaattccgttcttttttttgctccgagcgctgggatcgatcgaggaagcgggcggcggctgggttatatatatggttggaagatcgatcgatcggagagcttgagttggcggaggcggtggggtgtgttcgtcgtgggttttgtgcatggtgtggttcctggcttttcttggcgtgggtgtgggagaagaagaagaagaagaagaagagactcagtttaaacgtgcccctttgtgttgcgcctcggccagcactcagaaggaggctatggaggcggttgggtagcggtggttgcgcttgcgcatgcgcggaacgagcgtatgtgttgtgttggaatgaattattgtagatacaaagctttcactaatagagttttgaatggacatgcaggtgcagtaatagtactattggttaattattttcaatttttctatatatttgtcgacagatgttattacagtacaattgtggtgtaattacactgtaacttacatgtaattacactataagtataatgtaacttttaaaatctctccgtaacatgttgttccagtaaaatagagatcgtgggaacaaatcctttcacatatatgtgtgctgtgattttttttttcttcctcaccagaacaaatcttgtaatatatctaacgattcaaaattatgtgaaacttacatacaagttacactatagttacatgcaaattacagtataattacatacaagttacagtgtaattacattacgattgtactataattacatctgtcaaatttttaggagaaaatttatcgacaaatgtataggtggtcccatttttttccttggattttcctcttttttggtttaactgactgcaattctaagctcaacgcttttaataatggtgtctgatcgtgaattaatcaagaaattccatggagtattgtttttgttataaaattgtcgacgggtgatacccgtagaccggatatagagggtattggggtacgttggtacaaggatctacgtagtacgacatcaagcaatcaaaagacaagaattatactggttcaggccccttgataggtaatagccctaatccagttgatatgggattatatggtggaaaacacaggttacaaagaggacaatggaacttatcggatccgacgagatcgtagtcgagttgattcgactagctctcgatgacttggctcctcgcagattccgacttcgtaggctgtgttggttgtgttggctctgagattcgatcccttgagccctccccggggggtcctttttatatcgcggatctggaggtctccaagtagaactcggaggtatcagaccctatacgatacgtcaacgacccagttctgtccgagtaggattctttccttttgtaaatcccgtgaaaggtttccttagaacatacaggaaatatccgcatgcacgtggatatgccatatcgatatgtaacgtatatcgaagggtagagggtatgcctaacccgtaaccctgacaaaaatactccctccgtttcgaaatgtttgatgccgttgacattttagcacatgtttgaccgttcgtcttattcaaaaaatttaagtaattattaattcttttcctatcatttgattcattgttaaatatatttttatgtaggcatataattttacatatttcacaaaagtttttgaataagacgaacggtcaaacatgtgctaaaaagtcaacggtgtcaaacatttcgaaacggagggagtataaacatagcccttttacggtaatccatcttccatcttacctctagaaattaatcgttgcaacggagcaacctcgtgagctctggagaaatggacggaacgaccgcctgccacccgatgctggtagaaatgttgattatggcaggcggacaatgcaaccaaataaaacattatttttggcagacaaacatgttaaaatgccttcttgtaaaagaattttagcaaaacaagaacacaaatttccaaaagaaaacaagtacataaatcctagcacgatccctaagctagatcgatcagccaccacaccccgctacgaccgctacagtggccaccggctgtggatccactcgtcttggggcagcccccatctgatctagccgtcgaaaggctgtctgcggtggaggaggaggagctgagggagaagacgttgagaggttgccgatagtggaggtggagctgagggagaggaagttacaggatgccgatggtggaggaggaggagccgacagaggctccccaatatctggccgtcgcgaggctaccatctcagttgttgcgaagctactggcagtggaggaggtggagctgagggagatcatgtcgcgaggttgctagcaatgaaggaggaggagcctatggagcctctaccagatccgatcatcgcaaggccaccggctggtggacaaggagctgaggcgcacgtcggccgctctcatcgctagccgctgggtgagagaggtgatgggggagagaagaagggtgaaaatacggaggagaggtggtaggggagaggaaatgtgtgagagaggaatgatgaattgaagttaggagagggagaggagtaaaggacttaacgctggggacggagcagagaaaaggagagggaaatgacgtatccttgtcatgtgcgggctaaaatcgatcgtctgcgaaaatcctatttttcattctaacctcctatgagtttttgtagccgggtatttagtgaacaccatccaaatttttttatatacagattttagagctatacgcataatcggagctagtgcgttaccttgaaaagtactacctccgtcccaaaaagccagtcattctgtgttgaagaaatgtcccgtaaaatttgtcgctctagcatctgcccactgaacttagcatctagtctattccatggaatcattctaaccctcctgattttagctagtaataattactctttccctgtgtaacagtgccactactagtaccatgcatgtaccatgcgatagatagcagtacaagtactagggacaaggattttctacacctaggtgccatagcacctatcatttgcatgcgactcaaataaaatcagatagtgaatagtacccatacagtgcagataaaatttgttattttttttcttcatatatcgatcgaatttagacttgcatgtttgcatactgtcttatattatcatggactatcttatcaaattttatgaattttttatacaactgtttaaattatatgcatacacctagttgccatggcacttaggtgtagacaatatttctgctagtactagtgattacttaattacttgttgtatttttttcttacaatatgaagtgacaaatgcaaccactaaatagggacaatatggtaaattttacttccggttaatttatccggccaacttttttttcttacaatatgaagtgacaaatgcaaccactaaataggagcaatatggtaaattttacttccggttaatttatccggccaaccttaaaacgactggctttcccgaacagagggagtatcttcatataagattttttttttgagatttatcaaaatccacgtcatttctatacaatcgtagatgccaacgcaaatatgctggtaagtatgagacagtagttgtatacgtcaaaatcggagaagcatcaaccaatgtttcttccattaatttcagctatcaaatctcaaaaataacaataaaacggagtgtacataggtacattacattcacataatcaaattcaatccctttgtgtcaaaattgtttccgggagaaaatcaaatcctctccggccaaagctactatatatacgatcgatcgaaactcctcctcacacgacggcgacgtggtcgtagacgacgacggcctgcgcggtgtcaaactcgaagtcgaaccccgacggcgcggtggcgccgaagccgcggtcctcccatgccgccgccgccgccaccgccatggcgccggcggacgacgacgtcaccgcctcgaacctgaagccggccgccacctgcttgcctgctgcagcgccgccgtccccgcggccgccgtgatccgccgtggtctgcggcggcttgtagtacatgcgcgccgtgtgcgggcagtgggagtggaacctcgccgcgacgcgcacccccatgtccagcatctccacgtaccgcgacatctcctgatacgatttccggctcactctgatcttgaattgattttcttcttctccgagcagctgcgaggaggcaaggccgcaggggcggcggggaaagatggatttcgaaggggaatcgggcgatggctgggttatatatggttggaagatcgttcggagagcttgacatgacggaggtggtggtgtacgtgtttggcgtgtgcttcgtgcatggtgtggttgactggttgctggcttttcttggcgttggtgggggaagaagaagaagaagaaggcgagactcagtttaaacgtgcaccttgtgtctctctcggtcagcgcgacgatggaggcggttgccggttgggtagtggtggttacgcttgagattgaacgagctcagggtgtgggtgggatttgttggaggccaacacatatattagcagattatcgaatccgttcctttcaaaaaaacagtagaggtgcgagaagatgtatgtagtttcgagtcgacagtaatagagatgtgagaacatgtaaaacacccgtgcactttcctttaccctcgacaatatcacacaagcaaaaatggacagagataaagggtgtaactctctctctattagatctattgtcgttcgttgagtataagcaacctcaaaccctaccccaatataaatataggagataaatcttatttcttgcctgattcggattgaccaacaagaaatttatcttttaaaaaaaaacttttctccaagggatttgttttataataggattaactcaacaaagtcttaaaacgacacccacatattcaacaatagcctaagtgcaaatagcctctaaaaattcaacaatatcggcctatttgtttacttaatgtcagtttcaaaatttttactaaaattgctacaaataaaatttctggagtggctcagaaggttttttagtcccacacagatagcttttatacctgggagaaatgttatggagggggttgttatttttcatgaaacgtacatgagttgtgccggaaaaaagagtggtgtacgttttaaggttgattttaagaaagcttatgataaagtaaaatgttcttttgttcaacaaacgttgagaattaagggtttctcgcaaaaaaaaggtgtgattggatttcttcttttatccaaagtggacttgttcacattaaagtgaatgatcatgtgggatcaaattttcaaacatatacgggtttaaggcaaggggacccattatctccaattctttttaatatagttgctaatatgttagctatattaataaagagagcaaaaggtaatggtcaaatttctggagtggtccctcatctggttgatgatggttcatctatcttacaatatgctgatgatactatcatttttaagcatgatttgcaaaaagctaaaaatatgaaattgattttaactgcttttgaaaaattttctagtctgaagataaattttctagtctgaaaatttaaggaaaggaatgtcatgagcaatatttaaatatttttgggtgcaaactaggaaattttcctgttagatatattagcattcctatgcattttagaaagcttagtaataaagattagttaacaattgaaggtgttggtccagaagtatgttagcatggcggaaagcaaggcgacgagcacggcggcgctagggcgtgcgtgcttgccggagagacgacctccctcgccagcgacgccgaagaggggaggtaatcgagacgtttcgataggtgggaaatggtgttggaatacccatgggttagcccaagggcccgacactattcacgcgggctggagtggtggggctcgtggaatccgccatggatggtccatgcgtgatctgctcccgagcccgattaaggaggtttttttgtctgcgagctgggtgtgggtgccgaaagggggttctctgagtcctcatctagggtttccagccaccaggcgagaggtcgtgcgttttggggcgacgacgaggcggatctggagagctccggcgagactcactgacgggagatccttcctcgaggtagcgaagggaagtatggatcgtaaacctcaattccaacgtcctgatcaatgggttcccaataagagaagagcgttcgaagaggaggggggaggtgggaattgggggaatcgaaatttgcaggaaagggaggaacgtgaacttcggaatcggttgatggggcaacaacaacagcgcgaggaagggaggtggcagcaagttgagagaaggggggccaacaaacagtggcaaggagacagaaacagggagggtggtgcttgggagggaggggatcggcgtccgactcgtggaaaggagaagctgggggaggaagggagatcaggtccttcccagaaggaagagatcaagtgtttcaactgtggagaaagtggttatcatcaggtgaactgtcagaaacctcctctgtgctatgtctgtaagaatcctggacacatctcatctcattgccctgttcatgttggggggagtagctctaatttgagcaaactagaagtaaagctaaaaggttatggcatacctgagcagggttttttcagcctaaatgtagataatttaggtgtggctgagaaaggggcacaattcagaggaatcctaactgtggagaaaggggctggttcagtgcaaaaggtggccaatgagatgtctcatctatttagggagaaaaattgggattggaatgtgaagcaaatcagcagtaataatttcttgattgatttcccgagtgaagatgctagaagacaagttactaagtcagggggtttgtgtttaagacctcatccatcaaagctagtgtaatagaatctaagatgactgacaatgctgtggatgagctctttgtgatctgggtaaaagtttttggtcttccaggtttcgccaaaaagcaggaaatcattagagcaatatctgatattgtgggtgaatttaaagaagtggatgagaaatctttgaagggggaaggagctgttaggataaaagtgggatgcttggaccctagtgctatcaactattctgtcataatatatattaatgacattggatataagataaaatgggaggcagaggttgatacagaggggacagggtctattgattggggggggacaatgatgatgatgatgctgatgatctggatgatgattaccctccaggaggaaagaaaggtgggggtcaggatgccaaagggagtccaaagaaaaaggaacctgctaaggatgcagatagcaaaggaaggattgtcagtaagactcaatctgccccccagttgttaaaaggaactctaaaaacttgcaaaacgccataattctgtaggtggagaatgaggtgggggtcactgctaagggtgaggatcctattgaatcaattaccgtggagaaaaaggcagacaaggcagtggtgttatggaagtcagaggaattttcacaaccagaattgtttgagcaagtttcacaggaggaggacaaaagtggtgaccttctcaaaagaatggatgtggatttaaaattggggggtgttagattattcacagatgaagagggggagaaatgtgctatccccgctgactcagacattgagttgatgagggcagaggaagatgatgacagtgaacaactagatctggaaagtgaagcagagatacagctcaaggaggttaacttccagaaagtcaggcacaagaaaaagcaagttagtttggtcaagagacagagttctagggtgaaggataaagaggtatcagttcatctaaaagctgagctcaggaagtccaaaatgaacatgacctcaggtatgtcatcaaaaaattcttatgcaatctttcattctgttagtcaggattatcttatcaacattgctagggctaggggaatctctttgggtgacaattctgtggaagtgagatgcaacttagatgctatttgtgctagggaattggcacaggctactatttttgatgcagataagagtttacaacagatggctgaaaaagcaagtttggaggaagaaggggggcaggaagtccccccaaatgg

SEQ ID NO: 45852 - DNA, 2624 bp, Oryza sativa
gaattcctgcagccctgttgcaggatgtgaggctagatgatttgcttgacagcttaatttggcctcatgagaagaataagagattcactactaaatctatgtataggctgttaaagtttgggggtgttgtggacagagagatgcaagagatttgggggtgcaaagttcctttgaaagtcaagcatttcctgtttttggctgggagagggagaaaccttgtgctgatatcttagttcagagaaattggaggggggtactaaattctgtaaattatgcttgggaactgaatctagtaaccatgtgctttttacttgtcctatcgcttgctttgtttggtgctctgtaacagaggtaattgaagggggtttaattccaaccaatttttgggatggtataaaagctggtaaggaaaaactgggggtgaatttaggtctttttctttgtgctagtctttgctggggtttgtggttgataagaaatgaccttgtttttgaaaataaattggtgaaatcacctttgcaggtagtgtacaaggcaatttctttgatgcagagatggaaggtgctgctgtcaaaagaaagagatcgcgaggccttgatcgtgctgcttgagaagctaaaggctaagctggagtctctacgactagtggacgtgctaccggacaatattagtgtttaagtcagtttgtttgcttttggggttgaggtctcctagccgtttggatgtcttccttgatagggtctgtaagtcttttggggtttagctatctagcgcatgatgggcactggcagccccagttttactctgttttcctttaagtttctgtattcagaccttgtcatgtttggctttctcccaaaagccgggtaatcaaattacctattataaaaaaaacaattgaacaaagaattgagaaaaaacttagtagttggaatggtaaactaggtgggagattggttttgattaactgtgtgttatcaagtttagttatgcttatgatttcgttttttagattcctaaagagttcttgaaaaaagtgattattatagatcccatttcttttggcaaggtgatgaaaaaaaagaaatatagattgacaatatgagatattatttgtcatcctaaatatcaaggaggaataggtgttcataacttagaaatccaaaaccaatgtttattaattaagtggttgtttaaattaataaatgaacaaggtgtgtggtaagatcttttgaaaagaaaatatcctggtactaaatctattactcaagtcgagaggaaacatgggtattcctatttttttttgtctagtttcatgaaggctaaaagttcttttctaaatatgggctactggattattaataatggtgaacaagttagattctgggaggataagtggttagttatggttccgcttaatgtctgttttaggagagcattagttggtcagaacttgattatatggtattattttgtgtgttttaattgtgcatgttaatttaacagaggaggatgatatatttagttggaatcttcatcaaagtggtcaattttcagttcgatctatgtatttggctctaattaataatgggtatatagagagaaataagtttatttggaaacttaagataccacttaagattaaaagttttatgtggtatctctttatggggattgttttaaaaaaaagacaacttggctagaaggaattggaatggtaatttgagatgttgttttttataaaaaataaatcgatttaccatcttttcctggattatcattttgccaaatttctttcgaaatctatacaattcgcgtttggattatatcctccatataatatatctcatatatttaggaattggtttgtgggtgttaataaaaagaccaatgaacttaatcttgttggagattccgctgtatgttgagctctctggcttactagaaataaaattatttttgatatatcaccttcaaaatcttatttggttcttttctgggcaatatattggctccgggaaagggctcaattataaaagcatgatgatcatatcaaactaataagagatatgtgtcgtaaacttgagtcgacaatcatgcagctttttatcaacttcgggtggagattcaccaagagaattcaatagttgtggggtctttaccttgtttgatttttattagtttgcttttacttttgtttttgttactttagttatatactcattgggtgagttcatttttgtgtaaatcttataataattggctatagttcttgcgcaaatgccaggatgtcattccattattataaaaaaaaacaattaatccgagtccgacttgattccggagcccgatcgatcgatgtccgaactgtctcttctaatcgagacgttatatatatcatgctaatcctgcctgccacgacacccttcgtctacataagtgagcaagatagattagccagaagctaatcccactctaatcggtggcatgcatatatatcgattattgcatcactatatatatataggcgcctcaccgtccggagcgcgcaccgcggcgctgccggcgtcgtccgcccatgccgccgccgcccgccgcgtcgtgcggcctacacgggcaccacc

SEQ ID NO: 45853 - DNA, 9886 bp, Oryza sativa
aagacgacatcgccgccgccgtcggcgcgggcgagccggtgaacgtgcagcttcgcttccgcttcgtcgacgcgtcgtccaaccccggtcggccgtggacgccgccgccgccgccgccgccgtctgaattagccgacatgcgtggcgagaaggtgcgcgacttcgacggacaagggaatggatggggcaccgtggcgttcaagaagaaggagaagctggagagggaagggctcatcgtggaggatgggctggccatcaggtgcgacatcgttgtcatcacgcaatcctgcacggcgacgacgacgacagaggcctcgctggccgccgccgccgcggcatcgtcgtccagcgaggaaatggtttcccccaccaccatcgaggacaaggtggtgaacccggtgtatacaaaatggtgcttaccgccactgtttcagtaaaaacatagtctgcataagatcaagccgcctgacgtgatgttccaggtcggcacaagcggaagttcacggctaaccggcggttcgtcgccggccggtcgccgtcaccggccttcgcggcggagcaatttggcggcggccagacggagcaatgcaacgaccaccaccatcgtgtcatacaaatcgacggcatgaagcccccaagttgttcgacgcgctcagcttcatgtatggcggctcgttaccgatgagtaggccagattatcggcggtcactgctgtgcctctgctcgtcgcgagaagttaagcaagtactccctccgtattaaatgtacgacgccgttgactttttaacaaacgtttgacctttcatcttatttaaaaaatttatgtaattatcagttattttattgtgacttgatttatcatcaaatgttctttaagcatgatataagtatttttgtatttgcataaaaaaattaaataagacgaatggtcaaacattagttaaaaagtcaacagcgtcatacattaaaatattaaaatatggagggagtactacaagagaagcgtgtggtaagcttgttggtgttcgttgatctgtggcctagctgcaaggtgttcaagaaggcatgctttgagttcatcatcaaatcgtcgcactgtctgatgttgattgttcaaaaacaaaaaaaatgggaagtatggccgtgtttagttcgtatgccaaattttttttaagtacacggacacgcatttgaagtattaaacttagactaatacaaaacaaactacagattccgcatataaactgcgagacgaatttattaagcctaattaatctgtcattaagaaatgtttactgtagcatcacattgtcaaattatggcgtagttaggctcaaaagattcgtctcgcaatttacatgcaaactgtgcaattgatttttttttcgtccacatttaatgttctatgtgtctaataatttgggtagttccatgccaaaattagaagtttgactaaaattggaagtttgaagaaaaaagttaaaagtttatgtgtaggaaagttttgatgtgatgaaaaaattgaaagtttgaagaaaaagttgaaaactaaaccaggccttgatgtgaaggaatatttggaagtttgaagggactaaacactgcctatatcatcatctgtctgaactctgaactgtcgtactccctccatactcataaagaaagtcgtttaggacaatgtttaagttaaaccttgggaatataaatcatgaataactatcaagttgttgagtttgaaaatgtaaaaattagagtaaactgcactttaggccacctctttttaccaaagatgcaatttgggctaggtgtaagacatgtttttcacattagactagataactttgcataattgtttcaatttggacctccttttctatatgctcccctctttcttctcaagttgatgaagaagccaagctcaagcatagacttctggagtgccgcctaccgctgccttgtaatgcagccactatcctcgagcagctcctacgcaaccatcatcgtgcaactctcgctactatggccatggagtgccactggccgccacagtccttgagtagttccaacgtgggggccaagagctgcttcgctgccgtggcccttgagcgctgctcaattgctcattgctgtcatcctttatctgccatccgagagctttgattcgacccgttttgtcccaagctctagcttggtgagcttgaccatcattacgacgactgtacaggggccacggtctcaaggttgatgatctccacggggcattggggcttgctgaattgctgaaagttcaagcgttggggcttgccgaaagttcaagcttgacctcaacatgtctatactcacagtcacataaggtcaacgagagagagcgagctagagcctggagtttggagaggcaaaaaggaggttgaaggtgaaaccttttgcaaacttatctagcccaaagtgaaaaagtcatcttatccctagtccaaactgaaacattggttaagaaagatagcccaaagtgcaatttactctaaaaataaaaattatatgtatagatttgtcttgaaaaatactttcataaaagtatacatatatcactttttaataaatatttttatagaaataagaagtgaaatttgtgttttggagaccgtgtcgctgtcctaaacgacttcctttacgagtatggagagagtacgtgcggagtgaatggtcctatagcaaactctggacaagccaaatttttatatatgctgggccgtttccctaccatccattagggccttcgcccaccaatacgcttggtcgtgccccaccacaatacgctgggcctacaattgtttatgatgtcagaaatttgtcaagatacttttcccacaactcataaaaatttgatcactatttccgttcaaaacaaaattgatcacagattccatttgagtgtctgtatatatatagtacgtcaaccacgatcaggatctatatatatcagtgaccaagttatggtgactttgaacatatatatagaagaacctgatccatagtgtttaccgccatgatatttcaacatctggaattgggaatattttcttcgtgaaactatggtcgaaactcaaaattcatacttagagcaaggggcaaggctaatagccatatcaccttgctgcatgcaggcctgcagctagtttcaaaacttagtaaatatagcaattaagttatatatttttctctacaatctcccacacacaccttttgtttttctagtattaaattgggttgtttgaaggatggtagcaaggcacacgcatgtatgagaaaagaattgggcccacaacatggggagtagtgtgtagcccgacggcaaaacaatccttctctctttcacctaaaaaatctaatgtgtacatcactataggctgctgatatagttttatatatatctgtttttatattgtacatgtatacggacgtcatgagttaatttatttttataacaaacaggtcctattaccatcgctgttcgttgatcatatcggttttaagacgaggaattactttatctggtttaaggttcagagaagaaattaaataaaacaagagagttaagtgaactcgaaacagatatatgtctgtcactaattcatagattggagaaatagcatatatgttgaagaaacttatttatattctgtagatatatataatatccatctcactgcatatatacgcaataagtattagaacaccatgcgtgcccagaactgtactgggcaaatatatccgcttattcagtcattcattcataccaaatccaaccacagcgatatctcgaccgtccgatcagcgatcagtggttggcgatgatctcctgagccttgatctcgtactcaaagccatagctgctgacctttgagctgtccgccgaccagatgaacaatcccggcagcttcccctgccgctgcaactccttcgctccggcgatcccctgctccggccagagcagcccggcgacgtcgccggtcttgaagctggcgagcaccttgccgcccgggtagttcgccgcctgctcgtcgtagaacatcacgtacgtcggcacgtcggtgttgtcgccgtagccgtagaactggaagttgacgaggtcgatcacgccggcgtagcgccgccacagcggctggtagtagcgctgcaccacggcgtcctcgaacggcgcgatggaggtggtgatgttcgggtgccgcgccttgagctcggtgaggaggcggccgatgcactccacgaacgtgtcgacgccggcgccgccgtcgtcgttgaagtgctcgtagtcgacgtcgacgccgtcgaggccgtaggcgtcgatgatgccggagacggaggcgacggcgttggccacccacgagtcgacggaggtcggggagaagaagaccttggcggtgtcctgcacgctgtcgccgccgaggccgaccatgacgctgacgttggggtgcgccgccttgacggcggcgacgtcggccggggacaggttggccgtgtcccagtacggcgagaacacgccgttggtcggcgccggcgtggcgccgccggccgggctcgtgtagtcgatggcgaaggagaggatgaagttgaagctgaggtttgggttgatgggcacgtcggagaagcggactccggtgaactgcgcgccgatgtactcccggaacaggtacccgttcgtcatggctacgaccttgttgctcgagttagctgctatctgtctagctatctatttatacacgtgagcaaccggtttaattaattgttgattaatttagctttgactacacctatatgttgggggagatgagcaagcaaaagatcaggttctgatctacttactgttggatgcatcacatcagctgttgtttattaatgagaatataacaagttggtcatggtagataagcgaccaaggccgtgtttagttcctttcataataattttttttaagtatacggacacacattcgaagtattaaatgtatactaataacaaaacaaattacagatttcgcctataaattgcgggacaaatctattaagcctaattaatccatcattagcaaatatttactgtagcaccatattatcaaattatggtataattaggctaaaaagattcgtctcgcaatttacatgcaaactgtgtaattggtttttttctatatttaatgctttatacatatatttaaatatttaatatgacgaaatttttaaaagttcgaagggaactaaatacaatccaagtaaccacccgagcgcggctcgaaaaagagtgacatatagctagaacctagagttagacatgtgcacgccacgaaattggagagctagctaaggttaccatcttacgtacggtaaccatttgtgatttgtgcacatcggggattcatttatgaagccatgcagatcagcacgactcaaaattgtcttggattgggaattcgatcggacatatataagtataggagtgaagtgcaccagcggtctctaaacttgtgcgggtgtgtcatctaggtccttaaactcttaaaatgtatttttgagtcctcgaacttgtcttcggtatcatataggtccaaacaggctccgatccgctccatccgctaacgtggcatccacggtagcgtctacgggtcagtggggacccacatgtcagctctgtgcatcatctccaccgccctgggagccgagagagagagagagcgagagcaggaaagagagacaccggcggtgctcgacgcgtcacgcgtggccgggacgtggcaacgctgagctcctcccttttattcctcatacgtgtcgccttctcttctacattcttctggagccgaactactcggacgagagagagccctatgcctctccgtcgcccacattctcgtcgtcgatcgcgaagaagatgacgctcgctgttgccgacgagttgtctccatcgccaaatctttcccgttccaaacttcccacatcatgccgagcaaatctccttttgaccccatctcgttttatccactgcagcaacggaaacgcgaccttgcccacgagagctccggaactcgcaccaggcgtcgccgccatgaagtcgtcgctgttccaaccgacatggtccatctcaagccaagccatcgtgccaaagtcatcgcctcaccatcatggccaaaatccctcaagaaattttaagaatcatgcacagacgagggagatcgccgtcatcttctccaactccggtcaccgagtgccatcgccaatccctctctccccggtgagccacggactaattaatcgtgcatgcaactctttagggacctcactaaccacccatgcaccttctctaagcattccaccgctcaagcgagccgtcgccgtgaagccgacgttatccaccaccgccgggctgtcttttccattgccgctattacccagacctcgccatgccgcaatcaagttccagtgagcacctagggacctgctagactcgtatgcatgcatctttttgcactaaatcgagctgggactctacatgcacaggcgtattgaagaccaccgccgctcgtgacaccactggcatcgattccggccacctccggcgacgagaccaccttcaacaggatcgcaaggaagtcctcagcatttcttcttgtggttgtgtcggccgaagaatcgccgttcgccaacggcatcgtcgtgaaggaacgccggccggcgaactctgcggctgctgctgtgttctccctgtgcctatgataggtgggctccgctccattagcacgtatagaatttgattagagtaagtttaaaacatgtaaggttctttctgtaaatattgttatcatatcatatatttataaatatgactgacatgtgagtccccactgacacgtaggcgctaccgtggcatgccacgtcagcggatggagtgggtcggtacccgtttggacctatatgacacctaagacaagtttagagacataaaaatacattttaagaatttagatacctagatgatacattcgcacaagcttagagaccactgaagcacttcactctaagtatagctaaaggaaaaacaagaccgacttccagaccgtccatgcatgctggcacatgcatgcgtacacgcggaactaactgtgactagattgttcactactcggcgacacgttcacgttaattaattactcccaactaccacggagaaaaggtcatccgtaccggatggaaacccacaaagagtgccggtttttccaaacgacaccatgaagaagacacatattagaacacttaaaggtggcggttttagaactggcatctttaagttatacaatttgcaaagacaaatttacccgagccgatgcatcaaagcaacccaaaaaatcatccaaaaatctaaaaaagactacacatcagcatcacacaatcaataattgatggatcacacaatcaacaactacacatgggagctcgccggaactgtcggatctggcggatgggagcctgtcgccgctgccgctgcctcccctcccaccggatctggcggaggggagggcgccgcccgccgttgccgcctctcctcccgccgccacccgtggggcgccgccgctgccgttgcctcccctcctgccagatctagcggaggggagggcgccacccgccgctgctaccaccgcctccctcccaccgctgcacgctgttgcatgctaccaccgcgtgctagcgaccgagacactgcggtagagaaggagagagagccggcacagaggggagagggtgtgagaaagagagagcggtgggtgagaggacgagaggggagcaagtggataaggacgctcccttacctcccactcggcgttttattcctcgcctccccgtgcgataaaagaaaaaaagaggctgtctctcaattcggcttggctcgtttgatagggtgtcgtttttaattaaccgacacctataatatattaaagatactagtatctttataaaaagaatcggcacctatagtataggtggcggttcttctatagaaccgacaactatagcgtattaaaggtgccgttttattttttttcatcttttgaaggggaaaagcactatatgtttcggttttagctgatctgacacctatagtgccgacttgtatatgtcttttttaacagtgtcccaccatcccaatcatccctaacaaagaacatcaagaccaagaacaccaacacataatttattctaaaattaatcctcatcgataaggtgttttgtcgcttcgagtccaataagaattatctcatacttaaatgttgcatgggttgaactaataaaaattaatcttgattagtcgtatgcagggtatttcataatgcatatgtactctttgcacgaataaacaaaataaacattttgttagatgacgattatttttggagaaaacctcaagactcttaggcgataattacattgggatacagggaggagctactattgcacgttatgtcactattacccggacaaccttcgtatacagccagctgctagatataatctccgattgacctccatgttcaactctaccgacaccgtcgtcgtcatcgtggtggtggcagggtttcccttaccgccggtaaccgcgcgggcttatcgcgggggtacggtaatataaataccgcggtaacctccttaaattcaaataaatttaaaaaataatttgaatttttgataaattttacacggttttgtatggtttttcacggttaccgtggttaccgcgcggtaaccgtgcttactattggggcgcggtaaccccggcaccggcggtttaggaaaccctaccgtggtggtggtgatgttcaccaacaagctggctcccatgcaaaaaagaaaagctggaaagtttttctttttaaaaacacagtaaaaaaaacagatatttataatacgtaccctgcacacttacacctgtaaatgcacgtacgcatatattatcgagcaacttttaaaaaactgggccggtcaaaaaaaaaagtttaattctacatgaagggtctggtcctccatcatccccttgatctgatcgacctagctgggcttggtaatcggccagtactaaaaggaaaaaagtacaccgaacgtccttcaacttgtcatcgagttacaaaatcgtcccctaaccataaaactagatattcagcgtcccttaactaatcaaaactaaataggtccttcggtagttttgaccctggttttatcttacgtggcagttgagttagtgtgggacccacgtgggccctacatgtcaggatgccacgtcatctctctcccttcctcctctctctctcttctcttctcgtctcttctcctctctgggcaaagggtgcgggctgcagcgactagcggcgccgtggaggtgggcgtcggcggcggcgcagaggagatgggcaccggcaccggcaaagatgtcacacccaaatctggcactgccgtacaacggcacctgataggagcgtgtcgtaggaaaaacggcgcaaaccgtttcctacgaaaccgcgatcatagtaccagtcccaggacatagcgctggtacccacggtgacaaatatgaatcattgtaatccttaaattaaatagaggacttatttaccttaacttaggttgcagctcaggatagcccgagaatacaatcgacgacgcggacgaggaaacaccaacagcagcagcagcagcagtagcggaaccaacggtctaacacccaacaccacaggcgacggctgggaaccaggacaaaaccctaatcttcgcttaacttcatcttctcttcaagacggaggaactatatatatatatttatatagagcaagggtgagtattttcgtact

SEQ ID NO: 45854 - DNA, 7491 bp, Oryza sativa
  unsure (1)..(7491): unsure at all n locations
gattggcacccggccacaactttaaaacggccacccgggcctagctgatcccgtcagccacagatgttccaaacatcgaacccaagtccacaacagcaatttcacaaatcagtagtcaaacaaaactacgctaaggaatcaccttacatccgcccatgaccatgggcacgactgttcgaacagtttaataacctctgcagagggggcacactttacccacacgacattactaacccggatcactcagcccgtgcagaacagccacgtctggtgaccttgaggctttcatgacaaggcatttcgagagccgacacaggtttaccatatgccgacgagaggggtcccagaccaacaacaggttaggtcccagaccatactgtgtcaggaagcccaggggtccttcccgacaccaccctggcgaatccacttgtcccccggcatcaaggctcccctgattagctaattactcagtcaggggtgtcccattccacccatgtggtcgtacttgatatatgtccggatgaaattccaaaggaatcggtccttaagtgcaagaataggagaccgtgctcccggcacgtcccctggtctgcgattttggaaattcatttagttcgcaagcaccgacctaggcgtcgggtttttccgagtcttttgcaaaacccaagttttacccatcgttagatattttaaatttgaggggaggactccgacgtgcgtacccgaaggcccgtacatcgaagtacaacagttgacaaaggaggtttaagtgttcaataatttaaggagggtaattgcagcaattaggattggggccggtaggctatctcgcaagccgcggccaatttacttgtgttaatcctatccatgcattatttgtggaaaagaaatacttagatttaaattataggtgcaagatggtcaaaagtgacttgccttgctcaaggtcttcacggagcttcacaaatctttgagaaaacccgcaatcgacgaaaatccggtaaccgcaactatacgcaaacaatcgaaaacctacacaagacccaaaagaaagatcctatttagcctaattattagtgccattaaatagatctcaactttagagaattactggaagtggaacggagtcaatcggagttacagatcaggagatatgaattttggaagcttaacttgattttctggacgaggaaaagatttatcggaattttccggaatacgagaaatggtctatggaatttatagaaataatattctcaagaatattattgaatttcactgacaagcaggaccaaggaaaaatgattcatagaattttggaataaggaattgatttgtggaacaagggaaaaaggatctattaaatcctttttggaaaggaaatcaaggagggatgtatattagacttgtttcgggtggcattggtgcggcccaaagggttgaaggaggctcggccgagccatttggccggtgtgggcacaaggaggcggcccaagaggcgtgcggagagagagagaggggttgggggggaggagtagggcagctgactgggtgccggcttgacccggtcaagcggggccgacggctgaggtggctgccacgcaagcgcgagagagggaggccgagctcgcccggatcggatggctcacggcggccgagaggcgccggcgaacggcggcgaaccggagtgggcggcgggcaccggaggcaggaggaggagaaggggaactcattccacggctcggatcgggaagacgtcgcgcaacgacggccggcggcggcggccaatctcgccagcacgccgacgtggccgcgcgcgagaagagcgaagggcgcgcgggctcgggcttagccgaaccggtatggtgttgcgacgcgcacgcggtgaagcgggacccgatggtcgccgcgtttgaactcggcggcggcgctatgcggcggcggaaggggcggcatggcgcgggagcgggttgggaggccggcgactggggcggcagcctgggaaggttcaaggggacacggggagggtcgcggcgcaaggaatcggcgagagaagggccgacggcggtggattgcggcggcagccatcgccggcggagaaaaggggaaaactcgccggggcaacgggagtccaattcaccggggaaggagcttctacacggctccgggaactcgtttcaagcaacgggcggcgacgagctagcctaggggatcatggcgacggcgagtgatgcccgggacatggcgagggcgcgcggcgagctgtggcgaacggcggcggcatggcgcggcgtgcgacagggggaagtggttcggtggggagctcaccgacgagagaaacagcgtcggcggcgcggatggagtcgcggcgaggtggacgcgacggcggggcggcgcggcaccgagggtgcgcggccggggaaggagggagggagaggtggcgatggggcagcccggagctccccgtcacgcgtccacgcacgcaccggctcctccggtgctcggcggcggacggcgacggcgagagcggggcgagcagcaacaatggcgcggcggtgatggaagtgaaacgagaggaggattcgatgggaggggcttgggtttttatagcggaggcgaggtcggtttggggaggtggaaaccgacttggcagtcgagcgctcggctggcggtcacgggcgacgcaagagcggcggacgacgaggatgcaaagagcggcgaaggcggtggatcggacggcgtgacttgaatcaagggagcgcgaggggcaatgcggcgagctagtgcgtggtcaaggtggggcgtcgagctgctgcggcagcgtcagcggcgctctgaccgcggcgcaagcgacagaggtagggcgccggtctgggagggaaaaaggaaaaaaggagagggggaaggggacttggtcccttgccgctttgggtgagggaggaagcagaggcgcaagctctggctcccgtctttttggtggttagcagtgtggagcggcttgggatgatggcggtggtggcggcaaaagcgggcggggccgggcggcacgcggtcacgggcggcgtcagggctgacgcggcggcgaccgagcggctggccacgagcgagcgcgcgcacgtgggaaaccgatgggcggcggcgaaaatcaaatggcggcggcgggaaggttcaaaccccggcggcgggaatcggcaaggcggcggtggtcgactggcgagagagagaggaagagagacgacgctctctcgggcggcacacatgcacagcacgtgcgaggaggaaggaggagataggcagaggggagatgggccgaggggaacatgatcggcccacaaaacttgaggaaggcgatttagactttcacagaggaggctgatttggagagaattggagtttggatttggattcaaatttgatatccgaactcgagggttcagggaggaatcaaggaatggattcgaggtggactcggatatttgtggaattaggacaagtatttggtggggattcaaaggatgcgattgaatttcggagtttgatttcggagacttgagtcggaattggaatcttgaggtgggcgattttgatggcgatgagagggaacaaagatggagattgaattgagatccatggcacgacttagactctcactcaaagaacgaaatttttgaaattaggattttgccgaaatagtttttaacgcctcacgaaaagcggagcgttacaaaagaggagatggtcgtcgttgtcggtgaggtgggggaggcggaggaggggaaggggaaggatggttgcggcggcatggtgcgaggcgacgacgaaggaggctgggccccattggccagctcagagcgatgcatcggaggggccaccgacgcagaagagggaagccctgccccggccatggcagcggcggcggcgcaaccgccgcaaaggaggctaccggcgcaccgcctctaccgatcgcacccgcacttccgtcatcgacagcctttgcaagaactccacaactcctgcaacacacgatctagatggccgcgacgaggtgctcggcgtggtggccgagatccaagagtggcacgacgcgcctccgcctccagatgctcgacgtcgaccgccgtccgccgcttccgtcgcctctgcatccgcggctccacccccaccaccgtgtgcatcctcgctcacctcgtcgccgcctgggcccacgccggtgagctcgaggaccacttccatgtcagcgtcggcgtccagcggccgcggcgatgacggcgacgagtgtccgttggccaccatatgctgaacgggatgctaaatctaatgggccgatcgaaatattaggaccttatacgccatcagaagaaaatgggttaggttgggttgggttgggtttggatggacctcttgaaaaagggttagaatggactaggtagagagacttgttgctgcggctagcgtgcggtactgtgttctcctgcatcaaagatggtttcttcctcaccatgaggaacatgctcggccacggcagtaactggtgcaaacaggcagacccaccaattcacttatagtacaataaacaggtaacacgtcaggttaccagcttaattgtagtacaagtgggttaacgggcctgtccgtttgcacccttagcggtaagcgatgccttcacccacctcctcattggagcttgtttgtcactgctaggcatcaggttcgcgctttctcaatcttggtcaacaacatgcgaactcgtgcagatatcacaaacacacgtcacgaaacggtctacttctgccaatcccttcgaaacgtgtatattcctataaaaccggtgataaaatggtatatttctaaacctttttttcgtttgtgaaatgaagcagttaccatacattttgcctctcgcagtaaaagctgcctgaactgtcagttcagtgtttgatcatttcatataggagaaggattcatacgcaggggcagagctatagtagaggggtgcccaggaacctgatcaagaaaacattttagctacacaccacctgtttccaccatgtgtgtatcccctaatacaaacttagacactggcatcagcttaaactcgacctaaagtaaagtaaattaaacaagtggcacccttcttcatttcgttctatatccgctcctgtttatacggagtcggagtcacagaccaacgaagatcttgtcttgattctatcctggagctctatcgtattgtcatgataaaaaaaaaaaagcttcaattccggttgtgagtgtgagggagtgaattgtgtgcatgtgaaatcgccgaataaatcaattgcctgaatttcctttttcacggaatacagtacaatgtatccttgaaaatgaacttcggtgtcaagagaaatgtaaaacgaagtgacgtaacattaaattggatttcggcattgcaaaattcgatttcagcagatgataagaaggaaatatatatagttcttctgcagggagtgatagctgaagcctgacctatatctctttgactaccattgattaagttgcgaacgttccaattctttttccattttattcgacggttccacttgcaatcttcttattttgtcgcttgctctatccacgggctcttatttattcggcgcgaggggcccccttcacaccggtgcttgggagcggcaagaacagcgccgcccctccccactggcttctttcatggtggatccggtggcggcaacttttctcgcggcagatccttcaacggcggcttctcccgcggcggatcctttcaatgatgataatgttgttgttctcctttcatttttgtttttagatgttgttgttgttgttgtatcgattttatgacttgtgatctgtaatggcgatgatgctgattgttggaagttcgttggattgatttcgaagggcaaggcttagggatgacgcagggtggatgcgctcagtgaaccgatgcaacgagcctccttttttttcatcctaggaatcttataaaggtacctgtttctaaaccgacaccgtttactaggtgccggtttgaaaatctgacatccatatatcgccgattaccaatcggcacataagtccatttcttatttagcacgtaagtcgtgcataatgacgctcgatatataatacgaccattatttcgcaatttatttgctcttatttcataagtattatcacgaccgttcgatggacgatcagtggttggcgacgatctcctgagccttggtctcgtactcaaacttgtagctgctgaccatggagctatccgctgaccagatgaacaaccccggcagcttcccctgccgctgcaactccttcgcgccggcgatcccctgctccggcgagagcagcccggtgacgttcccggtcttgaagctggcgagcagcttgctgccggggtagttcgccgcctgctcgtcgtagaacatcacgtacgtcgccacgtcggtgttggcgccgtagccgtagaactggaagttgacgtagtcgatcacgccggcgtagcgccgccacagcggctggtagtagcgctgcaccacggggtgctcgaacggcgcgatggaggtggcgatgttcgggtgccgcgccttgagctcggtgaggaggcgaccgatgcactccacgaacgtgtccacgccggcggcgaagtgctcgtagtcgacgtcgacgccgtcgaggccgtaggcgtcgatgaggccggagacggagtcggcggcgttgcgcacccacgcgtcgacggacgacgtcggcgcgaacgtggcgttgacgccggtgttctggacggtgtcgccgccgagggcgaggatgacgctgaggttggggtgcgccgccttggccgcggcgacggcggccggggacaggttggccgtgtcccagtacggggcgaacacgccgttggctggcgccggcttggaggactgcgtcgccatgaagtagtcgatggcgaaggcgaggatgaagtggaagctgaggcccgggttgacgggcacgtcggagaagcgcacgccggtgaactgcgcgccgatgtactcccggaacaagtagccgttcaccatggccgccgatctagctagcgagtagggctagcgatcgagctgtggacgcggcgcatggcggctatgttttggtggctgccgaaatttatagcggcgactcggccacttgactccgatcaagttgggcggctcgcccggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45855 - DNA, 4581 bp, Oryza sativa
cctcgcggtaaccgtcaaaccgcttggtggcggtaacctcatccccaaacggtttggtaaactctgctacgaagaagcagatgctacaaaattagatacacaaaccttatactttagagtttttttttcctaaaacacactacaaatgcatgatactcataacacgcacacacttatccctatgaatacacacgcacatcctatctctatgatcatcttcgaaagactaaaccaatataccttgaggctgacgaacactactacagaacaacctatcaatgctggttcgattaaacccggtgctaacaagggtttacccggcattgataagaacccatcggtactgggttttttataggatcgacactaacaagttgagccttgagtggtcgagccgagccaagccaaaatgtgtagtagcgcactagcattctctctgttttctttttccatgtatctttcgatccccttctccccatcgctctatccttatctccttttctttccctctccctccccaggactggcgaccagatcattggaccctccccttctcttccttattccgtgtcacgcccagaaatttagcccaaattttcagactattttgtgtattaaatccctgtattacaaaatattcccggccatgatttttaaagggaattttaaattccctctattcttcacttgattaaattgctttaacttttatttaatttctaaaaatgcattatttaataatttttaatcccgaacgaatatcggggcgtcacattccgacaagaagtagccccctctccagctgcaatcgcagcctacccctagacgtcgatggcttgctgcttgggggaggaggaaacgacgtcatccacgttggtgcgcaccctgtcgatgagtaggctgacggtgtaaagttgcccaccaccaacctcgagtagaaggacatcgatgacagatgaggtcaccggtgatagatgtgacggctacgacttgaagagaacggcggtgaggtacgtcggctattccttccctcctccccagctccccctccctgctcgggagaccttcttgctagatctctacatgccaccactgcacatcgttctcatttgtgagggaacaacaatgagctagcgtgggaaggagcaatggactagtggtgccgtgatagaggcgacagaggggtcaaagcagtgatggtgaagggctcgagtgtggccagctctttgtgatgttcttgttctcaatgttcttgttcttgatgtggaattgtggatctgtgtaatatgcatgttcttgtctttagaaaacaatgtaaacttgattcatgtgtcatgttggatgttcttgtctagctttatctcaagtcatgcagaaattgatgatgggcggaatctgcaaattccactacaccgaagctagtcacctgtgacgggccctaaccatcacctttgacgggtttgggcctggtcactgataagtcccagtcacctctgacgggccagtattttaggtccgtcacagatgagagtcacctgtgacgggtggctatttccagcccgtcagaggtgtctgtcacctctgacaggtttaatttcaccacccgtcacaggtaggaaaaatcacccaaaaaaatcaaaagccctcagcccccagcaatgtctcgatatgcaagacacgataactttgcattttattcatagaaactttgcattttattcttagatctgttaacatcagagaacaacaacatatgaagcacttccacacaagtaatatatatcacagatcacacaacttatgtaacaatatacatcacacagtaatgattcccatcttaacaaactacaaatccacacaagcaatcaagatatagcctaatctgaaatttggcaatgaaaattagcaatgaatatagccaacctaatcggaaatggtggcggcgcttgtgggtgaaggagatgtggaggacgtcggcggtcggggggacgagccgcagacaccaacagttggggatggaggcggcggacgtccaccagatctggccgttggtcggcgggggaggcggcaggcggcgccggctggcggtcaggaggcgagggaggtggctgcgaacgctggcggtcggcggttggtcggcgggggaggcggctgccgccagatccgtgtcctccaaatttgttgaggtcggatccgcggctcgcggtcaggaggcgggggaggtggccgaggacgccggcggtcgacggtcggtcggcgggggaggcggctgctgccggatccacgtcccccaaatttgttgaggtcggatccggcggcaggcggcggcggctcacggtcaggaggcgggggaggtggccgcagacgccggcggtcgctggatccgcatcctccaaactcgtcgaggccggatccggcgaccggctattgggagacggggggaggagacggcggccccgagctcctggaggccggcggcgagcgaaggagacggcgacgcggtcatgggagggaggcgggaggccgcggcagccggtcgtcgtggggggaagcgacagccggtggagggtggacagggcgacggccgatggtgggtgggtggaagcgaggagaagagagaagagagaagagaggaggaagcgagaagatcgagaggaggaagagagaagagaagaggagataaggctggtgggtgggtggtgggcctcctacgtggggtggaggtttttttttttaaggtcaccagtgacgggtataaaaatccaacatgtttgaggtgaggtatctcacctgtgacgggttacaaacttaaaacccgtcacaggtaagaggtcatcagtgacgggtctgtacggggacacgtcaaagatgttgtgtgtcgggtccttatatagatccgtcatagatgagtacttacctgtgacgggttattttcttgagccctatctatgacgtgatttattgtaacccgtcacagatgaggttatctctgacgaggcactttggtccgtcactgataggccgtcacagatgggccgatctggcgtagtgttcgatcatcctttatttcggttggcatgttcttttcgaaagtagaatgactcttatggattattataacaatatctctggtagtacgtacgagcatgcatggagactcacttgaaatcatgttaacatgtcccaggaatcatgtcgtgtaacacgaatagaatcagatgatctaggcaacaacatacgtgatatctatatggactccacgagtttcattcggttggtattcacatcacacggactttctttcgcagttcgctcgcaagtcgtgacttcgcaatgaatgttgcgcgtgacaggaatcggatacgaacgacgtaccatagttttgacaaaaacatcttcaatatttaaatcatgggcgagggcaatgtagtcccaatcggacatgtggcaatggcaaatcacgcgcgcaaggacgtcacgggtccaatcgggcatgtgaaaaattgggcacgcgagggcattgcaggcccaatcgtggcggcgggcaaagccgtgtgtggaaaacaggcaggggcccaattgctgcgtgcggcaaggggtgcatgaaaaggtgtgggcccaattaattcacgcgcatctcgaataagagggacactctggtgtaagaaaaaaaaagaaaggatttcacagaaacataaaattaaaattgattcaaacatggatatcgtagcaaaattctggcggaaacatcttcaatttttataaggcggaatttgctacatgacatctaaaaaagtgtaattagctagaggacaccataaaaacatgtatttgctgtagggcatcgcaaaaaactggtaattaactgttggacacccgcagcattatttcataatttttggaggaaaaggagaaagaaacaatgattaaagataagtttgcccttggattaaatgactccaacgtgggccccacatggaagtcccctctcccccttcttcctagataggccgagtggcggtgccgaccacgttcgccgtcgggagagggggggtttacgtgcagccggcgccgttgcctaagtgcctcgggcaatccccagtgactggtggtcactacaatgaagcctccgaggcaatggtctttgtacccactccttccccgagcacccaccaccaccgaagcaccgattccccttcccagttcaagcctcaaccgttgccatgaccagctatataccaagccgtcctcctaccgtacgccacccgcccaccccccgggccgcccgcagccgccgccacgctgggccaacccactcccggccgtggcccagccgtagcgccacaccgccgtggcctcggccgcgccgccgcgcgctaccggccgccggcgcctgcgctgctgcgcccggccgtcaccccgcaccgccccgcgccaaccgcctcccgctcaggcgtgcactcacatggtgagaaaggggatcgagagagaagcaagaagaaagaatatagagaagagaggaaagaataaagaaaaaaaattcaaagggtagaaccgtatttacaagctgttttctcacct

SEQ ID NO: 45856 - DNA, 7407 bp, Oryza sativa
  unsure (1)..(7407): unsure at all n locations
cctgaaaaaatgtcataggatttcagacaataataaaataagatgatttttattttcgttagttttgcaaggaaaaggacaggatcgatatgacatatgttacatatgacggcgtgttcatatttaaattcaaaagacgatgaaacgatatttaaagctcgttgacataaccgatcgaggcggcatttgtcatgcaaattgaaatctccgttatgcaactttagcaagtaatcaaggacaatatgtgtacggggtagtacggcacaatggatatgtacgagatgatcgatgtgtacgttaaacccataaattatccatgactaattgggatgtctatagccggtccgatttaaaaacatacatggctccttcgtctcaaaaaaaaaatctcctccatctaaaaaaaagtatatttagttcacaataaaattgaaagtttagttaaaattggaacgatgtgacggaaaagttagaagtttacgtgtgtaggaaagttttgatgtgatgaaaaagtttgaagtttaaagaaaaagtttagaactaaaccaagccttaatctcgttcaatatattctagcacaatgaatctggatataactttatattccgatttgttctaatattaggttgtctttttttaacggatggagtatatgctataagacaagcatggtaaaatatccataaaagtatttattactctctccgttttacaatgtaagtcattctaatatttctcatatttatattgatattaatggatctagacatatatacctatctagattaattaacatcaatataaatatggtgcgtagcgcagaccacaattatttgcaagacgcgtacgtacggctgcgggcggcatgatccagccgcgtccatatgtaacaacaaaaagctcacctgttgacagggacacaccagctaatatgtacctggagtactacataaaaagtcaaagacttcgccgtcgcagtttgcttagccctcaggtatacgcggatggctcgccgcgcgcgaacgtaacgtgtaacggtggcagggatatggctcgccgctcgccgctcgccgctgcttgcctgcctactagagcttcccggcaaaggcacgtataaatcgctgaactaaattaacacgcgcccagctgtgtttgcttcagttcacacatatccctgccactgccgtactgccaccgcgtggatcttcactgcaataagtgttgaagaaaaatacaaacattggtcatgcaatttctggtcacatcagaaatttagttcgtgaaaaaaaaattagggtgtcacatcagatatttgaccggatgtcggaaggagtttcggacacgaataaaaaaattaattttataaattgcctgtaaaccatgagacgaatttattcagcctaattaatctatcattagcgcacgtggattactgtagcacttatggctaattatggactaactatacaattaatattttcatgtaaactatgtaattaatatttttctcacatttagtgccccatatatatgtccaaacatttgatgtgacgtttttggcaaaaaaaaaatcatctaacgttgtgtttagttacaaaataattcttcaaacttccaatttttccatcacatcaaaacttttctacacatacaaaccttcaacttttccgtcaaatcgttttaatttcaaacaaacaatttttaattttggtgtgaagtaaacccagcctaatcaaggcctaatattgtcgctggcgatttgcttcgcctgcgccccttgcccgcacgctgtcaggcacgcggcggccgtaacggcagcggccaaggcgcgtaccgcgtggatgggatggatatacactgtgctgcctagccacctgccttgctacgcgtgcgtgaggcttgcctggctgctgctaccccgcggctaaagcaaagctgcgtgcgctgtggtccctatgtttcagtttcacatgttcatgcctaggtcacgcgtgaaatgactcggttagtttgctgcaaatgttaatgaagatgcctgtaaatctcggggggatgaacttttggtattttactttatatataagtattgatatatactctcactctgttctaaaatataaaggattttgcacggattggatatttcctagtattcgtagaaaattcaacaattttcgagcaaactttggaaaccaaaatttgaatgtgaaaaattgaaatttcattagaggtgatcagttttcgatcgaaatggcttgaaatcctaaaaatttctatcagtttaatttgtccaagatgccacgaggagataaaccaggggggcagtgcagaggctttagtcagcgctggagaaattggattgtgcttctcctatcgactgcatcatccagaattttactcaatgggatagcgggagaaccaactacacacaggcgaggcctccggcagggtgatcccctctcgccctacctcttcatcctagcaattgacccgattcaacgactactcaataaggccacacaagaggggcttctatctccgttatcaaaccgaacagcacggttcagaatatccttatatgctgatgatgcagcgatctttataaatctgatcaggaatgatgtcaacaacttgattagcatcctcaagttcttcggcgaggccacaggccttcaagtgaatctgcacaagagctcggtcgtgcccatcaaatgcgcagagcagaacctgtccgaggtgttggaaaatttcaatggacagcggggcaattttcccataacatatttgggattgccgctcaccccaggccgcatcaagagaatacacttgcaaccggtgatggacaagttgcaatcaaggttagcgggatggaaaaggaagttaatccagcaatcagggcggaagacgctagtcacgtctgttctcagctccataccaacctacttccttaccgctttaaagccgcctaaacagttcctcacagacatggacaagattagtaagaaattcctctgggccggcgatcaagagattagcggggggaagtgtaaagtgaattggaaaaaagtatgctccccaataaacacgggaggactaggcgtgttggaccttgataaattcgcgagagctttgagactccgttggctatggtttgagtgggagtgccctgacaaaccttgggttgggacaacacccccctgcgatgagttagatgagcaaatcttcgcggccgcaacaaaggtaacaatcggtaatgggcggaaggcaaaattttggacatccaactggattggccaccagccgctgaaataccgagcgccagcgcttttcaaccactctaaaggaaagcaacgcttggttcaggatgtgttaaccaatgacaaatggattgaggatattaggcatgagctgtccatgccactgatccgagaattcttcgtagtgttccgccttatctgggataatgagacaaacctagaggaaggagttgaagacaccatcatctggagatggacaaatataccggtaaatacacagcaaaatcggcttatttagcccaattcgccagtagagaagactcaagggccgccaccttgatttggaagacatgggcgccatccaaatgcaaaaactttgcatggcttgtcctgcaaaacaggatatggacatccgaccgcttgcaactccgacaatggcccaataactacttttgccaactctactacaggaacttggagacggcgcaacatttattaaaggattgtccattcacgcgagaaatttgggacaaaataatggctaggatgaaccacaaccaacccttcccggtgcacaatccggacgagagtctagttgactggtgggaatcaagaacaaagcaacaaagcaaatgtcaaagtaaggggatgcagtcactgcacatgctcttgagttgggaaatctggtgcgagaggaacatgcgagttttcaaagataaagaacttcaaatccctcaactaacggcaagaataatggacgaaatannnnnnnnnnnnnnnnnnnnngcaaaatatcttgcgagaatagcgccttaacctctcatcctttgttgtaattttccttttttctgctctcctcccccctgtctttccccttgtcaccattggtggtatttgtacagtgcttatcttctgaaatataaaaccagctaagctggcaaaggttttaaaaaaaataaaccaggggatttattgctcgaaattcgatcggttgcttcaaaatccaataggaaagtgtggaataatatggaaaagaatattcaatactccatccatttcacaatgtaagtcattctagcatatcacatattcatattgatgctaatgaatatagacatatatatgaattatgctagaatgacttacattgtgaaacggaggaagtatcattttttgtaaaaaaaaaaatcgtgtacgtatgccacttagttctacaaaaactttccactcaaaaaaaaaagttttacaaaaaccatagtattaatagttgtttttaaattttccagtattttttcagaaaaaatgacaggaacagtatttttcaattcgatctgaatataggattttgtcccaaaaaaccttaaatttctaatcgagattgagatgtcaatatcttacgaaaaccagtaagttttggccgagaatgtaaatgcatgaccaacagaatctcaaaatactaatcccaaaattgaggatttctaataaatcaaatccaacagttgccatgctcagatgctgaatgctttcgcggttgccccacagccaacatgaattgaatagtgccacattcactgtgcgcagcccctgtagacggcctgtcgaacgatcccttagaattcccagcttcagtttttttagttctgcacattaggagagtctacgttctcaatccgtgcgtaaagattatgttagtagattttcaagatgggattttaaagatggactatctcggtgagggaagggtattatcatactttaaatttccattacagatttcctaaaataagatttaggggattaaattttggatatctctctggtcaaacccttaaaccccgtagttacctttcttaatgcgctaaatataatttggatcgaaatggtactaaacacggttgtatgaaatggtaaataaaatacacacggtaaatttacctctagttacttctcttggttaccttccctcccaattactaaccttattctgttcaacaatttctatttttaactcacaaacggttgatctttgtaacagacatagtaataatagtggaggttatttccattacagatttcctcgcagcttcttggtagcttctgttaaaccgtgatatatatagggggcatataggaatccatccttccaccaccaattaaattcagtttcgcaccaattcagcaaatccttggaccattttctttgagagtaatcgcttgtgtttctcgaaattgtgagtagtttgatccattcatctttgttggtcgcttgattcggcagcgcctgatcgatcaggatcgggtactggatggagtgcgctgactacttcatcggctccgggcggcggtgctcgccgtcgacgtcgacgtcgacgtcgagagaggcgtggaggccggagaagcaatggcggaaagccaccaacgtcatcagggggtgtcataggcttctgcgcctcggcgtcctctccgccgccgccggcatcatgcgccggaacccctcctatgtcgagatcaaagtgcacgacgaaggcgagctggacgtctcatccggcggcgacggcgaggcacccgtggcgttcactgtcgccgcagatgatgagtcgttcaagggactcgtcaagaacaagcgggaggactgcttccgccttctgggcggcggcgccggcgtcgcggcggtgctggcgtccggcgcggagcgcggcatccgcggcgacgatgccgacgtggcgcgccgcaagaaggcgttcggatcgaacacctacccgaagcccaagcccaaggggttcttccgccacgtgtgggacgcgctcgccgacgtcttcctcatcgtgctcctcgtctgcgccgccgtctccctcgccttcggcatcaaggagcacggcatcaaggacggctggtacgacggcgtcagcatcttcctcgccgtgttcctcgtcgccgcggtctccgccgtcagcaaccacagccagggcaagcggttcgacaagctggcacgggagtccgagaacatcatggtcagcgtcgtccgcgccgcgcggcgccaggaggtgtccatattcgacgtcgtcgtcggcgacgtggtggtgctcaagatcggcgacgtcgtccccgccgacggcgtgttcctggacggccacgcgctgcaggtcgacgagtcgagcatgaccggcgagccgcaccccgtcgaggtcgacgccgtcaagagccccttcctcgcctccggcgtcaaggtggtcgacggctacggcaagatggtggtcaccgccgtcgggacggacacggcgtggggcgagatgatgcgcaccatcaccagggagaacaccgacccgacgccgctccaggagcgcctcgaggggctcacctccagcatcggcaaggtcggcatcgccgtcgcggtgctcgtcttcgccgtgctcacggcgaggcacttcaccggcagcaccagggacgagcagggcaacgcgctgttcgacaagaggaatgtcaccttcaacgccgtgttcagcggcctcgtcggcatcttccagcaagccgtcaccatcatcgtcgtcgccatccccgagggcctcccgctcgccgtgacattgacgctggccttctccatgaagaggatggtgagggagaacgcgctggtgcggcggctgtcggcgtgcgagacgatgggctcggtcaccgccatctgcaccgacaagaccgggacgctgacgctgaaccagatgaaggtgacggagttctgggtcggcgccgaccggccaagatccgccgcggcggtgaacggcggcgtcgtgaggttgctctgccagggcgccgggctgaacaccacgggcagcgtgtacaagccggacaacgtgtcgccgccggagatcaccggcagcccgacggagaaggcgctgctgtcgtgggcggtggaggagctccccatggacgccgacgcgctcaagaggaaatgcaaggtggtgcgcgtcgaggcgttcaactccgacaagaagcgcagcggcgtgatgctccgcgacgccgccaccggcgcggtgaccgcgcactggaaaggcgccgccgagatggtgctcgcgaggtgcaccgtgtacgtcggcgcagacggcgccgcgcgcgagctcggcgtggagcagaggaggaagctcgagcaggtgatcaa

SEQ ID NO: 45857 - DNA, 11637 bp, Oryza sativa
tcgaattcctgcagccccgctgccactcgacaagctggtgctcgtccagcgcctgaagcagaagggccacgtggtggccgtcaccggcgacggcacgaacgacgcgccggcgctgaaagaagccgacgtgggcctctccatgggagtccagggcaccgaggtcgccaaggagagctccgacatcgtcatcctcaacgacaacttcgacacggtggtgacggcgacgcggtggggccgctgcgtgtacaacaacatccagaagttcatccagttccagctcaccgtcaacgtcgcggcgctcgtcatcaacttcgtgtcggcggtgaccacgggcaggatgccgctgaccacggtgcagctgctgtgggtgaacctgatcatggacaccatgggcgcgctggcgctcgccacggacacgccgacggcggggctgatgcgccgcccgcccatcggccgcgcggcgccgctgatcagcaacgccatgtggcgcaacctggcggcgcaggcggcgtaccaggtggccgtgctgctggcgctccagtaccgcggcttcggcggcgccggcgccggcgagagggcgaacgggacgatgatcttcaacgcgttcgtgctgtgccaggtgttcaacgagttcaacgcgagggagatcgagaggaggaacgtgttcgccggcgtgcaccggaacaggatgttcctgggcatcgtcgccgtcacggtggcgctgcaggtggtgatggtggagttgctgaccaagttcgccggaacggagaggctggggtgggggcagtggggcgcctgcgtcggcattgccgccgtgtcgtggcccatcgggtgggccgtcaagtgcatcccggtgccggagcggccgttccacgagatcatcacggcgaggaggaggaggagaagatcgacataactatcaacgcttaccactgttcatattttcggatttttgtcggtagcttaggccattcttttggagatattataccatcttgttatttgccatatataatatgatatatgatttgtttggttcatcaatattactcatatcttttctcttttaggtcttgtccgtctaatctctcgcctaatccctttctcataggagttattaaacgaacaaggctttacgatatgccatttgccattttgtcatcaggcgtgacaactgacaatactcagatttgtgacacagaatttcataaaggacaaggcgcgtgcgtgcggctacgtgtatctcacgatgcataatgataataagttgggatttgctctatctcttccatgatctgaaaaatgcagaattatgtgaatgcaaccctaacctcaaagtgcagatatgtgctctgtcaaatgatttaggccgagtttagttccaaactttttattcaaactcccaacttttctattacatcaaaactttcatacacacacaaactttcgatttttccgtcacatcgttccaatttcaatcaaacttctaattttggtgtgaactaaacacacaggccggcctctgaatatctgattcagatggaaacctgaatttcaaacaggctagcagcatgcatcaagtaagtgtttttggcagtcgttgtcagaaccaagaaactttggttgttgcaaactccgaattcttgttgtcactcataaataacgattcttcccaatgttcggcaggagatgaggatcggatagttaggtatcgtaagttgtgatgagtcacaaaagatagtttgctccagatgctgagcgcaaggaccaggttatttttagacttgaactcagaaagaatgttacagaatttcctggacgtttccttcaaagaactctccatttctgtcagaatgggtttcgccttttgttcatatggaatcaacttataccacactgaagaaacaatggctcgtgaatgtacttacattttgttcatatggaatcaactttttttgaaaattttacagcgtgctgctccgtctttgcaagtttcagtgccacttctttctatcgccagttgcaacacgtcaacaaaaaagagagtaaattgcactttcgtatatgttgtaacagggtgtaaatgacatcccccacataatatgataagaaacttttgttcccaaatgcggttcttgctgtcactcagtaacaacgtttctaccaaatgttcggcaggagaatcggatcgttaggtattgcaagcttgtgactcaaaacatggttcattcggtcattacatatgctgatatgctcagcgctgggatcaggttgtttctatagacctgttatacaagaaagaaagttaagtgaatttcctgtatgtttcttccagagaactatccttttctgtgagaatggggtttcgcctttgcttataccaaactaaagagacatttgtttgtgattttacttacattacttttgaaaaattctgcagtgtgggtggcaactgctcctagcttctttgcaagtttccattgcgaggtctttctctcactgcacggtaaaaaaaaaaattgacctgaataatttagttttcacgtccttctcagattaaccagtaatgagaactctctcctgacaccgtcaaaaaattacttctagtttagtttaaacgtccttctcatatttacccagcagtttcttgggaatgagaagttaaggggaagtaaagttcattctttgagaagcttttgacagagtaatgtagatgaagtctaagtaaatttacttaggatgcatattttttatagtagtgctgaagacaaggttgtgtactgagcacaaaaaaagtctgaatttcctgtccatgctgatctaaaacaatgaactggtctaatctgattatctgaagaaccatctaaaaagatcttaacttggcaacttttgttgaaccaagccaatttccaccaacctataggatgtaaaattccttgaaaataaaacaaatcacaacaatacatcacattcccaaacgactgttgctgatcttgcctgtcacacagttggaaatgcaagttcagagattcacaggtactgtaacagattggctatacaacttacctgggattgacaggtgcaacaaccatacagagaacatcaaacacaaagtgaaacaaatgaaaaataaggcaataacacattaggctatcagcctatcaccagtatgaaaattgaagacagctgaacataaataggcccatttggaacacaattctcccatttcctaggagaattgagtgtttcctacttcctctgtcccataagataagggattttgagtaaatgtaatacatcctaggacaacgaatctacgtcacatcctccccaaatcccttatattatgggatggagtataatattcttgtagatatcctataaaattccaatgttccacacatagtataaacaaaaaggaaattccacaaaaccacctgttctgatgcatcctggagtgcaagtcccagaatcaatcaaatcactatgacatctacaaaagcaaaggtcagtaagtgatcaacaaacttgactggacagcagtagcaaagctcttgaaacctgatcataaatgacactaaaccatacatccagttcttctgaatgagcttaaacagatgcagcctcagatagtcagatagcaaaccatcacaacatcacaagcaagcattgtcatcaacaagtaacaaccaagcattagctagtcacccaacagagagaaaaatataagcagtttcacatcacaactacaccaagctgctgcaagtcaagtcttcagccctaccaccaaattaccaaaggtttagccagccattacacagattcaggaacacctaattcaggtaatcaccataacaacaagtcctaaatgattaagactactagtgaaaagataactgggatttttttctcactaatcccctagcagagaggtcatagaaaacttccaagaacacatagccgccgctgcctctcctactccttggcggtcttgttgatgagggacttgtggatgtgcgggatgacgccgccgccggctatggtgcccttgatgagggtgtcgagctcctcgtccccgcggatggcgagctgcaggtggcgcggggtgatgcgcttcaccttgaggtccttgctggcgttgccggcgagctccaggacctccgccgtcaggtactcgaggatcgccgccgtgtacaccgccgccgtcgcccccacgcggccgttcgccgacaccctccccttcagctgcctgtggatacgccccaccgggaactgcatccgccattgcccccaagaaaacaagcatcagtgagtacgcagttgtgcaagaactagtgaagctttcggataaagaactggaacaacacggggtggatttgcgcgaaaaattggggggaattcacgaaggcgacaaagatgaacagtaaatctggcaagaactagagcgttttgctaatgcactcgtctgaaattgaatctgctaacgaagctaagaacagaatcgacgcggaaccaccagatctaccaaaacgcagccaagaaaccgcctaaaaccatccagatttccgcaaccgcagccgagaacaaccaagaaaaagatgaaccgtcgcgagaggcgcgtcggggaagggagagagagaacctggatcccggcgcgggaggagcgggagacgggcgccttcttgcggtccttgtccttgtcggcggcggccttcgccgccgtcgtcttcgccgcgagcagccccttccctcccttccccgccattgctcctcctcctcctctccctctccctctctcgctcgcgttggtggttcggctgcctcgcgtccgctctctctccctctctctcccccttcctcgctgtagaatttatgtcggtttgggaggagcgcgcggaggttttggagggaaattttcgcgggcgacgcgggggttttgggcgaatttcgaattccaccgcgcggcgaggaattaatttcgaggaggattttcggcggcggcggcggcggcgtgggtgggagattaagggagacgtgaagggtagagagcgtgggccttgttaacccagtaaaacacggcccattaattagacagtacaaactgggccttctggatgagctggaacttcggcccattaacttgtaggcccattttgtttgggctgctatttttttcaatttcctggcccacgtcaggaaatgaatggactattcaaggttggatgggctaggatgagtccccatccaacaaaaggaaacaaaagcccttgagtgttggactgtttcaaggactagccttttcttttttttttcttttgctatatatttttcgactctaatttctcttttcgaattaactacaattttcaatcggggcctcaggggctattacgctctcttttcccaaatttaagtcgttttatagacatattataagaattaagaaaacaactcaaaagattttggccaccctgcatattgcattgataaagataaatcatttgactgtgaaaaacgagcatttaaattttcatggaaaatatgaaatcatagttaaaagttaaaacaaacgtctgagctctaaaatgacttacattgaggatacctttaaaaaagataaagaatttacatttaaaatcaaaggcggttgctgggctacttggctgccgcagcaaatacgaatggtactcaaagcctgcaaacaccaagccagaagcacaactacaattgcagccagggttcacaaaccatttaggatgtggttatcgccacccaacaatataacaattaccgtaaggtataccgtggtttcaaaaactaagaagattaccgcatgtgataaccgcgttgtattataaaccttgattgcagcatccgcctgcagaacaggcctagggtgtagtaaataaaaaaaatggtgttgctatgaaacacacacacacacacacacacacacacacacacacacacacacacacacacacacatatatatatatatatatatatatatatatatatatatatatatatatatacctatccgtctcgtaaaaggctcaattctagttatgaatctagatatatacgtgcctagatttataattagaattgttttttcctgtacagcttagttaggtattattggaaaatgaaacaatagtacatagattccctggatggtggtgtacatctttgtgccgtggttggcccttcttcctcatctttgatgcctctatccatccatccatccacatcctttactggctttgagcagcatcatcctcagttccaactttcagctacaagccacaactttcaacagcatacagttcttccagctttcaactcaagacgaaatcaacttttttttttgttccaaggagctacaggcaattcgaatttagtccttctttagttggaaaaaattttttgggtttagatgtcgcatcggatatatagacacacctttaaagtattaaatgtagtctaataacaaaacaaattacagattccgccagaaaattgcaagataaaattattaagcctaattaatcaatcattagtaaatgtttactgtagcaccatattgtcaaatcattgcgcaattaggcttaaaagactcgtctcgcaagttacacgcaatctgtgtaattggtttttttctacatttaatatttcatgtatatgtccaaacattcgaagggtttttttcactttgatgcaattttcaaccatactatttttttaagttaccaaaaaaatctatgtttactttgttgccaaatttagttaatacataagaaatcctgctaaaattttggcaatattgctatcttgccaaaattttggcattgccaaaacttggtcaggtttattttggctataatctaaacagacccaatatgacagcgtgaaaatttttgttttgggaactaaacatggccttaggttaccagttcaaaatatttaaggacactttcattcatgtccaggataggaagtttcagtcaggaatttcaaggaaattgaacttcccgatagggttttcaacctggttttgaggggcctttcaaaataataataataataaggctctagttaactttggcagggttgttgcagtgccaactgccaagcctaacacagcgagaccaaagtgcacacttttagcaatcgccactgaactaagagcttgtttggataattgccaacatgaactcttccaaatatagataggctgaaattttcaataaagcaggatcattccactgttgccaaagttttagtactacattttttttcataacaacaagcatgaatgtttcattctgtcggtattgccaattctcttgtatggttagcatttgtaacaaaccaaacaaccgcactacacatacgtaaaggacgcttccaccacgacctacttcccattgcatcttggttccttcaaacacaatgtaagtaaatataatactactggtcactcaaactactttcaagatacattcttattttaaaaacaatggaatagataaacataagtagtcactcagaactccatcaaatacattttccaagtatcagaggactgtgaccaagaccaagagagacacctccccaaacttcagaagaccggtctatggcaaaaaactgatcacgcatacgagtagtaatgggtacaacttttgatctaacaagatataaggggactaagagcatcctaggagctcatccaaatttcatcccctatattcacatttagattcatccaaaaagattctcactctatattttttcccactccaacagatcatccatactacatcatccatatatattttattgtatctttcaactatcacatttatatcatttacatttatcttcctctcttctattctacccctcatcatctcttctattctaccgatgaggaggacgaggaggggcgacgtgcggtcatcgggcgaaggaacagcggggttgcgggcggtcgccgggcggaggaggaccggcggcgcaggcgataaggtcgcggacagaggagcagtgcggcggtcaccgggtggagtagccgcggcagagacggcggggttgccgagcggcttcttctccaataacctccctagcccagatccggttggtgccacctctctacctcccttcttccttcgatagccaattttatcgaagctgcgccttatcctccccgtatctcctcctccatctgctttgcttgccgccgttgtgaactccgggtgggggcgggagctcaacccagagcggcggttgcgatttggcgtgaggagagaggaacgccaaaattggtatttctctctcatgttttagcgatccgctacttttggcgttgccgatggcgtatccgctggaggctggttttttactcccatcctctatttcttagatggaggattggatggagcatctgtttgggatgctctaagagccacgtctataaggtagggctgaaatttagttgatttttgaattaaaaatatttaagaactaaaatgagatgtgaaagaactcgtagcccctaacggcctgacccattaccaccctaacagaacagaaaaaacccattccgttacagtgcagactcacacatgaacagtactccccgggacaatctgacgatgaagccatgattagtgaagaccaaaactgaagtgaaagaaaaaaataaaataaaaaagagctccctgattctcctccagcctctgaatttctgaaaccatcactgttaccctcgggcccatacgtcagagttccgtgggcccgagccgtgacgccaacctgacacctaccagtcacgtcccatcaagctttggtttgatcgtcttcaggcttcagcttcacaacacttcagaatactcgcaaatgaggacgccacgtcgtgcagtaatctgtctctgaaagtggtgctttgttcttggattagccagagatgttgccatctgctcaaagtctgggctcgtatcatcatcgctttaccacgggctcagtttcgtactagtaaaagaaactctgctactgaacaggaagtatcactaataattatattcctatttgatatagtgatagtatcttagtttttgtttaagataacccattagatgccactgagtttgttatgagtctacgatttgccattacctttgtcacgttctataatatgccatcgacttttgctaacctatatgatttaccatcgtcgtccggttattccccgttagtactgtacactttcatccaaatgaccaaaatacccctgagacaaaaactttcaaattttggataaaaattctaaaatgtaagactttaagtttttggtcaaattttgaatgtttacaatcttatgtttataatatggtattttcgaatttttgtccatattttggaagtttttatcttagggtattttggtcatttggataaaattgtacagtactaacgtagactaagcggacggcaatggtaaatcatagaggttaagtaaaagtcaatggcatattatagaacgcaacaaagtcagtggcaaatcgtagagctgtgacaaactcagtggcatataatagattgtctctttttgttttgtattggtgtgtatgggatgggtgaaaaataaacttattttggctctgttcggctgcccttattttcactcagtatattatttttgagtaaattgcaaccatagtatatcaacttggcaggtgggtacaatttggtgcaagaacttaagaaatgagcgttctagtgcaacaacttggcagatatgtgcaatttagtacatagttgatcgcataaatgcaacaacttataagatatgtacgattttgatataataagttcagaagctatgcgacaacttaattatttggagcactttttttatacatattcaatttttaagtacttattttgacaatatactagtgtggatttgtatataagcatatttatatttttatcataataactaataactaaaagtcaattaaactagatataaaaattattatatttcagttgagatttaggaaggtgaaaaaaaacaaaaattcttaaaggtaattatatctaaattggatgtgcatgataattcttaaagattaaatttaatattataaggtaataccgtaggattgctatgtaatggcatattgacatcgtgagaaaaactcacctagcatatgcttagctaagttgatgcaccaaaatactaaattgccaagttcttgtactagaacgtacacacttgttaagttgttgcattcaaatgtttaattctcaagttcttatattatatcacatccacccgccaagttgttgtaccgtgggtataatttactcattgttgtggcagctgaacagggccgttgtaacagatggagtagtataataataattcaacttattatacaataaaagttgcatatcagtacatgatctgttcccatttctctaatactaaacgataaggtggtgatgtctctgtcatgccatatcagtattgccccttcacttctctcttcaacagcatatcccttttttcttcagcagcaggcaggcagcatctctccctatcctattcccctttttaataaattggttttgtttaccaatcacatcacatttctgtgaccactcccttctctgtcaacaccacaagagatagagaatattaggggagaacttactcaataattttctggtttattggatatggttctattctgctaggtagcactgtactagtacagctttgctgataggggttaacctgatcagggtatggcagaaatgattggcttggggaaagaaggagaaaaaagaaaaggcaaatgttaggtttgatagtcacatgaactatgttgccctggaccatggccataaagttgttacacagtgtgcagctactgttcacaagttttttgcatttgacttttatgactccaagatcttttgacaggtattgttggaaagattaatcaccagcgctgactgtataaagcagaatggaaaatggtctgtcctcaaaaggtattactatgcacttaccaggcaccagccaggataaatagctggattattgttttttaggtacatagaagatataaggaaaaaggtacaaattatttattaaagacagttcgagttacctgaactacaacatcaaacactcgacactcctcgacatttcacaatgtacaatagcctcctcaagcatttctctggatggttttggcctaagctagcacatgtggcaatccaacgtggtagtgtgtgccaaatataggttgattccgcaatcttctgttcctctgtctccatctcaaatccctaaccccaaccccctctcccaaatctctagccgatgtcggacaacaatgaatcgatggatggctgtgatcgcaccaggccgtgattcctccattactagcgcttccatctaggcatgtgcatagttatgaaggaaagtgaggaatagaggagaggacgctaatgccaatgatggaggggatggatttgacaagagatttgcagtcatgatagatctgggtcttcccttgtagagcgacataatcgaggagggctgcaggaattcgat

SEQ ID NO: 45858 - DNA, 5527 bp, Oryza sativa
tattcagctgcaatagagttgtgcggcttttctgcagctgcactgctgcagccagcacaaacgatgaaggcccttctcgttttcttttctccatggcatagtgacatgcattttcctagtgcaatgttttctcgggtaggtgagtaaaatcgaaaatagatggttcctcggtcaccgcgttgttcatggatggttgcgcattgcatttcgaggagactctcaacaactatatttagcttaatcctacagtccagcccttgaaattggaattccttgttataaaaaagcactatcatattaatcaaagcaaatgggttttatacaatactccattcgttttttaatagatgacaccattgacttttaaacacatatttgaccattcatcttattcaaaaaattaagacgaatggtcaaacatgtaataaaaaatcaacagtatcctatgttaaaaggtgaaaagcaatcgatcttacagcatataataaggtggtgataaatagatttcgagcaaagttcatagtaccaaaaaatgactttaccctaaaatttaaaccggcccacaggtccagcccatcaaagtgctgggcccaacccccaataacctccaccaatctctttccaaatccaaaaggccccactatttttaaattattatttttcctcttctctctcatcacagctcttcttctcccccgtgcacttcactgaccgaccacctccgcctcgccgccacatcgccgccgccgccgccgccgcaggcgagctcgcgaaaccctaggcccctcccctctcctcccgcgccgcccaggcggcgaatggacccggccccctcgctcgcggcggagctctggcggccgcatcaccaccgccaccacttcgaggcgtcgtccgtcgtcaccgaccaggggagcggaagccgcggcggaggaggaagcgggcgcaggaggccgcggagcgacgcggggcccgaggacgacgacttgtccaaggtcgtctccacctccgccgcctccggcggcggcggcggcggcgggcaggactcggtaaggccgtgggggaaccgcattgggcgcgatctgtgttggggttggtgggtttcggggttgggggttgcaaagcaaggggggaagctgtggaatcgtggtttttgatggccctgttcgccgtgatctgcttgtccatgtggatgcacatgcgctgctgctactgtagctatggcagtagcagcgtggggagcagtttagcttcagtgcttgagcagcgccaaacctagttaacacagatcaaaatcttccaaatgccaagtccatgccagtgtccaatactgataaatgattttgaaatgctcaatactggtcagtgccttgtagagtgggaatcagatatgcgggcatgtcagttcatttgggttcattggcatcctagccttagtctaggatgttgctaactttctgaagctgtagcatgacagttgaagtatgaatttattttgttggtgcttgagcctttgcatattcaaagctgtcatatattgatggcaccatcactccatcagaccttgggtaattcaagcatattgttagtttagttgagacactgtatttgctggactgttccgttgttccttgggttagtcacacatcaccaaaacgatttcgggagtatatgtgatgttgttctttttgtcatttcaagaacttgtagttgacccgcaaattagtgctgcttaatttataaaaccttgaattctttgtactgtacaaatcctccgtttcttatttatgattgaatttcatttgtattttaaaaatgtaaagtaaatttataggtggttcacttcagtgtggatgatatatctggatacttgtgtttatacttcatcgactatctacatggatattcaaatcaactgaaagtcaccaccctactttccaggatgctccagaagcaaaacgtttgaaaccaatgaaatctagtgataagaatgatagtttaaggacagaagctggaaccgattcaggaaacagcagtaaggctgctgataaaaatgctacaccaccagagccaccaaaacaagactacattcatgtgagggcaagaagaggtcaagcaaccgatagccatagccttgcggagcgggtaagctcttacacaatattttttttccctaattttcggttttcattttaactatacaagttataatattctctcacaagattataacagagtgacaaccaactcatcacagaaaatgtaatgttcagatattgctcaaggtggattgcgggtagtaacatgataatcatatcagcttaatatttgtttattgacaggcacggcgagagaagataagtgaacggatgaaaattcttcaagatcttgtccctggatgcaataaggtgcactttgaataccatcatgttttcaagtttttgttactttaaagctctttgttctctcaaaattctattatgagtaaatggttctcttttataatatttacttttcaattcctcaggtcattgggaaagcatcagtccttgatgaaataataaattacatccagtctttacagcatcaagttgaggtattacattttctcaatcatgcttggcatggagttgtcttctagtttatgtttaagtacctaattgagctgtttctgcagtttttgtccatgaagcttgaagcagttaatagtcacatgattaacggaattgttgcttttccatctaaagatgtaagtttagttttgaacaactatttattgagcttacaagattcttgattattatctcagcttcagctcttaacatttcaaattgacctgacttgtttgctgagcttattattttactcagtgtgtatttgtttcctgaatctccattttacgctctacatttacattattttcaattcattggacatggagcaattaaaatgttatggattaagtctacttttcatccttaaactcttattttgtccaattttcatccctcaactctaaatgaaagtagacaataccatcctttggaaacaaatggcttgagagatcagtattttctactgatgtttcagttacatagatgattgcacaggaatcttgttttgcacatagatataactttcaacatgcaaaacaattcatagacttttaaaacggctttgctaagttactggatcttttctaatggtgatgaataatatctatacttgcaaataatgacaggtcacctcctgtctaggccaaatgacacattgtttatgtagcatttgttcctcctgaaatgaggtcttaaaatgttcatacagggttcaaaaagattaactagtgcctgtggtcttgcagtttggtgctcagccatataacacagctgctggtttgacatttgatccacaaacaacaagggaatttgcccagggttcaacatcagagtggcttcacatgcagattggaaatgcatatgaaagagtgacatgaataaagcaagcaaaaccataaaacataattccttgtagtggcaataaagtgtactgggatcgatcaagcctgtggtcctaggattatttttttttctcaacaatttcttctcattatcatgtcaccaagttatttttttgttcctaatttggtccatgatgccatagatacattcatcttgacctgttgatactcaacggtctatctgctttgcttgtatcccatggtctttgtagctcggatttgaatagggaaagaagaggatgaaaaaaaaaaacagttgtattgcatagcttgagcctacagttgtactaagagctgccatcctggcgtgtcgggggggaacaacttttatttctttgcaaggactggcttgtcgatttttcggaatatgtcctataatatgcttttggttttattgcgggagttgcatatgaatattcgacacctaactacctaagttttctgccaggttcatacgaaagatcaaaatcatgacaggattgcaaagtaaagtcccttttctccatattggtttcctttctttttgactaaaatgaaatgggcatctatacatgtcattttcgttggcgctgcacgcctgcacctgtttttcctgatggaaattcaaaggaagagacagccatgatggatccaatatctgaatttcgtggaccttgcaacgatattgtgcccatgtacagtccaaatcttgatgtggcgaactgcaggttcaggacccctaaactgatgcttttatagctgtgttaccactttgcagctcagaagatcagagttgcagcttgtgattctggggcagttctctgtaccctttgaaccaaccagcgttttatttgggttgacacactgcaaaggcaaaatgttaattaccaactgatataaggaaacatatactgtgcacacacatttctcatacacatcaactaattaaatgtcaccgaaaaatctataaaattttatgcatatactttcgatggtattacacatgcgtgtaaaatcttcacctcaaattctttatattttagccgtaaaataaaaaaagcaatctggctgctttaaggctataactctattagaattttgtatttttttctctttatgtaggatgaatttgaataagatactttacacgtagatgtactattgttgaagtacatatacaattttttctagaatttttagtgatattgtttgttaattggtgtgtatggtgtgtacgcgtgaagatttaagtgcacaggatacattccctacataattttggatgtgtgtatgcaggagactactttttgaggctacgagcttttcctgagacaaagttaggttagaataagcattagaggctaagactagagaaactgacattaagttagttattagtctatcgatcgagagggttagatgcaatactaatttgtttgtgatacggagaatatagaaactactatctttgttctaaaataagtttatttttcattcatgctatacatataataaaaaatagaatatccacactttattaaatttcaattattatttctctatttatctactcttaacatatttatttatcctctacttttacacgctctgatgtaatgataacttagaaataaacttattttatgatagatgagagtagctaaaagtaaacttattatgatatgaagggagtacaaataatgttagcattgggactaaggtggaaaataactcaaaactcatgagctaactcgacgtgcgtacttagcttgcttgactggacttggttgcttaagtgcttaaccagccagctcaagcttactcgcgaattaattgcttcatttgtgttagtatcacctctatcctaaaatataatatattttgattagatgggacacgtcctaataccacaaatctgaatagtactaggatgtgtcatgtttaacaaaaatcccttatattttggaacggatggactaatgtgttgaattacaaaccattgtttatatgctgcaaatgtaccataaggtcatg

SEQ ID NO: 45859 - DNA, 4997 bp, Oryza sativa
  unsure (1)..(4997): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcatctcataactgggcattcttcaagacaaagttggaacatcattttttgcagcagatctagtttcttgtgatacaggaaaaagacttgtacttacaattaaagttacactgaagatctcttctactttaagagtgtagcgactttgcttcatggtgatgtctttggtctttcagttgatggccaacttaagtgtgagaaatggattcgtgacgacgacaagaagtctgaggaatcgaagatgaagtggtgggtaaagcgtctaattggtaggccaaaggatgtgcacatcagttggccataccccttcgcagaaggcaagctgtttgttttgactctaacagctggtttggaaggttaccatgtcaatgttgatgggcggcatgttacttcctttccttatcgcactgtaggtttttcttaaagcatcaaaaagtcattcagttgcatgagttcttgagcaccatcctgagatctccataactaattttgcccaactaatggtctctgcagggttacactcttgaggatgcaaccggcttatctctgaatggagacatcgatatcgaatccatttttgctagttccctgcccaattcgcatcctagttttgccccagagagataccttgaaatgtctgaacagtggagggcaccaccactaccaactgagcctgttgagctttttattggtattctttcagcagccagccattttgctgagcggatggctgtacggaagtcgtggatgatgtatacaaggaaatcgactaatatagtagctcggttctttgtggctctggtaactatcgattgacttaatggttttactactcttttgagtaaattcataatctaaccaattaaagtaaatttacagaatgggaaaaaggaggttaatgcagagctgaaaagggaagcagagttctttcaagacattgttatagttcctttcatggatagctatgaccttgttgttttgaagaccattgctattgctgagtatggggtaagtgaattgaacatgtaggactgttttgttattagacattagctgctatcccatctcacatgcttctctgcgttccaatttatccatatttatgctcatttaatttggtctgtttatgcaggtgcgagtcatacccgcaaaatacatcatgaaatgtgatgatgatacatttgttagaattgactcagtactggatcaagtgaagaaagttcgaagtgataagagtgtgtacgtaggaagcatgaactacttccataggccactaagatctggcaagtgggctgtaacttatgaggtaaattgttctttcccttattttaaagcaactactatgaatatcacattagacaagtgcaacttgaaaggatattgtgttgtgaaacatgcaataccctatttgccttgcagttgtgttttcatatgcttgctagccaatcattagatattcaccaactagcacatgttgttcttattttctcttcttcttttgatgaaatcgtcgacatgcataccattgttcatgtttccccttttatatgactatgaaccattagccgtgccactaaattatattcaaatatatagtatcttcacatatttaaaatccatgttagcttggccctttgaacaaggcaaacatgccggttgttcaaattgtacatatctcatgaaaaagctggcgctcaatcttctgcactgtccttagctgtcagcttttagcataagaaatggatgagacctcttcttgtcatcatattggatagcttcttttatttttgcaatagtaatatttaatgttgcaatgataactcctcttggcaggcatcatattagatagttttttttttggcaattgtaatattctaatgttgcaattctgattctattttcaggaatggccagaggaggcatatccaaattatgccaatggacctggctatgtaatttcagccgatattgcacgctacattgtatctgaatttgacaatcagacacttcgggtaagcatcaactggacctagtatgtcctaccgtacatcctgctgtaacttgaactaaactgtagtgtatttctgtttcagctatttaagatggaagatgtaaacatgggcatgtgggtcgagaagttcaacaacacgcttcggccggtcgaataccggcacgatgtcaggttctaccagtctggctgcttcgacggctacttcacggctcactatcagtcccctcagcacatgatctgcctctggagaaaactgcagtccggaagctcacggtgctgcaacgtgagatgacaatggcagcaaaaattagccgtattttggagcaaatagagacgatgttaactcgtaagctcagctcgctgttggaacaccagaaaatcatcagcattcagcgatgctgacggttcggaggagcgctcatcttctggactggacctgatatatgattcgttcattcttttggtcggtggctccgtttcaagctgctgatttctgacacctgatcaatgatgttcttgccttcttggggattctttcgcctgttgatatttatactcgcgtcaaatttatttgacctaggaatttttgaggctggtggtggtggtggtggcggcggtggtatgccggcggcatgttttgtgtataaaaaggattttatgagttttactgtttgtgagtatatattcggtggactcctattggctgacactcttaccattactgtttttatgagttatttttagctggggagtgttattagagagatccttttgaacgggcagtacattcgtgagggaattcaatatataaaaatataatttatgcttaaaatactcttaataataaaataaatcatgacagaataaatcatatacatgtaatttatttaaatatgatgaatggtaaaacttaattaaaaaaaatcaatggcattaaacatttaagagatgagggagatgagggagtatgtttgatgaatgtagtccctatgcttaattcattgctatgtcaaaatacgtccaattttttttattatgacagcaagttgtaaccctttctattatttaataaagagtaaattgcacttatggtacaacaacttgacatgtgagtgtgatatagtagagaattgaatgtctgggtgcaacaacttaacaagtagcgcgttatagcataagaactttgacaatttagtattttggtgcatcaacttggctaagtatatgctaggtaaatttttttcaccatgtcaatatgctatgtaatcctacggatattatcatattaccttataatattgaatttaatctttaagaattatactgcacatacaatttacatccaattaccttttaatttttttttattttcttcaccttctcaaatatcaatcgaaatataataatttctacatcagtttaattgacttttaggaaaaaaaatataaatatgcttatacaaatacactactgtatattgtcaaagtacttaaaaattgaatctatataaaaaatgctctaaataattaagttgccgcataacttgttaatttattgtatcaaaattatagctatcttgcaagttgtcgtatttatatgatcacttataaagttattgtactaaattacatctacatatcaagtttttgcactagaacactcatttcttaagtttttgcactaaattgcacccacctgctaagttgatgtaccgtgggtacaatttactctaaagaataaatctattctgtttcgataaaaagaaactcctattctgagttgtttcagaattctgtttgttgatatcaattgaatctttttatattttattctctccccaaaatttttttttgtatagtttagccgaatttaacttcagtggaatggattttccaaaaaggttcaacggaagggagtgaaaaataacgaagcagcacgcatggtatcatatgatgagttgcactactcttctcagttcagacttcggactgcatataacatggactgggctggacaacatactcggcttggtagctcacttggcttgtgaacagctcggctcgttgagaaatgctaacaagctgagcaaggattgattttttttattttaaattttatttattaaaatattaaaaacacaaattttttaaaaaaggtttacaaatctacaccctaactctccttgagagggcttttttaaaaacgcacttccagagagcattttttataacgtgcacacatgcattggtgtggtccaacggttgcgtaaatattttacagatgacccttgcaactctctaggagggcggcaaggggtccgcctgtaaatggccaaccacgattgttttgcaggtggctctctttataaccctttgggagggcagcaccgcggcaaggaggttgcctgcaaaatgaccggcgaccctccatgtggccattagaatacactaacggacgtgtgccacgtcacaaaaacatcctcaggaagggtggcattaggggtgtagatttgtaaaacttttaaaaaatatattttaaaaatattttaataaataaatttaaaaatttaaaattcagatttagctcggtggctataacgagctagctcgcaaactgttgacgagcccaatgagccagagaaacattaggggaataagttcactttcggcctctctatttgtcgcccagttcgattttcatccctagaccacaaaattgggtacgacccgtcccccaacttacgaaaaccgggcaaacgagatccctcggcggttttggctgacgtggcgcctatgtggcttgtttgactaggtctccatcccacgtggcattgatgtggcgcttacgtggcaattatatctcgaaaaaataataaaaaccgtgggcccacc

SEQ ID NO: 45860 - DNA, 6447 bp, Oryza sativa
cccggaaactctctgatacatcgatggaacacgcagttgagacttcagggacatatgaaggagttcaccggaggtccctcaacttaacaacgagatttttttaaagatcccttaaacataaaatcagaaatgtgtacccctaaactcacacaaaccatgcactcaagattctatggtagtatatatgggtggtttcgctgacgtggctcctagtcagcaaaaaaattaaagagtaaattgcatctccggtacacgaacttgttaggtgagtgcaattcagtgtacaaacttgtaaaatgctcgttttggtacatgaacttgtctgctgcgtgcggaggaaggcgaaaaggatactacatagctaatcttattgatttaggggttgattaggatactagtaaacatatatctgagaaggttgatattgacatacacctcttcaatgaaaaatagaataggatatagtgatagtataaaaagtttaaaaaaactgagcaataatataagggttagaaatgtatgaaagtcatcatttccatgataaaggatacaattgagaccaaaattataaatattgcatgtcttatgcatactcactacacgtatgcatgtcacatcctaatcaacatcagcttattttggtccttgttcgcatgaactagacaagttcatgtaatgaaacaagtattttataaatttatgtactaaattgcacctacctaacaaatttgtgtaccaccaatgcaatttactcaaaattaaaaaaagtacataacgcccacatgtcagctgcacatattttttttcttctcttttcttctcttttctctcttctctcttctcttcttcaagccggcggtgggcgagcgccgcggcggagcgctgctgcagagcagcagggagcgagtgcggcagcgaagcggtggcgggctgcgggcggagcacacggcggacgagcgcgacggcggcgaggaggctcgcacgacgacatcgggcgtcactgagatgcgcgcagctatggagtcggcaagctcgtcggctggtgcggccttcccgcggcagatcgggcacgaggcgtgggacgagagccacatgtcgatgcactcctggtggagctgcctcaccatctccccctcgtcgacagcgctgaggcaaaccgcgcactcgaccgacgccgccgtgtccgagatctcgccgttgtcatgggctcgcacgtacgggaacgacgggaggcacgcgatggtggcggcgtctaggccgaacctcggcggcgtcggccgctgctgctcctgctccatgacaagtggacgatcacgccgacgacgggcaatgcggagagctcgagagcagatgaagatggtgatgaggaagaagctcagggcgaatgacacggccaaggcgccgaacaacatcgtggtgctgtagcatccggaggcgcccgccgccgagctcacctgctgtccgctccgcccgtagcccaccgccgcatcactgtcgcacttgtccactgctactctgccgccgcggcgctcgcccgccgccggcctgaagaagagaagagagaagagagaaaagagaagaaaaaaataggtgcagctgatatgtgggccccatatattttttttaattctttttgctaactagattccacgtcagcaaaaccacacatatatactgccataggaccttgagtgcacagtttgtgtgagtttaagggtacaaatttttggttttatggttaatggacctcaaaaaatctcgttgttaagttgagggacctccggtgaacttattccacatataaatacattccataacatgcatatgaccttccacaatacttcaaatctaggcatttctttcgattgaagaaattttaaaggattttccttaggaaataaactaatttatatcaaatttatgtaaaattcatgcggtttaaaggatttgaaaatggagctctcaactcaaataaacaaaccattttctaaagaaaaaaagaaaaaaaatgagcatatgaacaaactcatgcaaaattgatgctcttaacacaaattagacaatcgcaaaaaaagaaaaacacacaaattaggcgatctactccggtcatcaggtcaatgcccctgatgccaacgcaaagtccacgaaccagttaaaatccacaaatttcactgcctccatgtcagtagaaaaaaaggataaaagaaagcttcgagtcaactccctttatcctgctttgtttccttaagtttccgccatgcgagcctaaaaccatacgcatatgtatataaccttccaacctaaattcaaatctagatcttcggccgagtttagttccaaactttttcttcaaacttccagctttttcatcacatcaaaactttcttacacacacaaactttcaacttttccattacatcgtttcaatttcaaccaaacttctaattttagcgtgaactagacacacccttctttagattggagaaactttatgggactttcgaacaaattagactaatttatatgaaatttatgtaaaattcatgcattttaaaggaggaaaaaagtcagcataggaacaaactcatgtaaaatcgatactcctaacacaaattagacaatctactccggtcaacgcatgtcagtagaaagaggattaaaagcttggagtcaaccccctttaccccgcccgtttcctcttgtttccgccatgccgtgggctcaaaccgccggcgccgccgcgcgccggcgaccaaaaccaccggaaaaagaaagtcagaaaaaaaaagtaaggctcaaatccaccgtcgccgcgcgccaccaccccgcgggcgcctccgtctccggatttcacccggtataaatctatgaccgagccgacgcgagctttcttgcgtgttgtagctggagtgttcgaaggaattactggctggcacgcacgcgcgcacgggcatggtggcggtggtgatgatggcgatgaggaagaggatgcgcggcgcgctgctggcgctcgcgctgctgctcaccgcgacggccgtcgtgccgctgctcctcctcggagaggccggggacgacggcgtcggggccgtcgccgccgcgccgccgttcaacgcgtcccgcgtcagggcggtgtcgtggaggcccagggtcttcgtctacaaggggttcctctccgacgacgagtgcgaccacctcgtcaagctggtcagcacctgctgcaatcatagatgccaccaccatggctgaatcctatctgcgtctcgattgattggtgtgtgtggttggagcaggggaagaggaagatgcagaggtcgatggtggcggacaacaagtccggcaagagcgtcatgagcgaggtgcggaccagctccggcatgttcctcgacaagcgccaggtactacatttttggctatatatctggacgccataaatgcttatattttaggacaaaggcaatagtatgtcttttgctacaaatgacaatgatcttttagatattgtgttgtaccatgttcatatagtttgtgggaaattagtatttttggtggccacaaattgccatattaattgggttacaaacaatttttgaaaagaatttaaaatggttgcacaattgcagcgaaaaccgataatgcatttgtattgtggggagacaagtctgccagattaacagctacagttgcagtgaattgatttctagttaatcttcacgagttactactgcttaaaagatagtatttgaactgaacaaaaaactattttttttgtgtgaaattcactgttaaatggacctcatcattgcaactaggttctgacttgctgacatctctcctgcacacaacggtccatttccctgcatttcttctccaacttttgtctctaaattcatcccatccaatcgcaattactggcaactgttcagatcaacatgttcacaggatcaatgcaattcctgttgcgatgcaatgccgcaattactgaacacatttagatcaccatcagtggtctgctgtactaatactgaacctgggtatccggcaaccggtgaacatacaggccggcgtcagttactggaccactggctctcctctgagcagcagttactaaggatgcagatatcagtagcatccatccatccatctattgctgcaggaactgatactttctggcttagctagcattagcaattggaatagtagggaccagatttggtagtaacagtagttaggagatttggtaataacaatggtttgatatgcagtaatttgttttgttgcttgctctcgtactttctaatggattctgtcattctggggtgtaatgtaatggaaatgcgtttcttgttttgtgaaggatccagtggtgagcaggattgaaaaaagaattgcagcatggacctttcttcctgaaggtaactcttctgggcttcctcagattgtctcattgtttggttctattgattgttcaagtagcaaggttttccaagttaatgttactgctattttttttcatcagaaaatgctgagaacattcagatactccgatacgagcatgggcagaagtatgagccgcactttgattatttccatgacaaggtcaatcaagcactgggaggccaccgttacgcgacggtgctcatgtatttgtccactgtcgagaagggaggcgagactgtgttccccaatgctgaggtaaatttcaaatatcacgtccttcacttttccaaatccaaatgatgtatgagtttttgtaacattgctggtgctaatcaatttaggggtgggaaaatcagcccaaggatgacactttctctgaatgtgcacaaaaaggattggcaggtaatggttaccttttgaagtgttttaaatgtgacacctctctaggctctagtttctcttcaaaaactgaaacataacacacttggaatataaccaggctagtttaattgcagtgaaaccagttaaaggcgacacggtgctcttctttagccttcatatcgatggcgtaccggacccgctcagcctccatgggagctgcccagtgatagaaggtgaaaaatggtctgcaccaaagtggatccgtatcaggtcctatgagcatcctcctgtctcaaaggtgacagaaggatgctccgacaacagtgcacgttgcgcgaaatgggctgaagctggagaatgcgagaagaacccggtatacatggtaggtgccgagggtttgcccggcaattgtcggaagagttgtggcgtttgtgattcctaggatgtgtttattttcctaaatctgatgtttgtgtcacttgctgaacacttgatttgtacatacttagagcattttcagatgaaataggtagcatttgaattttcagacagtgaacagtagcatactatttcttcaaaaacaacggcttacatcctttgcacatggttttgaaatctcaagtttacttctagtggaggtgaagactgtgaagtaagttttggtattttactgatgcagaaatggaatctgtccttctggcaacaatgctactgcctgttccactttaattttgttggcttgcataacagtggatttcagtacagcagtgtgtcaggctgtctcaaaaataacaaactcctttggccctttccacaatatagaagttctatggtctttatctcctgcatcagcctggcttttagacaaggaaactttgtttgttgctacctcaaaacatgtttctaatccacagagaacaagtttagatcctaacaaaagttttgttctactgcatgcgaaaaatcgtcgaattagtgtacattttcaacagtagactgaaaatgtccttgcaacgatcatgtaatccatgtagggcttatgagaacagtgtgatccatgtagtcacaatctaataataaggacagtgacatatcacctgaaagtggtagatgtgtgtatttcttcagggtgcttcacactttgaaggatctgcttttggaccttgctttaccagagcaatctctcatgtgtcatgcctcctcctagatttactcaaactttaccttaaacacttttgtgtaaactaaattatcctctaacttggttttgctccaagggtaactaagtaatccctgatggtccatcagacagcattttcggtttgccatcttaaaactccaattggctctttttaccaatcaagatctaagagaaagaaaaatgaaacaaaagaaggaaaacaacataactcaaaaagcaaaggacaaaagcaagcatggcctcacctcctttgatttctaccatgcctcttcattagctaggcccttcaaaagcacatcagagccagcagctcaaggaagaaagaagctgagaagaaaaccagaagcaagaaacacataccactgcctccacaacaatataatgtgctgagacaagagagaagaagcctcacatttgagggggggctt

SEQ ID NO: 45861 - DNA, 9777 bp, Oryza sativa
cccgaaggatccaaacaaggccattgtgttgcgtgtgcagtgacatgtaatcgggaaaaaaaatttaagactaaaattttgaactagtagtatgaagctacagtgccttcttcctgcagctagctactacctccgttccaaaataagtgcagtcatggatatccatgcccagcgtttaaccatccatcttatttcaaaaaattgtgaaaaatttgaaaatatttagtcacatataaagtatcattcatgttttatcatctaatagcaataaaaatactaatcataaaaaaattttaaataagacgaatggtcaaatgttgaatgtgaatagtgtaaaactgcacttattttgggacagagggagtagatgcaatggcagagatgatctcgcattaactaacttcccccctccatggatcgatctcatctaccccctcttcccctcccatttattgcaaccccatgtcgatcgccatggcagcagcagcagcaacgaaccacttgctcccgccattaatcgcttcctccaactccccatcgtctctcctcctcccctttaaaccccctctcctctcgcctcccgctccaccaccatcgatcgatctccacctcgccggagttgagagagacgacgctgcagggatcgagatcgagatcagagaggttggcaatggcggcgcgcgtggcggttgtcctcctgctactgttcggcctcgccgccgtggcggtgacggcggcgaggatcatgcccgacgacgactgcggcgacacggcgaacgccgccggcgccgccggcgtgggggaagccaagacggcgttcggcgggagcgacggccgcggggggctcttcggcgggtacaccggcccgctcggcggcggcgccgccgggttcggccccttcggcgggttcggcgccggcggcgggccgttcggcgggttcggcggcggagttggcctcggcggcggcggcggaggattccggccgtaagacgatgactcgtaggacgacgtgtgcgcatgcgtatagtagtatagtgcaattaatgtgattccacgtgtataacgttgtgggttaattgtgccacgtcagatatatgtactaatgtacggtgagatgtatctaccgtacgctggagtttgtacggctatcgttgattagagatttctcttgtgttgcttaagtgtttgtgtgtgtgttcattgagttgttttgtgttgtaatttgctaaactttcaagtgcttatctatgattgacagaggtaagattcatgtggctgactatttgggcccaccagtcagccagtggaagggctgatggttgggctcagccaattgaatgttgacacgtaagcagatgcagcctcctaagtcatacctccgtgttcaacttatatgcaaaatttgccacgggacacgcaaaaaatgtgtaattggctggaagacaccacgaaaacgttatacggctgatggacactaaaaaaatgtgaaatttgctgtagaacaccggtcgcattattttattatttccggtcaaaagaggtgagatatttttctaagtgtccagattacccttctctttccttccttttctcctactctttccttcttttccccttcttgttgatttcgctgggaacggcatagcaacctcaaagcagcagtggggcgaggtcggcgcggcgtggtgtggcatcaccagcggccggggcggtcaacggcatgggcgaccatggaggcgcggtgttcgaccagatcgatagcgggcaggcgacgacactgctggtgcagcggggcgcggccgggaggcagcaccaagcgcaggcggggaggctacgattggtcccggcgtcaccactgctacgatggccagtgccctcgctcccttcggtgcgcttgatgagtgccgacgacggcggcgggttcagatcggcgccgacgaagaaggggtgtgatctccctctccggtgcaccatttttcggggtccttgaggggagatggagaggaggatgaagcgaagatgctggtgcaacagcttggcccggcttggtccagataagtgggaacggcgataatgttgctgcgcggtgcacagagcgcgctccagagctccggtgggcacgacagcgttcccgtcgattggctacacgaatcgagaggttgtcaaagcaagatttgattggcatggagagaagataatagaacatgaattagataggaacggagacggctcgttggtgatcggcagtgtcctccttctcagcggctgacaacgaaagataggtggagagggagagctggagctctcttcctaggttcgctctgtgtggaaatgaagtggagtagatggcgatgcagcagggacgagatgaagacttgcctcggcattttgaggcattgacacgtcgtgcacacgcgtcgaactcagccgacgccgatctctctctcggttgtctctggtcgatctctctcacgtcgcgtgctagctcatgtcgcttggcccaacctcccccaaacacgacgagctgaggaggctattctccaggttcggcaagatcgagagggaaaagaagataagggcaaaactatcattttacgttgtttctctctcatcaattgaccgagtattatattttaatgtgtccagtgttctgcagcaaattatcacatttttggagtgtctttgggcaaattcacgtctttagggtgttccagctaattacacattttttttgagtgtcctgtagcaaattttaccaacttatatatacatcatctgtgccataaaaaatcaatatgtgtagattcattatactaaaatgtgttaaattacatatactgtgccataaaaaactaacatgtcaagattcgttatagaatgtgtcacgtccgatcctaagttgttattttgggacgaagggagtacatcacagtaatgtataaaatttactgcaagtaccgtgtatgacatgactttagatgagatgtttgatattttaacatttcataaagcgggtttcgattatttaacatagtaggcatagataaaaggagacaatctaaattgataaatcctgacggatttaattagtatatatttgtataagttcatctcatagtgttatatgtatttttctttaatttttccctctcatacatgctagcttttcctttcactaaaaacaaaaggaaaagagggataacctaatatttcctcagattatttcttccttggaggagactgttaatttctaccgcctcagttaattgctctcaacttggagcttaactctgagcatatgttgaggtattgaagctgtgggccagaaagcctcttcagatccatcaggtaattcccttccccttctgacttgtacagctacaataagcacaagaggtaaaatttttatcatgggtaaaaaaaaattaaaggaacggttaaacacatgtttttttttgcaagtattaagatttggagggagtaataattgtcaaggggagaaacactatcagtctcattgtttggcttattcgaggaacaagccaaatgatatatttaaaaatgaaaaatatttttttaataaagttcttatatacatgttcttaacgatataaatgaaaagactaaaaaataaactacgatgaaaaactttaaaatcacctctaaatttaaagttaaatatttaaactttaactgataaatataaatataagcgaaaagatgaggttacgagagtgtatgaatgatgcgcttgaggagaatacctgaatttcaaagaacacagccgcagacaagctctcgaggacagcatcatcgacgggagctccaccgccatggccagcctcacctctgccactgccaccaccggcggaggaggaagaggagggcgcgtcgtcggtggcggcgaggtagctgcggatgatgcggcggacgccggcggcgccggcgaagcgtgcgcagagcagcttgccgtagcggccgcggtcgtcgtcgtcgtgcgcgtagacgacgccggtctcgcgcagcgccgccgcgatggcgcgcatcgcctcgcgggggcactcgtggaactccacccctcccagcgcccatccgttgttgcgtccgtcgtcttctccggcgacggcgaccggcggctctccggcagcactgctgccagttgcttctgctgctccctgtccagagcaaataggtgtatgatggtgttgaatcagttgatccaatacagtgttagattttttaaaaaaaaggaaaatccactttgtttagtacaaagaaatttcttgatcattattgtgcaaataaaacatttttgtctataaacattactccaggttgattatacttattgttttggataagagtattgtcaaactttaaaaacttttaattataaataacatctaaaatgtttgtcttagaaatgtggtgaccatatatatagattggtcttaaaagtgctccaacaaaatcatatatttatctatacatattttaatagaaaatagtggtcaatgttgttttttttgaagaccgtatactttttaaaacgataggtattatcagtctagatggatggagtactgaattagaaattattcaacattaattctagattggtaaaattgaacatcgtgaatatacttttatgtgctcaaataagaattttatggaaaacttttactgtcatactcaaaagaaaacaatccaccagagtcatatgtttgaactttgaagtgcatgtccaattgcacatatccaagatatttgtccttggacatgggaattttagtattgccatgaatgaagatttattttctgcagaactagttagtttctatacgtaccgtggtgttactttgtccagcttcttgatagacgtcaattgtccaaacataacgtgttggggcatcgaacttcttattgaggatcaggttgtaggcgaccgtcgcctacaaacaaatccatacatgcatattttgaaccacaagtgaattgcaattgcatcgatccatctgtatgtatatgttgccaacatgtcatgagtggcatgtcattaacctttctatgtaccaatactcttatagttgttactttcaaaatgtatgatgacgttgacttttcacaaagtttgaccattcatcttattcatttatttttgttatgatttgttttattatcaaataaaatacaatcataacatataattttatatatgcatactaaatttgtgaataaaacgaatggttaaacgttatgcgaaaagttaatggcgtcatatattttaaaaatgaggtagtacattacatacctcgttttcgactctgttctcaagtgattcaaccaagtacctcctttcaaagccatggccgactaccttgtcgacagtctcagcatcaatctagcacaagatataaacacaattaatcaaaaaaatgcgtaatcaattaaaattaagcacccaaatagcacataattaatcaaaagtaattaattaagcaacacttgccctggtgatctgtgtgcgagcgttgagaggaggcattgcgaggtagcgagggatggagtgctgcagccaacggtgcgtcctgacctcggtgatggtgaggcgcttgtcaggtctcacgatcagcatgctggagatgagatccctcgcgtcgtcaggcacgtacggtgggatactgaactctcctctctgcaacgcaatacgaagagaggaagaagaaaaaaacagatcagctgtttctcaatctcattgggattttcagttttgaccactgataacttcttcttccatttgcttgtctacagttgttcagcagctgaataatatatttttttgtcatatgttttacagttggaattttataccttcttttatttgctggtctagagtaattcagctgaataatatatttttttcagatgttttacaattcacagtttataacttcttattataccgtatttgttggccggtctacagtcattcggtcgaataatttattgtcagctgttttacaattgacattttagtatccatgatgttgaacttctaattcagatttttttttagataagggtatttttttacccggcctctatatccaaccggatatatacggccattgaaatagggaacttagccccgaaaacaacccaatctgaaattcgctccatagaagatttgaactcaggaccttggggtactactcaggtcactgtaactactaggctatatactacaagatttgaactcaggaacttctaattcagataacttcatatacgttgtttatgtttatatcaaagtcattctttttgttaatattaacacggttaattagatattgtaactattgtgattagaattcgaagagtaatttcctaccttgatgatcctgtgcagctctgatacatcggcgctgtcaaagggcaagcgtccacagaagaggatgtaaaggattactccacagctccaaacatccacaggtggaccaacatattttctacccgcgagtagctacaatacaaattacaataagcaacataaacatctcacatatgaatttcaatacattccccaagttactatatgatcgacgacgacatgtaactccttttttttaacacttaaatttcttctaattactaggcgtattgacattgaactatgtattctctccggtccgttccaaaatataagcatttccgtctatgtattttggaatggttaggaatatttcatatgagaaaaagaatatttgtgaatttgtggctgacctcgggagcggcatattctcggcttccgcatgacgcgctgagcaccttgttgtgcctgaagaacttgctgaaaccgaagtcgacgatcttgacgttcatctctgaatccatcaggatgttctccagtttcaggtcacggtggacgaccatgttgtggtggcagtattcggcgcctgatataatctgcctccatcgaattgaccaattaaaaaaaatgcattcgttgttgcatcatcaaattaacaacatttcattaaaatgtttatgtcgtctgactttctttctcctctttctcagagtaaaatttttcaaagtttggaacatggaaatcggcgttcatcaaaccataaaaaaatctcgtagactaacacaaatcattgtcgaaatttcagttcaaaatggggagcaataaatcggtgcaaaaatgcagagttcttcttcttttttgttaactctgaacttgtgaagagctgaagaaagcagggttttcaacctgctggaagatcctgcgagcgtcatcctcgcggaggcggccgagctgggtgacgtaatcgtagagctgcccctgcgtcgcgagctccatcacgatgtacacgtggccgccgccgtcgccgccggcgatcgcctcgtggaaccgcacgatgtgcgggtggttcagcagcctcatcaccgcgatctccctctccactgccgccgccgccgccgatcgaaaattcaggagagaaagaaaatcaagaattcaagatgagagacggatcgctcgagctcgacgatcggagaggaagaagaagaagaagacgaaggcggtggctgcttgcctttgcggatggggatgccgctggcgagaagtccggcgaggttgaggatcttgacggcgacgctgaggccggtgcggcggtggcgagcctcccacacctgcgcgaagctaccgcgcccccgcacccgcaccagctcgtaccgctcgagcagctcccggtgctgctgcgtcgccgccgccgccgccgccgccgccgccgacgccgcgccgccgccgccctgcatcctcgatcgcctcactgagcgtgtgtgtgtgtcaagtagtagtagtaattagtatgtgaaactatgggtagcttaagctactagtactaggattatggatgtattagtaaagctaattaggtagtgattattgcgagattaagaacgagattatatgcaaagtagtactccctccgtctcataaaaaataaatctacaactagatgtaacatattctagtacgatgaatctgtacatatatatctagattcgtaatattaggatgtgtcatacccggtattaggttggttttttatgggacggatggagtacgtagcatcactatgtggcgtctacattatgtgcattggaatcaccggaggaagaatcaattctaagacggtgaaatcaacaaggtaataaggtaattaaaattgaaattaaacttgccagtgaaagcaacacactaagctgggggacaagggggtgcatatagccagacaggcaaataaacatctttcgatgtcatagaaccaaatggttttctcaaatatgtcgacagtattgtgagacaggttttaccttattcgtcgatgtcatttacgccggcctaaatttaactcggtaatttgttgcaagccagccaatcttaatattttttaaagaaaatatatacagcaatttggctgtgcttctttggtttctcatgggtgatgttggctagctagcttgatagccccatgtatgctgctttgctttctcatggctgacgttagctagcttgtccagcttcaagtacttggaactttcaaactttcagttcagtttcagcttagttttttttctcttttttttttgcgggtaccacatgtatatactttgcatctgcatcacaatatattgcactttcatatattcacatagttacacatgtgcaaccatatatggccgggccggggtatcatcgattgttgaaattgacattttagggctccttcggaacaaaggatcaccagaggatttcgatcctatggaaaattcttcctatatggttacctgaatcaaaggaatagctatcaaaaaatcttatgaattttctttggattagctcaaaacataggaattttaaaggaattctaacatgagttccaacctcttaaaaaaaatcttggtgtctatctatcttatataattcctgtattttttcctatgctacatccaaacggccattcttgcagttttcttgtgttttttcaattcatggaatttgaggtgttagagcacttcaatccaatattatttccttccctagtgtattgagaatcatgcgttcatttccacctggaactgttatagtactgcaaggatcatcatatttatgtcaaaaaaatacgaatatattggttttttttaacgaaaggcaaagcttacctattcattgaatatagagggtaaatttagagctaacgaaaaaatatttacagcatcacggttggggtctacggtaacatctctgctaggcgtttggctcccgccatagcccaagattttgcctcttccttaatcttcgagattagggccaccatggttagttccttgtttcggaaaattcgttggtttcgctcctttcaaatttcccaagagattagaaggattaggaatcgagtcccatgcttgggtgcaccttgacgtgttgcaagcgattcccaccagtagtgtaccgtggttgattgcgcccagtttatcggcttgatgggttcacaggcaacccaggtagcaattgcatcctagattttccttgaatatattggtataatttgtatgcactaagcttattttaaatttcgcttattattggcaaaactctacagtgtttaccatttcggaatcacagttagctagctgagtttgagagaggggagatagagaagattagggagatacgcaaaacgaagtaaaccattagtgtataat

SEQ ID NO: 45862 - DNA, 1535 bp, Oryza sativa
gcatatactggtagaaaggttaaattaaaggttgccatctctctaaacttggacggcagctgcaaggggaagagaatgacatgaagaaaggtaatgcaacgcagagtttacgattcctgatcaatttcgtgaaacggctagagaagtaccctctccgcaaaaaaaaaaaaaacaaaacaaaacaaaaacaaacaaacaaaccaacctaggacaagaacatcaaatctcgttttatgtagagtacgttggtttggttttttatgaaatggaaggagtagtctaacggaaggagtagtctgttttcctatgtttacacttcgaaaaacgtaaaggttacgccctttgcaacgtcagtgtcactaactcaccatagcgtacgcgtgttgccatattagcttaatgtgatcaaaggcatctcttgttctctactggtgtcgtctaatggaaatcctgtaaaccaggggcaaattcacaaaaccagccacgaattctagatgcaaaagaactgcctggccttaaaataagttagacaaatcaagaaagtggtccatcttcaggagcaatttccttgatggacctgcaaccagaactaccatcgatcttcaaggtcatcgagtaataatctctccaaaatcaaaattatttatgaagatcacaggtttgaaaatgcaagttgttccttcttactaagatttagctgtggagtaagagaagatataaagtgggggaaccaacgtagtaacacctactactcatatagcagagcgaaaagagggtagcatacaggctatacatgaatagcgtccaaaaatacacgggactccgacccataaacccagtcactatccgacaccaatcaagcgcgacatcagggacactcgaacacccaagaatcggggcaggactcatgactaacagaacaaaaaaaaacatatggtcttttttttcgccaggaataggcggtattatggggggcaaggtgaatgtggaggactgggaagccaacaccctcacttgcacttgaagccatggcacacggacaggatgatgatgaggatgagcgcgatgatgatgcccaggacgatcagcttgatcttcatgttttgtaaccacatctttcgccgcacctttgtaccctgctgtctgaaatcttgtgcctgcaacccatagttttgatttaagaacgaagaaagctatgtgcatttccaaaatgccaagacagaataaagtgcataatccataagtgccaccattcattggttttctttaacagtatcatccaaagcatctatattgtgtctcacactgtttaatccagttaatttcaacagctgctacttcccatcgctcataggagctaaataagcaaagctcagatagttgcatatcattacaagcatctccaaccactacaagcatctcattgtgcatcaaattattcagcttgaacagtataatagatggtaagaaggatctatatgcttgttgtagcatagtaataatgtattatacatcaaaagttgctgagttaatta

SEQ ID NO: 45863 - DNA, 2549 bp, Oryza sativa
acagtaataatgctataccatatcaacagtaagccagatcacctttggaaccataatgcggtacttctacatatgtacaccagcatcgacatggaagctttctagtcagctcaaaacagaaatacataggctaaaacagaccacgagatatcttgttctttagggcaatcttgtatcttggcatatatgttccaaaaattctgaaaaattattctagagatgataacatttcaactaccatagaagtccagtaatattgatgtttcaattaatgaaaccatcccttccctactaacaatgatgcttcaactaacaaagccatcaaaattctagtaacaatgctttggatgcattgagtaaaagagactagatttgtcctacttaaatcttattcagaatgtttttattataatgcactaaattctagaacataccattaccatactccatactctcatgcgatctacactaacatgtatcagtaatttctccatagcaatccattgtataaagattcctgagttctataagatgatttgcagttctaaattctctgtgttacacaacagtaacttcaaagataaagaaactagtacagcacatcatgaaggaaaacgttaatacctgagatctcaggttttcagtcttgtcgacaagcagttcaatcttctcaccacggtcaagaacctgaatttcataattgtaatatagaatcagcaacaacctttgaagagcatcatggtttttaaagaacataatgtgcagaccattggatgatttaagaatgaaccttctcaatgttttccatcataactcctttgacctctgagacttgtgctttgacctttgcaagcttgctgatttcctcagggtggtccacacaatactgcatgtgctccttaagttttgatctttaaatagtagagacaaacaaatatcagtcaaaagaaagaaagcccacaccatgctcgaatatcacataaaagcaaaatgaacatacccgaattctcggttgaggctgtttgctgcagcagtagctgctttcccaccaccatatcttttggtgaaatcttccttgactctgtcaaggaaagcaatggggatttgtcgcccaactgattcaacagcaactacacagtatgctgcacaaagggggggaaatggaaatgataattaatctcaatgcacatcatgagtttgtgttagaaagtgaaaacatcaaagtaccaaaagatcaaaataatgaaaatagttgttttagggtgaccaagcaatttagaatggttccaaaaaatagatgacgcaagtttgcaaaccaatttagactgtttaaattgtgtaacatattcaatttaccataaaagggtgggtgctaccttaacagtttgcctgtgggggaaaaaaaaactttctaaccacccatcttcctgctttttttgttatccttcataaccttccactaattactcaatcatgcacgccacagcctaatacaagataacagttatgaatcttcccttgactacgtaatgttagccccacatccaattcctcttgcactatgaaaccatgtcttgccttaattgtttatttgttcaaaaacaatgcaaacaattggattgggaacttgcatcctacctaaaactaaacagcatttattccataataatatactgcaacctattcaatgaagtaccaaatgaaatttgaagtagccttttgatgtcattttcacattaccatgataatggaaatatggtcacccagtttgaacataacaaaaggcaaaatatgctagactgccccgatacaatacttgtgcccgcaagactgacacaattttaatgcctattctgatcatcacaaagtagaatatgaaagataagtatcacaccattttgatttgataagttagttagatatgtccatgaatcgtccagaaatgcaaaatcgaaaaacgcaccaatcacctaatccctgaatccccagtatgccgatgcggttagagcctaaaaaatatttgatatagtcaaataacacattcaaaacgcaaacacgtctataaatttcctgattctagcatgcaatcacacatggaaacacccgagcctcctctaaatatagccaattcccaacacctagcctccctctctagcattcgtcaactcaaaccgaagcacaagcagcacacgctagatagcactagcacgccccgcaagtcagctcggagtccaagcggatccaaccactcgaggccccaggcctaccgaaacagatcgaacaaaccccgcgagatctacacgcatggagaaccccaaatcgagcacgcaacgttgcggatccgaggcagatcggcgtccgcgcggcctcgccgaggagggagaccgatcgatcattggatcgaggaggaggaggaggaactcactgaatccgtcctcgacgaggtagttgaaggtgtggccgtcgcagttgtaggtgaacttgttgttgctcgcggggagcttctggaggcactgcgccgcgatggtggtgaagttgccggtgaactc

SEQ ID NO: 45864 - DNA, 7451 bp, Oryza sativa
tcgctggtgaatccgacggcgccgacgaggatgaggtcgtcggcggtgaggtggttggggggggggggtggaggagaagggaaaaggggatgaggatggtgagcgagcgaaggtgggcgtggaaaaaggggagaaagaaatcgaattcgaggtggggttttgcactttggtccttgggagggggtatatttatgtactgtataactgttgctttgactggtgtccctaatctttgacgacaaatcagggctatttgatttgaagaaaaaaacatataaattttgaaggatttctagttttatagaaacttttttatgaatgtcttttgaaacaaaggattgggtcattttatatcctttgaaattcctatggaatggaaaattctatagagattttggagaaaaattagcaagagcttcaatcttttgaaaatcttcctttgagtataactctctcatacgattcttatattttttttcatgcggtccaatcaaacgtttttcatgtgttctgtaattctttgtttacacttgcatttctatcataatcctaattttccctattttttgtttttttattcctacgaatcaaggggctcttgaagttttagcatattggaacatttcaatgctgcttagggtctgatttttaatctccaacttaatttagattttcaggggcacataaaataagataaaccattagcacataaatcattagtgttaattattacaaaccttaaataatgggtttatttgaattttaaagaaactttatataaaaagcttttgtaaaaaatacgtcatttaaccatttgaaaaatgtgctaacaaaaaataaggatggagttgacaaaaagaacaaggcataaggtaatgctctttttaattatgcaccgaattattgaaatgtattattctgctctctaattaaaaatacatttaagaaaatcttctgttgtattgcttagatagcttgttttgaagtttactttttaaatatttaatttatccatataataataaagataatatatgataataatccgttcgataatctaaatcaaacggaagcttgtgtcatggttgcgaggacgtctctacctctgtcttgataattatatttttttaatggagttatttttgtgcgaactgaataattgtttgactcggtacaaaattataatagtgaaataatgatacaaactacaaactctcaagtaggcattaattttccattcattttaagatactttatactttatatactaagatattgaagattagttataacaaccatgttgcctacatcagtatctaggtgttttaaaacaatactagtagtattattcaagtgataacataattagtagagctttagacgggttgtcccttgtggtttctactttctagttgcaccaactgatgctcaaccttggagggtacctgtttgtgatggagccataattgcagggtgttaggtcccatctggagccaacaaattggattgccggatcatgaagcaagatgatcagaaaaacgagcagatgactcgtcaatttaaatcgcaaaggaattcacacagtgacacagaagggaacacacatcgctggtcggtaccaacttaattaattttttatgggaaaggaaaaagggtataatggaaaaatgagatactggtgttcttttaattctgaacctccgcatactgtgatattgcagatgacaccttgatgatgggattttggggttaatctcgctagctctctctgcgatgattcctacgattcgggaatagaaacgaggcttaaacacgggtgctaaatagtttgataagattggcattggtgccagcaaatttttggtggtgtttgaatctcctaaggatgaagattaagtatttcacgcaaaacgaggtggtaataacaagtgattaattgagttttaattattacaaacttaaaaaatgaattaatctgatattttagaacaactttcatatagaaagttttcgcacgaaacgcaccgtttagcaatttgaaaagcgtgccattttaatccaaaatttaatccactctttccagtggattcgaacggggtacatgtaccgttctcttttttttaaagaattacgcagtacatgtaccgttattgttaaaaattcgtttgaccaagattttaaaattaaaattaaattaaattttgcaaggaaacttcaaattgattgagcttccatgatccatcttgtttgggactacttctagattctctttttgcaatgtaagatactcatctccctccgtttcaccattataagatggtttgatctattcatctatcgtctggatttacttagatcaatataactttggacatatttgtatataaatctagtcaaaaccgaaaacttctcacaacataaaacataggaagtagtaatatgctcaagacaatacctaagaggtcctttgttgcatgaactgttattatttacatactgaatattctataaaaattcatgccttccaaaaaagctaaaaaagataatacagttggcaaacactggttaatagtgatttttttcattgtttataataagacaaattttgctacataacattcaaaacttgtgtaatttgctaatgcacattgaataatgtgtcacgactgaaagacatcctaaaaattggtaatttgctagagaacactttcggctcaattggagaaattcttaagaacgacgagaatgctcttaacatacatgcttcaaacataacgttagagtaaaatttagaaattatgcaaatataaatttaccatcaccccagtacatcactatacatcataatccatcttcactctagcctagctcaaaagctttttgaccggcattcttttttttaataatttctctctacaatgacgagtgtcctccagcaaattatcaattttgtaattgtctttcagccctaacatgtttttatgatgtctcccaacaaattatataaatttttgagtatcttgtagcaaattttgccttatatttaaggttagatccatgtttcatccttaaacctttgataaaatccattttcatccggaactatatatagaactgatttccttttcatccttgcttttcaacaccggttatatcgggtctgtttggcacagctccagctccagctccacccctcctggagctagagctcagccaaacagtttcagctccaccaaaactggaagtggagttgggtggagctctctcacaagatgtactagagttgtgtagctaggtttaggcagctccacaactccactccagactcaactcctggagtaatatttaggagctggagctgtaccaaacagccccatcgtctagagtaaaaatggaatccgtgaaaagtttcgagggtgaaaataaaagactactgctttagaactgcaagcaggagaggaataatagattgggcaaacaaatgctagggctagtgatattagaattagtatagagataatgtattatatagattatcttaaaattatgagtatgtgatatggataaaattagaggtagcaaccgtaaaagtagctcttggaattataccttgattcacgagactaatcaaagactggccggccgaccttagcaaactttagggtagtgtttggttggtgggatggaacgggatgagttgggtcgatcccatttttccagttgtttggatggagggatgggtgggatggaatgattctagatgggaatattctctccagatccgggatgaagtgatccgccaaaatcggccggaccaatcgatcccacttggatggagagaacggcgtcactcgctccagccacctcccgctcggttctgtcgtggcgccgcccgtaccctgccgccgctcgtcccccagcgccgctcctccgcctggacgccggtcgtctacctcgacgtcggtcgcgctcctccgcctggacgccggtcgtctacctcaacgtcggtcgccgccgctactccgcacgctgctcctccgccgagtcgccgccggtgaagctgcgcatgctcgtgcccgctgaatcgcctatcggcgacgctccttcgcccgctcgccgagtcgccgtccgctcgccgagtcgcgccgcccactcgcgaagctctgcgtgctcgcccctgccgagtcgcttgccggcgctgctccttcgccggcccgccgagtcaccggctcctctacctgctcgctgccgtcctgctcgtcgaggcgagctccttcgtcggcctgctcctccgtccgggctcagcagcggcggatccggggatggggagtgctgcggcggcggatccggagatggggagggctgcggcgacggatccggcctctccctctccgccgcggacctcgccgatgccgtcgtcgccgagccacggctgctcgcagtgaaggccgacaccattgcccgccgcagatcggcagctccctcctgtctggcggcgcgacgcatctcggtggtggagagggaggtgagggcagaggcggaggtggccatggttattgcaaacggcgtcgtcagtggttgcaaacggtattcatcccattcctccctcgtcccttcaaccaaacaaaaaactgggatcgtcctattcaacaaaccaaacacacaggtggaatcgtcccaaccccaaaatcaggaatggtttcatcccatcccaccttgtcctagaaccaaacacacgctaggagaacgaacgcgtttcagactcttcgatccagtgttgtttcctcctgtagaatgtacgacggtcacagtaaatacgaatggatcaacaagcaagcgcgtgccggcgtgcgtacatgtgtacaccacttgtgcgagtcgtagtacgatttctaataagtcgcgcaagtgtacatgcgccgtgagaggatgatgagatgagaggaggcgagcgaggcgacgggttgctttcgccgcccgcgtaaatcgtatgacgccgttcactttttatttaacgtttgaccattcgttttattcaaaaaatttatgtaattatcatttattttattatgacttgattcgtcatcaaatgttttttaagcatgacataaatatttatatttacataaaaattttaaataaaatgaatggtcaaacgttggtcgaaaagtcaacggcgtcattaaaatatgtgagggagtgtaattaattaaagctagacatcttgctaaatacggcacctgcctcagaatcagataattaaacacgctcgtgaatcagaacagagacagtatgatacttcctctatttcatattattagtcattttaacctcttttattgaacttattaagtttaattaaatttatagaaaaatagagtgatatttttttacataaacgaaactaatttactattttatatgtgaactatttttttctataaatataattaaaatttaacacaatttaattagaacaacacagagaaaatatcacgtactccctccatacttgtaaaagaagtcgtttaggacaatatttaagttaaacattgggaatataaattataaataactctcaatttaatcattttttaataaatatttttatataaataagaagccaaagctgtgttttggaccgtgtcactgtataaaacgactttcgtaagtacagagggagtatacgtacgctggccaagccatttctcgtctgggtcggtcaatcgaaagagatggagacaaccgggaaatgcatgagcacgctttccgtgctcggccgcttgatagccggcgaccaacaggggtggctgtcccatttgctctctctagatggaacggcatgtcagtttacttttactactccctaggttccataattcgtgatgttttagataataacacggacttaaaaatacatacttaactataattttttaatataatatatatacaataaataaataaatttttatttttgttatagtactttgtaagataaaacaatatgtatgttgttataggttttttaaattaaatatttttaaagttattaatagtcaaagttataaaagtttaacctcaatcttatctaaaatattaagaattatggaaccagagagagtactccttttcatattttaattatttgtgagaaacacgcggggttttttggctagctccataagatagtgggctaaacgatctgggtttgaagcctcacctcttataattatttgatattaggtcatttcctaatattcacgtttttatattttaactagcatggtgacccgtgcagattgcgcggctagcatcattatattttctctcatataatagcatatatgttttctcattatattattcaaatatattaaaatgacaacataattttaaattttgcaataactttacaaaattacaaatgtgtaatattcatattgtattttatatacgtgttagttattaattatttttaatatcaaattttagttatttgtaaattatatatattcctatatagactctatgatcttcttccaatattatttatttttatttctgaatttttattatttataattgtatttttatgtggactctaaactcatatttcaatattctttaatttttaatttcgaatttcagttacttctaaattatattcctatattaactttaaactcttcttcccatttttttttcttaattttaaattttagttatttgtaaattattttttatacggactctaaactctacttttaattttattatgtttattccaaattttagttagatttaaactcttatatggactctatactctacttctaatattccttatttttttaattcccaatttctatttttttttcttaattgtatttctttatggaatctatactctacttctaatattccttatttttaattcccaattatagttatttcctaattgtatttatatatggattctatactctacttctaatattccttatttttaattctgaatttcagttgtttcctaattgtagttctatatggactctatactctactgctaatattccttatttttaattccgaatttcagttatttcctaattgtatttctatatggactctagtctcctcttctaatattccttattttttagttccgaatttcatctatttctaaattatatttccatatggactctagtctcatcttctaatattccttatattttaattccgaatttcagctattcctaaattgtatttctatatggactctactttttcttttttctccgattaatggtgagaatttctagggccatgagagtgaacgtggaggttacttataaacttgtattcctatattgactttaaactcttcttcccatttttttcttaatttcaaatattagttatttgtaaattgtatttttatacgg

SEQ ID NO: 45865 - DNA, 1835 bp, Oryza sativa
ttcctgcaccccaattaagtatgtaattcgaaatataaatttgtaatctcgtcaaattgaattaaaaaaaatctagtaaggcatttactggtaagaatacaaaaaattggaactccatgtttatccagtaatctggctgcatgtggtaaccagtcaggccaagtgcctaggtttctttggtaaactggcttttgaaacctttgcttatatgcatcttttcattctcccatactgtgctgccatctagtgtttaatggttgatcacatgttttcaaaagtatgttgatagtagatagtggtgtaaccaagtcgacttaattataatccccaaccaatagattagtacctaaataatgttcaaaaactttcttgggtcagaacggagttcatttggaataagtgctgatatgaaccattcaactaaagctactttggactgttattgttaaccttgtggcttgtgcttatatttattaagtgtagtgacatctaatgatattatatacttctgccttaggaaaaactcttttcaagtcggaacaggacagaggccaaccttggcaagaagttgaagattgaatatcttccagatattgaaaagatacataaagtatgtagcgtgtttaacccagcctgttttgccagtgaaagctgtttcaagcttgttaattaatgatttacctattttcttattgcagaagaaggagaggttgctcaaaaagcaacaaagagaagcccttctcattgatagcttcttggctccagatggatttaccactggtcgctctcttcgtgatagaaagccagtaacatacacttttggtaagcaccaagagtctaaggctgaacctcggtatagttatgaagatatccagaatggaaataccatcggtgtggttctgtcatgtggtccagaggtccccacttgtcagtctcatgctagatggtattatccaatcatatatctttgtgatgctactttgttaatttttctttattttgatagcagcgatgctttgttgcaaatgcttcacaattattaaactctctcatttatttccttcacattttagatatccaggtgatctacgtcacttgctcactgttttatttccctacgcattgatatatgccagtaaaaagtcttatttattctcagcagcaaattactgatggaattataacataactcctgaaaattttaaattgaagtgaatctatgttggctagtttaatacagatttatctgacttccagctgtaagataatatagtcagtaaacttccaaaataaaggctgattgttaaatagaggttgctaattgatagccagtaccatgtggtggaactgatctagcttccacattttgcattcactatctatcattcctccattcatgtccatgacaactggagtatgttatatctatttcattacttctgttcagttaacttcattgattcaaattaaatgttttgactctacgtatggtgcagatgaatatgaccgctcaataagtgaggccataaaaataacgaagtaggtggatcgcatctattgctcagtaattttcacttggaataaaaaaaacttttttagagacaccaacagtttagcatacttatgtgcccctttcatgtgcaggaaaggagaaaactctgctgagcctgctgctccagccaatagaaggatccttacgccaagaccggaggcatcgagcaatggcaaggtgaatggcctctcaccgactaccaatgaatatgatggaaattcttcaaagtcagatgactaccgagatagtgatggtgaagaagaaagtgagacacttgatcgga

SEQ ID NO: 45866 - DNA, 1698 bp, Oryza sativa
ttaggcgcagcaagcgttcttctcgtcaacgcattaattaccaacagtatgattattcggacacagacacagagggaggaaaggaaggaaaatccgatgcatcagatcctgatgctggttttgatgcagaaaatgatacggaactctcgacatcgagtcaagagcaagaggaagatgaggatgatggccctgaggaacaaaaggacaatagcgacgacaataaaatggatgaggatcatgtaatggtggaaaataaagaagagcaggaggagcagccgcagccacctccactgccaccacagcagcctgtggaaaaaatggaagctcctagtagagagattgaaactgtagggagaacatttctagatttaaatgagcttgcacctggaggtggctttgacgatgggccaagcctgactatgaaagatgaggatatggataacagttaggaaataagttttgtaatacaatcgagtttagtaggcgctgcttggagcaaggtgtaactgcgtgaagtcgtgggccattgccatagatgaatggtccactagtaagatgacacagcaatatctgaacagttttagatgatgctgttacatcgatttacagtgacaaaagaggcgaggttccaccgaggttgtggtgaaaagagcttcaaatgtaacagattgcttgtttgatacttgggggccatccaaagggagtttttcattctattgttgtacactacacgaagggcgcgcatcggtcgctgctgtattatgtccagactgattgatgctgtgttgctgccagatacaaacttgtagcctccatttgtttagctctaggcgcgatactgttgtcgggaaattcttgcaacattcatatggtggaaacttgtaatacacctaagtgctgctcttctcggcatttcttacggctatattccacttgtagaatgtagtttttgagtctaagtaaggcctgtagctcttgtatttatatctgtcaacctgattagattggtacatctgtgtgcagttgatgacctgatactactgagctagtaggatttctccagctaagggtggtttgtttggaagtcgcctttgcgtttatttctgcctgagaagaacggaagatgcagctgaagactctttggagtttgggattaccttcccaagggatttctagagattcttgtttggattccgaaaatttttcatattcgtacactaactaaatagtttcctacaatactcctgtgaaattcccttgtttcaaacggatatataaatttattccttctaattctgaccacatagacaaacaattaataataattatatattattaaaaattgaagatgtttccgtggcctgtcattcgtgtttgagtcggttataaaaattaaagatgttttcgcggttcgtcatctgtgtttaagtcggttttaatctaatgttttggttttaatctatatctcttctcttctatatctatactattataaaaattgaaaatgtttttattatattttggtacgtcatctgtatatgagtcggtttttaagttcgtttgtttgtttttggaaatacaggagcaagcttgtagtaattttgcaagcatacggtatactgcttcgcgcggaacaaatggaggaaacacacacgcacacacaacagaacataagcaagaacaagcaaatcatgggtg

SEQ ID NO: 45867 - DNA, 1519 bp, Oryza sativa
atgttatgcaaatgcatatgtatataggtatatatatgaacaaaatatatttatattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaaatttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtatctgtctataagttcgaaaaccttgtcaaacgtagactcttttttatccattgagtcatatatgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatacagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcatgcttgacaagcggtttaccgagttcgtacatgtatttcacttccgccttttcgattggtgcgactccta

SEQ ID NO: 45868 - DNA, 1782 bp, Oryza sativa
tttaaataaaacgaatgctaaaacattgcaaagaaaaaatcacattgacaacaaaactgtgggatggaggatacgtgctgctggcttcctacagacgcacttaaaagtgccatctgctgtcttggtgtcccactgactctcagagaatcggccattgaagaggaatagctcctatctattgccgcctgtactaatatgaatggcgcttgctcccgcagcaccaagggcaaaacaggaattctcgctctcggtacctgtgtagcaatacgtacaaggtactacatgctctatgtttaacactgcctgccgtagtactaacaagccatccaccatcattcttgtgacccctacatcacgaatctccgagcatctgacggcaaggatagtgggtacatatgtacccgagctcaaatctatgtgtgtgtgtgtgtgtgtgtgtgtgtatatatatatatatatatatatatatatatatatatatatatatatatatatatatatatatatatatatatatatatatgtatgtacccgagctcaaatctgttcatcgtagccactccgattttaaatctgtgttaaaaatttaacaagatagatcgataagggagatggaaaatctgcacgcgagtgcacatatacccttgacccccgatagacacctgtccccggtagtgtaatggtttcgtgtaattgatcattaaaacgtagagtggtcttgtacatctcgatggcgcatatggcgaatgagtggtaggtgtcagcacagagcgatgtggttttgacatttttacccttcagcgcttgaaggtgtaatgatcaccacgccgcttcttgtgttgtttccacagtgcatccactcagatagctaaaggcccacaacaagtgttgtttttttatgccccatcgatgccatcacctaacattactataactcagcaatgcgcgcctgacgccatgcatcgtgtcagccatatatgcgaatttttttcagagaacatggatccgtctcactcggatggatgggtcacaatggctcctgctgatgtatctgcacacaggatacatcactccattgacaagatagatcaaggctccctccatcctaaaatataaagctcaaccactcataacacaaaaccaagaaaacatttaatcacctttttggttggatcaccttgatacatgcaagcaatatgattgaaaggtttgatggtataggatttaaaacaaatcaattctattggaccaagaggtgttaattaatgtatgtatacatgtacgtcttatattatgagacataagagaaaagtggctgtaccttatagttcatactccctcggatgggataggacatctcatcctagattagtttttttgacggagaaagtatactaatttgagttttctgtgttatttttgttataatttatacaagttaaattttaacttgcatatttgtgaagtgatatattacatagaagtattcatctatcacatgtgctttttttgctcagagccagcggaaaatagactactgcttgatgacaaatctgtgagctagatcgatcacgataccatcaatgtcatcgctgttacctggctgcccactcaagggcatctggaaaaggttgcacgtgaaagtcaattcttgatgacagtatttttgtgcagcgacttactacctccgtccaaaatataagtatttttagaaaatacagatttgcactcgggttcatatgtacctacaatctacaccgttgatgtgttccaagattcatg

SEQ ID NO: 45869 - DNA, 15182 bp, Oryza sativa
tacggtctagaaattcttatattaatcggagaaaagaaaaacagagtccatatagaaataaaatttagaaatagttgaaattcggaattaaaaaatgaggaatattagaagaggagactatagtccatatataaatataatttagaaataaccaaaattcagaattaaaaaataaacattatcagaagaagagtatagagtccatataaaaatacaattaagaaataatagaaaattggaattaaaaataaggaatattagaagtagagtatagagtatatatataaatttaaaactaagtaaaattaggaataaacataataaaattaaaagtagagtttagatgtccatataaaaatacaatttacaaattactaaaattcgaaattaaaaaaaacatgggaagaagagtcttaatacaatataggaattcaatttagaagtaactgaaattcgaaattaaaaataaaagaatattgaaagatgagtttagagtccacgtagaaatacaattagaaataataaaatttcagaattaaaaataaataatattagaagaagagcctagagtctatatagaaatacaatttatagttaacgaaaattcggaattaaaaaaataagaaatattgaaagacgagattagagtccatataggaatataatttagaaataacggaaatttgatattaaaaataattaataactaacacatatataaaatataatatgaattacacattagtagtttcataaagttagtacaaaatttaaaattatgttgtcattttaatatattttaataataaattgtgaaaacatatatgctattatatgagagaaaatataatgatgctagccgcgcaatctgcgcgggccaccatgctagttatctataattttataattgattatactataaagttataacccattaactcctaaagcttaacatgcaaagatatcacatcatcatccactaataatcattacatttaaacatcatgcaaacatgctatattatctataactttataatttattatactataaagttataacacattaactcctaacgcttaacatgcaaagataccacatcatcatccactaacaattattatatttaaacatcatgtaaacatgctatattatttataattttatagtttattaaatttttagagctcttgaaatgcaagcatgttaaatcatcatcccacaaaatccacaaaatatttcaatatatatctcccttatttttttataatattctatgtacatatatttcattctcacttagttaatgttatttctttcttctctcattaagctctaccacatcaattgtttttagtgctaaatggttaatctatggcccaaattatctctatcattttcttttctcattaagccatatcaactcaattatttttagtttttagatgattaatatacggtccaaactatctccctatatttattctctcgtaaaatcatatcaccttatttttacatttaaattatcattcaatatactatttaaattaaaattatcataaacaacgttaacttatgtaatcttagttatctagctatgttacacattatttttatttattgttgtcatactaaactcctgtagcaacgcacaaggtttcacctagtgtgtttaaatatatgctcccatcattgtaaaatgtaaagaattttggtcgaatatgatacataatagtaatacgaatctgatctaaaatataagggattttgatcagcattgtttagaaggatagtcgtccttctgttccctcccctcaagtccatgcatgcatgcatgcagcgcagaagcacaactccctttgtgaaaatcagaaaaacaagaggtttgttaacgaaatccacgctcttacagcgtattctggtcggacgggcaagttgcagtacgcaggtatgagtaggacaaaatctctctcgaaggcaaatactacatatatagctgaagccttccttgagtttccttcataaggatttgcagagatgctcttgttctacacatcacatttgcgtcccgcactaagagcatctctaatagagaccatagactcagtcctaatcaattttcgagggttaagatataaaaactagattcaacaccgaccctagtaccctactaaagctcccaaagtgagaagaccccccgatcctcctcccaagcccctagtcctggggctccgagtacggcccccatcgacttatttttctagcgtgaaccaaaatttcacttcgcgtgatctagtctcacccgcacggcactatgacctggatctcctccggcaatcgccgttgactccccccacccacctccgccaagatcgccccaaaaaggtgaggtttttcctacctttgttgcagtcgtctacagggcctccgcttgcacgcctggcctccgcctgcatgctggtcgttcacacgctcggccatcgtccacctggccacacgccgcccgcccgcccacacgctggtcgctggtcgttcttatataaatttcaaatgcacaaactgcacaaagattttgcataaaatagtttattgaggaaactctattcattccttaaggggatgtcccttcgtttttacacattgcttaaaaagttataaaaaattagtaggatcaatatgtgatatgtcactccacaaacatgtatgttcaaatttaacttatacaattaggaaaaaaattcatagaaacgcgtaattcgtggttaaatttattatttttgttttgagttgtacaagtcgaattttaatttacgtgtttgtgaaaagaatatatctatcttagaatgtttttattttttatgacattttaaacgtcatgcacagtatgagaggatgccccttcgaggggggaaataatttacttccagttcattgctcaatttcatcggcaagcaatctcactttcaaagaatgacagtcacaaaaatattgctactagtaacaaccgcaattactgagcagctgacaatacatacagttaattaatcacaaaatactacaaatagaagcataaatatgcgggggttaatataactaattaacttgtgggattaattaattgcttttctatggattgggaacctatcctctaagcacgaaaaacggaacaatccattagcacgtgattaattaaatattagctaatttttttaaaaaaatggatcaatgtgatttttttaaacaactttcgtataaaaacttttttaaaaagcgcaccttgaaaaacgtgcacgcggaacacgagagagatgagttgggaagactgaacaaagaacacagccctagtgatatttgtgatcgatcacaatggcacgtagaacacctcccagcgcagtatgagtatgacgacggccggagtgcaggctccgatggcgatgaccaggtacgccagccaccgctccgtggggaggacggtgaggtagacggacgtcatgagggagacgatcatggcgaggcaggcgacgacggtgaggcggtgtccccaggtgagctggtcgagcttgaacttgacggggtccctccacgcccagatgaagcagaagacgacgacgatggcgctgcacatggcgacggtgttggacaccacgaagatcttgaacggcgccctgtcggcgtggatggcgagccccgtgttctggttgtagccgccgggcatggtgaatgtggcggcgaaggtgacggtggcgatgagggtggccacgagggtgtaggtgccgacgctgagctcgaagtactcgtcgttgctgccggagcccggccgccggctgcgcagcgactggtacgtcgccaccggcggcagctgctggttcttgcaccgccgcgactcgtacttcttgagcttctcccagaggtagacgacgtaggcgtccatctcgccgccggcgacgcgctcctccacgaggctgcgcgccgagtggccttcgcggttgaggaggcaggggtcgacgcgggggtccctgagcagcatcagcgccgacttgatgcgggccatcttcgcggcgaggtggagcggcgtgtcgccggagttgtcgccgcggttcaccacctcggcggggcggacgcggccgaggaggcaccggagcgcgtccaccttgccgctcgacaccgcgacgtgcacggcgttccggccctcccggtccagcatctccgccgcgtcggggctgtgccggagcagctccgccgccgctgccgtcgagccgtagtaggccgcgacgtggagcgccgactgctgccgctcgttgcggcggtgggcgaggtcgggcttgtggtcgagcagcatccgcaccatgcgcttgtcgttcttctgcgccgcgaagtgcagcgccgtgttgccgacggcgtccgtcaggtcgatcagccccggcgccgtcttcatcagcaatatctccaccacccctgctccacacacaaacacactcaaatctcttcaaatttgattcaaatgcctcaaaaatctattcacctttttttttaaaagtatccatatacccctctaaactaacgatggaagacggtgatctaacactttaaaactggactttcaatcccaaactttgtaatatcattcattatttaccgctaagatagttttgaaaatcgcaagcttaaacaattactcccagtatcccataatatagcaactagcaatctaggataggatgtgacgtttcatataatgaatctggacaggcctcctgactgattcattagaccataaaactaattatccggttctaggttgctaatattaaaggacggagggagtatgtagtttttgaataattaataaaacatatttacatatcatcaatcattggttattaaatttatacttatataatgatgttatgtgtaagagcgtaagcatggtaagaaagcaaagtttaagtgaaggtttgaacatataaatgttactccctccgtttcatcatgtaggtcattctaacatttaccacattcatattgagatatatgtctagattcattaacattcaggggttggatgtggaaaaaaaaatattgagtactggaattcatcaaaaagagtactctttgaattaatttgagcaaaatttcttcttacgggtgtggccgccgaggacggcctggtggagggcggtgccgctgacgttgtcggcggtgacgaacttctcggggacccatggctggtcgaggatcttgtcgacgacgtcggcgaggccctcgcgggcggcgatgtgcagcggcgtctgcatgtccacgttgggcgtgtgcccgcagttgggctccgcctccagcagccgcagcgccaccgcgctccgccgctgcttcaccgcctcgtgcagcggcgtgttccgtgtcttgttcatcatcatcagtggctcctcctacatacatacatgacgtacatttttcgcataaatattatagtcttaaatcttaatccaaaattgtatggtcaaaatatactttatatttccctacacggagggagagtaacgtaattatcaactcgcaaagcactcgtaggagcaagaatgtatttatttgaaaagaatatacttcattcgtcttgaaatataaggctctatagctctgtaaaaaagggaatcgacatttgtacaactaaaatgacaaaatatatggtattactaaattcattttttgaaagaattttcacaccatgttaattttatggttgtttatatttttaaacagataaaagtatatcacaatgagtgatgtcttttagtgattaccaaaaggtactaacacacattataatgctgaatttgacagctctcgatttcttacatatgagatttataaaaagtatcaaattctacattgcaaaaaaatggcaactctcttgtcacaattatataccggatggtcgaatttcttatattcaaccagggttcaaaattctaaaacgaaatttctgaaacttcgagtctattggaccccacacctagaaaactatttggcctaaaattttcaggttatttacaatttttttttgtgaatttagaaaattttatttatatttgacaaatcgttgtgcaaattttaaatagtgtcaaaacgaaatacccgaaatttcagttgtatcggtacccaacagaaatagcctaactgaaatagtatcaaaccctgtattcaaccggtgacgacgaattaaagctagaagaaagaaaacggacggatacctccggccaacaaggcccagccatggtgatgaaggtgatgagcatgtcggcgacggccatcttgccggccctggcggcgaggtgcagcggcgtgtccccctggtcgttcctggcgacgaggaggtcgccgtgctcggcggcggcggcctcggcgaacgcgacgcgcccgagcccggcggcgatgtgcagcgccgtgttcccctgcggcgtcgtcgagttgaggatcttgccgccgccctgctcctcccccagcagcgccgccaggctcgccgtgttcccctgcaccgccgccttgtgcagccgtggatccatatatgcttcttatttcctctaccttctacctaccttagctacctagctagagctagcctctgtacagtacagtgatcactcctctctctgaatgtctgaatgtctcgtgtattcttctgtcagtgtgtgtatgatgagatcgatcatggaggtgatggtgatgcagcaatggcgatgctgatcgagtagttgtaacttgtatgtactccatgtactatgtaggagtagtgtggatggattctttgcttgtttgtggtgggcttgtgcagttgtgccctaccctgccatggaagctaggttcatggtgctttacttgctaaaccgaatgtgctaaatgctccattagaaaatatatatgcagtctgatgtgctctgtctccagctcctgccacagcatgctttactggccgtcatgcatgtagcacaaggaatcaaagctttaagatggatgtggatatatattacaatgtttgattactctaatttcctcctgaaattataaagccatgcgataggtttggaggcagctttgccaaccatatgatccgcattggtgatgacgacaaaatcattgaagaattaattttgatttttcaactatccatataaagaggatacgagattgagagagaagtaaaatgcaattaacttagtagtagttgttaactgacttcagttagagagaatcacaactttgtctcaagggtcaagcgtcatgtggacatggcaacgacctctgcctcgctggccttgacgctttgtgcatgacttcatgtcgctttgttggtgggttaattatgtgattgtgcaagagtggataagtgggttttacgggttttactttgttgaggtataggaaatcaattaaatagccaacaaaataaccaatttatcaatgcatacggccacatcctaatctttttgcgaaactttttgatatgccggtgcacacccggaacccctgggtctatctttgctcgatgagatcccatggacagaagaaaatacaagagaagagtcttatatacaatattatttccatggtgttgttcatataaatcgttacagtatcatacggggatttacccaaccatgccgtcttgatatttcatgtggttgattaccgttttcagtaattgacaactaattcagtgattcaagtggttgagtaaaccatttttctactaataaaaatagaagggttttttcttccgtcgacaagtaaatataacacggtaccatatgatctaatactaatactagtagaaacttgatatatctatcgataggtaagacaaatttgtctatcaatagtggatctcagctcctttggaacacaaggttttgttgagttttttttttaaaaaaaatcatctaattaaagttcaccctttttagaggagtcgaggccggaacttcttggtaactcgtaatagtaattataacacgataccatatgttctaatactaacagtagtaggtacctgttatatggatcaatagataacacaaatgaacacaacaaacgtggatcttggttcctttggaacataagattttgttcgtttttacaaaaatcctctaaaacctatcctttccaaaggaggcgagcccaaggattgcaactagagatggcaatggtgaattcaccgtcagagatcatgcctgcgtccccgtcaccgcggtgaaaatatttcaccgtccccgcccccgtcaaccacgacggagctataatttctccagccccgatcaccacgcggtgaatttttctccgtggtgaacccgtccccggttaaacagcatattcacagccatggtcggtagatggtggcggcgacagcggctcccggtggcgcagcgacgacggttgctgcaggcgcggcgacgacggctgctgcaggctagcggcgcgtcaacggcggctcccggtgaagacggctgcaggcgccgcgccggcccggcggctcgtcgacgaaggcggccggcaacggcggcttcagtctcccggcgaacggcggtgcggcgaacggtggctcccgggctgccggcggactggcgaatggcggcggcgcggcatgcgtgactcgggtggagggctggaggctgctgtggatctagatgggtggaggatttggctttgacctgttgacttagggttagattatatatatatgcctactaaatgggcttcaatattatgggccaatacatctaaaaagtctagaattcctcccttgtacattacagtcgggtcaccgtgggggccggggacggggaatggttcaccgtccccgcccccgtcatccccgatggtgagaggtttttaaccattctattccccatggtgagtagatattaaccatccccgtcacctaataggtgaattcaccacggggaaacggtgaacgggtccccattgccatctctaattgcaactccagttcaaaattttggacccccggggggggcaagtgattattttggctaaaattttcggtttttctcgatttttttaatttgatcaaaatttagtcaaattcagtaaaattaggctaaaatttcaaaaaaatctgtccaaaaagtgttgaaaatcctgaaattttcggtagaaacgaaatgagcgaaatttcggacatactagcttgctaagatactatgccacaaaagttataaggtttattatggttgaaacagtggtgttttagcaaactatgaattcatttgtatggaactccagtaacatacataccctcttttgagcattccatagaattcctttcacacacatgtgcagcttgactagtaacgtgtacaactccgtattaattgcacactgaacattgtggaatactccactatatttcatcaggacaaaggtgtgtataatactgttttgttatcacaaaacaaagaaaatttaatacctaattaaaaagtcctatcttgttaatttacatgatcttttgattcccataaacacgtacggatcataacccccaaaattatccaaattatcccaagaacaaaagctgcacaaacaagatcaaatatatcacatcacaaatccataaataattaaaaacgagctgacaaattcccagaagcaatttttccttgccaaaaaaaatcactccgaccatcatcagctcagagtgcaagcaacgctcccatcagcagcagcgccgccatcgtcgccgcggcggccgggacgacggcggcggcggcgccgccgctcggcgacgagcccggcggcggcgaggtccccggcgcggagctcttgatcgggcacgcgtagccgcactccgccgggtcgaccacccggtagacgcccttgctggtgagcaggtagacgtcgccggcgttgtcctcgccgaaggagaagatgtagcccagcgacggcagcgtgctcctcgccgcggcggcgtcgcaggggatcggcgacctcccggagcaggcgaacggcagcggcgtgacgtcgtacgcgccgctgcccggcggcgactcgaggcccgcccaggcggactgggcgtagaggtcggcgtagaggtagcggccggcgaggcaggggtcggtgccggagcggtagacgtagccgccggtgatggaggcagagccgacgttgttgttgacggcgctgtgggcgtagcccatcaccggcgggatggcgtcgatgtcggcggcggaggtgttgccgccggggctcgccagcggcaggtacgccgtcgtgccctccagcacccgccacccgtagttcccgccctttatcaccaggtcaacctcctcgtacgacgactgttttcaaattccacacaaattcatcaactatatggcaaatttggaccaccaaaaccattttgttaaaattaaaatggactaaattaatcccagtgacatggtatcgctggagaaaaatactactccctccgtcctataatatagcaatctaaaattggatgggacatttcatagtacaacgaatctgaacatgtatctggaccggttctaggttgttatattatgggacggtgagagtattagaagagagagcagtataaaaaaaagctatcactaggtcaatctccttggtgttgcctatttaaacttacacaaaatcatcacaattatatggcaaatttagggggaaatacaaaacaataatttcttaaaatggacgaaattaatcatgtttgcttaaatatacgagacatggtatcgctgaaaaagaatagtaccagtagggaccatcgtaaaaatctttgtaccgatatatgtcctattactaatagagatcgccgtaaaatttgtcttaaaggaagggaatgtggcacctgtccgacgtcggcgcagtagaggtcagagggcttgccggagtcgaagctgcaccgccacgggttcttgaagccgagggcgaaaacctccggcgcaaacttggagtcagtggagaaggggttgtccttggggatgacatagtttccccagcctgcagtgctattgccagctgcagagtttgtaacaggaagatcggtcaatcatcttgtcaggggttgttgcaactcaatttcagaactcaccaaaatatgaacaaatttctgaattcaggtactatcctgaacagtgaattagttgaaagttgcttttgggggcatttgatttgattatgaacaaattccagaggaatagagctaattcacacactatccttttttttgaacttaattcacacactatcctgaacagttctgaataggattgcacctgaagcataattcgtttgaaataaaatgaattttattttgttcaaatgttgctttttttttgggggggggggggaggggagggggggcatttgatttgaatacgaacaaagctaattgacaaactatcctgaacaatgttacctgtcaggactggaccttaagttcaattcgctgggggaaaaaagaaatgaatttttagttgaaaggttgctctttttctgggcaatttgatcgcaaaatgggggagaatttgggattacttggcaatgcgttgacgtcgatgcggatgatcttgccgagcagcgacttcttgttctgcgcgaagttccacgggtcgccgacgctgccgccgtcgcccatcatcaagtagaggtagccgtcggccttgctgaagaggatctgcccgccgtggtgcgtcgtgaacggcagccccatcgtcatgatcctcctcacctccgccgggttcgccgccgtcgcctgtgacatcaaccgctattgagttacatgcatcgaccaatttaacccaaatacctaagctgatgagaaaagacggacaattcacttcatatccaaacacttccccctcaaatcttaagtcaggattcaaactcgtgatgagaaaagacggacaatttactttatattcaaacattaccccctcaagtctcaagtcaggattcgaactcaaaacttttggctctgatactactattgagttgcatgcactgactagttaacccaaaagctaaagctgatgaggaaaaaataacaattcactttatattcaaacacttccctctcaagtcttaagtcgatatacgaattcgagaattctggctctgataccgtgttgagttgaatgaaccgatcaatttaaacaaaaagattaagctgataaggaaagacgaacaaaccaccaccgctggcgagcgagaagagctgggtgtgcgtaccgtcgccggcgagccggaggaggcgttggcggtgtactcggcgatgacggtctggaactggcacggctgggcgccattgtcggcggtgagcttggaagggtcgcagccgacgtcggagttgcaggcgcagcggccggagcaggaggcggactgcgtcttgtcgcagctgtaggagacgaagaagcggccgttcttggcgaactccgggtggaacgcgaggccgaggaggccgaactcgttgtcgaagtggacctcgtcggtgatgtccaggaacggcgtcgccgcgtccacctgcagcggcttgccggagccctgcgccggcacggtggcgacgaacaccttgccggcctggttgttgaggaacacgcggttcgagccgtccgggtgcggcgccatgttcaggtacgacccgttgccgaggcgctccaggcacatgccgctcgccggcggcgcgacgcggctcgcgtcgaacgccgcggactcgccgtcgaagcacggcgcgccgccgccgcccggcgcgccgcccagcgcggtgcagaagtcgcccgacgactgccacacgtcggtcagcgtcggcgccgccgcgccgccgcggggcggctggaacggcgagcccgggatgcgcacggccttgcaggtgtcccacaccgtcgtgcagtagtccgtcgccgccgccgccgccgccttgccgccgctgagccggctcgcgacgccggtggagttgcacagccgcggcaccgtccgggggctcgtcgtgacggtgaacagctcgccggcgtacgggttgcatctctgcagcagccggcgacctcatcaaaccaagaaatcaaatctccatggaaattccggcgaccaagcgaaggagtcatcataccgcgcagaggatggacttgacgagttcgccgcacggcgtgccggagatgttcatggcggcgaactgcctctgcacggcggcgtcgtccgtcgagttgcagcaggccgtgccattgtagccgcagaaggtgagcgatccgttcaccgtcctcgggaacgctgctccgcggccaccatgatccaaaccatcagttgcaattcacaattcaatcacaaagaaagacaaattgcaagaacatcatacttgaatccatgcacaattgcgcgcaatggccatcccggacggcgaggagaagcacggcggcgatggcgaagagtagtaccgccccggtggacgacgccgacggcgccatggtggattcagggaaggagaaggtgtgaagatgctcagaggcagaaatggtggacaactagtttgcacttatatactagtatataagtagaaggcagccattgaccaatgcaagatcaagaaattcaagatttggtagtaaaagaaggcaaacaagtggtaatttttgggtagaattaaattctgatttctgaaagttcacgtgttggatggtgacaactttctgtacacattatatatcataagatgagcattagcatctggtcatgcactccaatttgcaattaattaaacaaggaagtcgcatggagagagagcagacaaatgtgcttgtttggattgtgaaagtgacaaggtgaaatcgacagcaaatttgtcaacggcctatttgaagtatggagttcagagaatttgctcactgcaaatacccaatgccccaatcagctgaatattttcactcttgaacctgaagatcccagatccatcggtttcagactttcagtgaactacaaactacaatattgtattgtttttttatgccatcaggaaataaagcatgcagtagcatcaaagctacatgtaacttgtaaaatcttcatgtcagagcaagaaggtaaagttggtgttactctttaccatctattgtcataacaactaacaagtggtattagagattcagaacatcttgacagtttttcttttctcgaatatgcagcagaactgcatatcattgcattaagaaggaacatcttggacagtcaactgggacatgatagttcttcagtggccttgtaaaccctcttcatcactgtactaattgaacaacaaagctcctggattttcttaaggttggttgtcaatttacgaccagatagttcaaagcctgtctaaagagacttacctaattgcaatttcctttttcatacaggaccattgacacaagtggggatatatcaatagatcatgaaggtccaaatgtaacagaaaaaaatgattagacagcaacagttgaccttggaaagatatgaaagctttgagtcgttgtagtttggattaattaaaggcacaggaaggtaggttactttggatacttgaaatttgtgcttcttttaaggcccccaagggaagatttttagaagaaaattgtttacatgaggatactgaagtcaaagagagtgagcaagtgggtttgtattttgacactggataagagtactcacatggatcaatggacttataaacagtgggagatatctcacactggttaggggaaaacccagctatgatcactcagtagtagtggagctgaagttactactaattattagtatcatatctgacagtgattttggtctcaaaagttacaaatgacaaagttatgcatgctgcctcttctgtcaccaaatcatcactccaagcctttatgtgcctatatgtaatatattatgatatagggataaattttataacctttttacaatgttcaaataacaatgccttttgagggaaaaaactgaccctgggtggtaggcaagtccaaaataatttttaagtgaatcttttgagagcttcgaaaaggttagatgaaacttaaggaaaatgatatgtgaaaggattttttttccctacatgcaaaattatacaaaaggagttgactatgggcatatggattgatgtgcccagaaca

SEQ ID NO: 45870 - DNA, 908 bp, Oryza sativa
acaaataatacatactccccccgtattttaatgtatgacgccgttgacttttttacaaatgtttgacctttcgtcttatttaaaaaatttatgtaattataatttattttattgtgacttgatttatcatcaaatgttctttaaacacgacataagtatttttatatttgcataaaatttttaaataagacgagtggtcaaatgttggttaaaaagtcaacggcgtcatacattaaaatatggagggagtacttcttatcctacgatttaccaattatactggattgacatacctcatatcctacaatatgttttcgtacatgataaggaaatatagacattatggaaaatgtccttacgggctggagactaccagagtcctactcgaaaaggaccgggactgttctatatcgtgccggtttcattgtctacgagttctacttggagactaaggcaactcacggtataaaaggcacacccccagaggggtttaggatcatcgaatcatagcgtcaacacacccaccgtagtctacaaagccgaaggactcaagccgaagccgctgggagatctcgtcgaataatctcgacagggatctatgtagcgcccgttccgtcatggcgcctagcgggaaaaattatctcttaaaaaccctaattgtgaaatttgtttctttgcttgttgtctagtgtccgtgccatctcagatctcaaatccccgatctatcgtcaagttcaaatccgaatccaaatctttccaaatcaaattcctccgcaaaagtctattttgcctcccccggggtcgatgggccgaatttctctcggcccatcttcccctctccctcggccctctcccctcccccagcgcgctccctctccccctctccctccaatccgctccgccccgca

SEQ ID NO: 45871 - DNA, 12866 bp, Oryza sativa
tggtcgccgccgccgccgtcaccctctgccgcgccagcccgcgcctgtcgcccgtgtcgtcgcgccgctccaaaccgccccgccgtcatcgccgtcgtcatcgcctcggtcccgccactcccgcgctagcctccaacggacggaggcagagcctccctcctccctctgccgcgacgcccccgctccctcctccttttcccgaagaggcaaggggacaagcccccttttctctccctcttttcccctttttcctcccgccggcgtcatcctcctccctcctccctgtcgccgctttggccgcgaccgccgagcgctagccctctcctttgaccgccctaagtcggttcccaaaccgacattgccatcctataaacccgagctccccccctttttcctttcctctcccattcacctccgcgccattgccgcccctctgtttcgccgtcgccgttcgtcgttgcgcgtgtcggaggagccggcacgagcaaggacgtggaaggggacttcggccgcgccctctccttcctcttccccggcccgaggccggagagattactcccgcgccgtcggcctctcgtcacagcaccccgacccgcacggtagtgcctctctccgttcttcctcctcgctccatctcctccccttagacacgggtagtagcacgagtagcctccccgtagctagccggcgccgccccgaccgttgccgtcgctcgccgtgtactcgccgccgttgccgcccgagctccgtagcacccgctcgtcgccggcctcgctcggcgtagctccgcccaatccgacgctagcatcggatttccgtggccgcgtagatgctctcaccgccgggaatcggcccttcgtgacctcgtcgccgtttccctcttccctccccgccggttgccgccgccgcgattcgccgccgtcaagcttcctccggcgaatccgagccgttggctcgtttcccctcgtctcgtgcaaccacccggtgtgctcgctttcgcctgtatcgccgtggttcgctccgccgctcgccgctatcgtccgtcgtccgttccggccggtgtcgtcgtctacctcccgccggcccgcgtggcagccacgtaggcgccacgtcggtgccagctcagccgaggtcgggacgggccgaccccggtcagcccctcccgtgagcgcgttccaccgcgagccgtgaggctgcgcgtgggcccgcgcgcatgcaccgcgttcctcccccgcccgcgcgcgtacgccgcgtgctcgctccgcacagtgagccgtgtcaccgacaagcgggtcccacccgggaccgcgcgcggtgagcccggtccaccggctctctctctcctccctcccgcgcacgcgcgcgtcttgggccgccttgggccggtcggcccatttagctcggccggtccgctccatttcccttgggccgcgccctagccgcccgagaaaagtctattttccctccctcttttcttttcttttcttttcttttccaaaaaggatttaattaaatccttttcctttagacaaaaatccaataatcttagaaattcaatatcttcccaaccgtaaatccgtttgactccgttcaacttccaaaattcctcaaatctcgagatctatctaatggcacgcttagaggtcatcaatagggctttattttttttttgccgtttgttgagttgccccgcttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttgttgcatttgatctttcatttgttaattgttatgtcatgtccccttgtaaccatctagttgcgtctcgatattcgtgcaccctgtgcgggtatcgacggacgccttcaaacttaaaaatctgattaacaacttgggtaaaactagggttttacaaaagacttggaaaacccgacacctgggtcggtgcttgcgaactaaatgaatttccaaaaccacggaccggggaacgtactgggagtacggtttcccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggccgatccccacgggctgggtgatccgggttagtaatgtcgtgtgggtaaagtgtaccccctctgcagaggttaacaaactgttcgaacagccgtgcccacggtcatgggcggatgtgaagtgattcctagcgtagttttgtttgactactgcttgtgaaattgctgttgtggaaaggggttcgatgtttgaaaaatctgcagctgatgggatcagctaggcccgggtggccgtttgaaagttgttggcccgggtggccgtttgaaaagctgttggccgggtgccaaccttgtttcaattctaaagactgatacattgcacatactccgaccggacgagacgcactgtctcacccgtgtcgtttgagaagcactcacttagttgtttttagaaaagagttcaaataaaatcaattgcaaaaacaacagcctttctttgaagcctgtattaaacacttatttcccatagcttgctgagtactcccgtactcacccttgctttatataaataatcccccccagttgctgaagaagatgaagcggatcctgctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacttgtgttgctgtgataatccgtcttcctgtgataccagcactgttttctgggactggtatcgattaacaggttaatttggagcgtcacgggctagttccggtcggtactagttcggggcgtgacaatctagtcgttatcaacaagttcatctgttctctttgtactctatggttttctatatcaatcttatataaactggattagggctattaccttacgagggggttgaaccagtataatcctggtctcttttctgttttgatgacgtatcgtgtagaatctcgtaccaacgtactccaatactccatttgtccggtctatgggtatccccggttgacaaatttatcaaaagaaatttatgccttttgtattatatgttctttcaatattattttacatagcaacaattcacgactcagaattgcagtcatttaaaacttaaaattttctagtgcaaatcatacggcatacattatgtttatttgggatattaaaaaaacaaaaaaaaagatttatgagactggcacgggacgaagatgtaatccattttcattatttaaaaaaacaaaaaacagattttttttaaaattaaatggtctcaaccattggttatatccatgcatgcacgcatatatatacatgcatattttactaagggtaattattactttccttgttagataaatgcatttgtggaaggagaaaaaatatttttaattggaaaataaatcacaaaacaatcatcggctaggattttattatgttggagcacgttaaaaagagtcaattttcttttacgaactagaagattatccttgcagagttctcgggaaacctttactactagggtctgggggtaaaggaggggacgttgtgctctctatcataggcagtgttccgctgcatattgcagctgctgcaacgcagccagcatagctgctgcgatgacacaaactactgtgctgcgaggtggttgtgccacagctgcagtagttgggcgaagaataccagtgacattccgaagacaagtcagctctatcttgcccaatgcagtggttcacctctctgcccgaattagaagtttatctgggacaacaaagcacctctcaaggttcagtctttgcctggcttcttgctaaagatcggcttccaacgaaaaagagccttcataagaaaaacatcgtgtctgcccccaactgtgacctctgcaatttggctgaggaaacggtttcgcacatgtgcttccactgcccccttgctgatgccttctggaataaccttcgcatttatatcaacatctcgttgacgagcgagctggcgcatcttcctctacctcctcaaatccccagcaaacactttcgggtgtaatacctgctatgcttctggtgtctatggaatcatcgttatggggtggtctttaggcataaggaagcttccctatgttatgtatatgctatgtgtgtttcagaggcctctctctgggctgagcggtttaaattagatgatagccatgtaatttcatcctggaaggtcctcttctcttccacccttcactctcttaatatgtaataagataaactgaactatttttcccctcttttctgctttaatgaattcaggtggggaagctctcccccctgagagcaggtacaatagcaggctataagccagctacaaacatattttaagaagataaatgaggagagagaagagcaacgggctatagatttgtagtcagctgtagcacggactccaagacgcagtgtgtgtgtgacaggtgggaccatgtattaatagtgtagtatgtaactattgtatgaatgagctattagattggctacagatgaattggagctagtagttggctatactattaaacttgctctgatgaattttcaaaaaaacaaacagctgcagtagtgcagccgcacatgctcatggtttcaacaaggaaaggtttttatcagagtttatgattgctctcttaggggtttgaaaacaactttatcattgcttgaactaagagagtgatgcaaagagagatagatagcaacatcttaactggcgcaattaaaaataaattattgaacggattgttgctacaaattatctacttgattatagtatagattaaatattttgataaatgaacttaacaaataacttaaaacaagcgatccaagaatgcaacaaaaatatttttaaaaaatgtgaagcaaataatccattttaatattctgacaaaattctagaaagaaaagaagaggggtgataaaaatgaggagcaaattatctgacccgatccactccaaatccgtcaaaaacgaggatatggtatggtcttacataatccggcggatgtggatagtacactgcggattttgatgtgaatatggtatctctaaaatccagcagacgcagattatccgacatttctatcgaattatccgataggccgtttgtcggacaattcgaaattgtcaatccacaactccattttgtttgttgcatactgcaagagatggcacacatagactccttagagctcatctcacacatgcttaactgtttttttatattatagatatacatatattcatattatttagcacttaagcatataagttattcggatggatgcttcattttaattatattgttgtccgttgtatcgctaacttgatgttatattgattgcatatacatgttataactgacaatttcaatatattttcaaaccgaatccacaccaataccatatcatttacgacgtccaaaacaatctgctctgcattcacttcgaatcctcttaatgttgaatagtcccacattggttatggaagggtaaaggacctaagatataagtgggggagcccctcacctcaatggctagcttttgggatgggaaagaccctttacgatcctacaattggtgtcagagccaggctaggttaacatctctggtccgatggacacagtgtgtgaaggcctgatggactgtgcgtgcctgcggggcccgtatacctgatggaccgtgggccggtggggcccggatacggtgaaggggctgagggacaccaatgtgtgaagggggagaagggggagattggggatgtggaagggcaaaggacctaagatataagtggggaagcccctcaccttaatggcgatataagtggagaaaccaatcaccttaatggctagcttttgagggacaccaatgtgtgaagggggagaaagaggagattggggatgtggaaggacaaatgacctaagatataagtggaggagcccctcaccttaatgactagcttttgagatgggaaagaccttttacgatcctacacttaaaacatatgggttgtgatatggtattatcactatccattcgaatccgttttgtttttattcctataaagaaaccacaggggaagagtgtgtaacacaggaactgcgtaagataagatagagcttgtagcaagactacaaaggccttacgctgacacgtatttagctgaaaactatctaagctaaccttcaagtttcaaccacgaaacagtcagagcattccaagtcgctgcagcccttggatttgcacacaaacccatcgggccctggtggatttcagtaaaagctggaccattgtttcccttaattatgcttatgcgtgttggatttcagtaaaagctagacgcttcacagcgtcactacctcactcatttagctccttccccacttgaatccatgcgctacacttcacttctggttgcgtcatgttcgacacgatcgatatcgatcgagttgaggcgcgatgctggccatgcgttctcacggacgaggtccacgcagagatgatgaccatgcatatgccacgtagtcacttggctcccttaaaacgttgaaatttcagatgtttttcgtaaaatcactatgttcctgtagtaattaacaagtagcagcctagcagggagattaagctgtagcagagcaatctcaattctcatttctctaactagaatggtttccctaatattgaataatatgtccacaacgaataaaagattacgtgagaatatatgtactcctttaaaagactctaatggtgatggcagtaaatttgctacccaactgttcatattgtttttgcagtttttacaaattgtcccctgatatttattaatattgtgaaatgatccactatttagttcaaacaaatggataacatataatcaaatgagcaaacaagtgatattaagatatttgataaaaaaaatattttgctatggcatattatgattcttctgttaatagcaaaatatgggtattttgctagtaagcatgaaatgaggaaagagaagaaaaggacatatttatacacactatataagcgagaaatgcgtagttttaaaaaagcatatcaaaatagtaatgtttgtattagcggagtattaatgtgacgtggatgattaaaaaatattttactaatagtatgcaactatttaacatataaataacgatagaacgttctcttgaaagtttaaaaacaactctcgtcattagatgaaagatctttcttatttgactttacatgaagagagccgacagttcacaaacgcactaccacatacgtattgggacatcccataaaaaatcaacctagtactgaatatgacatatcctactactataaatctgaatatatctctatctagatttattatattagaatgtgtcacatccagtcctatatgcctttttttgggatggaggttgttcgcattggggaaacctgtttacacgtacaggtacgcgcaaattaaacaacatgatgcgcagtactccctccgtccaaaaatataagcatttttagcatagtgacaagtcaaatatttttaactttaatcattaatagaaaaaaataaaaaagataaattgattttactagatttatcattaaataaactatcataacatgtaatattttttatttaaaacatcatacttttatagatattgttagtgaaagtagcatatcagaaaccatgtcaagatttaaaaatatttatattttgggatggagtgagtagtatttagcaggacaagttcaggtgggaaggaagtcaattaaaggaccgaggtacaacgtgcaccagagcggcctcccaattccgaaacaaccgagccagcagtaaaatcagtgaacttcggtgatgtcgaccgtcgacgaagcgcgcgctcgcgttcagaccaatgtcaacctcgtcaatgaagctggcttaatatatgacaattaatttttttttcttaatcttcaactaacagtattatttatttatttatttactcagctaaataatgccatcaaaagtactttaagcatttgtctatttgcaacaatatttttatataagtcaaatgaattaaaaaggacaaccgaggtagtatgtcgtcataagcagcactatcatctactcctaactggagtatttatatgggtatgacagccggcaacattagcaagtagagcaacgaggctagagtttagctaccatgttagaaatggctaccactaccctgtgcctgcagggtgcggccctcgtcgtcttgatcgtctgcctggcgccggtggcaccagcgtgggctcagcagccggcgggctgccccgacaagtgcgggaacaccagcatcccctacccattcggcattggctcccgctgtgcccgcgacttcaacttccggctcgtttgcaaccacgcctactcgcctccgcgcctcttcgtgtctgaagtcgagctggttagcctgtccctcgacggcgaggcccgggccctcatcaacgccagaaactattgcagcgacggcacaacctacatcagttacaatgctttgaggagggacagccagggccagctgccgttgtctgatgtgtctttcggccgtagcaccgcctaccgcttctccgcggcgaggaacaggttcgtcgtgctcggttgccccgtcctcggttacctggttgacgccgaggagtactatgtcagcggctgcatatccatgtgccgcaagtcgcaagccggtaatgatcacctggtatggctgccagaacaccatacctcggcctctcaacttctacaagccttacatcctcagcttgaataagtcggcagaggagaaccgcgtggaacccatctaccatcgcctcaactcgacggcatgcaattacatgttcctggtggaggacaagtggatcgacaccacgtacagctatcgcgcctacttcaaccgaaccgacgacttcgacgtgcccgtcgtgctcgactgggcgattcggaacgtccgcaactgcagggtcgccaagcgcaacgccaccaagtacgcgtgccggagcgagtggagcgagtgcttcgacgccagcgacggcgtcggataccggtgcaggtgctccaatggctaccagggtaacccctacctcgacagcggatgcacaggtaatcattttaacccaatcaactgttacttgtctctatggctcccatcgtttggttattcacggaataaaccaaacggcatatttgtaaacgaaaaataatttgtaaataaaacttttatgtccgtgtttttaacactttaaaagcaaagactgaaaaataaacttcgacgaaaaaacctcaaaatcaactttaaatttaaggttataaattcaaattttaactaacaatcataaacataagtgaaaagatgggactgtatattttcttggatatataatgctgcagtctgatcagtttgatgatttttctgggcaaacggaagacatcgacgagtgccaagacaaagagaaatacggatgctacggagactgcacaaatacgataggagggtatacttgcttatgccctcgggggactattggaaatgtccacgagaagaatgtttgccgccctaaggacaagttcacgtttgctctcaaggctgttacaggtaattaatgatcgaactaacccatcatgtatgcaattatcttaactttcaatggttttagtctgcaatttcttcctaaaattagcctatgtatatgcaacgttatgattaggggttggcctcggcgtgttcatgtcggtgttcatggcattctggctccgccttaggcttcagaagaggaaactcatcagaacgaggcaaaagttctttgagcaaaacggtggaatctttctgcaacagcagatgcgttcctatggtggcgctggcggtggagtgggtgggttcaagattttctccacggaagaactcaagaatgcgaccaacaacttcgcagttgatcgcattcttggtcatggagggcatggcattgtttacaaaggcgtcctggaggacaacacggtggtggccatcaagaagtcaaagatgatggaggaggcccaaaccaaggagtttgcaagagaaatgttcatcctctcccagatcaaccatcgaaacgtcgtcaagctgcttggatgttgccttgaagttgaagtgcctatgttggtctatgaatttgtctcaaacggtaccttctaccactacatccatggcaaagaccccgaagttgacatagcacttgatacccgtcttcggatagcggcagagtctgccgaggcgctctcctacatgcattcgtcggcttcaccaccaatcctccatggtgatgtcaagacagcaaacatcctgcttgatgataagttcaacgccaaagtttcagattttggagcatcaaaactagcaccaactgatgaggctgagattgcaacattggtgcaaggaacttgtggatacttggaccccgaatacctaatgacatgccagctgaccgataagagtgacgtatatagttttggtgttgtcgtgctggagcttctaacaagaaagaaggcattataccttgacggaccagaggaagacaggtgcctggtgtcatgtttcaccacagctgtgaaggttggtcgtcatcaagagcttctggacagccaagtaaggaatgagctgagtgacgaaatgctccaagagattacatacctcctaatgagatgcctaagcatgattggggaagaacgaccggcgatgaaagaggtagctgagaggctggaatcgctgagaagatatcagcagcacccttgggctaaagctgaaggcaatgaggaggagattcagagcttgctcggcatggaacaaaataatgcaaattaccaactcaggcaacaagatgtcctgggtctggaagaaggcaatgcatatacatttagcttatagatcatgctgatcgtgtcaatctttggtaaatcaatctgttctgatacaaaatctttaaaattcttttccgtgtaacatgaatggaaacactcatatggattgcaatgaaataaccaccaaggaatttatgtggctgtaataaaaaaaaagaaactgcatagactatatagaccaatgatttgtaactgtgagtattaaatggttcttgtttgttcttctgttaaaagaaagggtgaaaacaacatcatgtaaagacaacatgtgatcattaaatagaagcatttaagtaagaacataagagatttgcataccatctctatgtaattttatataccttttggagttttagttggatagaggtttttttttaaggggaaggagggagctctgccaatttcaattaagtagggggaaaaacaaagttttacaacatacaacctccatccctggagagcgtggagggcaggcacataagtttaaggtaatgcaaagcaactaataacaagacgcgcagaaaaatcatctaagttatttgggcttcatcaaactccttgcacatatctatgatggaatcaactacctgaagcacggaattgtatatcccattaaagattattccattcgtttgtaaccaaataccccgagccgtgtggatgaaaaggccatcgaagttgcgtaccatttctttcctgcaagcttcccacgaacctagcatgtctccagtgaagagggatggtgaaggcgtgtggaggcccaatttcctccatatggagctccatacttgtcttgtgaatgaataatctatgaggaggtggtgggtagtctctggttctataccataaaaggggcaaatctcactgttatcccattcccgaatctgaaagttgtctgcagtaaggatttttcaatggatcatgagccatccgaagaatttgctaccttgtaatagcaaattcaagcttcccctgctaagtgaatacatatcaggtcatcatggctcagctttccgtgctgagccatttatagcgtgtgcccatttcaatccaaccaaagcaaacccaaatacaaaaccaatccatttaacccattccaatccagtccattagcaggcttacccctagctatcgtcgtgtatggtcaggagaccatcacactctaagagttggtccgtccaatgaaatgaaggaaggcaatcatccatgagaggaaaatttgttaattaaagagtgggtgtgggtgagctccgatttgactggcacagtaccaatgcacttcactaatcaagcaagtaagaaaagattcatgatgctagccctagcccacactgcgatgtgcgggtgagaccgactgaagcacacggacaggagtagagaagacgaccagtagagactagagtgaagaa

SEQ ID NO: 45872 - DNA, 1186 bp, Oryza sativa
tcagctttccgtgctgagccatttatagcgtgtgcccatttcaatccaaccaaagcaaacccaaatacaaaaccaatccatttaacccattccaatccagtccattagcaggcttacccctagctatcgtcgtgtatggtcaggagaccatcacactctaagagttggtccgtccaatgaaatgaaggaaggcaatcatccatgagaggaaaatttgttaattaaagagtgggtgtgggtgagctccgatttgactggcacagtaccaatgcacttcactaatcaagcaagtaagaaaagattcatgatgctagccctagcccacactgcgatgtgcgggtgagaccgactgaagcacacggacaggagtagagaagacgaccagtagagactagagtgaagaaagattagtagagctaaccataatttggcaacgcactcaccctgaggcctgacggaggcagaggcgcagagcgtgggaaacccggcggagggcgtcccaggaagtcaacacctccggcggcggtatagatatcctccgcgtgcggtgcggatctgatcgcccccgacgacggcggtggcggcggcgacggcggagggaggggttccggccgccggctcgctgctgtcgtggttgagagagatgacaaaggtttcaaggctaacacgtttagcccatttttaggcccctttacagtgacaaactagttgggccgaaatggaatttgcactaggttgatatggtgggcctaaactgggctctcgctaacgcgcgagccgaattaggcctgagcacgagattcctgcgaatgcgtggtgggttgggctggaataggtctaggacggcaaatgtgcacggtggcctcccttgtcctgggctctaatgaatctgggccgtcttttctcataagtcccacatggaattttcgaatttttttcgtttttagatttttttttaatatttacagaaataatctatcgaccaaaaaaattgcagaaatagcccctgccgccctaatggtgggcggcaagctgacgtggcagacggtgggtcgaccgcgccgtctgccgccgtcggccaaaattgcgattaggcccttgccgcccgtacagagggcggcaaggggctaattgcaattttggccgcccataaagagcttgcggccgtacttttttcatctgggtc

SEQ ID NO: 45873 - DNA, 4845 bp, Oryza sativa
aacaaggagaattatgttacatgaagaattatgttaaatttgaacatgatacaactatttgcattgcggttacatagatgatattagattcgaactaggagggaggtagtgcaatagttgaacacaacgacgatgtagtaatgggacagggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaatgaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaatgaagaacctgacaacgatcaccacacctgcatcttggacgggcttcccatggagggagtgccgtagttagcacccgccagtcgctctgttgttcacgacattgtcgtttataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatacgcagataataaaatacctcacggtcatagttagggcacctaaaaaagcgccttcctcgaatatcaggattcctcgaagccattagttggcatcgatcaccgcataggcagagaggacgctgacaccaaggtggtagtaggtatacacaaggatcgctacgccagtttagatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgacagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgcgcctggtcctgcgtctgcaccggcggtgcgcctcccagctgtgaggggccgatgacgtcctctgtcgagcctgaagcgaagtcgaagtcggtgatgtcgaagaggaaggtggaaggcaacaagtggtccgacgaggtcccagcatggtccagtggtggaccctgactcgacgtgccgactgcctgtgacgaagtcccggtgtactgccagaactgcgctgagtgcgaggtcgacacagctgcctgagacgctgaccctacagcctgggagaagtgggcggcctgcgtcatagcgaactgggcgaaacctacacatcgacaacgggacccttgtaagctaagacataaaatgtatgtaaattgattgtcgaagtaatgttgtttttttaagtacctgtgggggcacaacataaggcctagctgaggaaggcggggtgctgaacggtgcacgaaaccctgaagcaatcggcaagtgaaacggctcacttatatgtgcgaggcatgtacagaaatagtaataaaaatacttacctccgtgcagagggggggtcggcctaggaacgtgcgcagctggacggggaccagttggtacgggtggccgctgtacagctgcgtctgcccgagcaacgtcgtctgcacgacaggtgagaactcggagaatcgagcgcatcgactccaccatccgcgtgtacgtcgtcaggtgctcctctacgggtaccggaatccccgcgcctaaacgttggatcgtcattgaaccatcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgagtgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgatggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgctgcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccatgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtctggtgttgcggtggtgtgccaacggctcgagcgggaggtgcggtgcacgctgtactagtgcgaaacgtgccgtcagatcgtcctgccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccaccgtccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacattgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactaatggtacataatgatgacgtgcaatttaacatatatgtagagttcaataatataacataacattacgtgtcgaagtctgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagctagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgt

SEQ ID NO: 45874 - DNA, 2583 bp, Oryza sativa
gcaactcctctagctttttctgcatgaaagctccaaacaaaatgctgttgttcggcatagagggaagaactacctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttcgttcatgcagaatccactgagaaaatttctgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaaaaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctatcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaagcttcgtaagttccaaatctcatctctattattttctgtttggccctccaggccttggcatagctaatagtatacttgtatgtctcttcaatgtgtcagattattgaccttggttcatatgtgagattatcgatgacatgcgcatacatctcagatgcaacaaatgcacatgtaatgttcctgtggtatttctgaacaccaggtagaaaacatgtatgcttggtaacaactgacactgtccaataatccttccatttccccttatacgtgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcaccatcatccatgttcgtctgcacacctggatccttcgggtgaacaaacggaaccaaagctagaggccacccacattgcaatgcattttccaaataccatctccacactcgagagttttgaactggcattagttcccaataaaaaccctcagttgcccgacttactataacattgattggtatgtcacttgtttgtggatcaactctcaagcccctcattaaccatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaattagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgggggctgggcagcaggccttttataggcagcgaggcctgccgcccggccagagggcggcaaggggccactgcaaaatagccggcccccactggctccccggcattcaggccccttgcc

SEQ ID NO: 45875 - DNA, 6291 bp, Oryza sativa
cgcccggcaagggttttcctgcaaaaaaaccctccctccgtcaccgcccgttcctcccccgtttgccacgtcagcttgctgccccagaggtgggcggcaggggctatttctgtaatttttttggtcgatagattatttctgtaaatattaaaaaaaaatctaaaaccgaaaaaaattctggaattttcgtttctcttgtgggaagaaaaaaattggcaaatagcagtgcagttgactggtcagagcatgtaggagtcagcagtcagcaccctgcttttccgcatcattcgagtaaatcaattaaatagctttgtcgagtgcaggctgcttctttacaatacttatgtaagattagcctagagctaatgttaaaaggtaatatttagtcatgaattggtaggctaaacattagcctagaatcgtatgtttggatctatgggcaaggctaaaaggtggagagagagtaaaaagagaggagagagaaggagagagagagctgtttttttatggtccccacacaaaattagccccattaacatatttggagagactaatgttttgaggggggctaattcatattagcccaaaattagcctacctgtttagattcttgtgggctaatttgaggctaaaaggtgagggctaaacattagcccatgaaatcaaacctggccttaattactcggccatcagctcttgtataattaaccgcataaacgtacgtactccgtagcatatatacaggccggtcgtactacattagtttagagtagctttgtaacgaggagcaaagagaaaaccggcaacacagcaggaagtaagaaatcaacagaaatagccgagggacaattgatcagtgatcaagggcgaatccagcctccaaaaatcattactgttggttgcccttaaattttacaagacgacacttaggcgtcattttagattctactccctccatttcatattataacttgctagtattgcttacatatatatgtgtgtgttttaatgaatttagacatatatatttagcttcattaacatatatatgaacgtgggtaatgctaaaaagtcttattataatatgaaacggaggaagtagaataaaatcattgtttgccaggttatctttctgaacgctgtatatacgatggtatccactactaaatcactactcccttcatatcaaaatattccaacctaagataagatataatataatctagcacaacgagaatctagataaaccaatgttagattcattgtacttgtactagattattacattccatcccatgttgttttgttttgggatggaaggaatagaccactgcaaatccgtttccatttacgttcgcaaaaaaaaaaatacgtttccatttctgaacaaatgaatcccgcggggactgtcctccactgaagaaaaggattggcaaatgggcaaggcaattgactggaccaacagtgcaagtggaacacatgctcggattcgtgcttttctgacccacccagcattacaagtggaacagcttagctccttccttgtcgtacgacgcaacagtccggttcggaggacgtgtcgagtcgtcgaccgccgaagcgaccaacctagctcgtcaacgagcatatgcaaatgcatcttcctttacaattctccaactaaattaaagaacgaagtgcacgtgccatatactcatgtcatgtcaatacgatctatttatgcatgctgaaaccagcgtcatagtaacgagaagcaatgcagagttcagaaatgggggtgttttccagcttaggcgtcgtagtgttgctgttactgttagtcgtcgccctggcgccggtgagaccagcgtcgggtcagccattgccgggctgccccgacaggtgcggcaacatcagcgttccctaccccttcggcatcggcgcccgctgcgcccgcgacttcggctacgagctcttctgcaaccacagctacttccctccgcgcctcaccttcttccctccactccccacgcctacatcgatcttggccgggcgccggctgaatctggccagcctgtccatcgccgacggcgaggccgtagctctcgtcaacgtgttccgccagtgctacagcagcaacgagagctacgtcagcgacaactcccgtaactacacggtgtacctgtccctccttggcagcaacacctaccgcgtatccgccgcgaggaaccgcttcgtcgcgctcggctgccccaacctcggctacctcagcgacgacgcgggctactacatcaccggctgcacgtccgtctgccgaccgtcgcagtggaactccgtgtcgccggcggcgtgcaccggcgttgggtgctgccagagcaggataccacccaatgtcacctactacgaggcgtccgttcaaggcttccaggaagcccaggggagaatcttccgcgagaacacgacttcttgccggtacgcgttcgtggtggaggacaggtgggtcgacaccacctaccgggacagcgccgacttcaaccggaccgacgacttcgccgtccccgtcgtgctcgactgggccatccggaacgtcgccaactgcgacatcgccaagcgcaacaggacggactacgggtgcaggagcaccaacagcgattgcgtcgactccaccaatggtgtcggataccgctgcaagtgctccaatggctacgacggcaacccctaccttgacggtggatgcacaggtatacaatactagacaccttaatacaatgcagatattggttatcaagttaacattgaggattgttcatttgctcgccattcttatattctctgccctcaaataaataacaatcattctgacaagaagtgatgagtttgtttttcctcttccaagatattgacgagtgccaacacttagacaagtacccatgccacggagtctgcacaaatctgctgggaggctataagtgtgattgccctcatggattcagcggagatgccataaaaaatgattgccgtccaaacgacaagttcacattagcactgaaaatagtcacaggtaattttgagacactaaggaggtgtttggttcatggccacaccacacttttgactgccacagtgtgttaggtatatgtttgtttcactgccacagttgtgacttgccacattttttcaataccatgtcctacatgtcatagacttaattttttttgccaactttaacacattttgtggctagcaatttgtccaccacacttttgtggctgctacaacttacctaatgttagttgtggcaaagtgtggccagcaaccaaacacaccctaatgcacctttctctctattgattctccgatttctgatgagtgacattgcaatgccatcttcaggggtcagcgttggtgtgttcttgtcggtgttcatgtgcttttggttgtacttggggctccagaagaggaagctcatcagaacaaagcaaagattcttcgagcagaacggtggagtgatcctccagcagcagatgcactctggtggaggcactggtgggttcaaaatattttccacggaagagctcaagaaggccaccaacaacttcgccgctgaccgtgttctcggccgcggcggtcacggtgttgtctacaagggtgtcctggaggacaacatggtggtggccatcaagaagtccaagatgatggaggaggctcaaaccaaggaatttgctagagaaatgtttattctctcccagatcaatcacaggaatgtcgtcaagctgctcggttgctgcctcgaggtagaagtgcccatgttagtctatgaatttgtctcaaacggcaccctctaccactacatccatggcaaggaacccacaactgacatagcacttgataaccgtcttcggatagccgcaaagtccgccgaggcgctcgcctacatgcattcatcagcttctccaccaatcctccatggagatgtcaagacggctaacatcctacttgatgacaagctcaacgccaaagttgcagattttggagcatccaaactagcaccaactgatgaggctgcaattgccacgttggtgcagggaacttgtgggtacttggaccctgagtacctaatgacatgccagttaaccgataagagcgatgtctacagttttggtgttgtcgtgctggagcttctaaccaggaagaaggcattgtacctagacgggccagaggaagacatgagcttggtgtcacgcttcaccacagcagtgaaggctggtcgtcatcgagagcttatggacagccaagtgaggaaagagatgaacgacgaaatggcaacagagattgcagacctcctcatgcgatgcctaagcatgaacggtgaagaacgaccaacgatgaaagaggtagcagagaggttggagatgttgaggagataccagcagcacccttgggctgaagctaaaggtaatgctgaggagaatcaaagcttgcttggcattgaacatcaaaatccaaattaccaattcaggcagcatgatgttcttgatctggaagaaggaagtacatatacatttagcttgtagataatgttgtttgcgttaatcttttataaatcaatgaattcacatacaaattcttttctatgtaatatgaaaacacatccatggggtgcaaccaaagaacgaccaagaaatttatgtgttctgtaatataaaagcaagaaattgcatagacgatagagaagaatggtatgtcactatgagtattgaaaggttcatgtccgttcttctcttaaaagaaaaggtgaaaacaacatgatgtatagacaactcatgatcattaaatagaaacatttaaataagaagataaggacttgccacaaaatcaaagatatatatactgtaaagcgagttacattggattgtcatggggaaatttctccccaaataccgccgtgtatgggtcaggaccatcacactcctagagttggtcgtccaatgaagggaggcgatcgtccctgacaggatttttttttcttctacacagagtaggtcatctctgcatgcctgatttgacaagaaccataccaaattagtagagttattcgtaattttgcgacgcgctcaccagaccagatggagtcggcggcggagtaggaacagcctgcggatggcgtagcggacagctccctcccagctcccagaggatggaaggaacggaggacttctggtagacaccatgtatggcggctgtggcggagacaatgacagtctgcgcctccgacgacgccggcggaggcacgggaggaagggttccagccgccggccgctgacctgcttgagacagagagagagagagagagagagagagagagagtgggtggggaggatgatacgtgaagggctgaaggccctcgagacacattgagccttgttggaaggccattagagaggagaaggcctagtattgggcccttttgtttaggctctttgcgatgagcgaactgggccgaaactgtacgagatggaataagtctactgtctggtggactagacaagctacctactcccttttcacttggtgtaatacacatcccggatcaataaatataaatataaatatagtagggtcatttttcacattgaagatctaaatctgaatagggggatgctttacaacggaatcccgttcgagcgggatgataccggttaggtatcaggacatgatacctattagatatcatgcgatttctaccacgtatcaaatgatacttgcaaggtattagacgattcctatcaggtatcatgtgattatacttacgaggtatcatgtgatacttggtattgacttattctcgttgataccagatcgataccgactgatatcaggtgattctactgggtatcaggagccaggcaccaaggcatcatcgtcggtggccgtgtcctccgcgtttgagcaagtcctttaccgtcactccccacgctggagctcggcggcggcggcctcacgtcccatgccggagatcgacatcctccgccatccatgttccacgccggagctcatcgccggcggccgcgtcctccgctgcctcgccctacgccgggctcgtcgctagcgcgaccacgacatcctccgccatccatgttccacgccggagctcatccccggtgcagccacgacatcctccgctatccatgttccactgttaacagtgaaatttggtaatcggcaaagacgtcatcggctgagaatcattatcggctgcagcatctcggaatcagccgataggagttatcaagtcgccaatagtcggattcc

SEQ ID NO: 45876 - DNA, 1307 bp, Oryza sativa
ctgccagcttccctgcagttgagcagcagcagcagctcatcgatcactcgcttcctctgaaagcgtcggtgaatgaccgaacatattggagatggattgctcctgcaaaatctctgaaattatgcacgccttcacctgatcggtgatcgattgatcgatcgatctccgttgttgtttctgctctctattcagatttcagatcgttctgcgactgcgcgagagttgtgcattgcgtgtgcagacgccgtgctgctgcattgcattgattagcccggcctgaaggagaaaagcctgcttgcttttgagctgttttatcttctgttcacatcctgggtctgtatgattgtcgctgcgaggcctgtttgtagatcatgatcatcacctggaacgctcgccgcattgagctgagcatatggtgtctctgcttggatgtctgaaactgcaagcatgtctcgcctggagtggatgattctaaaatcttcagtagcactcattacggtacaggattagttagagtcgtctgtccgatcgatagtgcccgattctaccgttgccgttggcatgtccaccgaagctataggtctctaaatagtgcgaactataactgcttctcatgtgcagcttcatgccgttacagatatatctacagttgactagtaccacatgcatgttcttctccctccctcctttctttgtggggatcatgcatgagtattctactatttctggacttaacctcaacatctgatcatgaatcttaacaagcatttgcccagattaatctctggacggggtatgtgccagtgcatgggggagcatatgggttgactgggaaacagatcacccataactacacatgcagttgagttactgtccagtgagctcactttactacggtccacatgttaatggctcaattcacatcagttaagttaaatgaccccgttccggttgactgagcacgtatgtgaattaatacgattattaaaagaagaggaagaagaaggcaatgtgtgaattcgggccctgtgaagcccatgtgtggcacaaggcccattagaatcatcctggcctcggcctaaggctatgggcttggactcttggagactggcctgcctggttggtgttaagtgatctgtctatgtgccgcagcccgcaagtagtatcagcaactagcaaaggaataaaatcactttgactctcttaactaatagccgaatctgattcttatctctaaatcacaataccggatatctcaacccctaactattaaaaccgacacaatttaactcctgcaattgttttga

SEQ ID NO: 45877 - DNA, 1923 bp, Oryza sativa
atcattgatgttgcgaccggcactcctccatggctccctgtcgtgaggccggcctccttcctcttcaccacgcgaccaccatcccgctgctccacctcgtagtccaccgccttcgtccctacgcctgactgcggtaccattgccgccctggaatcccttgcacttctgttgccaccgctttagctcttcccatagacggacgaaggggtagagaaaggggagagaaagagagagacatgaggaagaagggaaggataaagagaggatgacatgtgaatcccataatatttcttttattaatgataaacgggtttcacatatttttttaattctaatatcacataagcatcacgtcaatatcacgtaggacgaaaccaggtcaacactatcacgtcagcaaaaccgtctcttcaaaacagtcgagggagtcaaattgttctgattttaataattgaggaggagtcaaaatatccgatgttatagtttagggatacgaaccggatccgacaaccagtttagagaatcaaagtgaaattataccactagcaaagccatggacatgtgtcggtggggactgtgtatatggcgatggaacaggtagcccagcccacgggaggcggaggagaagttggaattgcacctcaccttcccgttcgatcggctggcggcgcgcccaccgggtgacgcaagccgaagcatccagccgacacgagccgatagccgtcaaaaaggttgatgttgcgaacctcaccgagctagtctcaaacattgggtagtagttcagatttcagaacacggtaacagataaccaggtgggtttctgttatctccgaccgtgccgtgccgttcggtttcgaaagccgcgagtcgtgcagctaacacgcgcccaaatcgtagtttagtttcaactttcaacggcagacggaattctttggttggtttttagtccactaagtactccagttttgatacttgagcacagcggattctgctttgtgctctaagtaaacgaaacatcttaatataaaatatatattttacggtctcttgttttttacgttccagattaattatgtcataaaatgttgcagatttatgctagttttctctttttacgtagttatatgtattttgtgcaccatcggtattttacctttttattcgcaagaccgtaggcggtagcatcggttgtttgatgtttttctctcgtatcaccgagataaaccatgataaattttaaatatcgtcaaattccctcgaacatactccatccgtattttagagaaagactacacaacggtataccgttgaacggtataccacttatcctccatgccgcggccccacgtgccggcttctcccgagtatgtcgcgtgctgctaggattatcatcacgcacatttgctgtgtgtatcagtgtatagttttgttcctgacagctagctagtactcagcatgcttaagtcctgcttttgatactagcctagctagtaaataaaaccggaggtactactagcttgttgtgcataccaaatccctgtaatagctactagtagtcccgtaccctagttatgtagggtacttgttatggcagagcctagtagcctagctatgtgtctaagattggttgcatctatttgcatgtgtcctataccatgcacggattagaccagacaaataattacctagattatatatggatacaatggattctaattagatatgtcatgttgggctcttggttatactacatcttagaaactctagtatgtgatacatagatgctagattatcatacactggtggagaagtgctttttagtcccggttcgtaaccccctgtaaaaccgggactaccaatccgggtatctttagtcccgggtgaaaaaaccgggactaaagatcgatctttagtcccggtttt

SEQ ID NO: 45878 - DNA, 5719 bp, Oryza sativa
ccttttttcttttttattttctcccgaatcgagtggtatgtatatcatcaaatcaaaccccaaatccacatcacaactccacagcacgattcacagattcaccacaaattcattcacaatatccattcacatattcattcacaacatcacaaatatattcacaatattgattcacaggttcattgacaacatcgagtcacatactcattcacaacatcacagattcattcacaatatcgattcatagattcattcacagatcaaaacatccaaacaacaaattaaaaaaaaataaaaaaaaaatcgactcaccggccggccacccatctcgccgcttcccctccggccggatctgggggaggggagggcgaggccgccggcgaccggcctccatcccgccggcccgcgccgggccgccgccggccgtcctccatcccgccgcttcccctccggccggatctggaggaggggagggcgaggccgccggcgaccggcctccatcccgccggcctgcgccgggccaccgccgggcgtcctccatcccgctggcccgcgcccggccgccatcccgacgccgccggccggccgccgccatcccgccaccgccggccggccgtcccccatcccgccgccgccggccggccgccgccagcctgcgcccggcctccatcccgccgccgtcggctgcctctgcaagaggaagagggggaggggaggaggagagggggtgagagaagagcaaggggagaggatggaaggagaaggatggagaggatggagataaggaaggagaagaaaaagagataaggatgggagatagagagagagagaggggctacgcatgcgcttgtgcgtgggctgtgcgtacgctttattctcggttgatgttatcaaccgggattaaagatccctgggatctttagtcccggttggtagatcctatctttagtcccggttggtgggactaaagatctcggggggcctgacaaggcctgacagatttagaaccgggactaaagattatttttagtcccggttggtaacaccaatcgggactaaagatcaaatatgcccgctgtagccaccaaccgggagtaaagatcatctttagtcccggtttttagtggaaccgagactattgtggatttcgggcaaccgaccaaagacggtttctccaccagtgatatctgatatccaggtactgggtcaaatacctaggtaccaagtatgaaacctataaatacaagatctaatgccgagttatcgggtctgatacctataaataccggatccgataactaggtatcgcgtctgatacctgtgagtaccagattggatacccgggtatcgggtatctgatctgatacctatgagtatttgttccaatacctatgcgtaacgggtcggatacccaggtaccgagtatgatacttatgaataccaagtctgatacctaagtatcgggtctgatacctatgagtaccggattcgatacctaggtcaggtttgatacctatgagtaccgaatccggtatcgcgtatgatacctatgagtatcggattagatacccgggtatcgggtatctgatctggtacctatgagtatcagttccgatacctgtacgtactgggtcgcatacccaggtaccgagtatgatacctatgaataccaagtctaatatctaggtattgggtctgatacctataagtaccggattcgatacctaggttaggtttaatacctatgaatatcggatccaatacctagataccgggttgatacatcttagtagcggatctgataccaaatatagggtgtgatgtcacgagacttcagatgtgataccactaattctgatatttatgggttatatactcctattcaacaatcaaataaaaagatggaccatgcatagctaggccagaaagtacagccaaacttgctcatgtgctgctgacatgctttgtttaggctcatgctactagctctagtgcttaattctaactttgctagttgaagcaggtgtcagatccatatggacctaaagaggtgtagaagtagtgctgtactagagtatttcatagctattttgtaatgtaggagaaaagagacctctcgtcagtcgtcactagtcagcagccgtcatgtgaaaggacagtacatgacacgcttttagagagaaaaagaatcggtgagtgattggtaagtataaattataaactataccgttgagacggtataccgtcctatagtttttatcgtattttaatgtatgacgccgttgactttttggccaacgtttgaccattcgttttattcaaaaattttgtgcaaatatgaaaacatttatgtcatgcttaaagaacatttgatgatgaatcaagtcacaataaaataaatgataattacataatttttttaaataagacgaatggtcaaacgttgcataaaaaatcaacgacgttatacattaaaatagtacttcatccggttcacaatataaatcattctagcatttcccacatttatattgatgataatgaatctagatatatatctatctagattcattaacatcaatataaatgtgggaaatactaaaatgacttacattataaaaaggaggagtattagtggtagcactattaacgtcaggtttaaaaggacagtagtcaatcgtgccagtctgactcgaatcgtcggtcgttctgacagcagatattttttttaaaaaagtacaagttgtagacttggagagaagattcgccaggttgagcgaaaacctgagacggtttacgtgccagggttggcttcgtgatcccctcgtccagaaaggcaatggaatatactctactgctcctacgcgcacgccccaacccatcggcgaattcggccttgcgatgtgatgcccagtattgcgggcgagcgcgcagctgaaatactgaatcctgaagaatggacgaacagtgagtcgacaaggcgacggcactccgtttcgcgcggtcgcagctgcgcctcccccacccctcacctgctgaccaacctacgctagctatcttcctcttgtcgtcctcctcctccgtcgcatggcggcgcgcggtttctgcaggtataaatagcggccgtgtccagacacgctagtctcacaccaacatacggagttcgagtgacatacgagcagcagccaacacaagctcgatcgaaagttctctcacaagttcagagtagcatttggttagtgacagtaactggtcagcgtctctcaccatgtcgtccaattttgaggccaacaacaacaacaatggcgagaagcagctggtctgtgtgaccggagcaggtggcttcattgggtcgtgggtggtgaaggagctcctcatccgtggctaccacgtcaggggaacagccagggatcctggtaagtactagtactattagttcacggtgtttgcataaatttggtgcgtgttgtgcttgatttattgatcggttcttgcatgcgcgtatctgtagctgacagcaagaatgctcacctgcttgagctggagggagccgacgagaggctctccctctgccgcgccgacgtcctcgacgccgccagcctccgcgccgccttcagcgggtgccacggcgtcttccatgtcgcctccccggtgtctaacgaccctgtaagttcactagcctggttcctgagcccaaaagagacgacaatggcacctttaacctcctccaacttttactaatgctgctccgtgatgcaggaccttgttccggttgcagtggaggggacgaggaacgtgatcaacgcagcggcggacatgggcgtgcgccgcgtggtgttcacgtcgtcgtacggcgccgtgcacatgaaccccaaccggagccccgacgccgtcctcgacgagacctgctggagcgactacgaattctgcaagcaaacagacgtaagcacattactctgctccgttctacggttctaccaactccaacagcgttgcttacatgaacaataaattcatctcggcaaattttctcgtcgtacatgcagaacctgtactgctgcgccaagatgatggcggagatgacggcgacggaggaggcggcgaagagggggctggagctggcggtggtggtgccgtcgatgacgatgggtcccatgcttcagcagacgctcaacttcagcaccaaccacgtcgcccgctacctcatgggcaccaagaagtcctaccccaacgccgtcgcggcctacgtcgacgtccgcgacgtcgcccgcgcacacgtcctcgtctacgagcgccccgaggcacgcggccgctacctctgcatcggcaccgtgctccaccgcgccgagctcctccggatgctcagggagctcttcccacggtaccctgccactgcaaagtatgcagatattagccattgatttgcttatgtgcattgcttcattgctcttgtgagatgcaatcgatcgatctcaaattctcatgcgtgtgtttcttggatttttttttcaggtgtgaggatgatgggaagccgatggcgaagccgtataagttctcgaaccagaggctcaaggatttgggtttggagttcactccactgaggaagagtttgaatgaggcggtcctatgcatgcagcagaagggtcacctgcctctgatttatcccgttccaaaacgtgcttacctataaaatcaagataaaaatacgaattcgtctgttgcgatgggaaacagagagcaacagggaaaaaacaaaggaaaaaaaaggaaacacaagggctctgagattgtttatttgtgcaagtgtagtaggcatttatattttgttcttacacatgtaaaacccttctgtaatgaacaataaggtcccatggagggaacggcaaatgcaaatatggccttcatttgtattctgggcttcaggatgtaaatttgaatatcattgtatttattttctatgttgcagggaatttccgagtattcagtgaactgttaccacggagcatatgtgcatcatattttctgttctgtgcatcatatttttcttggtcagaagtatatgtaagggcattgtgcaagatggaacgaagcatagtcctgtagtcatgcttgtattgtcgcttgcaggaagaataacatagtagaattgcagagcaccttgatatgttcctctaataatgcaagttttagctgttttctttgtaaccacagctctgatatagcaaacaacagccataccttcacaccagataatccaacagccataatttctgtagacatttgcttgcaacaaaaacacagatcccagaaattccatgatgcacacaagctaatcttgcccccaccaagctctgacttccaccaaatcatttcatagtttgcaatgactgacatatgttgtgtcatcaagagtttgtagtgatttttgctcccagataaagactgattgtagcttggaactaattgtacacaagtttgcgtaagcaacacagcaatcattgtatctccaactgaataatttgaaaatttgtccaaactgaacttgagaacacaaagcttcggcacatccgtttcacctttcgaaactgattgttctgtcatcttaacatgagtcacaaattcttgatattctaaaaccgctcttccaggaagtagaaatggcagagaatcatccccttgcaatactacaatatcaagcaaggagctactagcaaaatca

SEQ ID NO: 45879 - DNA, 1682 bp, Oryza sativa
  unsure (1)..(1682): unsure at all n locations
nnnnnnnnnnnnnnnnnnnnnnnnnnnnnnnnnnnnnnnnncagtgagtgatgggttgccatgcctacctccctcccattcatgtgccatggccatggagttctgaatgctgctcagtgccgtttcttccgttgcagcttgcaccaaagctaacagaattcagatcgaagctgatagtacgtgctagtttgctaccaagttaacagcaatccaacagcacacacaacggggagggaaaaggggatattacactttggtcaaaagccatcttgcaggagcagcagcagccaaacatctttggccaaaaggaaacgggagtatgatgatggatgagaccttgagggcatcgaaagaatgaaagatcctctttgctaggcatcgccccagcacgcttaagttcgttcccttccccatgcaggcatgctctcgcgcgtttttttgagcaaccacatctccgtttctaccaaaagccatggagattgagatgagaacaatagggcattgcagatgctcttttgccaacatttccagtacaaggatggaagaactgcttctgaaaatgcaacgatcagagataaggaatttacacaggcttataccagtaaagagtaaaatgggagagatcgtgcaggtttctttaatctatgagtaaaacgcagaaatcgcaatgaatagcctggcccgagagaagaaatgcaagtactggtcacctgaacaatctgacataagctattatgaacagtaataaaccaatctgacagaacaacaatatgaacaattaactcctgatccggactagcacaacgcaagatgcaccccaggagaacaagatcatacaagctgcaatgctgcgttacaaacttttcatacgagacactatgcgaagctgcaaacaaaccactgtaaggcaatcttcatgcaaaatcagaactcaattaatacaccatgctcgcacttgagaatttcgacacaacttgaaccaaatctgccgaattgtctgaggcacgtccatatcagaaatcacgcctatagccaatacctaccccagatcatacatacataaatgcttcagactggcttcccgtgaacaaccacagggaaacactgtacttgtacgcaagacctattaagtaatgacaattactccactgatcacaaagatcacctttcaatacactgaatcactgattcacaaagatcaacttgaatagcaacaagatacgcaacaaaggaatccatccatccatctgcaccttgatagtatttgctttggtcaactgaccaacaatgaacatactgaaacctttgtgatgccattgttaaaaagaattaacaaatagaagtaacaccttaagacatcgttaatgaactcatccaataggctaatataatatccattatgtccagaaagactatgtacatctaagcacaccaagaactctagtcgcatatcatgaaggccaaaaccaaaactctaaacaaaagagagagagagaaaaagaatattataggtaaatactagagacaataacgaatccaactgacatattaacgcatattgacggactagacagagaaaattgccaaactcttttttagttttttaacccatcggcggcgaggttaaaatactggcatgctgctcaggaaactgttggtttcaccgccaccggcttggctgg

SEQ ID NO: 45880 - DNA, 2001 bp, Oryza sativa
ggttggtggtgtggcggtcgtcgttcttggcggggatctcgacggggacgttgtccttcaccgtcggcgggtcaccggcggggtccttcaccttcaccgcgggcggcgggacgaagccgttgtcgaggccgaacaggtagtcggggcccgtcggcgctggcaacaccggcggcggctgcggcatcggcacaaccgctggtggtggcgactgcacggagaccgactcctgcttcggctgcggtggcgacggtggcggcggctgatggacggagttgagcgcgtcgacgaaccactggcgttgctcctgcttgggctcgaggaggccggacggctgcggcgggggcggtggcgtgggcgactggacggggaagaggaaaaccctgagcctgggcgtggaaccgccgcgggacgagccgccgccagatcccggcgcggggcggagcaggtggaggcggtcgtactcgaggacgaggtgctccagatcctcgtcgttggtgacggagacgagcgcgtcgaggtcctcgccggggagctggtacttgacgcagaagtcccccggagaacccgcgaggccggccaaccgcgcggcgaagtcggcgaagcggaggggcctctcgagcgacaggatcttcgtctcgccgttgacgtacgagagctggtggtcgtgcggccgcggctggatgcgccccccgtagctcaccatcaaccgcaccttcgccggcggcgccggtggcgggggcgccgcctgcgccgccgccgcctccgagccctcgtggtgcgcgtcgtcggtggccgcggcggagtgcggggacgagtcgccggagtcggccatggcggcggcggcggcgcgcgttagggttggggatgatatgatgggggagagcggggtgaggggagagggaggctgttataaggtaggtaggggtgggatgaacgggttttggtgcgattaagggtggtgattagcgatcttaattctgtgtttagtctctaaagaggggaggggattattgactgcggattttggcgggggtttggcatcgggagatgtgtggggacagttgggattgaggtgtctactgtggatatgtgtgcctgctgtggcgggcccggctttttccatttctttcttttttattatcctgcttcttttcgcgtgatctttttctcacctggagatacatgcacgataggatactttgcaaattctaatagtttggttttagtattactgattggattagcatccagcaatgttgaatcagaaatgtgacgccgttggacagatcgaaatgcacctggcgaattttttcgaattggaaaaaacggcagcatttaaattttctgttcgccgatgcctggtctattgtggaggggctttttttagctgctgtgcggagcgtcagggcgtgccgtgatggcgacaagcggacggaccgatcgaaggaagcattgggtgcgtctggttgcgctttacgacggcccaaactgcctcgccgtcgccggtgtcgccggtgccagcccgcacctgagaattcaccccattttacaagtttggaagaaggaaagcgggcgcaagtttcgatgcgtgggcgcgcacccacagtttccacttccaaccgacagggtgcactcgggcgcccgggtgtgtgcatgcgtcgcacgatcgcccaaggccccaaaggccaagaggggtggtgtgctggggccgacgtacgtccatgtgtcgcgggggtgctgccgctgacgacgcgcagtcgcaggcgcagggccatgtggatgtgtgggcgccgtcggagttaattttggcagcgtgttaggcagagaggccgcggcagccaccacaaaaccggtcgcttctcctggtcaaaacctccgcatctcaccgcagccgcacccacgggcgccaccacaccgctgcacctgcactgcccatgcgccccgcttcgcatacagaaacaactcgttccactgaaattctgacgcatggatcaataattt

SEQ ID NO: 45881 - DNA, 1262 bp, Oryza sativa
tggcgtgccgtgggtgacggcggccatgattagctgtgcataattaccactttacaagattgctaatcagcgaaatcatgctgtttttttccttaaataaaactgcagaaaatttacgtgcgtacgtgcactttaaagcccaatcagttttttttttcggatttactcggctacagtttctgtccatgagaccaggggagaggcattgaccgagcgtcatctccttaatgggcccacgtggcagtcacagcgaaatatgggcccaccaggccggggagtggggagggtgacgcggcatgcatttgagctggtggcgtacgagcggcgcggcccacccaacacgttgctgcatcatctctccacacatatgcgttcacaggtgtagtaaagttgactcggtaaaattgactaagtaattcttactgtaacttttttttagaaaaaaaagataaatttaataactgttggttacttcgtgttagtgtagtattttcacgattgataatgatataagccgacaatattattaaggatttaagggcgtgtgaaaagaatagtggacggaatggccgaataggttctccgccaaagaggagatgctgctgatcgcaaagaagaggagtacacgtacgctttgcctcaatgagatttagagagcgatgtgcatataatgtgggtctcgattagggatggcaaccggggacccataacccacaacccgatgggtttttactctattaggagacaaatatgttccaaatattacacccatggatctcttatcgggctaaaacgtcacccatcggttgggccgggtcctggaacgttctccatccacccgaacccattaacccgtgggttaaaaatacccataggcctcagcccagaaaatacaagtagcccaatgcccaacaacaaatctaagcatctaagtctaagtgtctaaccctagaaataaaaacccatttcctctctctctcactgattcacttctcctccctccccggtactgtgctgctgtagggtggccgccgccacaaaccctacggcgcctctcgcccgcgccggcgcacgcccacgccgcccgcgccacccgcgctgtcgcacgcctgcgccgtacggccgcacgcccccaccgcgctagccgccgccgcacgccagcgccgcgctcgccgcacgcccgcacgccacccgcccaccaccgcgctcgctgccgtacgcccccaccacgcgccgcacacaatacaggcctgcgcagctgt

SEQ ID NO: 45882 - DNA, 8843 bp, Oryza sativa
  unsure (1)..(8843): unsure at all n locations
gcaggctgtaagccagctgcaaacatattttaaggagataatgagaaaatagaaggataatgggctacagatttgtagccagctgtagcacggactttaagacgtagtgtgcgtatgacaggtgggaccatttattaatagtatagtatgtaagtattgtatgaataaactattagattggctatagataaattgaagttagtagtgggctatactattgaacttgctcttagggtgtacgtgatttagaagcaaacatctcgtcagactttcttgcctgcacacgatttagggattgtttagtttaagtcaaaattgaaagtttaattgaaattggaacgatgtgatgaaaaagttggaagtttatgtgtataaaaaagttctgatgtgatgtaaaagttagaagtttaaagaaaaaattaagaactaaaccaggcctcattccttctctctgtttgttttgttctggggctatgaagaaacagaagaaagtttcttgcggcgccacctcaacgaatatccttgttcgcccaaggcctggagttggactgaacaattctctggataacctcaacaagaccgattcgtttgtcatcatactacagtatcattaggatcagggttttcaatatctgaagatagcccttgacatgttcagctgattgcctgaaactgacaggtaattggtacttctagatgattttatttcagcttttgagccgggatatctacctggagaagattaccttaattaatttcttcaagtccgctaatgatatagtaggagtactatactagtatactggtactagatgatcaaaatggcaaccacctaaccgttaaaacataggagtagtaggaggagtagctacgtagcctgaaacctcggaagtgtagatggagacctcgcagctacacactactgaacaaacgaacggtccaaagccttttcacagagagcaacctccaaaccgggacaagcatctgctgccgtccatgcggcgccaagcaaagcccatcaccgtcgtgttggcaccatcccagccgtctgtccctctcagtctcacccatcatcatcatcatctcgcaagcgtcgtggacgcgaaagtgaagcttcatttgccgatgtactagcaaacttcagcctcagctacatcgtgggtacgctgcatctcctgctccatcggtcccaaaaacaagtatagttttacgcggttcatatctaacgtttaatcattcatcttattttaaaaatatttataattaatatttttatttttattaattgataaaatataaataatattttatgtgtgactatttttaaaattttttataaatttttaaataaaatggacgatcaaacgttaaatacggatactcatggctacatttattttacgacggaggttgtaccaattaacatgatctaaattgttcccatcaatcactatcacgggcttaattaaaagagcaagttaattaaaccctctatttatggggctaccaaaaatatgatgatgggagcagatgcaaagtactcggttaacttagctccgattgttaagctttaatcttcacatgcgtgcaagtaccagattgagctgttttgtgacttgtttagggtcgagagcctcgagtcccgagacacgtaggcaattaggcatgatgggtttaaccaagatacacatgggttagtgcaaatcaggattaaccaagtactctcacctgactagataaacatggaagctagtactacaagtcaccagccagagttaacaaacactgctctgggtcttgcgatccatgtgagctgaagtgtttgaagttccttccaaacgcattaacaaattctgccctgctttatcactgttataaccactcggcaatgtactgtaggagcagtagttagtggtacaggactatcggtaaactcgaattaggagtcgtggttgattgcattgacgagcgtaacacgagctggtgcagttggttggtacatctgcactcttcacccgtgtctgaatttctgctcgtctgctgtgctgtcgtcgtgctgcacagtctacaggaatagctagtggaccagtggagtaggaggatttacattttacaatctcgatatattgcctaggagaattgcgtgatgcatccacgaatagtactagttgctcgagatcgaggagggagacaaggattgtgtgctattttactggacttcgtgtatcctgtttctttcaccctttgctgctactgcctactagtactagtagtagtactagtttgcttgtgccttgcaagttgcaacatgttgtacgtatgcagttactcgctcagtcccaacaaaaaaaaaaaaaaaaaaaaaaaaaacataggtttctgtgccaactatccgtcttatataaaatttttttataattagtattttcattgttgttagatgataaaatatgattaatactttatacgtgacttatcttttttaatttttttcatagttttttcaaataagacggacggtaaacgttggacacggatttccactgctgcacttattttgggatggaggtaggggctgtttggtttaatgcttcaacttgccacaccacactttagactgccacacctccttagccttgtgtttggttcattaccttaattatgccaagccacactttcttaccatcttacccacatgtcatagactcaatcttttgcctaactttaccacaaatgtggcttacaatttgtaggccacaaaaagtgtggcaagccacacttacctaacattgtctaaagtgagttatgacaatgttagttaagaaccaaacatgctggtagtacttcaagaatttatctggcaggcaacatatgctactggacgctgatatttggcaccggattcagcccatctaattttgagcccaaccagatcttatcatatctgtcaaagtttattcggcccaactatatatcattacgaggcccaccagtggcagtgctcccctccctattggaccggagtacaacaaagcccaattgaagagacggcccaatgaatgggctgcagaacaaggcccacgccgcaattgctccgtggaacatagggaaggaaagcctcgcaagcagcaggcgaagaatcgaattgcggcctgcggcaatttgtcatcaaaactcaaagacatatttcagctacttgtcaatttgtcatcgcatacaaagcatcgtcttcttgtcatcagcaacttgtttgcgtacgattatgagctatgctttggcctacttccatcagcaagtgtgcaatacgttgagctagcatccagtggtcactggttagttagcagtagttgtgtactgccagtatagtagtagctaacaggaaggcacattcagtgtgtcagtcgacgagtccatactaagtcataacctggttgtccgttagctgcaggccggacccgatgcgtggaccaaaagagtatcggaattcagacacgccacatgattttattgatcggtacacgctgcaagtatggctgggctggtccaagcccaaaattattaagagcaatgacccggtttcagttgcaggcagcaaatggaagagaatacttgtagtatccaggaaaatcttcctctcaaaaactttgaaatatattagggcattgtttagttccaaactttttctttaaactttcaactttttcatcacatcaaaactttactatacacataaacttccaacttttccatcacatcgttccaatttcaaccaaacttccaattttagcgtgaactcaacacaccctagtatttgctgcagaactgtagagaaggattattagagcatgtaactgatgatgagaatgctgaattattgatgcaccaactcttcatccgggactgattcaaagggatttagtcgatttttctccctcgattaaatggaagacactggtcttctactctgttatcatctgttcaggaaacaggactggagtagccacatttaccatctgtaattataaatttataatatgctcatttgacagaaatgacatatatatcatccaatgcaatggaacatgagcagagagtagtaatctagagtaaatgcccatctgtttgtacattatcttaccaaggatttttatcaaatcctacctgaacgaaagcaaagccgaaaagaaaaaccatactaaaatagaagagagatcagggaacaatacacctaaactgcaagctgagagaagcagcactgaagaacaggacacgacatggatctatctatcatcatctattggaatctggattcgggccactcggaacctcatgcttgctgtcgtcgatgccggccgagttccacctccgtggccggaacctcctcgtcctcgccgccggcagcagaaggcgccgtccaccggccgggaccgacgtcgccgccgctggcaacgacgacgacctcacctttgcttcttcttcttcttcccccggaggaggagccagcgacacgacgagcataacggcgcagagaaacgcacagaggccgagaagcggcagcgcagcagctggtcttcttccatctccaatccatcgagctcttgccatgcaagaatcagcttgcagtaaagccttcgatctccccgatctcacaagccaccactaaccaaaactcccatgggcatctgccagaagacgagacgagagcttagctgaaatatcgctctctctagctagctgcctctcactctcactctctcagcgtgtgtgagctcagctagctcttgtaccgtggagacaatgcaagcaggcagctgttctattctttccaggattcacacatgggttggctacttggcttctctggagtctggaccaaaagtttgggtttcttgctttgcttgcttgcttgcaggtgaaatgggagatgaccatgtgtatgcaaaggcacggagcaggggtggctgcttcttatctactgcccgtgaagagaagcagctgagagagctttgtgtgatccatcgtgtatctgacagcatcatcaccatacatcgatggctttgtagacgcctcagcaagacatgcccctagattgtactgctactgtagctatatccattgcatgcatacgcatgctaattacttgcagtatggagtacgtagtactatgactgtatgagcgtgaatcaacatctgcattgtactacgtactgcagatgtatgattgcactcgctaggtgtgtgagaaatttacaattgcttcgagtatttacttttgtcggtcgcgagctcgcaggaaaaagttgatcatggaggacggagcagcaaaaggacgcaaaggacgcgatggaaaagacgtaagacggcatcaactgagagctttgctcatcttggtaaggctgtaaagctccaatccaacaaaatatttgacgctcattgacagtgttgctgatctttcattaactaatccatctcccttttaattctcatcttatttgtatatctgtcaagaacaaaatgatgggggtgctacgatgttagctctgccattcaacgtttccacaggctaagctagcaagcatgataaaaaggagaagattgtgaaagcctgaaaggagtagtagcatgcatgcatgcagtgcagccaggccaagccaaacaagaatgcttttccatggactgacgacaaacacaagctgcatctacacaaattcatgtccaaccctgtagcagacaggcaatgttctgcagttgtctcgtcacctcctctgtagggactcgctacagtcaccacacggaccttgcacatgaactcaggcaaatatatcatcacatgaactgtaaaagattgatctactagatggacaaacacaaacacttcactgttcgccatgtagatgctgccggatcgatcgagaatttgatttgccgtttttctcttcgagaggggacgagtggggcgcgcatgctggatgaaaaggttacacgaacttcaaagcgggcatggttaattatcatgggctctagagagggcaagagctgactgaaactggactaatctccacctatcgtctaatcacaactcattctgtcgccggccatgaatgcctcgtgattcgggatatatgcaaacggaggaagcatgcactgcacatcctgtatgctactggagtactattatcagcaggttacttttgtgcatctgaacgtggcaaaccgggcttcacgggagcaggcatcatcaagagccaaaacctcccactataattcttcttttcgactctattcttcaggcttttgtattaagcctgcagcaccctctcaatacttcaattacaataggatcggtgaccacagcttactaggttaggggacacaaatatataacttgtcccaagttaacatttgcattgtgcatctgcttttgtagcagtagtagtagccgtgctaatgcaattattgtggatggaacaattcatgtaacaatctcatgatttggatacccacggcggcaagcatgccggccgatcatcctagctactcgtaagtatcatttcagttgcatacagtacaatactccctccgacccaaaataagtgtagccatggttttctgcgtccaactttgaccattcgtcttatttgatttttttttttaaaaaaattaaaaacataagtaatgagtaaagtactattcatgttttatcatcttataacaacaaaaatgctaattataaaaaaatttcaaataagacggataatcaaagttggacgcggaaactcatggctgcacttattttgagacggagatagtagtattgtctgttcagttaggcttcgggaagtgtactaaaatattacaccaaaggttatcaaaagctggccttaaatacataataacttagcagcgcgttactactagagtactccagtatttaggaccctttaaatcacaggaataaaaaaaaatgaagaaataggaaaaacataagattttgacaagaatatagatgtaaaactgtagcgcccgttccgtcgtggcgcctagcgggaaaactatctcttaaaaaccctatttgcgaaatccgtttctttgcttgttgtctagtgtccgtgccatctcagatctcaaatccccgatctattgccgagttcaatcccgaatccaaatccttcccaattcaaatccctccgcaaaagtctatttcgcctccctcgggttngaaggncngnatccctnnnggccccttcccccctccctccttggctctctctctctctctccccgctctgccgtaagccgcgccgagccctccctcccgctctcacagccgcttcccgccgatgccgcccaaatcgccgcaccgcccgcgcgcgcgcgcgccgtggtggccgaccggccagtcgccgccgccgtcagcgcctgccgcgcctgccctgcgtctgccgcccgtgtcgccgctccactccaaaccgccccgccgtcatcgccgtcgtcatcgactcggccccgcctctccccgcgcgtccctccaagggacggaggctgagctccccccctctgccgcgtcgccctctctccctcccccttttccccaaagcggcaaggaggcaagccccctttctctcccccttttttttttctcttttccctcccgccggcgtcatctttccccccctcctgtcgccgttttggccgcgagcgccgagcgccagctcgctcccttgaccgcccaaggtcggtttccaaaccgacatcgccgccctataaacccaggcttcccccctttcctttcctctcccattcgcctccactccattgtcgccgcctcccgtgctctgttcgctgtcgccgttcgccgtcgcgcgtgtcggaggagccggcacgagcgaggacatggaagaggactccgggcgctcgccttcttcctcttccccggcccgaggccggagagatcactcctgtgccgtcggcctctcgtcacagcgccccgcctcatctcggtagtgcattcccccgttctccctcctcgatccatctcctccccttagttttcggtagtagcatgtgtagccttcccgtagctagctggcgccgccccgaccgttgccgccgctcgctgtgtgctcgccgccgtcgtcgcccgtgctccgtagcgcccgctcgtcgccggcctcgctcggcgtagctccgcccaatccgacgctagcaacggattcccgtagccgcgtagatgctctcaccgccgggaatcggcccctcatgacctcgtcgccgtttcccccttccctcgccgccggttgccgccgccgcaatccgcccccgtcgagctccctccggcgaatccgagccgttggctcatctcccctcgtcccatgcaaccccccggtgtgctcgctttcgcatgtatcgccgtggttcgctccaccaatcgccaccgccgtccgttgtccgttccggccggcgtcgtcgtctacctcccgccggcccgcgtggtagccacgtaggcgccacgtcggcgccacctcggccgcgaccgggtcaagcagaccccggtccgccgcttccctccgcccctcgcgcgcgcggtccaccgcgagccgtgaggctgcgcataggcccgccgcaccgcgtcctccgcgaaccgcgcgcatgcgccgcgcctccctccccaaaccctagcacgccccgcgtgcacctcgctcacggtgagctgagtcgccgacaagcgggtcccacccgggaccacgcgggttggacccggcccaccggctctctctctcccctccccgcccgcgcgcgcgcgttgggccgccttcttgggccggccggcccattaagctcgg

SEQ ID NO: 45883 - DNA, 2989 bp, Oryza sativa
aatttccaaaaccgcggaccggggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtttgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaaactgttcgaacagccgtgcccacggtcatgggcggatgtgaggtgattcttagcgtagttttgtttgactactgccttgtgaaatttgctgttgtggaatgggtttgatgtttggaaaatctgcggctgatgggatcagccaggcccaggtggccgtttgaaagctgttggccgggtgccaatcttgatcaattcaaaagactgaaacattgcacatactccgaccggatgagacgcactgtctcatccgtgtcgtttgagaagcactcccttagttgtttcagaaaagagtttaaataaaatcaatcgcaaaaacaacagcctttctttgaagcctacattaaacacttatttcccatggcttgctgagtactcctgtactcacccttgctctatataaataatcccccccagttgctgaagaagatgaagcggatcccgctgacgaggagttcttccaggagcaagccggctatgatgagttttagggtttcggcctagttcccaagtcgcgcctgtgatgtttggtccaagtcttggcttccgcttcccttttgtaatgcagttgtgagctcgagatctgtccgcagcccaacatgactgtactcctactctataataaagagacctctgttgctgtgatattctgtcttcctgtgataccagcactgtttcctgggactggtatcgattaacgggttaatttggagcatcacgggctagttccggtcgggactagttcggggcgtgacaaaaacagaggattgcaaaacacagaaaaaatatagtaatgaccgtttgattggaccataggaaaaacacaggaatttgaggagagataaagactcaaaggatttcttcttccatgaggttctacctcttgttaaaattcctccaaaacttgtatggaaaaaggcattccataggaatttcataggattccatagggttcattcctttgattcaaggctttgtaggaaaaattcctatagcaataaaatcctcttaaattcctatgaattttctttgaatcaaagggggccttagcctcgaattacactattagcatatgctgttagcctttaggccgttattgaaaagctcacatcctttaaatttttgcttaaccgtatgctatttctgaacactactctctccgccccaaagtaaattcatttatacacataccaataaaaaatagaataaacatgctttatatcaaatatcaatacaactattttttcgctttatctactcccataattatttcttatttttacaaactccgatacaataattactctaaaaataaatttatttcaagtaaaacaacaatagctaaaaatgaatattacgggagagggagtattgaacacaagtgcaaacatgattaaggctgtgttcgggagtgagggtcccggcacataaaatgaagcagcgtttaccacatgattaattaagttttagctaatttttttcaataatagattaatatgatttttaagcaactttcgtatagaaacttttcacaaaaagcgcaatgtttagcagtttgaaaagcgtgcgcacggaaaatgagacgagggagttgggaacaactccaaacgaacgcaacctaaggctgtgttcgtttctatatataggttgggaacccctctcttgtgcatgaaaaacatagcggtacattagcgtgtgattaattaaatattatgtttttttaaaaaaaggatcaatatgattttttaaaacaactttcgtatagaaactttttacagaataaaacacaccgtttagcagtttgaaaagcgtgcgcgcagaatacaagagagagggttgggaacaccgagcaaagaacataggctaaggccattcacactgcacctaggtgtcattccccttcacctaggcatagctcggagcctcgcaagaacgggggcttttgggcccacaagagaagaggtggagaaaggggaggtattggctcgttcttcgttagaatcgcagcttctaggcccacaagagaagaggtgaagaagggggagggaggggagaagcgccgatgccgatggcgatgccgtcgtcctcccggatctgcgctggccgcgccgccccccgatccatgcctgccgccgaggaaggaggccggacggtgcgccatacggggagctctgcccggtgcggtctaagcttggaccgcgccactgcattgccgcctccggccccgatgaggagagatggaggcgtggagctcggtgccgccgctactccaccggcgctcgggcggcgacgtcgccgccttcagccccgacgaggagaggtggaggcgtggagctcggtgtcgccgccgctttgcttcgtccgtccaggagagagagtggtgcggaatgtgtgagaggggagagggagagataaaagggagcggagagagatagatgggacctactccaagcaacatgcattgtggagtatgtactatctccatcccaaaatataatactccttctgtttcgaaatgtttgacaccgttgactttttagcacatgtttgaccgttcgtcttattcaaaa

SEQ ID NO: 45884 - DNA, 7130 bp, Oryza sativa
  unsure (1)..(7130): unsure at all n locations
cgaaacggagggagtaacttttagctatgaatcgtccagttggaagtctttcagaacgaacggtgagtgccccaagcgctttggtgatactccagtgtgagcgtgactgtgagtgaggtcacgaaaatgttttgaagcggtttctcgcatggagctgtgcaggtcgtgatggcgcctttggtgatggtcagctgtaccctggagcctctcccgcagtagcagcagcagctaaggcagagagagacatgctactatggtgcacggagattggagatggagagtggtcaaaggcgtaagcaggcatgcatcgcttcatttcagttcagggggtagtctcgctgcttttcaggaggaaaggctcgccggtctctgaggccattgctgaatgaatgataggattgagcttttgttacaaaggagtaaagagagagaatatctgcacgtgactcggctcggattctactatagacgtgtcacgtgcttgtgtacgcggacggcccgttgcaggcccatctaaggcctgctcagatgggtatccaaattctcatgaagtgatattcagtcaatgaaaaaaaaactggcgatgcaaacatgccatgattttatcggttgtactatatagtaattatgattagttaatttttgtcgaaataatagtaccacatccgttccgaaatattgtaatttaggatgagatttaggctttgttcgtttctcatggttggaaacgttctcctccggcgcaaaaaaaacggaacagttcattagcgtgtgattaattaagtattagtaaaaaaaattgaaaaataggttaatatggtgtttaaagcaactttcctataaaaaattttttacagaaaatacaccgtttagccgtttaaaaagcgtgtgcgcgaaaaatgagtgaggatagttggaaactcttagtgccgaacacaaccttaatcaatcctaaaacaagattgagatatgtccagattttttgttataagatgcatcaaatcaatgttttgggtaagatatatcaaatcaacgttttgggatgaagaaagtactctctccgtatctaaatataaaggattttagttggatgtgattagcgacggagggagtatgatagtttagcaatacaagcatgtcaagcagaggctggtgtgagtccatcatctgcagcgtcatggattacggataaaagcctgctgactttgctgtggtttagtgcgcgcgtgcatggagatgaccagatgacagcagattagcaggcagagtcccaagccagcagcagagccagagtccactaaatctgttgagcgtacgtgtcttcttcatccacccatgacgtccagtgctccaggctgctgcctgcctgcctgcgtttttcttgatccttggggattctctgctcagctctgggctctggcactgcctgccgacaaaaaaacaaaaaacaaaaagggcctgtccacttggatgggccattattattgaggcccatccaaacaaggtaaatcatgagataggctaatttgcctcctcctcggaataaagtcattcttaggccctgtttctttcagcttgggattattataatctagattattaagtcagattactataagttagattgttataatctgtagtagaataagcggttagttgtttctttcctagattattagagcctagattattgggtttgtaagtctaaaaagggagtggggtggcatggtgggtaatttttcatccaataatctggaaaaagctcacctaaatgagcttatcagattataataagctgggctccagattataataagctacttcaataagttgtctgtttctttcagcttactcctaataatttgtattataataatcccaagctgaaagaaaacagggccttaacctctcacggttgttttcaaataaattcatttttagcagtcattacatcaaagtttataaagaatagagaataaatatactgagagtaggcaaagtgctgaataattgcattgcgattcgataagttggagtattttagtatttgtcgttttatgttggtatacgtaggatgtgtgaaaaatgattttacattttataacggatgatgtagatagcactaaattgctaacggtacaaggaaatggcggtggctttggggccttcaagacggtggaggctgtaccgtaatatggagtatttgggccaaatatatattgggccgggccgagttttgttcttccacaaagccgtcgtggttatttgctgctaacctcaattcagcagatgaaatcatcaacatcatgtggccgtgccactttgcttcctccatacttaacattctgcattctagctccatccattgcctttgatttcttctgcaccaaatctcatcatatccaatctactttcttaccgtacagttacacacgtaatccatccattcttataaaaacctaaccttgttaggggatgagacttaatctagtacaatgaatttgaataatcctctatctagatttctcatactagattgtgtcctgttttttaattaggttgggtttttttaaaccaaagggagtatctataaagatcgagcttcatcgtagcgtctcaaaaagctttcaaactatatactagcagaattatccaatagcaaaaccgttcttttcttagaaaaaaaaatacagccaaaaagagctttcccaaccaaattggttttgagtcgttggatttcaaacggacgcctcggattagcgcgcgttcggtgcgggagacgttccaatttccacgcaacccgaggatgacaatgacatgtggaccccaactgctactcttgcgctgcgtgcacacgtggagcgagttgctgccacgcgcgtgccacttgtcatgtgttcggcgtcgggcccacacgtggcaggtcttgttcgtttgtaccgtgacctcctctgctttttcagctactctagctgtctagcacagagcagagtagacagagaccaactcatcgctgggacacgtcaccttcctttctatgctctcttgatgaaaccatctctctctctctgtgtgcaaaaaatcgagttacacagagaaggcatatgagataattgtttgacctaattagggaaatgaacagcagtaaaatgcatccatcataagcacgccaaaacatcatctgatgagtttacttccattttatttttatttttttccctgatgaatggtgtttacttcactttgctcgtttacttcgatcggtctcgccaatcctaccagaagaagctaaaaacggcctctctttagaaataggtgaatgcctcagcctcatctgagcaatgaacacagaatctcgaccgatcaaggaaaaatgttcttttctgaacttgtcttctctgcatcctttccttgccgccggccaatttattgactcaccgagaagtttgataagtacaagagaataacaaaataacatggttgttgtgcagtctttttttttgcttcttcttcttaaacagattcttttcatcttgagccattgttgatctttgctcctctggtcgtcaactcttttctcctgtttcagggcgtaggacggaggaggagatgagaaaaacaagaacacttccagctctgaatttcactctgcatgcataagttgcaggattaggctgattgcagaagattcggtgagttgtttgacactcgagagaacttggtttgttttgaatttcggtctgtttatttgacctgttcttgtacctgaaacttgaaagactccgagtaagaggggagtaaacgagtgataagccccgcgatttgttagcggctgtttttcagctaaccatctttcaatttctgtactggtttgtcagtgacttctgcatgtggctgtgttgtgcgactaccttggtccttcctgattagtgatggggtttagcgcatggtaatctgtttaatgtgcatgcatgccgatgatctttcatgtagactgtatattcctgtgcttagaagccatctgtggatcaaatccatgttgtcttccaagcaattagctcatctgtgatttgatttgtactttactctttgggaagaatttttttgtctttatagcttttcttgcatgaattccattccatgatgcatttggtgtttcttgattggaggcagtgtttgaatgcaagggtcaggttgcgctggtaggtatctgaggaattcaggaattgaggatgatgagtaatggccacagcaacagcagcaagagccttgaaaggtttatatctcggagggctctgcagatggggagctctgctccctgcaagacatgggcactgggcttcttctgtggtgtctgcattgtgtacctgtttggtgttgctctcccacctatccaaatcctgatgatccgatcggtacatccaccggttcggcgagcaatcttgttgaattcaacatcaactgaacctggtattttgcgaacaccatttcgcataaaaaattcagtagtagtgtagtactatatgttcatctaggctgaatgtattttttcttttccttttaactgtgacaatgtctgtgtaaccagctttttccatgcaggtggagctacacaaacagatgacttattctgtttaacaagaaaagatagaaatagccaccaatagcaaggacatcaatgaagctgataaaatgcatttgtataatgcttggagcactttactggatacgaccagtgatgaagttatgaaaagttcagacgtgccgcggccgcctcatctggagaattgcaggcttaaatgggaaagaaataagaaatttgacagttatagcgacaacggcgtatttcctccttggacattatggaaagggtcacttggtcttgagttattcaaccagaactattcagattcagaagagtggaggcaaatgtttttcaggtcaaatgctaaatctgacagggcgccatatccaccttgggtgtgtaaacttgcctgaactcgtaattgtcttgtcagtactactatgaatgcagtattctaacttttgagttacaacaaaactttaaagattgcaggatcagatgaagaaaactatccactgaccagacaagtgcagagagatgtatggattcatcaacatcctccaaactgcagtgatccaagcttgaggtttctctatgcagactgggagaggctaccgggatttggtataggtgcgcaactcgctggaatgtcgggacttcttgctattgctataaaagagagaaggattctagttgcaggatactacaaccgtgctgatcacaatggttgtaaaggtaggaacaatccagcttaccttgtagattatgaattgataatatgatatgtgtaatgctacctcaagttgcatcttttaactgacatgataactgacataactgtcaatgntcaaatttcaggcctagcaagatctagctggtcatgctactttttacctgaaacatctgcagactgccagaaacgtgctttagatctcatgcaaagcaaagattctagggaaaatggaattataaaagttaaggaaaactatacctccaagcaaatatgggctgggcatatacctaggtaccatttcgatgcgctggtcctgtttctggaaagctaaacacgcacccaatactgatgagctatacacatttactccctccgttcctaaatatttgacaccgttgattttttaaaacatgtttaaccattcgtcttattcaaaaaatttaagtaactattaattcttttcctatcatttgattcattgttaaatatacttttatgtatacatatagttttacatatttcacaaagttttttgaataagacgaatgatcatgtttaaaaaagtcaacggcgtcaaatatttagggacggagggagtatatctcattcatcgctctgttcttgtggctcttgccgattcatgcacatgttttctgaaacctgctgttatgcaggatatgggggagaccatggaaatatatgcaaccgacaacagagatagatgggagattggttaaaaatcattgtaaaatggatcggagatggtggattgcacaggtgtgtacctcatgccaagatgaatgatgagcatattttgtgctattcataatggggatgcaaatatgcttcatcaacctgaaacttccatgtaggccctgagatacctaatgaggttccagtcagagtacatgtgcagattactgaatgtggctagacattcagcatttggcatgcaggcagcaaagatggttcttgaaaatgtcccagatccaccaaaggtttgtattagcaatctgaagatttttatgttgctttgttccgtggagagttttgtctgcgcatcattcggataaagcaacattagcactaaccaccttacttttttagataagtaactgaaagatttcacaattgcagcctagcattagcagaacagaatctgacattgagcgacttgtgtggtcggagcataaaccatatatacccgggcctcttatcagtatgcatgtaaggatgggagataaagcttgtgaaatggaagtagttggctttgagaaatacatggagttggctggtcgtcttcgaaaacgttttccaagtctcaagaacatctggctttctactgaaatgcaggcaatttaactcctcaattctcatccctcgtatggtgtaaattaatttcttcatttcattggtctgtaatttaactctgctaatgctgaaatgtaggaagttatcgacgaaacaaaattatatcccaaatggaatttctatttcacaaatgtgacgcgccaagatgtcaatgtgagcatggcaatgtatgaggccagcctgggccgtgagaccagcacaaactatccccttgtcaatttcatcatggccactgaagcagatttcttcattggagccctgggatcaacctggtgctacctcatcgacggcatgcggaacaccgcaggaaaggtgatgtctggctatctgtcggtgaacaaggaccggttctggtaagcaattcagaagctgctaaaccttgttcattgtattttagctcctctgaatagatatgtttggcctaagtttgcttctgtacgg

SEQ ID NO: 45885 - DNA, 1298 bp, Oryza sativa
  unsure (1)..(1298): unsure at all n locations
agaaatgtggtttagtcataaaagttacacaacaaatttaacactcgtagaaatgtggtttagtcataaaagttacacaacaaatttaaggcttcagttgtaaaaacttcatgacaaatttaggattataatcatcgttaatggcatatattctaataagtacgaacatattatagtttgtgtataataaaatgttacatcatttttaaaataccacgcacttcgtccttgtgtgatgatccgccatagctaaattttagtgctgtatccgccactgtgttaaatgatgatgttttttataaaaagttttttttatcaaagtttattcgaaaaatcaaataaacatatttttaaagtttgtaataactaatactcaattattaatgaactaatggtttttcttgttttatatgtcattgaaaagctaaatcaagctgagattcaaacaggtctaaaatggtaatacagacatactcacatcctaatacaatgaatcgaatactgttaatagattatgtccagattcattgtactatgatgtatcacgtcgtagcacgattatgaatctaggaggggtaggactatgaatctggagtttttttttaagtacggagggagtaatatagaaatgtactagtgaccaagcaatagacagaacagcagcacagcagaagtaaacgaatcgaatcatattcatattcaccttgttggccacagacgcatgacccgcagtgtctagccacagccactcgtgtaacatggttacacttcagagtttaggtttgcagaaccagcctatagctagcaaatttacagacagaacagagccagactatagataaatgatgatacatcgttgccaccgttgaaatgccaccggcgacaaacctacgaaagatctaaccgatcttcttcaggttggaagagctcaagctctgagctcacggatgtagttagggctcattgggttgaccttcggcgagagggcggcgaggtgcacgtcgttcagtgccgaattgagcttgctctccagtgggctgaacggcatctgctccgtcgccggctgcttcttgacagcgcgcaagcaggctaggtagctgttcggctggttgttgcagcttggcagcttgcttatcggcacccctgcttccttctctctggacaccggtgcgccagaaggatcctgcaccaaatcagagatccccacatatttctcataatttgttttcactgacaagattcgatnnnnnnnnnnnnnnnnnnnnnnnnnnnnnnnnnnnnnnnnnnnnnnnnnnnnn

SEQ ID NO: 45886 - DNA, 11585 bp, Oryza sativa
gagctagatgacgtaccccgagaaggaggaaggtgaactgctgctgctgcttgctccctgcttcttcgaagtgatcctccaagagctttctcaggtcagaaagacacgagttgctcagcaatttcagaccttttatcagatggccggactcccatttgatgtagacttcaagcaggccgtcttgtccagaagcattgttctccttgttctcatcagctgcctccaaagcattgcatgatttcagctgctccgacacgggcaacttggcatcgtccacaacttggcagacgataggtgaaagctgcgaggatactggactgtcggtcactctgacgtcgcacattggaggttctatcgctccccatgctgaagggtccttgttctcatctccaaacactcgcttcgcaggctgctgcttgttctcatctccgaatgtttgcttcgcaggctcattgttctcatctccgaacgccttctttgctggtgactggaccttcttggctaattctcggtgattcccacaaagcctgaaaatgttctgaatccggttattccttgtggcagggtcttcaggctctgcaaggggctgttgcattacatagctctcttcgacaacttccttgcacacttcctcttcaacgccactgtctttatcttcttcttcatctccctcctcaaagacagtgctcaggaccaccttttctgggtacccagacagcctcacaacatcatcttcttgctccacagcgctggtgcaagagcctgcagtatttgcttggctccatatctggccctgcttgcgagtatcctccttgatcaccttcacgtcttgcgcagctggctgatctcccatatcaaaatcaatggacatatccattgacatggactgatccgccctagcggacatctctgacagacgtgccagcaatctacctccgatgatatcctgctgcacaggcttttcacgctcaacctccttcagccgctgttgcaaagcaaggagttcttgctgctgcctaagcattttctcttccatcttcatgagctcagtcctcaaactctgggtcttctccatgacctttgagttaatctcttcctcctttgcagctgctccctgaccttcaatcagcttgagcttcgccctgagctgtgcaagctcctcttcctttttccttagcacactctgggcctcattgcgctctttctcccttagcttgttctctttctggagattgtagatgaactgattcatcgcgacaattcttgaattgagcattgtagatgactcttcagagctcattttgtcccttggggttgcagcgtgggcagcacggataatgcacttcgctttagcaccatactccaatgtagaaactgtcttgtgcaattcctttgggtcaggacttgcacagagaatcatcaagatttttgatttgtcatcctcaaatgaatcctgaaaattcatggaagatcgtaggcattacgttagcagctttaattttacagtataaatttgtatcgaggaatgtgaaattttagaatcttgtacctgcaagagcattgtgagcttgctgtctcgaaatggaacatgggagtcaccattagcaatggactcaaccactcgtttcaaagccgtgttcccttggttaatctttgcagtctgttcaacagtaataataatgtaaacaaaatatgaacttctgttatcgaacacataacataatttgcaggaaaaaaagtactagtagctaatctttgcagtctgttcaacagtaatgatcatgtaaacaaactatgaacttaattatcaaacacatacaataagttgcagaaaaacaatataatagtagtacctaaagtacttaaaaacagcgtgactgtgataatatcactttatcattcaaaaaaagggagaaaaaaaacctacaatgtggtcactgctttgcagaccgttaactgttatgtttagatttttcattacacaacagtgttaattattcttctgtattaggtattcattgttgaaggggtaactttaaaaacgtcctgctgaaagtacaaaattatacaggcattagtgacatcacagacctgcattttggcttcaaatccagtttggcctgctgcttctatgttctcagaaccagccatatccacaagcatgagccttccccccaccgatggaacatccaaaattatctagagaagtaaagcgaagcttatcaatagcgagttcatttttgaaatgaagattccaggagctaacagctcaatacgagaacgcaagtgtgcaactaaccatgcagtggctccgggaactcctctcattacaaagcgtgctcttgacaatacgcctcttttccacttttgcaacttctcttgatatcttcccggcttcatttccagatatgtaggttgcattcttggctttcttccccattacttctagcctcgcctgcacataaagtaaggagtaaggactgagaaacttcaacaccatagaaaatttccaaagttacgcagttaaaactattaaaatcttctgtccatcatatgttcccgaaaatcatgttaaaacctatgataagtatgccaatccttggaacttacaagccatgagcttcctatttaagcttacagtaattatccactcaaaaaacaacctgtttcagctcacagtaagtatttcagcttccaatttcatattaccatttgtttatccctaaaatgctgcaatccgagcaccagaaaacaacttaattcagcttaaagtaattatccgctcctaaaaaaaatgtcagattcataactgacaagcaagattcactgaaaaggacagtgacagtaagaaagcagacaccacctgttaactttcaaacttcaacacacatctatcttaattaataacatttcctaagcactaggcatcatcacatatgaacccaattgcaaattgcagctgcattactaacagttaataatggcatgtggaaaattagtttcggtgtatcaccttgggggcgtttcctttagcattcgctccgctccccacgagcaaatcgtagatctcctcgttgtagatctcgagcacggcaacctgcacgaacagccccatcccgaacccggcgtcatcctcgccacggccatcgccttcacccccaccaccagagacacctccccctcctcctcctcctccttccagtatatcccggagagcgcggtacacgatcccgggctgcttggcgcagccgaacatggtgtggctcttcccggagcccgtggggccgtacaccatgacggtgcacttggcgcccacccgcaccccctcgatccgcgaccgcacgaagcggcggtagaacccctccagatcctcctcctcggagaccgagaccccgtcgagggtgaagtcgcggcacccgccggcgtcgccgcggacgcgcacggccgtgcccccgcccgcgatctccagcgccgacgcgccgcccgcccccgcggcgaggttccggatgcggccgatcacctccaccgggtgctccgtgccgcccgccgcggcgcccccgccgccgccgttcctgggcgtcatggccgggaagtggaggcggtgcttggatgcgggcgtcttgagcggggtcgtcatggccgcctgcggcgtcggcggcggccccggccggggagagggcgtcggcggcgccatctgcgagagagagagctcgctagggtttggagatgtgaactcggattcgatgcgagagaaagagagagagaattggagatcgagttgcgggtgaagagagagaggagaggagagggctgggacttgggaaggggaaggatttgaaagggaagtagccgttggagtcgtaacggtaagtgtgtttgttttgaagctggacgagagggagaccgcaccgcgccgtgtaccgcccgccgcgaaatcacgagattttcggtcgatgcaaaatgggggaaaccatgcatcaaaattgaattctgaaacaattttatatggtaacttttctttgtttccttcttaagaaaaatgctccctccatttcagattaagatgttttaactttggtcaaaattaaaatagtttgatcaactttgtagaaaaaaatagtaacaaatttattatgaaaatactatatttaattattgatttgatgaaacttatttagtattatcaacattattatatttgtctataaacttagtcaaagttgaaatgatttgactttgatcatacttaaaacgtcttataacctgaaacggtggaagtaatgtagaacgatatctcgttcggattgaatgatacctctaagatatcacctaggcacttgatttttgataggtatcagttgatacctgttcagataagatgatacttaccagatatcatacgatatttttaaggtatcatttcgttcaaacgggataacatcgtatagattttactcttttttttttgtccaacgtactatgtcggtctgatgcgaatatatagtattgtttggattctactatgcatttatgggtttagtttttttatttggtgatatcctttgtctgaacatagaatcgggtggtggtgcagcgaaactgtgcaaagataattaatttgtcttccgaaactgtgaaaaataaatcatatagtgatgttaatcaaagtgtttttttatttattactcctatctacttgtggagtagctttaaaatcatcttataaatactcgtattgggatcgagcgtcacccaagtagtactacagtaatttagccgatttttttataaattggtcatttttaaaaacttattttgaaactagtctctgcaaaaaactttaatcaaaaataggccatggactcagcgccatggacattggcgctaaactataatccgtggtgatatgaattcgctgagtcatcagatcttagcgccaaggtatttggcactgaggtccagacggtttaaataatcgcgcaagcaacatatagaaccaagaccgtgatagcgtggtggttggatgcttgggctgtcatccatagggtactaggatcgaatcctggtttccctcatgtattttacaaaataagttttgttctcttcactactcactctctttaataagttttgttctcttcactactcactctctttacaaaatgactgttccgtttgtaaatttgttttattttgaatttgatttgaaatttcagtttaagttctcatttgccatataatatagcactttaatatttttttaaattaaaaaaagtttcatattaaacatatattttgaagatagtattacaagacaaaaaaaagaaaataaataaataaagatagaaaaagaaaacgagataaaaaaaagaaaaaacatattaatactcactcttattctttacaaaatgactgttccgtttgtaaatttgttttattttgaatttgatttgaaatttcagtttaagttctcattttccatataatatagcactttaatattttttttcaaattcaaaaaaagttgcatattaaacatatattttgaagatagtattacaagaaaaaaaagaaaataaataaataaacatagaaaaagaaaacgagataaaaaaagaaaaaatatattaataaagagtgagggagagaagaaaaagggaaaactaaaaggaaaaaaaagaaaaagaaaacgagataaaaaaagaaaaaaatattaataatgagtgagggagagaagaaaaagggaaactataaggaagagtgagggagagaagaaaaagggaaaactaaaaggaaaaaaaagaaaaagaaaacgagataaaaaagaaaaaaatattaataatgagtgagggagagaagaaaaagggaaactaaaaggaaagaaaaaaaaagagagatgggagtcaaaccctgctcttcaaggatagagtagaactctactaccattatgctatcaatggggtgttactataaatgcctccgcatctatttaaatcgtctaaacctgagcgccaaataccttggcgctaagatctgatgactcagcgaattcatgtcacctcggattagagtttagcgccaacgatgttggcgctgatacgttatagcttagcgccaatgtccatggcgctgagtccgcggcctatttttgattgaagttttttgcagggactagtttcgaaataagtttttgaaaaggatcaatttgttaaaaagtatatacagtattttgtgttccattatcttcatttcacctggtacgatgtgggccccgaagtggcccatgagacggggaaatgtaacatccgtacttatgggctggcccaatacggacatattcgtatttccttttttttttcggggatattcgcttaggtcttgagccccgaacactagtcgaagttgggaagcatccaatgaggtatggaactataaaaaataaggtaaaatctaaacagagaggcctctctgtttagtctctgtttagtcttaataggagacggtatagaaagtctacgtacatagcagagaaagcctacacatctgtacgggagacaacagacaaatgcctacacatctatataaaatttctttttacccttcttataaaattttctctaaaattacttatccgatatacaatccgattacaccattgtattcattacaattaaatctttacaacaagatcttacatgattatattgcgacgaaaaaaatatttatgtttgtaaattacttttattatatatgtaagttacttttatcatatatataaattacttttagatttgactaagttacttcttatacattcataatgctctaaattgattatttgtattattgtttttagtaaattctgtaatttgtggactttaaatttaatttttcgatagaccatattttctttcctacaacgaatttacttctaatgttataacaatttacttgcattttatgctaagttacttttatgatttatgtaaattattatttctactatagagagagttagaagtacttctattacataactaaattaattctgttgcatataattacttctactacagaaacttatttctattgcatagctaagttacttctattgtatagctaagttacttctattgtataactaaatcacttctgcaatttaaatacattgcttttaaattaataaaatatttgaatatatatcaatatggatcttgtattgtcacatattttatgtagagcataatgacgcaaatagatactaaaaacaatacgtgatttaaaatatataagttattaaagagcttaaatcacatatatgacaaaagtaacttacatatataataaaagtaacttacaacatatatatatatatatatatatatatatatatatatatatatatatatatatatatatgtatgtatattatcagaatataatcatgtaagattttgttgtaaagatttaattgcaacgaacacaacggtataatcggatcataaatcagataagtattttaagagaaacttctctaaaaagaaaaaaaaacatagatattgagtgtactggtagcttcttttggaaagaatagtgtctctctttagcactatcctgctagtactctcggtgtagttgtgtccaaaaaataaactttgttagcaagccagcggtaatgttgtgtttgtttgggactagaaacctcgttaacgcgtgatcaattaagtattagtaaaaaacttaaaaataaatcaatgtaaaatttaagcaacttttgtatgtattttaacagaaaacacaccgtttaatagtttggttaaaaatatttttttcttagagcaacttttttattttttttataaaaacataccccctccgtctcaaaatataagcatttttagctaaaaattgctatattttgggatggaggtagtacttattttgaaaaatatggaaaacaaaagaatataagttgtcccaacccctctccctcgttttccgcgcgcacgcttttaaaactgttaaacggtatattttttttgaaaaagtttctatatgaaagttgtttaaaaaattaaattaatccatttttgaaaaaaaataattaatgcttaattaatcacatgttaatggattgttatgttttccgtgaatagggtgagtagcgaacacacccttaatactgctctagggctgcacataatcgccacataagctgctattcggcgtcaaaagcgacataactttatcaatcctaattatcatcacacgataggtcactagcaaaactgacaggcatcaacctttccagacacacacagagtgacatagagatgctggcattatgctgcagtgtttaaattaagatgcttgctaaaattatcattaacttaggtcagacaactacacctcattgttatttgtttagtacagatgcatgcccatcgagctagctaaacaaaccatctgcttttggtcgctcacagttactatttgctgtcctaatcctttgctctagctaataagcagccgctgcaagaaaataattaagctgggctgcatgcatgcttatcatggagggaggagggagagatatcgctttgtgagaaggcaagatcacatgagctgagatgagaattgagaggagaagagagaagagagaagctgcagcttgcttgatcaggggaccaatcgccatggatgccattggggtccatgactccatggatgcacacacacactgtcagtctgtcaccgatcttatttatatgtgctagtggtagcctgttagctatgcatctttgctgctttgcccattctgaaatgagatctcagcaagccggccagcaacaagaatgcttctgtgcgtgaactgtaggacatctgaaactctcgatggatggattggatcaactgtcgctcgatcgacgagatttgtttctgcataggattatcctccatgaagctatcgcaggatatgatcagtgtagttagagactgtaacaacattattctgaatctttctacttgctgaatttagtagagagctgctcttcctcagcctcaagctagaagcgagttcagacttcagagcagtaaaattatactccctccgtctaaaaaaaagacaaaccctgggttttcatgtccaactttgactgtccgtcttatatgaaatttttttataattcatatttttattgttgttagatgataaaacatgataaatattttatgcgtgacttgtctttttaatttttttcatattttttttaaataagacggacggtcaaacgttggacacgaaaaccagggtttgtcttttttttttttgggacggagggagtatatctctttaattgtagaattatagcaaacagtgtactcgtacgtgatctggattggcacagtaacaacaagatttgagctagctaatggcgccatgtttcacagctgtgccctgcagccacgagagatcagggggcctacttgggctgagcagtagcgagatttgtcagagacagaagcatccgatctagtgtgaatctgcaggtacagagaacactgtgctgcccatatctctcaccaaccattagatttcctcctcctgcagccgttgcatatgcttgtgccttgccggctcagctgctctgctcatctcggtgaccaatggcgaattgtcgattaattgcctggttgatctgtatgtttgacacgaccattcagttctactatttgtcatcaagtagcagtaggctaattgcaattgcaaccaactaccgcgcaaacttgtctgcgtcaacacggcaccgaactgccaaacaacacaacaaccaatgacttttacaccgttttggtcagggcagggcagcctctcttattatgggttgattagttgcatggtctacagattaatcactgctagttactgtaaatactagtactcccttcgtttcaaaatatttgataccgatgactttttaatacgtgtttgaccattcatcttattcaaaaaatttaagtaattatttatttttttcatatcatttgatttattgttaaatatactttcatgtacacatatagttttacatatttcacaaattgttttgaataagatgaacggtcaaacatgtgctaaaaagtcaacggtgtcaaacattttgaaacggagggagtgctattgtactagcgatgatcacattagccaggttgctttatttggctgtgtcagtaataaagacaggagatataaaccgtttttatcaattattaagaggtgtttcatcagtcctaaaatgtaagaacctaacactggatgagatatttcctacccattcaaattcactgtactagaaaatgttccatccagtcctaggtttttatattttaggatggagagagtagtttgtttttttttctttttcttcttctttttctttcttcacgaggaggaggagatcgatcattagattcgatggatatatcgtagctaatgcgggtatggattattaaggatatttaaccgttacaaattcgtcctgcagctatatgccgtacgtgtgtcttggtcggccgtgtgtaaatctcacggaaaaggacgttgtcagggttgttcaacaaagctttaaagtgatgcaacgacaatgggcatagtgtcatccattgatgacattaatcttacacaagtggggtgttatgtcatggctcatggggaccttattcaagtttaaagagggaatagcaattaatggataagtgacattaatttagacaagtgaccagcattctttccctctttttagttatagccccccaatacaaaaatgcgtcccacatgtacacaatatcacagcactagctacactaactcataagttcaagtttctgattttcttttggtgccaggcaacgtgtgatatagtgacttcgttaatttcaagtctattagtctcaatcgttcgaagttgcttataagagcgcatatgcatacaattgataagggtgacgagcatatactggctccatcgtaaaatatagctatcagatgcgacatatcatgtattagttagataattcctccgttttagaatatagcaaattagaactagattaaacaccatataacacaatgtatctatgtgatgtccaatctagtttctggttactatattcctgagacggaggaagtatatttaagaaggatatagcaattgtttgcgtttgtattgcgtttagcgtagctcaactggttaggtttattgtggtggaactaacccacatgggcttaagtcataaacttgatacggatggtcgtattttactgttaattatttatttagtggtaggcgacgtaccccttgacagcgagacacccgtggtgtttcatacaagctttgaaattttggaattggttttgttgccggtggggaccggaattttagaaatttgtttgccgaaattatttgaaaatttgattgattttgaattaatttgaataaaacctgatcaaattaaaaaaaaattacaaaaaactgaaaatttcgggcaagatgtgagcttgccggggggggggggggggggtg

SEQ ID NO: 45887 - DNA, 22645 bp, Oryza sativa
agaaatttcgaaccgaaatttcaaaccctggtttcatcaattttaagatataccggcccagcctcgtggatatactcatagagacagggtatgcgtatgcgtatgcgtgtgttataagcaccaacgattgtactgtgtttctcaaaagaaaatcacacccgttacttacctaaccatttaaccaatgatgtttgcaccaagagaaaacatcatcaaccgcaacttacttagctcacaaaacaaactgtcctggcgaccatgaaatgatcacccgagcccatgacaccaccaaaccaaaccaaacccccccaagatcacccacacaaacacacagtggagggagggaaggaggcgccaatctagagcacacgcaggcaaagtctcgatacagcaggagggcgagacgcagacacagagagaggagaaaaaagaaaaatacagcgagacatcgcgcgaacaggaggaccacttcccccctccctcctctccagtctccctccgccgcgccgcgattcccctccctcccttctcccccccgcgccgtcgtcaccgccgccgcgggaggagggggcggatcccgaggccgacctcggcgagccagatctgggccacatgccgcccagctcggcctagatccgccctgacctagcgccgagcgacggggtgggggcatggaggacgcgtccaagtacgcgcacagcccggcccacctcgccgtggtgcggcgggaccacgcctcgctccgccgcctggtcgcggggctcccgcgcctcccgcgcgccggggaggtggccaccgaggaggagtccatcgccggcgaggccgtggccgacgcggtctccgccgccatcgaccgccgcgacgtgccgcggagggagaccccgctccacctcgccgtgcggctccgcgaccccgtcgccgccgacatcctcatgtccgccggcgccgactggtcgctccagaacgccgacgggtggtccgcgctccaggaggccgtctgcacgcgggaggacgccatcgccaccatcatcgcgcgccactaccagcccctcgcctgggccaagtggtgccgccgcctcccgcgcgtcctcgcctccatcaaccgcatccgagacttctacatggagatatccctcacttcgagtcctccgtcatacccttcatcggccgcatcgccccctccgacacttaccgcatttggaagcgtggagctgcgctgcgtgccgacatgacgcttgccggcttcgacggctccgcatccagcgttcggaccagaccttcttgtgtctcggggatggtgctcgtcctgaggatgctgggggcaaagagttgcacccaggttctctcatagtgctggctcataaggacaaggagatcacagatgcattggagggagcaggggtgcaaccaacggaggccgaggtcgcacatgaggtggcgttgatgtcaaagacgaacatgtatcgtcccgggatcgacgtgacgcaggcagagcttgtgcctcatttgaattggcgccggcaggagaggacggaagccgttggacattggaaagctaaggtttatgatatgttaaacgttctggtgactgtgaagtcaaggcgtgtgccgggggcgatgacagatgaagagctgtttgcgatggagggggaggagaagaatgggaggggcactgaacttgacgcggagctggatgaagtgttgacagccgaagagaggaaacagcttgattctgcgttgagaatggggaccaggaagaaaaatttgaaaagaggtgcaagaaaagtgatgccggggctgatcatttggatgcaaatggcgtggcaaaagataagaagggatggtttggttggggtggcaagaaaggcaccaagaatgacgagaaaccatccaaggcgaatcaagggagtaaggatgaatcaggtgacctaggaaagggaaaggagaagaacagcagcaagaagaagaagggtgcatcatcaggggattctactaaacatgaaagtgaatacaagaaggggttaagaccagtgttgtggctgacaccagatttccctttgaagacggatgaactgatccctctgcttgatgtcttagcaaacaaagtgaaagctgtcagaaggcttagggaactcttgactactaaactgcctccaggcacatttccggtgaaggtaaccacctgccaacttgactatataatgtccacctatttcagcaattaactgaatttttgatatgccattcattttagtcaaaatttgcacgcttattcatttgcaacataaatggtgatatgattctatgtaactcaatcaacgactgtttgctgattgtatgagcaattattttgcactggtttctttgactgccagtgtttgttgtttgatccacctgctgtgtcatgcgtcgtaattcactccctagctgggacttgtgctgtctgccttgctgcttgtgcatagtactgtttgaacctggttatgacatgtgcttgaatatgaaattatgaatatgtgtttctttattgttggcgctgatgcgcggcttatggctatgcatgtggtttttttccctttagaccggacatattaatacaagatagttctgttcaagttctagaactagcacatcttatgtgtgtcctcccgggtaatcaatccctcgcactaacaaggcattatcataagatgtggtgcccgccatgtgcacaattcatatgattgatggatgttcgaataaccaaaccttttctattagttaccactactattggccacccatatggaataattagattccaataatagatattatatttgggtgtaaatgataaatgtgcagtgtacttgcaaaatatcattgactatttctaaggatttgatgcatgatggttgatgacattttttttccttgttgtattaaactttatatggacatggaacactatcgagttattgaatctagtacaaatatattgtatatttctatttgtctgtttgccatttcttttatgtggtgttaattaactttaaaagtagccagtgggtttctgctcccaccatcaatttaataatctcacagatttaagaaatgccaaaaaaatatatccattgaagctttcaaaactttcatatgtttatttcctattcatccactctatctcttcctctgtttgagtcttgattagctgggtcctactccaaaccaccataaaactgatgcccccctgtaccctactgaccttgtatccctaaatgcagttgatgatccatcgacatcttgtgaccactcttcctgtcaaatgttatttcatgtgtcatcttttctttggtgaatgctgcagtaatttttccattgcattattagactatttttaccgctttccatgttttgttgccatgctttattgtttctaaattggtacagatgtcttgtctcaatgtgcatagcaatctgaatcgtttcattttgttgtaacttttttggaatctcatcatttgttttgaatcttagttcttgttggataaggcattgtggtgccagtacaagacgtttgcactgcatcataattattatttcacatagtctcaaatttgaaatcagatctcttcttttaccaaaattaacatcactacagttacttcgaaaatgagattcacatgaattaatctatattttggaaaagatgatatctaactctctgtaacattgattttcagattgcgatacctattgttccaacaatacgagtcatcgtgacattcacaaagtttgaggaattacaacctttggatgagtttgctaccccaccctcaagcccaacgcaattccaggatgccaagggcaaagaatcagaaggatcaggctcatggtattcgtgggttagaggggggcgtggtgcacagtccagtgatagtggtgatagccgtaactggaaagatgaggttgatccattccaaataccttctgactacacctgggttgatgccaacgagaagaaacggaggatgaaggcaaagaaagccaagaacaggcggggctcaactcggaaacaatcatcgaaaagcacctcgtcggaaggaggtcacccgatgatggatggctttgaggagtaaaaaagtttcgccacatagcaggtcacctttcattcagagatgttagatgttgatgtcagctgtgctgcgcacctgacagcatagattgataatgtgctctggagaacgcgtagttgattggatctcctcgaggaagtacaggatggctatataccccgctaatctgtaattcaattctattttttgcccccttattttcttcttccagctggatgtatgtttgatgatcatgatgatacggccctgttgttgttaaagatgtgttttgtggggggctttttagctgtagcacttcccctcctgttgtacgaaaaccctcgaatctggcagtgattttctcgcaaagaggaagctcaatgcacatgcttgcttatgactgctgctgtccctcttctcttcgctttgtttccaaggaaactggacatcttatgcttgccagagacgttatcttgctttctgttggtacttaattagtacagctgctataacttgctgtagcttattgtgtttcaaagcagagtaattgtggtgctctcattgaggctaagcagatcatttacagtctgctgttgagagcgaaaccctgcgatgcagaaatgtacaaaactcatagttgatggattgaaaggatgttatatgattgtgaaagatcatgcagcttactgtcgatcagatgtcatcatttggtagcagtctctctcttcaaatgaggttattatggccacacacagtttgggattttgccggttggtaagctacgctatcagcttgagggcttgtttagagcgaatagttaaggggaaaacaaggttgaatgccagaattagaggtccaaccagctggattacgctgaaagagacgctacaatccttaccattagaccctgttttttttttcaacttcaaacttcctcattttctattagcatgtttttcaatatgttaaaatatacattcttaaacaattcctatatataaaagttattttaaaaactgaaaataactctattattcaagtttataataatctgtattaggtgcacttatattagtatattctactaggatatcctgtattatgtgcacttatattgggacgaagagaatattaataattaattaattatatgcttatgagatttactgttttgcgtgtgcttaaaattctccttcaatgggaggcaaacgaacgggcccttagaagctcatcacttgggccgagtcacgggccttagcccaacaagagaacagaactggtcggtcactgacaaagcgggccccacctaatgcggccccagcgcttttcggtgtacccatgccgcctgggcccacagccacagggcctcgcgctcgaaacatttcgaaatttgaaacgcttctcccggtcgtaaaattcccaaatcaaaccattccttccccaaaatctcgcaaaccatctccctctccctctcgtcttcccccagatccccccaaaccctaaccctaccatcgccatggcctcccgcatcaaggaccgcggcaaggccgcacccgccgccgcgggatcccgcccgctcacccccaaggccttctccgcctcgtcgtccgctcgccgcacccccgccgccgccgctgccgggaaggagaactcggcgtccaagccctccaagcccaccgccgcggtgcggtggtccacgtcgtcgatcccgagggccagcaggatcccgagctccgtggagtcctccaagctcgtctccaccctcagggcgtcctcggtgatgccggggagggcatctgtcgggaaggaaatggaggcggaggcgggcttgcggcggagcgtgagcggcgggatcagggccgctgccccggagagagcgaggaggtcggtgggtggcgttgggggtagggtcccggatgcgaggagagcaagcagcgtgcctcgtgctgatgagattggtaggaggagggatgggtttgatgctagggcgaaggcgagtgatgtgaccagtgggagaagagaaggctttgatggtaaggctaagcaaatgaatgcggttgataggaaaagagagagcttcgatgtaaaggcgaagcagatcagtgggaaaagagggagcttcgatgttaatgtgaccaagcaatgtgatgagatcaaaggggaaagagagggctttggcaccaacgcaaagaagcaatgcgatgggattgatggcgacaatgagggctttgatgtgaaggccaggctaggtgacgaaatcaataagaagaaagatggatttgatacgaaattggtgaaagagattcatcccaagaaagttatctctagtgtcactggttcggcagaagcttcttccaaacctgcaccttttcctgctactgagaaggatggtgacggaggcaacaatgctgtcatccctgtattcactgtccatgtggtggacgtggacgatgttccttgcagagccagggaagagcagaagaatactgatgagcctaagaagcaggaggaaaagagcaagctggcagacaagattagagtttttgagaaagcgtctgcaagtgggggatcagtgaaatctgtttctagtttgaacaagtacccaagcaagctgcatgagaaactagctgcattggaagggagagtccaaaagatagcgacagatatcaagaagaccaaagagatgctggatgagaataacccggatgagcctaagcagatattatctaatatccagaaggagattactgcaattgagaaggcaatttcccatgtcaaggatgataataagattcagctcggcactgcagataatagtgagtgtgagatctcttatgctaaaaaggctgcagagtgtgctgttacaaagccaagtgacccgaagcatgctgcaaaaggtatgaatactgatgaattagaggcgaggttctttccacatcataaattgttgagagactgcaaatcgtctagcgctactcaacaggaatcgtccatggctgtcaaaaaggattgtaacacagatatggaactttcttcccttgagcctcaagaagatgagaatagtatagccatggagtttctggcttccttagatggtgaagaaagcggcttcttcaagaaccgcagagcgaagaacttggaaaaaaccatcatctgtgaagcagcagatgttagcagcaagacatcgggccaaggttcctcaaataatccggtaggcccaaaccatgacaaagaaattgaattgcttgctacagagaagctagaagagtttgatgaacaggagaacaagtcctttttgattttacaggaggaaacagaggaattctctagtgatcagttattagggatagggaacaaatcctcaactggtggatggtttgtttcagagggggaagctgttcttcttgctcatggagatggtacctgttcttactatgatattgcaaaccgcgaggtacttgattcattactatgttttctttttgttcttttcataatttatgttaatacaacattttgaagttctgattgcattaaactgaaaatgacagttcaagtctgaatacaagcctccgagtgtgatctcaaataatatgtggggtgattgctggttgatccgtgccccgggtgttgacggatgctcaggaagatatgtagttgcggcatcagctggcaatgcactggaccctgggttttgcagctgggattactatagcagagaagcaaaagcatttcacattgaggagatatctcatgcttcttcagtaccatcgtccagaactgttcttgggcctcttcctaatgtaggttcatcaagatctagctctgcaatttctactgtagaaagacagcaatggtggtatagaccctgtgggcctctcctgctttctgctgctagtaagcaaaagatggtcacagcttatgacatccgagatggtgatgtagtgatgaaatgggaagtgagcaatcctgtacagggaatggaatattccagcccactacaatggcgtagcaggggcaaggttgtaattgctggtactgagtcgattgggttgtgggatgttaattcgcttaacccacaacccctgttatctgttgcttctgctggcaaaaagctttactgccttcatgtgaacaacactgatgcagagctgggcggaggagttcgtcaaaggtacgcctggaattattagcttgaatgccctttgtgtaccattggtaacactatactagatcctgtctggttgaacttggcttatgcttgcaaatgcaggattttttagttcatttaccaatagctgatttttttttgtcttgatcattgatgattctgaaacttggaaatgtaactaatctaaaggagatgtaagttctgttttgtgtgagctgacatgttttcaaagttaacttgtttatcgttctgttttgcagagttagttcctgtgaggtggagggaaatgatggtgtttttagcacacaagaaagtgttaatgtatttgactttcgtgtacctgctggcatcggtcttaaaatggcaagacatggtggtacagcaagttcaatcttctcacgtggtgactcggtattcattgggagcacagaaggtaggctgcaaataaaagggggtctgaaatcacgagttcagcaatattcactgagaaagggaaagcttgttgcaacctatgagctacctgatttcaatgcccacttccatcactcttcaataacccaagtatggggcaactccaaccttgtcttggctgcatgtggtatgggactatttgcatttgacgcctttaaggaggacggtcaacaaacttacagctttgaccgtggagccactcttggagtaagagaggctattggctttgatgatttgtactgccctacattcgattactcgtcatcaagggttcttcttgtctcaagagaccgtccagcacaatggaggtatctgtcatagctatctatttatcgtgtgcatcatgtgatcgacatgtaatatatttgtactatgtttatgctttagcttatttagtcatctgtagtgccaagcatcttgctttcactgtattagcagaaatgattgggtttcttccccttcagttaattaatatctattgcatgtttattttaccccattgtgttcttatttccttctctaacattgacatcttacttattttgtttatcggcaaattatttgaattcagtttgatgcaatggtgcatatgaattcatggaatattttttttggagggtgggcatccatctccagatacatacataacacaaccataaacaaaattaagatcttgttagcgaaatgacgcccaacaatcttcatcggaccaagaagggattattccttcttttttgacgaactgcctcgattagctgctctgatttaagcttattccatcctaatcagcaacatcatggtcttgtgcaccaatggtctctgcaaactttattaccacttatgtaccaaatctagcggcaagcagcatctccattcctggaactctgatccttactggccttgatgttggcagcatgccggcatgtcctactgcttaatcaatcagtttcaagttcacggaatggtaatgggacagtcttcactgctctgaacttgccaacgttgttcaaatgttcattctccaatctgcaatcccataaaccatttcaccatgttacaccataacattaaattaaaattgatgttccttgtaaaagtacttccaattacctatagaagttccaatggcctcgtctgattatctctagtgaagcgagcgagaaatccagtaagcgcgactcaaccttaccaatatggatcttcattacactctcagtccatgctaggcgaagtgcaagattgagcatctgtaattatttgaaggcattagtgtcctagatctggaattttctagcctagtcagaaatgaagtatattaagcatagtaccatggatacgtagtagattgatttattcttcaagatgagctcgttacgaagccatcggttctttgattttgggtttaagaagccccagtccttgacaaagtcccagtagagctggtaaattgtggcacctgaggatgaaatgatgaccatccacacccagaatggtgttggtgttgcagcatatttgaacctaacagcagctgctaccattgctgatacatattttccagcattagcaagttggttgatatcatgtccttcctccaagtaccttcttaaacacttcaaaacatgacacagctattagtttgaaactgatccaaacaaagttgttaatcgttagtatttcccatctaaagattcatacctgcaaggctctccagaagtatgggagaaaggagatcacataggccagatgcttatattgttggccactagtacaggtctcatatgggtgagttctaaagcttccagccatgaagtagcacgctgtaaattccatgtgccgtaatagtggaatctgcagatagtagcaccagttcactcataagatgctgagctccaactctcaaaagctctagtgtaaagttcagtttcttcagtattacctggctagttagttggtcagccatgaagaaatcagccatcagaacctgcatgtcaaagcagcctgcttatcagatagatgctttcaacaatttgtgataagaaaactcatgaggtctttagtctttaccttatagaatggtgaaaatatgatattgcgcatgacacgcatgaagcagtatcgcgtcgagcggtagaatatgtcaaatggacagaatagtacacctgttgacagctgaaacaacagaatccgagttgagaactgaaaatcagtacatgaaacagagctgaattaccaaattttcccaaagtttatgtttcttactagtaggagtgctccaggcaaagcattggcataggctacaccggcgttcttgaggaaaagattgatgaccagtgcagcgacaacagtgcacattatcgatgcagacatgaggaaggcgtcccggtgcgtcaaggcggtgtttgaggagaaatcgaatatgaagttgtgattgatccttgtgttcttccacatgaagaggttgcacccatacaggaagatgtggaggctgatgagagcaaacatgctgcagaagcaaggtcacatctatacattactttgaggtaaaattgcatcttttattatcatgaggtcctaagtctgaaatttgaaaaatttgcaaacattgagcccacatgctaaatctaatcaattgaactcttgtcaagaacagagcatatatagcctgaacagaagtaccaagtacaaacgcagtaataaaaaatctatttctaaatagtgctttacccctagaactgaaccgtaattctcaagaatttacctgaaaacatggtacacaatttccatgtaggctgagttcccagtggaagtaaaaataccactaacatgggctaaaatcgcgtatatgatgaacagtgaaacaaaagtgcccgtgaacaaacctgcaaattagaacatgaaaaaaaagaagaagtgaagttagatttgtgtgccaaatgcagatgacagatctgatattctgatcttgaagttgctcagctacatgcctacgaggaaggtgatcatgtgagtgtttctgggctgctgtggcttaaggtatttcatcgccaccttcctgtcattgcctgtgaaatgcttcatgaagatgcactcgacctcatctgctagctgaagtacctgttcagaatttcgcatgcttcagttcatattcgtcagagagacatgtttccatcccccaaaaaactgattgaagtgaatttgtatgtttgtgcagctttgcagtaggattgtggagcaccagatgataccttgtcggagctgctaaatggcgacctcttcaccttctctgaaaacaggtctgtagctcgctgttgctcggacacctgaaatgcaaagcagttcgtaccagtcactgtcagctcggagtagcatttttttaaaaaaatatattaaaaaattaaattattccttgcaagaaaatgtttatgctgtctcatgttattaggctgactagtgactaggattacactgtcgagaatgagatctagtacctctgctttgagggtactaaactactaatagtacacttagaactttattctcctagaagccttatatatgtagaccggttttctttaatctttatcatctattatttagactcttcattcttccatccatccatttcaaaagggcacagatgtggctaattagtatattaccttgacaaatttcttcaatattttggtgaaagcctttacattgagagagctgctcccatccatccatgcatgcaaccaaaaaagcatccaaatccgtcagaaccacaagaacaccataattgacaagtaaaagaaatataaagacagccacctaaaataaccggtgaattaatctaccttttcaaaaaccacaaaagaattagtaatttgaaaggagaaacagtcgctttcaggtgacacaggatggtgtatggatggctacgtgatttacacggatgcttccatgcaaaacggggttgaaatttgactaaactactactgtactgcatgcttgggtgcagtgcaggtgtagttgtgtgctgctcacacagtgctccatgactcatgctgcaactaatattcatagtagtaatttgttagatatacatctatgaagaaacaacttaatttttttttcctagttggtcagttaaccaaactatctatatcatttgtgtgcatgcaattagtgtgatcgatcagttgcatgctattagtgtgaggtttggccatcagaattctaaatagcttacaaatgcgtatatatatgcatcatgcatggcatagaagacaatatacatagacacaaaaggcaagtcttgttctaaaataccgtgacttcgtggttttagcttgtcagatatggcaaaaaggaaagatgaagagggaagatgtgcctgaatttcttgagcagctcgaggccgcggtagagcgccatgaaggcgtcgcggatgttcttctcggcgtgctggatcttcttccggtggacgaacgccgcggcggggtcggcgccgtccttgcggagcacgttcacgagctcctcccacaccttgagcgccgcccgcccggggctcgtcgccgggatgtcgatcctcaccgtcgctggcagctgcagcacgcctccgcctccgccgccgccgccgccccgccctttgccgctgccgtccttggtcttgccgtccttcttcccggcgagccccacgaagctgacgccgttccgctccagcgccgccatcacctcgtccgccaccgccgcgccctccgacacctgcgcctgctgcaactccaggctcccatctgcaaaacacgccatcgacgacgacgacggcgacatcgacatgacatgacattgcatgcataaagagatgtgcagctagcccaggattcatgtgtgtgggtggttggtgtcacctacctgacatggactgcggcgaggagaggccggagaggaggtagcggccgctggagccgtgcaccgacgacggcggcgaggaggacggcggcggcggcggcatagagcggcttcgggcgaggccgcgggcgcggcgggcggcggcgtggtcggcgaggatgcgcttgacgtcggcgaggatccggagctgctccagcagcgcgtcgccgcgcgccagcagctccgcctcctgccccgtgtagaacgcgttcaccttctccagctcctcgtccgccctctccatgaactccctctcctacaccatccatccatgcatctccatttttacaatcaatttaattacttagttttatttacaatcaaattaactaattaattttatacatgcttgtccgtggatcgcacgagctcccctctgtccgggcactcctcatcctcctgcgaaatgcacatacgtattaacatcagaaatgtgtattaattaattaatacacgtttattagttagtatttgattcgagacacaacgacgacgtactgaggcagaaggctgttgtccagcggagaagcgggcggcgatggcgcgaacggggtcaagaatggagaacccatagccaccggcttccttctctgcgggcggcggcgggagaaggtggtcggctgcggctgcggcgttggcggcggcgaaggagtcgtcgcggcgggtgaccttgatcctcttgatgagcttcttgagccgcttgtagtcgacgaacgcagccttccactccggtatgatgctcgcctcgtactccctcgagaacttcaccatcttcttcttcttcttcttcctcgttgcagcagcagcagcagcagctgatcgatcgatcgatcgaacaattaactgaaacgtacgtacgttcacatgtgtggaatcgagctaggagaagatcaagatggatggatggatgcaggaaagggacaggcaggcagggatgatctcgcaagcaacaaccgtcctgccttgttagcttatatagatagacagttagagagagagagagagatcaggctactagcttggtgctcttctccttcttcttcaatcctctctctctgctcacctcgagtgctcctgctatataagcttagcttagctaagcatgcagcgaaatttggcactgctggtgcacatacagggacagatagtggccttgtatgttacaatattaggtagagctagctagcttagctaaattaaagtagaaaggtgtatctgaattcagagatatatatatacacttacatagtggggatcgaccatgccattcgtagaactgtttgtgtcctgttcattcagttagtggcttagttagttgcttaattcgatcagtgggatcatatatagttatattattatatactagttatgtacacgtaattaagcctcgtcgcatgatctggttggatgctaattctgtattaagggagaaattgattaagtaattacttctaattagagtaaggcagtgtatacatatttgtagcgcagagaattaaagaggagaaggaaagaaattaaagaaagaaaggaaagaaagccggttgctttaggccgggttgttaatttgagcggcccatcttttgggcgaaaaggcaggggcaatggagtgagggaaacatgagcagctgcaggaatcaagcagagacagacccttgcttaacctactcggccactcacactcaggtgaccatgcatgcagctgctaattagctagttgcctcctctaaaaaaagacaataactaatcaagtaattggctagttgacatgcactataattttcttattagtatcactaatcagctcatgtgttaattaattatttagttaattaaagaagagggcagtgtccaggggagtaggactaattaaggtcgtaaacttttaagtatgtatgtggatttctatgtctaaagtttgatcgttcgttttgttttaaactttttgattagtatttttgttgctattagatgataaaacatgaataatattttatgcgcgacttttttttattttttttataaattcgttaaataagatgtgcggtcaaacgacaaacacggaaacccgctaatgtatttaaaataggatggatgattatataattaattaattaattaattctgattagagtgttttgtgcggtgcagcatggagtgactgtagatatgctatagctttacacatatcgtggttcgattggatcgcggaaattaatggatggatggatggatcgatcgcaagttggagacaatggagctaagcttagctagggttctgctagtacagggaccagatcagccggatgctctccatgtatgcgcaatggaggccacgccaccgccgctgctgcagcgacgccggcctgacgtggccatgacgccgactcctactcctttttcttttctttctttttagtgtttttctttttttttaaaaaaaaggtatatttctctaggcgcagtgacgaaaactgggtagggcagttagggctgttgccctaagcttaaatatctattaaaagttacatttaaaaacttcaaaacacgaaaaataaaggtaaattatgtaaattatactagttgtgctttaggcgtgagaaaattctaactacaccactgctctaaggtatctatctacaattgtagtggagtacatggtatttgtgtgtgtgtgtgtgtttttaaaaaaaaagataaatatgaactgatcggttacacagtaagcatgcatgcacatgagctgagttggtcggatagtggcgcagccgtgcaacggaaaagtgtagctaaggtcgacagtactaacaagtcgcatacctcatcctaaaagaaaaaagaaaaaatatgttcactgtatacggttggctctggtatgatcgatcgacggcgtcgacgcgaccatcattaaatgaactagccgcccaacatcgatcgcttaatgaaactgaatcgaatttgccgtgcacactttttttttcctgagcttctagataacgtgatttttataagaactttctatatttgaatttaattttttaattgctgtttcaaatatattctttaactagaaaaaatgcccatgcgattgcaatgggtgaatgatattttaatcttattattgttatatgtttagctaggatgaaattcactgtgtgcaattaggagtccgactttcatttcaagttggcatgcgagtttttttaagaaatttcttatacaactccttttgtatttccaaaagcaaataaacttaaaaaccgactcaaatacggatgacgtaccaaaataccggcaaaaatattttcaatttttataatagtagggactagttaatatttactcactccttttctgattataagtcgttttgattttttttctagtgtaaatttataggaaaaaaattagcaatatctaaaataccaaattagtttcattaaatctagcgatgaatatattttgataatatgcttattttacgttgaaaatgctataactttttttataaacttgatcaaacataaataaatttgattaggaaaaaaattaaaatgacttctaatatataaaattaaagagagaaagtaatttatttgcttctacccttaaataactatcacaaatcactagctattcagtccttcaacacaaaacaacatgtcataaatggaagaaaatattaggtcagccagtttatttctcgtattataagtgcgcgcatacgtacgtattacctggcattaattaactagttcgcttacgtacgtacataacatatctacgcgtgtgtgtacatacacatccatctcccctgcgcggatgcgggggcgcgaaaaattttgtctccacgacgtgtatttcgcgccttttttccgcaacggaaaaaaaaattgaaacggtgaggcgttattttgcctccatgtccgttacgcactgcagtgtaagtggtcgcagctgccgttgcgtcgcacgtcatggggtccaagcagaagtgcagaacagaagaaagagatcgaagaaaaaatgggtaagtacacccgcgttgcgtacacgtccatgacacctcggatatggtgcttgctgcctccctcgccacaaacaataggaaacccggccgacctcgtttggtataggtccagctaaattttgttatattcatactctaaactagctgaagtcttatatttttgaaaaaaaaatatagtagtcatagtcttgtcaaacaccatagagcttatgatgttaggtaggtttaatgtgccaatatttgtgtgtctgggtctagcgcaaacatgttcagtcaatgtcgtgtctatcatgaaatgttgtctttaaaaatttatacaaagaaactttatatttagagactattaatatagaaacatttagaaaaaaaatatatggttttgaattagaattagaatcagacatataaaatttttatggcctacaaacttaccagaaaatgaaaaaaaatatgatgctaaaaaagaaaatcatgcgtgattcgcacgatatctttttttgtaagatgttctcttcaagaaatctcgttcttgaaaaattgcattatgctgtaaattattgtttttttcctagcatttgttctagcagtttattttattaatggatcaaaagccggcttctacaccaacaagtgtgtacacagccaactagcggttcatattcatagtggtttttccagtggtcaccatatgggcagaacaaatacatcgacgttgtaaagtttcttggagcgatatgtttgtgcatgccaggatgataggaatccatatgattattcagcaacaaacaggcgtcagctcatctaaagaaaacaagtgtcagctcatgggaagcacatatatctctctttttgggggtcccttgcatgcaagggtcaaaatctggtgccgtgactaactggcccaactgtgcaatgcacacagcataattctggttctctgcaggaatcttcttgttggtttcaggaggaaaccaagtcactaagcacaaaccagaaagcctcaagagaagggtttgtagagatagcttaattaaatgttaacaaatctcaccaagggtgcaaggcactggctagcacctacttttcagggcttaatgctccttaacaagaatgcaaaacatgataataaaggcctttttttttccttcatccttccttccttcctttgctggctgttgttgccatttcatgagtgtccacttcacaacaaatgtgacctaaaaatgagagagagagataaccctttcttctttttttctcccaagccagaatggaaagatcattcgcaacactagctgcatgatttattcttctaaaccatcctcctattggctcatgcttccaaaaataagaaaaagtcagtttaattaaaagcttcatccagccatctaattggtcctttctgtttaggacatgtttaggatgctggttggctaattgacttgtttaatattcactaatctctagctatgcccatagttaacttattgcagtatgattctagttttaacccgtgcacgcatcgtttgtttgcagaatgatatagtgcgtaagttcagatagcactaagaaacctgtggctaatcgggcatctctctctcaattgcactttagtttattaattttggtatcttggataggaatagaacatacaaagttatagttaaattttgcttcgcataatgcacaactgattggactgaaatggctgcatacttctgagtaatggagctaagctaattgtgcacaatgactgtactttataagtaacagagcagaattagctaaaggaatcacaacaaaaatgtgcaaaatatgaaagatttgagggtgacaagtgtcaagtgcagcaatttgtcagtgagaaattaaaccagcgttgctttctgaattacatgatgttctagtgttctagtgtgtccggattgattttactaattaattactagttagcacgtaattaatgagtttgtaatcttcacgtatgtatatgaacttttacgtgcgcaaagatattccaccaaggaatgtgcatcttttcaggagttgatccggataaacgtgctgtgatctgggagagtcttgtacgtttctgacagatgatcagagatgtgtgacaaagatcgatcaatgctcaatgggatccacgatgcaaaccatatgatgatatcaaagccatcttttggttgattaattaagctttcatttcatcgaattaatgtttttcacgacgagcggcaaattggacactgaattgtaccactaatctgtctgaattgtactactaatctgtcatatcagtcgcttcatatatgattgtctactacaatgcaagttgtttcaagttttctttctcaagagataattagtctgagaagttatgtgggattactttgctaagtgattttacagtttgcatatctctatctacgctagctttaggaaaagctcgaagtggtagattctatatcgtgtacgaaaagaaatttcaggtggacccaattaattatgtaatcttttatacaataatactatgttttttggcacatctttttttttaataaagaaagtgcataatgtgatcttaaaatggtcactgcatttggctttaatttgatgataaaaagatgagcgtatggctggcgttttcctaatccaggctattgtgattagaagcttttttttctactttcaggtccatttatgccgacctttgttttgttcatcaaaaaattaaacatcgccctgccaatccttttccataaagtgatttatcatcgcacatatgtaggatctaagtggagagaagtgctactttataagagcagatgatgatgtataaaatgtatacatttcattatctgaaaaaaaatgtgtatatttgcaaccaaagtcctaagtgggcagtgcacaagttggtgtgctgctaggtgatccctattgttcctgcagctcatggacattgacatgggaaagaaagaattagtgggcaaaaataggtcactatcatatagatttatgaattccaaatccctaagatcctaaaatgatctgctgatttgattttaatgccagagaacagggcattgaatattaagtacttttactgcggttagaactatcactagtagcagtgatctcaactatcgattgatgaattctactaccagttgttaaggtggtagcataaaaatgtatgatccattaaatcaagagcaattttacagtacttgaggagttaccatgagatacaaaaaaatttagagtaaaatttaatacctcgtagaacctcttcataaaattgctcttaaattaaacaatgcgaatgatctctaccgtagggactgtgatgctcaattgctatgtgtttcagaaagattagttagtaggggtgtgtgtgcttaattcagtgatcaaaattagccagtgcagtgcaggtggtggaggctgacgtctcccataacgatgcgtctgtgtatgtgtgtgtctggttgtttccctctgatcctcacaatttgtctggggcaattctcctccttttggatgctctgatgatacacgaaaaagttgcagacgagagcggttttcagctgtaaagagaaacaagaaaagcagctttctcttctttatttcttttcttttatgtattttctcctcttttttttttctaatatgcgattcagactgatggtcacgatttggagttggatgtgttcgtagcagatttgttctcggccttcagactgaagccggaagaagtttttgccggaaatgcgttgtttttctgcagtttgctgaccatgagtcttgtccatggtgactgcaactgtttttggtgctttgcacggttcgtcagcagcatgaagcctcctctcactaccttttagtatcggatttcctgtttttaacaaaaatttggagataatgcactaaccggttgacttccttttgaatgatgctgcatctttcaagaatatgttccagatgagtcatgcgtcatacctggtaataatacaagtgttttttgactgaagtgatgatacaactgttagtgttctaatctgcattccaagtcagaagatgcactctgcactacagagaacgcactctcttatcccatgtctaaacccattttttgctacagttttgcctcacaataatcatccaaaaatgcacacaagttccatgcattgctagggcactactcgtctactactatagtaactctacctcctagacttcagataaggatgcatggcatccatatactatatatccatcagaatataccactttctgaattctgatacctaacattgagccattgaggccaagcaatgatcaaccatgcagtagtgcatttttactgctgctaaacttcatacatctgcatccactgcatacagtaacaaccacaacacaaaccattgccaaatactgattgcatttgcaaaaatcatccaacttgaaatcatcaggtcaatggagtcaccagggctccaagaaccgccccaccgaaggcgcgatcgccattgcgcgtgcgcacagttctcattccatggtgtccaaggggagagagccccctggggcttgatccatggtagaagctgataggattcagaaggaatctttggaagtggggagcaagctgaaatgcgatgtgctcatgtccactaccttggcattgtgatgtgttgcactcattatatacgatgtatgccacgagaagttcattgttccttttcttcagggcactgttacagtgtccctttcagagtttcaggatccatccatctctaagaagcagtgactggatggatgggttgttgagaagaaactagtgcatcactcttggccaggaatcgcaaatggaagcactagagaatggtaccttattaggagaagaacaaaaggaggtaaagtattacatgtcatctactcatgtagggt

SEQ ID NO: 45888 - DNA, 8903 bp, Oryza sativa
caccttgtgaataaatcttgacatgccctgattagcaatcaagtcaagaatgggaacatcaacctttgggctcagacaaaaagttaagtgttctccaaagcctggtccctctgtggtcttctccacacaatcctcttccctggccaagttgttgccatcactctcatcggcaacaatttcttgactggcctccaatgcaatgggaactgaattagtaacagagcatggcactactgccactccggtggaatcatcgcccacaattggttccactttactgttgcggcatgtctcaagcatttgattgatcatctcctttatctctacacacaaatcatgcaaggtcttatctgatttgtcctcaaccttgcccatgtcaacctcatcctccttggtcgcggtgagggaaaccggtggcaccgctgctgctgatgcggctgagggtgtagacggattcatggtggccaggaacacatgttccagtgtggtaggtgtgctctcggcatcagacttggtgatgccacagcttggtaccggcgtcgagcacttggtgggcatcatgtcggcaccgttccctttgaaagactgtgcgtgctggacatcaagcaggcaacacccatcatagataaaaagatatctgatgaagtatatcgattattcagaattggaggggcatctgaactcagatatccgtttgcagatctagagacaattgttttccttgctgatggatttttcaatgctctaccgcattcaccagctacacgattgaaactaacaaagtacaaaaactaaaaatttcgatcaaacattgtgttggtttggttggggtgcgccaggcccgggcagcagtgcaacgcctgggcgacgcgtgagggccccagtggcaagccactgtggtgggctctcccccacaaaaaataaatttaatatcaaagtggacacatggcccacgtatcagatattaaactgataagaacagatactacacttgatcttagccaaaaggccgagaaaggtatgagttgcttcgtctaatcctgcctgcttatatacagagcgcaacgccctcgtacgtccttcgtctccgaggtggtactaaaccgaagaaccatccatccatctccagatcccgtcaggtgctatcgtttaaacgcatacatgggccggagttttccttttgaggccgaaatctgggccgtattttttttgcggggccgaaatatgggccgtatttatttctgttggcctgttactagtggagaaggcctgtctctatacgtcacggcccactattgaacgcgaggacgaattgaagacgtcgagaatttgtcgttcaaaactatttgaacgctgaatgtttagattggaggttcttttcggcggaattcgttcacatgccatcgctgtcgcaagtatgacaagtggttctttgcgttttttggtaccaccggtggtgttaagtcaaacatgatggcacgaccaatgaccatgacaatagcttctgccgtgcaagatttggaatatttccccataaatccccgtagtagagaccatggtaatagatgctacttcctccgtttcatattatataagactttatagtattattcgcattcatatatatgttaatgaacttagacatatacgtgtgcctagattcattaacatctatatgaatataggcaatgctagaaagtcttataacctgaaacggagggagtaccagattgccaggtttttttttttggcggggatttaaatccgaacgtgccgttgtgagttccaacagaagacggaatgtcgaccatagttgaactttcacccaggcacatcgaggctagcattgaacggcaaatatggatttgatttgattagtattaatctttctgaaaagaacaataaagtcccatggagatggagggaatggtaaatgcaaatatggatttgatttgtattctgggtttctggatgtaaatttgaatatcattgtaatttttcctattttgtgaggcgatttcctagtattcagtgtagtaatgttaccgcggagcatatcgaacctaaggctgtgtttagttccacgtcaaaattagaagtttgaagaaattggaacgatgtgatggaaaagttggaagtttatgtgtgtaggaaagttcgatgtgacggaaaagttgtaagtttgaagaaaaaaattataatctaaacagggcctaaggctgtgtttagttccacgccaaaattagaagtttgaagaaattggaacgatgtgacgaaaaagttgaaggtttgtgtttgtaggaaagttcgatgtgacggaaaagttagaagtttgaagaaaaaagctggaatctaaacagggcctaaatgtttcggtaaaattgaagttatctgaagtctagaacagcgaaatctgatgatacttagggcagtcacaatgcgtcacgtaacgtagttttgaggagccaaaactgccacctagactgagaaacttcataagcaacaagctccacaatgcatgtggtctactttttccctacactgggtcccacccgttatctctcctaactttttctctcctctctctctgccgaacccagccggcgcgtcccctcctctactccgccgccggcgcccctctttctctcccaggcggcggcggcggatggagcggcggacacaggcggcggcgaatggagcggcggacacggggggcggcggcggacgacgcggcggcccaggcggttgacggagaggcggcggggcgatcccagcgccggacggagcgccggcgtatccagtgatggcgccgggcggagcggcgatgggacggccagatccagccggatctggcgtcggcgtcttcctcacggcgtcttcctcgcggacgacgagcggcggcgtggtcgtcctcgcggaggtcgctgccgaccggagccccgtcgccgtcctcgtcttccggccgccgcacttcctcccctccttttccagccgccacgcctccctcctccggccgtcgcgcgtcccctcctcctccggccgccatgctcgccggatctggccgcggacggcgacggcgggctcgtcggctgtgcacggcgacggcgggctaggcggctcgtcagcaaggaggcgccgccaggcgggctaagcagcgacgacgatgccgggcggcgctgccgctcctctctccctgtctgctggatttggatcctctaccttcacggcttgaaggcacgagcgtgcagtcggcacctcatccaccgttcaaataatccaatggctcacgtcgcctgtgcacgtctgaatggatatctgtctgtcaaagtccacgaagcactactgctatatttcagtccgaataccaatgatgtttgcattataaattttgtaatttttcttatcaatcctatgctctaatcataatttttcttttgctttttatgatgtgacttgacattgcgtcatgctccctctattagttcccaaaataaaaacttttcatgtggaaaaaaaaactaattacacagtgtgcgtgtaaattgtgagatgaatcttttaaacctaattacaccataatttaacaatgtggtgctacagtaaacgtttactaatgacggattaattaggcttaataaatttgtctcgcagtttcctagcgaaatctgtaatttgttttgttattagactacgtttagtatttcaaatatgtgtccgtatatccgatgtgacaaccaaacccaaaaattttctccaactaaacaaggcctaagtcgcttgacttttttttctagtcaaacttctttttttttactttttaacacaaaacaaatatattataaaaatatattcaacgttagatttaataaagttaatttgatattttatatattactattttttatataaattagtcaaacttaacgatttttgactagaaaaaaagtcaaatgacttataatatgaaaaagatggagaactactttgtaatgaattagtgttgttatttgaaactttcagttttcttgtatttttaatttggtgatatcatccattttttttcatgtgtattagcactaatatagtttgtaagtttctttagctcgcgtacacttcccagaccaaaacaaccatcgtgggatttttttttttgcgatagaaccatcgtggtctttcacagacaaattcattcgtctatttaagcgcacatgcgacgtgagccgttggattacttcaatggtggataaggggctgactgcatgctcgtgccttcactctgcgaaggcagacgatccaaatccctgtctgctgccttgcccatctcccctctctcctctagcccgcctgtgggtcccaccggagacgaagaacgggtagccaatgttggctactaggagctaaggaagttgtgcatttggatgatgtggcaaggaatattcggtttttggggtggaggctgaatgccacgtccgcatattgtaaacgcccttataagagttggacacatctgaagtctgaactctgacgatgtctagattttgggcagactcttgcagagtttttgttcatgggtcaacaggtcagtgaccaattttttagcaaatttacgacgaaagctatccgaaattttgagtttcatggatcaccaatttcgtagcaaattaatggcactcaacatcagtactcaactcaactcttcctgcagtaaacaacttaaacagacgtagaggatcagcgttcagcatgagaaatcatcaaacttttaaaagctgttttggttgggggtgtgccaggccctggcatcagtgcaacgcctaggcgacacgtgagggcccccagtagcaatacactgtgatggaccctcccctataaaaaataaattcaatatcacagtggatatatggtccacagatggcacagctctaactctagtcccacctcttctaaagctgaatctcagccaaacaatttcagcttcaccaaaaatgggagcggagctaggtggagctgtctcacaagataaagccaaacaatttcagctccaccaaaaagggagtggagtagagctgtatcacaaaatgaactagaggagctgtatcacaaaataaactagaaataaactaaacaattttaagctctaccaaaaatgggagcagagttatctcacaaaataaactaaaaaagtggagctggatttaaacagctctaccccagactcaactcctgtacctaaatttagaagttttagctctaccaaacaaacccttgattttagccaaaaggccgagagttgttttgaacaagcccacctgcttatatacatagcgaagcgccctcctccgccttccgttaccgaggtggtactaaaaccaagaaaaaaggcgcaaacatggcatgagtttttgttttagggccgaaatccaggccatatttctcgtgttagtggaaaaaggaccaaaattataactgtctctatctgtcaccacggcacacgatggtaatgggtcggcattgtgagcattaacaacaattcttttgatttttcttttgcctatccaaggtgtttgttagttgcacaacttaagctctgtgtttggtggatttgatgaaccattcaatactcatagttgcatatcattgttctctatagcctatgcagtttcctgcttttcattactgcccacatggacagtcatcttcctggcaacttcacgaccgaatggtcgacgcgtctcctcctcctcctctcgccctatcgccgggtgccactctggcccaggcgcccaccccctcctccaccgaccagtccggccctagtgtcctcccccgctagcacaggtttcatcctcggctatcctccctttctagagagagtcagcctcggctccctctctggcagctactcggatggggatctgccagatctgcttcgccctcaattcctcctggcaaatctggtcagtgaggcagcggatgcgcgtccccctggtgccagccaagatccagcaggttcccccctctacaggttctttaagttttcaagcagccccggttttactgcgcagggtgggtgaaggatttactcctcctgtgccctccggcttgaaggtacagggagttactcctcaggatagcttcattcaggcagcaagatgaatggcttcgccctcgcagcttcccaaagcaatcccaaaaaatcttccgtctgaggctgccacccgtcttcaagtttggcagacagtgaagccaaagcattggtggaggaagagacatgcccaacggccttcggcattcatgcaccttcaatccgctgctcctcctcagcttccctccgcattcactggtcgccaccaacctttcctctcgcagtccaagcctcttcaagcaaggatcagcttcctcgagctctttaaaaagaaggcggtgggtcactgcttccgctatctagctcaggaccaccgagttgcttcctgtagagaccccctgaggtgcattctctgtggcagttctggccacaaagcccgctggtgcccgggagacagacgacgggatagggggggtccagcctcctcgccccactcctgctcctccgctagccagtcggctagttttccctccgctcccggcaatgtcgcgcccaggggacccagccaacaggccggacagcatccagcgcgtcctgcccaggacgtcggccatccgtgaggatgaaagtttcctttctcgcaccgcagcggtggtacaggttacaggcaatctcccagtgacgaacatgagacagatcaacaggttactggcgtccaggtttcaggttcctcgtgaggacctcaatgttgtcgtcttctccaaaggaggctacctggtcacctgcacctctcggtcgctcagggacatgatggttgcggcgagcccttttgctgtggaggacattgacctctcggtgctcccgtggtcgagacgcgtccaggcagagctggtcaaatggtgcttcagcattcgtgtctgctttgaaggcatccccagccacgcttggtcggcagagacagttacaggactgcttgatgaaggatgcttgatccaggaccttgatgagccaagaacggagaacgagacggcttgcctctgcgcctggctgtgggcggacgatccggactccatcccgaaggaggtgcacttcgagcttgaagaaccgctgtccccgcgctccccagactcacgctgggacctggacggagaggctcggcagaggacttcccctcccaagctgctggcctacccggtgctcgtgcatctcgatcaggtgctcgacttcaacccgccgccaactgagccaacttggatgaatagtctagggagtcaggccagtggaatcatctcccctgtctcgatgacagaagaaatcccaaagcatcatgattttatttggagccttggcgtcaaggatggcactcttccccctcagcctccggctttccctagcccgggcccaggcagagatcgctcacgctcacgttcccgctctccgccagcgagggagcgccgccgccccttggggtgggatgtccctcctgctcgcagctcagctttccccaggcgctcctcttccaggtcttcggagaacagaggtgggtcctacgggggtggtcaccgcagggcagcttgttctccggtgagggccgctcgctcgaggtctccgcgtggaaggtcatcccccccgccgtcgctgtcggttcctgcagtgatgaaggatggcggcttccagctgtctcgccccccttctacatccccacaggacccgatcacccaggccacccctcttcaggccaaccagttcgtgatggaggctgaccctatgctggaggagctggtagctgaccaggcgtcccagtccgccgtgctggtgtaggtctctcaggctgcccaatctcagccttcccagtcgcctctgatgatctccccagacaagcttgcagatttcctgacccaggccttcgcggcggtgcagcctcctctgctcaaaactcccacgcgccaggtctccaagggaaagctcttgaagaagatcccgacccgtcttagccaggcgggccgcaagagtgctcggttggccaagaaggcagccgctcgttcctctccggccaagcaaggtgacctcgctcatgagctgctgatgaagaaggctggcctgctccctgaggacggcaagaagactgaggacgcaatggccaaatacgtcaagcttttcaagcagcctctctctcaggaggtcatagatgccttctctgctctggtggccggctgcgccattggtgacagcaagaagaagacttagttggcttcgccgcttgttgatgtgctgttcctttttgctatcatgagtctttgtagtactgaaatgggttgtttgcttctcctgaggggtttagagcagtttagtttcttttggagctcttgtagctcgagtagttggctttgttcttctatgctgtgcctcatgctccccctgtacccagttagacctcgatctagtaaggatggtccttcagttatgtatccaggttatgtctctgcagaaaatgaagtgctcagttgcctctaccggccaagctctacctcatctctccctgcgactgtgttttgcttctctactatgtttcaagcctcaccatttctataggttgtgctcttccatccgcttgggatactgcaggtgcccctcccgttaaatgtctacaaatgactgtgccattttgagttggaatgttagaggcttaaactccacggcccgtcagcaggttgtcagaaaccttgtcatggacataaactgctcctgtgtatgtcttcaggaaactaaattagagttctttgatcaagcaatagtcaacaggttctaggtccatcgt

SEQ ID NO: 45889 - DNA, 9817 bp, Oryza sativa
acaagaggaggtatcctgctggcggtgtctgactcaaaatactcgattgaaagtgtgcaaacaggtgtttactcgatcacggcaaacttaaaagaaaaagaagatgtcttggcttggagcataacaggggtgtatggaccacaaccagacaatgagaaaagagaatttcttgaggaactaaagcaaacaaagaacacagtaaatcaaaagtggatgatcttagatgatttcaacctcattgtccaggactccgacaaaaataacagcaatcttaacaggggcatgatgcagtcttttagggcggctttaaacatgttggaagttattgaaataaaactaaatggccgtcgatacacctgatccagcgaaacagaaataccaaccttaacaaaaattgacagggtgttttgctcacatgagtgggaagaaaggttccaaaattgcttgctttcagctatctctacgatggtctcagatcattgtcctctgctgctaactgcaaacccttctaggcctaaatgcaaccttttcaggtttgaaaaatactggataaggctcccaggattccttgaaactgtgcagtctgcctggtcaaaaccggtccactcgcctgatgccctgaaaagaattcttatcaagttagcccgaacagtgaaagcactaagaaactggagcagatgcagagttaggagtctaaagttgagaatggagatagctactgagcttgatcttcagactagacttagcacaggaagagaggaacctctcagctcaggagatccttttcagaagatcccttaagcagaagctcttaggtctggcagccctagacagggtgcgacttcgttaaagatccagacaattgtggatcaaagcaggtgacgcaaacactcggttcttccaaatcaaagctagcgtgagaagaaggaaaaacttcatacaacacctcctgacagactccgggatggttcactctcatgaagaaaaaggacaagaacttttcaacttttacaagcagcacttgggagaacataggtctcgaacctctgtgatcaatccctccttcttacaggaacacaaccttgacctcgctgatctagaagcacctttctcagttgaagaaatcaaaagtgcaatttttcaatcccgttcagacaactccccaggtccagatggcttcacaggtgcttttttaaaaaatgttgggacatcattcaggaagatatcacgcaggctatggcttttgaattcagcctacattgctttgcttccaaaaaaagagaatgctcttcgtgtcagtgaattcagacccataagcctcatccatgcatttggaaaactcttttctaagctccttgcaaacagattagctccgaaacttcaacagcttgtgtcccacaaccaaagcgctttcataaaaggaagaaacatacaggacaacttcctcttcgtcaacaacttggtcaaagagctccattcttccaagaccccggcaattctcctcaaattagacattgccaaagccttcgactcagtcagctagccttaccttcttgacaggcttaggacgctggggttcggtagaagatggctaggttggatctgctccattcttggttcttcttcttctaatgtcctcctaaatggaagagctggtaacagtttcatgcatggcaggggtctatggcagggtgacccgttatctccgatgctctttattctagctatagacccacttcaaaaccttcttgcggctgcacaggatgaaagcttgctgcagccccttcataagagaactgcccgctttaacatggctctatatgcagatgacgctgtcattttcaccaagccgatcaaggatgagatacaggcagtgcaagctatcctccttcactttggacgaacaacgggaatgatcactaacctaacaaaaagcgaggtttacgccatcagatgtgaagatctggacctccaggatattctttcccccttcccagcccagttgaaagaattcgcgtgctcctacctcggcctacctctgcacatcagaaagcttcggaggcttgatgttcaacccctaattgatagatttgctgctcgccttcctacctggaaaggaaaacttctcaacaaaacaggtagagcggttctaatcaagtctaccctctcagctttgccaacctatcacctcacggtgttccccctcaagaaatgggcagagaaaaagatggacaagattcgcagggctttcttatggacaggttctgagcaggctaatggaggccactgtctagtcaactggaagagggtttgcagaccaaaagatttagggggactcggcattactaatttggaactctttggtcgtgcactcagactgaggtggttatggtatgattggacagctcaggacaaaccgtggcagggctcaaaccttccctgtgatgaaacagataagcaactcttcagggcctccaccgtcatctccttaggaaatggaaacaaagtcaaattctggcatgaccgatggctggaaggtaaagctcctaaagatattgccacatccttatttcagatcgcatccaggaaaaacaggacggttgcccaggaacttggcgataatcgctggcttcgtcagatgcagagaatgaaaagcacagtccaagtcagggagttcatcattctttggcactctctgcagcaaattcatttgcaggatggcattgaggattccatatcatggagatggaccccgaatggctgctattcggctagctcggcttacaggatccagtttctaagaagtatacaggacaacagatcaactttcgtctggaaggccaaaatggaaaataaatgcaaattctttggctagctgatgattcacagaaaaaacctcaccgctgataaacttcaactaaggggctgggataacagtgagatctgtcccctctgtggcattgaaccagaaacggctaatcacctactcatggattgtgccttcgcaagacaagtttggagctccatgtggaacaagctcggcctacacatgccttcaccctctctttttccgggacgtttgctagattggtgggaggcttgcaggaaggagctagttaaggaacaaagacgtaattttgacggccttttcatctacactacctggggcatttggctgcaaagaaatggaaggattttcaatgacatttacaactcggtagctcaggtcgttgatttcatcattgctttgtgcaaagagtttgatgaagcccttagttcctagatgagttttctacgctttcttcttcttgttgcagttcactttctcaagattggggtttcccatctgtttttaatctcgcaagctatgtgcttgccctcagcttgcgtggctggcttgtaaaacgacctctattgtctgctcctccttttatgaaattggcagagctcctgccgtcttcccttaaaaaaaaattactgcccacataaatttcttggcggttctttcattgcactccatagatgtgttctcatgttacacataaaagaattttaaagaatttgtacctgaatttattgattgattataaaaggttaacacaaacaaacatgatctacaagctaaatgtatatgtacttccttcttctagatcaagaacatcatgttgcttgagttggtaatttgaattccgttgttcaatgccaagcaaactctgattctcttcggcattaccttcagcttcaacccaaggatgttgctggtatctcctcagcatctccagcctctccgctacctccttcatcgtcggtcgttcttccccgttcatacttaggcatcgcatcaggaggtgtgcaatctctgtgagcatttcttcattcatctcattccttacctggttgtccagaagctcttgatgacgaccagctttcactgctgtgatgaagcatgacaccagactcctgtcttcctctggtccatccaagtacaatgccttcttcctggttagaagctctagcacgacgacaccaaaactgtaaacgtcactcttatcggtcagttggcaagtcattaggtattcaggatctaggtacccacaagttccctgcaccaacgttgcaatctcggcctcatcagctggtgctagttttgatgccccaaaatctgaaactttggcgttgagcttgtcatcaagtaggatgtttgctgtcttgatatctccatggaggattggcggtgaagcagacgagtgcatgtagaagagtgccttggctgactctgctactatccgaagacgggtatcaagtgatatgtgagctatgggttccttgccatgtatgtagtggtagagtgttccatttgagacaaactcatagatcagcatgggcacttcgacttcgaggcaacaaccgagcaatttgatgatattcttgtggtttatctgggagaggatgaacatctctctcgcgaattccttagtctgggcttcctccatcatcttcgacttcttgatggccaccaccatgttgtcctccaggacacccttatagacaacaccgtgaccaccgcgaccgagaacacggtcatcagcaaagttgttggtggccttctcaagctcttccgtggagaatatcttgaatccaccagcacctccgccagagtgcatctgctgctggaggatcactcccccattttgctcaaagaatctttgctttgttctgatgagcttcctcttctggagaactaggtataggcaaaagtacatgagcagtggcaggaagacaccaacactgacccctgaagatgtcactcatcagaaatcgaagaatcattagagcgagagagagagagagaaaaaaaggtgcattggtgttgccatgatggacgacagttataatttttcacctgtaactacttcagagctaaagtgaacttgtccttttcgaggcagccttgtggaatggacgggtcaccacgagcacctcgcgggcacatgcacgagtacgatcctagcgtgttggtgcactcgccgaagcatgcgtacttatctggccgctcgcactcgttgatatcttcgcaaatcacccaaatcaacaggaattagcttttaaactcacatgagaaatataatctatctattatattattaaagaaatagaaaaaggagcctccacgttcgttctcatggcctagaaattctcacattaatcagagaaaaagaaaaagtagagtccatatagaaatacaatttagaaatagctgaaattcggaattaaaaaataaggaatattagaataggggactagagtccatataggaatacaatttagaaatagttgaaattcagaattaaaaaataaggaatattagaagaggagactagagtccatataaaaatacaattaggaaataactgaaattcggaattaaaaataaggaatattagaagtagagtatagagtccatatagaaatacaattagaaaataactgaaattcggaattaaaaataagtaatattagaagtagagtatagagtccatatagaaatacaattaggaaataactgaaatttggaattaaaaataaggaatattagaagtagagtatagagtccatatataaatacaattaagaaaaaatagaaattcggaattaaaaaataaggaatattagaagtagagtgtagagtccaaataggatttttaaaactaactaaaatttggaataaacataataaaattaaaagtagagtttagagtccgtataaaaatacaatttacaaataactaaaattcgaaattaagaaaaacatgagaagaagaatttaaagtcaatataggaatacaatttagaagtaaatgaaattcgaaattaaaaattaaagaatattgaaagatgagtttagagtccacatagaaatacaattagaaataacaaaattctgaaataaaaataaataatattggaagaagagcatagagtctatatagaaatacaatttacggaaaattcggaattaaaaaaaaggaaatattaaaagacgagtctagagtccatataggtatatatataatttacaaataactaaaatttgatattaaaaataattaataactaacaagtatataaaatacaatatggatattacacattaatagttttgtaaagttattgcaaaatttcaaattatgttgtcattttaatatatttgaataatataatgagaaaacatatatgctattatatgagagataatataatgatgctagccgcgcaatctgtgcgggccaccatgctagttatattattaaaggaatagaaaaatgagcctccacgttcgctctcatggcctaaaaattctcacattaatcgaagaaaaagaaaaagcagagtccatatatacaaatacaatttagaaatagctgaaattcggaattagaaaataagaaatattagaagaggagactagagtccatatagaaatacaatttagaaataggtgaaattcggaattaaaaaataaggaatattagaagaggagactagagtccatatagaaatacaattaggaaataactgaaattcggaattaaaaataaggaatattagaagtagagtatagagtccatatagaaatacaattagaaaataatagaaatttggaattaaaaataaggaatattagaagtagagtatagagtccatatagaaatacaattaagaaaaaaaatagaaattcggaattaaaaagtaaggaatattagaagtagagtatagagtccatataggaatttaaaactaactaaaatttggaataaacataataaaattaaaattagagttttgagtccgtataaaatataatttacaaataactaaaattcgaaattaagaaaaacatgagaagaagaatttaaagtcaatataggaatacaatttagaagtaactgaaattcgaaattaaaaattaaagaatattgaaagatgagtttagagtccacatagaaatacaattagaaataacaaaaattctgaaataaaaataaataatatgggaagaagagcatagagtctatatagaaatacaatttacagaaaattcggaattaaaaaaacaaatattaaaagacgagtctagagtccatataggaatatatataatttacaaataactaaaatttgatattaaaaataattaataactaacacgtatataaaatataatatgaatattacacattagtaggtttataaagttattgcaaaatttaaaattatgttgtcattttaatatatttgaataatataatgagaaaacatatatgctattatatgagagaaaatacaatgatgctagccgcgcaatctgcgggtcaccatgctagttttatttaagggtttgttggaaccatgccaccctatatttgcaaaatttaagatataccactcgtatctcaatgacatgtaggacccacatgagtcaatgacatgtaggtcagggtggtatatcataaattttgcaaaatttgtgtggcatggttcaaattctccctttatttaatgggaggtgtggttattttttttaccttggcatccaccgtcaaggtaggggtttccctcgtagccctgggagcagttgcatcggtatccggggccatcaatggagtcgatgcagtggctgttgacgctccggcacgcgtagtccgtcatgttacgagtagcggcgctgcagttaccgacgttccggatggcccagttgagcacgacgggcaccgcgaagtcgtcgtttcggtcgaagtccgggtggccgcggtaggtggtgtcgatccacttgtcctccgccagaaacacgtaccggcaagcagtcgtaccgccacgtaatatggggtccccttcccctggtttgaaagtttgaacgtacagctcgtagtagtcggtattggtcggtatcctgctctggcagcatccctcgccggtgcatcccccggtcgaggcaccactcgcaccattcccctgcgatggccggcagatggacgtgcaaccgctgacgtagtagccgtaggtgtcgacgaagtagcccatgtttgggcagccgagcgcgacgaagcggttcctcgccgcagagaagcggtaggcattgctgccgacaagagtgatatccttgttgacataattattggcatcaccgatcaaaccctccgtgctgttgtagcactggcgtctggcgttgatgagggcagtagcctccccgtcggcgagggacaggttgaccagatgttgccggtgggtagacacgatgaggcgcggaggggagtaggcgcggttgcactcgagctcgaagtattggtcgcgggcgcagcgggcgccgatcccgaaagggtaggggatgctgatgtcgccgcacttgtcggggcagcccggcagctgctgctgctgagccgacgccgctggtgtcactgccgccgcgcagacgaggaagacggttaaggcaagcacctgcagatgcagggcactggtagtcatttctgtcatgatagctaaaactattgtctcgttgctctgtttgcttaaatggccgcctgatttccatataaatagattatagattttactccctccgtattttaatgtatgacgccgttgattttttaacaaatgtttgacctttcgtcttattaaaaaaattatataattatcatttattttattgtgacttgatttatcatcaaatattctttaagcatgacataagtatttttgtatttgtataaaaaatttgaataagacaaatggtcaaacattaattaaaaagtcaacggcgtcatacattaaaatacggagggagtactgtacacgcgattcgttcattagttggaagattggagtggaaaagaagatgtatgcttaggcacacgtgcttcttcgttggcgaagctgcctgcctgattgatacgaatacgaccagtgtggttgcaaggatttctcagaaaagcagggagatgtgcatgcgttccacttgcacgtgatcagtctggcccagtcaattgctatgcacccttggattttttcagctacaccaaaatatttttaaccgtccattatacattaatcaaatggctaatgtttctttaaccctttagctctcgttcgattaatctttcctagaagatttaatgggaatttattccaagagacagatgtgtgttcctggtatgcactgtggcatacccaaaacatatgcgaaatatttaggatgtacgccgctccagtagtcagaagtactcagtaagcctcgatagtctattttcaatgctttctcgagcttcaggctgagtttacatccaaagtttttctttaaactttcaacttttccattatatcaaaactttcctacacacacaaactttcaacttttccatcacatcgttttaatttcaaccaaacttttaattttgacgtgaactaaatataccccagttaacaaagcaaagcccataagcctaatcaaccaccccgactcacacagcccacgaacgaataacttcttgtttttttacaatcaaatcatatgggaaattttatcaggttacaaataatacatactccctccgtattttaatgtatgacgccgttgacttttttacaaatgtttgacctttcgtcttatttaaaaaatttatgtaattataatttattttattgtgacttgatttatcatcaaatgttctttaaacacgacataagtatttttatatttgcataaaatttttaaataagacgagtggtcaaatgttggttaaaaagtcaacggcgtcat

SEQ ID NO: 45890 - DNA, 12731 bp, Oryza sativa
ctatgtgagctgctcatgtctccaaaaggattaactccatcagtactcagggcaaatctaatgttccgtgtgtctttagcaaactctctgtactgagcatcaaagtttatccactgacgagcatctgccgggtgtcgaatcatcccatccttcttgtgcccttcttcatgccagcgcattagttccgcatctcgcggattttagtatatccgtttaatgcggtctttgacaggaaggtaccacatcacaagctgcgggatttttctctgtcatccctcagttgtgtcagacggttctaggccagtattgctattcgatttgtatcgtgtcgcgaccgagaaaatttgcattttcccgaacgctagtgtattaatccccgtcccaggaaaagccggggtacaccacacaaacatgatacaaaaggcacatctttattatatcgataatatttacattattacaaagacactttaggcttgacaaacaagaataaacagcagcggactagcgggcctatggctccatcttcacaggcgctcaactggggtataagccaggactccacctaagacttcttctccaaagcttctcttactgaaggggggggggaaagattgagcaagaatgagtacaaccacagtactcagcaagtcccaccgggagatgcatgattaatgcgagggagtacaaggggtaataatataggggttaagttttgcagtaaacatcatttaaaagtcacttagttgcccaaagctattttgtaaacacgatcctagagctatacaatattattaatccaggccgtggaccctcacgaacctgccttaacccaaggcctacgatgattcagaccgaactggcaacccgaccctgggtcctagctcgttccaagccaacccaggccaaccattccacattttagttgttaagcaagttttaagaattaaaacactaacttgggtacattgctaggcttgcccataaccgagggcacggctattcgaatagatttactctgatcagaggtgtacatctttacccacaagacacatcttcctcacgtgtaaccacgtgccacataccaccacggcatacggacgaaagacgtgacatagttaccaacccatcctagccataaacaagagtaccgacccagccccgccttcggccggaacctccgggacaggtaggcaggattgagcccctagcagcaggacaccagccctatgccatgacatctcgactaccgggccgcagctcgtgtagccttcatttgtcctagagatgtccatcgacccccgacttcgtccatctctatccgtgtacctttgtttataaccagactgagccacaaactaagccttacccactagacatgtggaagtacggtagtgctttgcaacagaggcccgagcttaatccttatattagccggggtgctacttcccacaactggcatgcacccaaaccccaccgaaaaacaggttttaggggttttgaaagaggaagagaggtgtatgtccaattccaacataatccaaccatcccatagtgtccaagtgatatgagaattcccaaagtctaaagttataaaaccacctattgttgcctaattaatcagcgaagcatctacctaaattcatactagtggaaccataaatagagtacccactagttggggttttgtttatcctagggtgaacaaggtaataataacaatagcaataataataaggtcataacaaaggtaaataggcatggctaaataaaacattgataacgcaggaatttaaataaagcgataatgcattaatttaaatcaaaataattttataaactgagattcaatatgctcaaggatgatgtgacttgccttgcttagagataacggccttctgaacctttggcgatgaccgcgaaccacgcttcgagaacctccggaacgatagaagctacgcgaagcacacaagcaaagctacaagcctataaagaagcaataacaatacataaaaagaaagcacagggttctttaggttataacaaacattaggagacttgaacgggtcgattcggagctcgtatgaccaagacatgatcatccgaagtttaatgctgttatatggagatttgcggattattgtaattaggttttacaactataaaacatgtgtaagcgctagcctggaaaagaaaggaaggctgcgccattgacatgcggaccccacatgtcaacctaaaggaccgcggtagaccgagtacacagagacggtccacgggtcgacggaagcggaccccgtgtgtcaaccgaggcgagaggccgacaaacggacttgactagacaccacgcgagctgcacacgtgaaaccacgcggctaccgagcggacacactaacacggtcaccacacgcacacacgaacgactaccaacaccggtacacgggtaccagggtcgataaccgcacaacgggcacggggcgacacaaaaagagcgaggatggggcagcgaaggagagatccttaccaccacgcgacgaggcgagggaacgacaacgacgaacgggcgcggtggagagggacgggaacgacggagacaaacggcgaggggacgacttcggcggcgatccttggacgaaggcgagacgcggccggcacaaggcttgacgacgcaaagccgaggacgaagacgatgacggggctgcggcacttgacggagcgaggacgacgaacgagaacggcttgacggagggacgaacgccacgacgaccgggaacgacgggaggacgacgacaacgacgaccagggccggcgaggaggcgacgtgggcagccggcagcggctgcacagagacgaggatggcagggaacacgccgctgcgaatccgacgacggaggcggcgcaacgagacaacgagccggcgaggaggaacgatgacgacgacgacgaacaccggcggggttcggtcgaaggggaggcgaggccgagggcgaccttgccgctgcgatgccggaggtggtggtggtgcggccgacggcgcacgggtggaggaagggccgaccgggggaattccggcgaggcagatggagaggccggcgcggcacggcggtgttccggctaaattagggcgacgccgtggcctagccggtgaagaggacggcgttccggtgccgggagaggtggtggcgacgtcggccggcgcacaggagacgcggcagaggcggccggaggcggaacagtggtgacaacaccactgttgccggcgggggcgcacttccgggggtctccacgcgaaacggagggcaggccgggggagaggaggctactgcgacgccggggaaggcgacggcacggccggccggcgcacgggcgggacagcagaggccgctggaggtggccggcgctcggagagagagggaggaggcggggaggggtggtgaggccacgggagagcgcgggagggggctaaaacgatagaacggagcgaggggattccgttttatagcggagggaagcgagtcgagcacgggaggagcggggaacggcggcggaaaaggcgcccggcggccatggaaggcggccatgaatggcgcagccgttccggtcaaaatagtgcacgattaaaggggagattagggggaaaagggagaagaaggaaaggggattaattccccccaattaattttggaatccaacgcttaaatcgcgcttattcgagggaggaacgaactagggttttcacgggagggagagaggagctgtgcgggaggaggacgacgattgggcgggtgggacccaccggtcaggcgcgtggtcagcgcgcgtgcggcgcgcgcgtgacaggcgcatgcggcgcggcctggggaggctcggctgggcccggaggtggcccaggtgggagggggcagggcggcctgggccgggcaggggaaggggaggcccaagagaaggagggaaagaaggagagggagagaaagagagggaggaagggaggactttggccgtgggccgagagagatagagggaggctttgggccagacttggcccaaagggaggagggggattatttttagtttttctttttagtaaactttgttaattgtttttgttgcttaataattatttccggtgctctgaaaattcaagtaaaatttgagggctcgttttagactaaggagaatttaataaaaattctctggaccacattcgaatttttcttgtacgtattttagtgtttgccaatttcttttcgaattttaattaattctattattccttttagaaaataatttttatttcgggatgaatttatcaggacgtgacataccggctagcaccgcatgttggacatttatctaaagaagcgtactctttcctgtacagtatgcagtgatttacgcacgcatgaatcttttccacaccaagtgaaagggggtatatgagtttctttgcttgatatgtgctgtatggtagtgagttaggcctcgggagcattttctgcagaagttctaacaaactgtcgaaactggtatcagaccatccatgtctcgcctttaacctcataagttcaagaactgaccggagtgttgtgaactcactgtcacagcccttcgactcatcgtacaaaacttcctttgctgcaaagttatttaaccctctagccgaccccatcagcacctcaggttctacatgatgtaacatttcctctaggtcgattttgttctcaacagaaccatcgtcatgcaccatgtcttcaacttgtgtcggaactacattttcaggcccgtccacttgttcttcgccatgacgtgtccatatttcgtacttgtccataaatccacgagttactaagtgctccttcactttaaaagcatcgtcgaagtcccaggctatttcattcttgcagtcagcacatggacaaactatcttcctcatattgttcttctcagcgtgtgccttggcaataccaataaatttagacacttcgtttctatatggagacaaaaacctcggccaatgatacatccattcccgactttccatatctctaaaaaaatacacataaaatatttgcacaattaataccaaatttgtagggtttattgaaaaaacttatcgctattcaaaactaattaactaaaggttaagtgcaaattaataaaaaaatcaaagtttatttcaatttttttacacagacatgccaaattagtacattaggaaaatctaacaaaatcatatcatcggcatattacaaaatactataactattttttgattgcaccgaataaatagacattaaaaattttattctctctctatatatgacaagatctagatctagatctagaactaggaagtggatgtgatagcaaaaataaaaatctaacatcaacatatcaaaagaaataaaattaaaaaacatggagctcttccttcacaattttgcatgcataaatccatcacaaattaaggtctaaaagcttaaaaaattgcatacctagtgtggaaatgagtagatctaagtaccgtagaaaaatctcccgaagatttgaagttcaaaacctcccccctatatttaagtcactttaggagagagaaacttcggggagaatgaacagggctcggggaggaagaagactatataggggcatcttttcaggcgggccatataagcggcgcctgcgaagattgatcttcgcaggcggaccgccccctccaccctgggtacttttttttgccggcggggttttggctccgaattacatgcccgcctgcgaaaatcgatcccctacgacgccgaaaatgagttttctagtagtgtgactagtctggccctcttgtgttgcattaaaatcaaattgccacggtcttcaaaaaacaagtgacaaacatttattggcaccacatcacagtctactttatgaacatattgctcccgatagaaaatgcatctctccgctcgattcacccattaattgaatataacacggcataggaagccttctcatagacaaagataaatatgcaccaaatctaaacggatagcattagtgaaagtgccaccacaattattaatttgcataccttcccctgaattttgcactctaattaaaaaatattacagcactgccccttttcatcaatattagagctatcttgctgtactacgcatggaagcatagataaaccattattctgtttagcaccatcatccattgataaaacatcaaaatctcaatagcatgcagctagagtatgatcaagatgtacaccttctgaatttttctgatgaactctcagaaatatagccctctctagttatcaatacatttttctgattagggcaatctctcatgtaatgtcctcttctccctacaagtataacactgtacacttcatgattttgaaccagatgcaacggtagattcaactttagatgtggatttattcaccgaactagtagcaagtttagatccatctctagaaggagtagtcgacttgaaagagactgacttactagcagcacatacattactgtctcgctgaaaagaacatgaacggctagtgtgacgactctttggttgttgctccaccctctgagatatgttcaccatactttatatatatctcctattataaaaaattaaagatgtttctgctggaattttggtacgtcgtccgtgtttgagttggttatatatcgtccaaatccaattcaacgtgtgtctagaataactattatacacccctatcctagcccaacccctctccctcccagcccaacccaaccggcccacaccattccgcttccccatcttgcacgctcctcctatcgacgtctttttttcctctcctttttttgttttgtttttctcccaataatcctgatcgtctcctccttccaatcccatctcttttcttttctttttccttatttttttctcttccaaatttctctcctcaaatattttccttttgaatttatcattgtttaaggtgcatacacaagtttgttactttgcaaatgctttccatctacagaaaaaaaatatttactaattgaatgatcaaaatttcaatatttggtctacgaggtataacaaaatgcacatgtgtcaacttatgaaatagtcacccaatcgatttttgaggctatgaaaaagtgtacataagagattcttcgtgtggtatacaaaagattcatatcttggaaataagctttgaaaaggtttatttttaaaattaaaaattttaaaagttcaaaaagtaaaaaaaaaaaaaacttgtgatcggctctccccgtccactctgcatgcacgattggtgattgggagtggctgcccgctcccaacttgtgaagagcagaagtaaacaaatatgttttttttttgaaagaagggaaaaagctttacctcttatacattgatagagcaggagaaaaccgaaaaagttatatacaaagcccaaggaactcaagcccaaaggaaaaggtagagatctacactcccgctggaattgatctcggttagcttagccgctcccactgcgatccaagctcgctcctcctctttaatcttggcaatgatgatggcaggcatggatgccacttgtctgaaaattctggcgttgcactcgcaccagagttcccacgccatcaggataatcatcgatttaagggccttcgtaggatagtttgttgtgcacaaaatttttcacaaccagtcttccactgttgcgcattccccccattcttgtaggcggaggtctataccagtccacctttgtgcttcagcccaaattcttttggagagcctgcagcctgcgagtaggtgaagtgctgactccggcacagtatggcagagtgggcaaacacgctaattagccgaacttcttttctgcactctatcaaccgtccaaaccctattctgaatgattagccacgagtagaatttgcatttaggtggggcccaacatttccatatggtctggttgtagattgtagtagccacgccaagaaattgcatcccgtatgccgaactagtagaatagatgacatttgttgtcagcttctggacgatggagtcccgctggtcggatagcgggccaacctgttggatcaagttccaaagacagacatattggctcaggtggtctgcttctgtagtgtgcattagatctatgtccctaatccaattgttgtgggcaagggcgtcgtgtaccgttcttgatttgcgctttcaggccgtgaagatggctggtgcgatctcttttggcgctttgttgtccagcgagtgcggtcccaaaaactagccatcttcccatcccctaggatgattgttgtcgccgctaggggtgggcattcggttacttcggtcttatcggttcggtttattcggtgttttaaaagttcggtttcctaaaactacaagccaaaattctttttttcaaaacaaaaaccaagctacaaaaactgatgtaacttggtgcggttttttcggtctacggtttataccgatattgagcgcggcgctttgctcatgggggtggcggtgtcttgcggctagggttagcatcaatagaaaggccgatgcggtgtgtttggatgggagtaaatattgggtaagatgagatgaagctgggttccatgttgttgttgggtcatgggttgaggtgaggaagtggaggctctagttcggtgttttcagtacatgcggttttctttctaaatgaaccgatttagacaccgaacaccgaactgcgctaaaatgaagaccgatgagaaaaccaaacaccgtaaaaaccgggatgcgactacaccgagaccggtatcgcgatagggctatcacgcgacgtgcgcaactggcgattccgcgccgcgcgcgccccatgccaaaaatggaaaccactttttcctgggcccccgcgtgcgccatcgctaaaaatggaagggaaagcgcgcgcttgcgcgcgcaagcgccgtgcgacgcacacgtcgctagctggcgtgggccccacctaagacagcacgatgcgcctctctcccccactccaacccatcaaatcgggacatccggcgacatcaatccccacacagtcgccacggcggtaaaaatcagaaaaaaatcgctatcttggaagtggggacggaggagaagcaaatccaagaaaatatccaggtaaagtacacatgaagtttaaattatgtcttctttgagatccatccacaaaaaaaaggaactaacctagaaacttttagatcttttctgtattcttcgagaaatgaattgatatgaatctgtgctgtaattttgtaagtaatatcctttttgatttctatcttcctttataccctaaattcactttctagtgctgctgagaaaataagttgtagaaaaggcatgagtactggtgtttcaaaaatctcaaagcaatttctaggaacatgctacttacttccagataaacttgaattcacaatccctagtttaaacaacatgaaaacatctcatctagttgtctctcagtgcaatttgaacagaaaagttaatttacttcccaaaataaacttgaatttgcattccctagttacataggcatgagcgctggtgttggaaatctcatagcaattttacagaagtctcagtgcatttttaatagaaagttacttctaacacttcaatgagttacttcctagaaacattaagttacttctcactgtgcattaagttacttctcactatgtattaggttacttctcatagcaattctaaccgtctcagtgcatttttaacggaaagttacttgtaacaattcaatgagttaccacctagaaacttgcaagttacttccctataaacttgaatttacatttcctagttacacattttgtaccttgtttctatatacagcataatgcatcacctagttgcgtctcaatttcattttgtactgcatcaaaacaaattgtgaaaaaaaaatcattagtatagccactggtcttaatttgagaaaattgcttcctagaaagcatctaaaaaaacagaaacatttgtatcggttatttaattacatcgagtccagttataaagagttactatcctgttgcatgtaacttacttccaaactgtactggcttacttcaaaacatataaatgttactccctctaaaacatgcaagtaattttctataccacagatgaaattgtctgacaaagttactctgaaaacataaaagctttactttcatgtgatgtgtaagttacttctccccccccaattactaaattacctcaatgaatgctctgtataaactttgttactaatagcctgaaacacatgcagcaaaaatggattttgacctcaacagtatcccagaattagtttctggtgaaaatgaacctccagtacaccatttactagttgatgatgaagacagaagtaaaacatagttccctataaatccacctgacactagcatggatgattcctgctataaatttggactacacttttgactttgaaactatgtatacttctggtgatgttggaagtttacaagcacacaatgtagccaatgatgagatgcaagtatttgaagccaatgatgagatgcaagtatttgcaaccaatgatgagatgcaagtatttgaagccaatgatgagatgcaagtatttgaagaaatgtcagatcatgcagacacaatgcatactagtgttgcaactggcgcaacaactgctactgccaacacaatttcaagtcaagactctggaacagatgattcagaagtgccgtacctcatcttgactttcaactcagaggaggaagcaagggctcactacaacaggtacgcaaagcgcgttggattttcaatcaaaatcaacactgcaaggaagtcagccaaagatggagaacgtgacaaagtaatgtttgtttgcaacaaatgtggtccagaagaaaaaacgggtgaagcattccccacaaagaaaaggaaaataagtagaacaagacaggctgcctgcaaagcaaggatgacagtgaagaggaaaggagctaggtgggaagtaattcagtttgttgaagaacacacacatcctctggttagaaagttttcactcaagaagttcctaaggtcacatagagcaataccgaaagaggaaaaagatttcatcacaatgctgcacggaatgaatctctcagctggtagaattatgaaattgatgtcggaattgtatggaggggctaggaatgtaccctacactagaaaagacataagcaatttcaagtcaaagttggggagtgagtataggtgtagagatattcctgaaccaattgctcacttcgaggaaataaaaaaggatgacccaaatttcttctacaagattcaacttgataaggaagacagggtgcagaacatattttgggttgatggagcagcaagaaatgcctacaaagacttcaaagattgcgtctcgtttgactgcacatacatgacgaacatgtataacatgccttgtgcaccattcattgggataaacagacatgggcaatcattacaggtactcctttttttttgcaaaaaaattaattctaaaatatctgtaataactttgtacattatagtacaccataagttacttgttgcattcattgagttacatcaagtcctgataaaagttgcttccagtagaatatgaagttacattttttttaaaaaaaaaagtaaaaaagtaactaagtttacaagctacatcttttagtgtctgttctatagttcaaaattgtactgatttacttccagcaaacacaaactgtacaaactacgcaaaattgtagtaacttacttgcttcaaaactgtactgacttccttatgtgtattttttttgatattcagctgggttgtggatttctaaggaatgaaaagacagaaacctttgtatggttgtttcaagcatttctagagactatagaaggtgtaaagcccacaaacataataactgatcaagacttagctatgaaggcagctatagcgctagttttcccacatgctaagcatcgcaactgccgctggcatataatgcagaatgcttagaagaagattggccatatattagatcatgacaaagcattgtgtgatgcattcaatgactgccatgacaacagctggacagagtaagagtttgatgctaaacgggttgcaatgttgacaacatatcatttagaagataatgagcacttccgacacctttgggagatgagatagtgttgcgtcccagcatactttatgcactgtttcttccctttcctccagactacagcatagagtgagggatttaatgcagtgctgaagcgctatgtaaatccccaaaacagcatatacaacttctttttgtagtacaagaagattcaagaaaaatcactgttgcaacagatcagaatgagtttgaagcagaagaaacaatcccttctatgtgggcttactatccgatgaaaacaaaagcattggaggtctacacaaggcctatattcaacagatttcaaaaagagctgattgcttcaacatcatataaattgacccgaacttctgaaaacatgtatctagtagaaccgaatggaggtcctgttaggaattatggatcaaaggcattcattgtatctgcaaatgtgttggacaggatatacaactgtgaatgctgtaagtttgaaagggatggcattctttgctgtcatgttct

SEQ ID NO: 45891 - DNA, 1851 bp, Oryza sativa
ttgtgggctaagtgagtgacattccagaacactacatattgcctagatggacgatggttaaaaagcctgaattgcctctagttacaagcattggtgaacaaatgcaattgccccctgaatctctgaagctaatcaggtataccaatatgtgcacaaaatttacacatattgcaaaagatgcatcaagcaacgagaaagcctaccatatggctctacagcgtacgagctcaatgactgatgatttagcagctatgaagcagagtagaaagaaacagaaaaaggcacagccagccccagataagaggaatttcagatatccccttggcatcaactaacccaacactacagataaatgacccccccatcatacaaaagcaagggagaccagtttcaacaagacgcaagcctggggtccatgcaaaggcgtcaaagacatcagttaggaaaggcctagctagtactgagaagtgaattagagctacgagatgtaacttataatgttgtgacaagattgttgaaacttacttgcacagttgtattaaattacttttagcttccatagtagttacttcacagtgatatgtaagttctcaggaagaccatgctgagttctttgcagaaccaagatgctattttaatttgttacccaacctaatttatgtggctataatttatgtgctggttcaggaaaaaaaatgcagtgtttcattaccttaccttaagtgtaggatcaagctctttgccccataatacttgcatccattgcacacgattttcttgaaatgagagcatcttgtgtgtaagtagtttcttaatgttggggatgtcacttggttcaaatgctagcaactgtttgccatcccacaactccacaaatttcggcatataaaaaccacaatcccggctgtttttgtttgcaaaaacaaaaagggataagtttgagtaaaaacaataaatgaaaatcactaactaaaaaaaagcatgttacgtacatgttatcttgctttgggccatcaataaaaatcagtgggtaattctggatgattttctttgaagacctcatgtaaaacctatcctacatggtcttgatggatacaacaacaagattagatgctgaaatcagctcttcgtcatcttctcccctcagcgaatcgtaaacctcgaatctttcagctttcagattaaggcacaccacgaaatagtgaccatccttatcattcccattacccaattcctagagaatgggaaaaattgtctgcattcaagtgaaaagagggagaggagtggaaaaaaggtttttctgtaaatataatcataatttagtaagtataaaaggataataaaaagtgtttcagaataacattttctgtcaatataacagaaaaagttacttccacaaacatgctgagttaatttgcagagacatttaagttacttctacaagcagacaggaaaagtaactttacatgtcattgacatcaggaatatatattttcttactaattcttctacaagcaaacaggaataagtaactttacatgtcattgacagctggaatatatattttcttactaattctttatggtcaagacggttcgctctcgtttgatcgaagtgtttcttaagctcattcctgtccaactgcaaatccaacaaatatccctgcaccatgtggaaaaaaaaacataaggtgttgcaatgataataatagtacactaaaaagtaagagatttttgtaaattttatatactcctattctggcaggaaaaattctcttcgaattgtccttgatatcagcagacagaacaattaatgccaattcacatgtgttattgtccagtggggctgcag

SEQ ID NO: 45892 - DNA, 12174 bp, Oryza sativa
cctatgctcatcgtcatcttcttctccttcatcatcgtcatcttcttctccttcatcctcatcatcatcagaatctccatcttcatcaatatattcatcttcctcagtgtcttccacttcttcttcatcagcaacaaaatcttcatcatcacttgaagttacatgtaccaaaagaacaaaagtaacttagtgttctgtaggaagttgtttggacaaatgtaaaaaactaaaaattcagttcaaatcatcgtaaaaaaacagtgtggtggaacaatgatactaatgagattcaaattgtgcagagtggtagaacatggctatattaattattctgtacaataattaatagaaacatagtgaaaaaaccaaacctagatcttcatcttgctgaactttttttggcctttatgcaagtttcttccggttctttcgcatttgccttggttggctacccctaggatccacaaaatcaaggccggaaatctgcctcacaaatttcgtgaccaaacctgaaaaaccttcacacaaattttgcacagaggtcacaattctgtcattttcctgtataaaaagaaaaaacagagaagttacatatgcagatttcacaaagttacttttgcagttcgttgatgttacatctaccaagtgtacaaaaagtaaaacagagaagtggggaaaaaatataaacctgctcctgcatagtattgggcacatttgaatttatgaaggttgaaaaatctacattgctcccaaacaaattggtcccttcatgctgaaagctgctcttaagctatattttcaattataaaatccgtaagttacgaacaaacaaaaaactaaaaatgatgcaagtatgtcaactataaaaaaactcactaataaagctccaaaggagccatctgctgatgtgtctgctagatttatcaattcattcgtccaaacagtagctcgataaccctccactggaacattgagatttttaaacgaaagtgagtccaaataaagaatctacaaaagaaattagagcatttagattaagtaaaaaaagtacataacttgtttgatttaaaacctacaaaatatgttaactttcagatgtaatttaaatttgaaaacaaattggaaaaaaagatgtggcagggcatatatgaagaagtaacttaatgtacagtgaagtgacttaatgcacaataagaagtaatttaatgcacagtgagaagtaatttaatgcacagagagaatttacttgacagaaagttatttataacaatttaacataaagaagttacttcctaggaacatgtaagttacttcctggacagcttaacttactttaaaaaacataaaagttacattgggacagtgatcgaataaaaaaaaggtgagcattgttaccatcatgtacaggagacatgctgagttggtattcttcccagctttagtagctttttgcaaagtagatatgacaaacttgcacgaattaagattcttgatatttccagcatcaacaacagaaggatagcatcttgggctgactgttgttgctgtcgttggtgctaaaacagaagaaatggcgtagatgatccacatgcgcaggtacttgtcatctgctaacttcaactcctccaattgaatcccaagagaagtcagtgatggtgatcgttgattccaagcaaattcagcacaaattctgtagcttcagactccatctcatatgagacatctttgtcgcccatagggataccaagcacagacttcactgactccttgttcacatctatggctccacgtccaggaaatacaagctgattggttgctggatcgaaatgctccatcaaccagctgcacaaatcaggtctgagcttcgagcacttgagatctacgaggccatggaagccagcccccctctgttagtcgcttttgttcgccactcatatggggatacaactttataagtttcatagatgaagccctgctactctcttgctgcaaatgtataaacaacaaaaagaaaaataaaaaaacatcagcatttgtttattttttcaaaaacatatataaaacagttgaaaaaagggtaactgaaccaagaagtaatttgccattaagttagttctagaaaataacttgccctcaagcagcaacatcaaaatattttaggcacggcgagaagtaactttatgcacatagagaagtaacttaatgcacatcgagaagtaacttcttacttgttaacagaaaatctcaaagcaattttaacaggaagttacttctaacaaatcagtaagttacttcctatgaacatgcaacttacttccagataaacttgaattcacattccctagttacacagcatgatacattccatctagttgcctctcatagcaatttgaacagaaagttacttgttataaaactcaaaaagttacttcctagaaacatgcaagttacttccaaaaataaacttgaatttgcattccctagttacatagccatgagtactggtgttggaaatctcatagtaattttaacagaacttaatgcacagtgagaagtaacttaatccataatgagaagtaacttaatgcatcataagaaaatgtagtgcattggaaaaggcaaaacactgcttgagggcaaaaaatgcataaaaaaaggtggatgcttaatacctttgctctgctcctttttggaggaggttgctctatgtcatctgcatgatcatctccaatatttcttttcttagcatgttgcgacacccctcttgttttttttacttgactctggtttgcctaacatgccttctttataatggtttttctttttcccattcctggaaatatattttggatgttagtaatcaacttgcaattaaccatcgatcaactaataatcaacttgcaactaataatgttagtaatcactttggaaattcattttggatgttagtaatcaacttgcaactaaccatcgatcaactaataatcaacttgcaactaataatgttagtaataattttggaaatttattttggatgttagtaatcactaataatcaacttgcaaccggaaaaatcaacataagccagagagagaaatttaaataccttcaaatggaacccgagatccacaagccgacgcttgagggggcgaattccactgcaaccttgcgctcgccgagaggatgaactagcacctgatgaatgagggagagagaggggacatgagggaataggggagaacaaactgggaggtttgaggagcaatttgcgcagtgaaaaattgcccaatctccacctccctggcacaaaaaacgcatggaaaaacagccccatcactccacctgttcggctcaaaaaaaccgcaacgaaacagccgcatcacgccgcaacttaccgaaaaaaatggccgccggatttggtggagagaaaaccacctccgccgcagcctacgcttcccaccgcaactgccggcgcgatgagaggaaaccgtcggctccacgcctccaccgtcggctacgccgacgccagcgcgacaggaggaaacagcagcaactccccaccccaccccccattcgccacggatttcgccggagattcacgccgcctccacctctctctcactctccgcctctctctctctctctcgtcgagcgccacccaaaacatttgaacagtaaaccctcgcgtgagctcgctcggtcggccggtcgggacgcgcggcgtgcgccgaatggacgccacgttgccaatcgcggatcgacggctgccacgcgcgtcgcgcgatagcactatacgaaaaaaccgaagattcggtgcggttcggctcggttctgtgcggcctacagttttcggtgattttctgcccagcctcgctgccgcaaagagacttttgtccagttggttgcaagggagtgcaatgtgtttgatggtattttgttatatgcaaggaaaatttacagtggccatagcaaggaaacaatgtgatatactatgtgaggttagctagcttgtcattttgtgcgtgcatgggccatgcaaatatatgaatgtatatgccgtatatatacacaagctagagaatcaaaggctagcatttgctaattggccagtggggcaattatgtacgtacatgcatgctccatatgcatgcttatcgtattaagcgtgattaacggtgaagtaattatcgtattttacgcgtcgccggctggataaactgatcaaggcccatcaaaaaccaacagagaagccacccaaatatttgttcatgcacggaggagataaaatccaacgaaccaagagataatgagcataacaaaccagatgacggcggcggcgcacattgtcgaaacatgatttcggcaataataaaaggggtagcacacgagacctaaaagtggatggatgcagagacaaaggatttagacaggttcaggccctctcaatgagaggtaataccctactcctgtttggggatttgaatccgccgggtgtagtatagatctgacgatcaggttgtgtctcatgccccctagagggcctcctgcccaccttatataggatggggggcaggattacaagatagaaaccttaaccaacacggtatcggtttcctaaatctactttacaatcttatcaagccaggactttaggccgttccataatatacagggaaacgtaatacccaagtcatgatctgttacatatttcatagatataagttatcccatataactagtcggataaccatgccgtgtgggtatggggtacccataatctccacagtagcccctgagaccttcacagtcgaaaagataatattctctcgaactagattactccaaagccgagtgcttcaatcatctttgccatgacttcccgagtacttttaccaaatctaaagactgtggagggctgaaaaataaagtcaggtgcatcgactagatgcacctaataggtgtagcccccgactatgtggttaattgaacaaaccaaacacatagtcaaggaataaataatctaaccaaccgagtggtttcgataatagcatatgatgtgtgaatccctgaataatatgatccaagtgatataccgactgctttgtaaaatatgatgcgtgcaacttaaagtcgactacattattgaaaattcacatagcaaaacagctataaagaagcttgtatgttgtgaataaagaaatttccaaagtattgggcatacgccatgcgcacactgctttaacagatgtgcttaagtccctaaaagacacatggtttcaccacacctgaaaatatatggcatatgtggtgtaaaatccgagtaaataaactcataaaggatttaccaaccgcctagaaaatgaccaaaatatataatcagcccaagccataatattggtcaataaaagtgcacacttacgtggcaaaaaacaatgatattgtatccaatcaattgctttatgaacccaaacaacaccttgacttatataaaaaagtcagcgggcagctatataaagcattactgtttggcaccttttaaaatgcattgtaccaactcctaaaaagttgagtaactgcggtataaaaggattttaaggtattgggcatataatcacgcgcacttttgcctaagcaaaaagatgcctaagtccctaaaagaacgtgacaggccacacctgaaaatatgggctgcagacatattaggcctaggccaaaacatatgccctcgacaccctttaaaggatgacgcatgtaacatgctcccgagtaataaatcttccgggtaatatagaccaagcgtagctcatatgaatagcttctgatctgagtgattatcccttatgggatactccaaaatagatataaaaattgaatcccgactggcgcaagtattcggttgataacccttacggagaaaaataaatagtccagtctttgagcatagaaaatagacccatgatcatgaattcatgttgcatgtaaccggaacaagtccaaattgaaggtatgatacttgtgtttgaactagtaagcctctgagcatatagcttgtccttctttgtagtcacaattgtccatcgatggtagctgacgcagttggcatagagacaagacgaccaatatagagataatattgcccaccagaggtggcaaaaatattagtggtagtgaagatagtgataccaatcaaaagtactgaagtcgcatagccatggaggcgaagaaaccagtcggcggcaaacagatcaactaacaatgaagatgaaggcgcccagcgataaagttgtgtagccatggcagcgaaataatcagtcggtgatagacgaggcagatcaaatgcgatgacgaaatccaccaatcatgaagatgaagaaaatagttgacgatgacaaacgcaaccgacatgatgaagatgacgatgtcgatgatccagtcaatagcagtgtagcaaccaatgataatgacaaagacgctcatcagcatttgcatagtaggtcaaccgtgaaggtgaaataataagtcggcgaaaacataatcatccattagcaacagcggagatgtcagggtcgatgaagcagaggtgctggtgatgatgtcagtgacaataatctatcaaattaatgttatagctgttgtagatgctttacttggaggagagttgatgttgttgcccaactcgtctaaaccgaaatatttgaagttgttgaagtagaatgtctgctccgaagcaaagatgaagataatgactcctggagttgactcgttggctgattaattgatttcttcagcttgacataaaatttgtcaaattttgagccttgtatttgtatagcccccgactctttgattagttgggaaacaactgaacatagagtcgagaactgtagcttcttgtcgtcgaatagttattgcttgattgaagatatgtgttgaagatgtccaagtagaaatcctgaatattggagagccacttgttgtagtaaaataatacggcatcgcatgccgagatgtcgagattcacaaagacgttgtggttggtgaagtagcgaaacttgcgaagtagcagcaatagagtttgccggtgccgaagataataaagatgaagtcgctctaccatgatgacaaagttgcattgccgtgatgaagtgaacacgagtcggcgtcaacagaagcaaactggtagtgaagacgcgcagttgtgaagataaaagcactagttggcgacagcataaccagtcggcgacggaagacgatgatgttcatcagtagtgatagctgtataaaccagatgtagaggcgagggcactagtcagcagcagacgagacgaccggcgatgaagatggtaaggccaatcaacactggcagaatcatgcagctatggaagtgaagaaaccagtcggcagccatggcaaacgtaggcagcttgtattgaagatactgatgcctattagtagtgacagcgatgtagccagccgggaagaagatagcatcagttggtgttataacaggctagccgtgcaggcggaaacaccagtcggcggcggccaaggcagccggtcggtgaagacgtagacacccaacaacggcggcataataagtcagccgtgcaggcggaaacaccagtcggcggcggcgaaggcaagccggtcggtaaagacgtagacgcccaacaacggcggcataataggccagccgtgcaggcggaaacaccagtcggcggcggtcgaggcggccggtcggtgaagacgtagacgcccaacaacggcggcataaaggccagccgtgcaggcggaaacaccagccggcggcggcgaaggcaagccggtcggtgaagaggtagacgcccaacaacggcggcataataggccagccgtgcaggcggaaacaccagtcggcggcggtcgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtatgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaattatattatctctatgcttttgatttcttccgagtaatacttagcaccttgcgttactcggtccatccaacgagcccccgggtgctaggaatcggcccaaaggcaactatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggggacaccactcggcggcgacggaggcagaccggcggtgaagtcgtagacgcccaatagcggcggcttaataggccagccatgcagacggaaacaccagtcggcaagagtagtgccgcggcgttacatgcaaacagcaaaaaataccaagagagattaattctgagacggagcggagtaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcattttgttgaagtcgtcggcggcgaggaatcaaggagctcccaaagcgaaggcgaagccggcgactcataaagttgattccatcgcactcgtcgtcaggaaactcggcgtttacccctacctggcgcgccaactgtcgaaacatgatttcggcaataataaaaggggtagcacacgagacctaaaagtggatggatgggagacaaaggatttagacaggttcaggccctctcaatgagaggtaataccctactcctgtttggggatttgaatccgccgggtgtagtatagatctgacgatcaggttgtgtctcatgccccctagagggcctcctgcccaccttatataggatggggggcaggattacaagatagaaaccttaaccaacacggtatcggtttcctaaatctactttacaatcttatcaagccaggactttaggccgttccataatatacagggaaacgtaatacccaagtcatgatctgttacatatttcatagatataagttatcccatataactagtcggataaccatgccgtgtgggtatggggtacccataatctccacacacatgctgaggaggaacgaaggagatggcgccagatgacggcggcggccggcgacttcggctgcggcacctcggcatccgacgagaggacgcgtgtgcggagaaggaggcgctgccgaggaggagataaggctccagtccattgttatgggcactgccctcgtcggagtcaccgtgccaatcgactcatggacttccgtggagagcaccgaaggccatcgtatcggcgtcgccgcgcacacactccggtggctggcaacttgcaccagcagcagctacaccgccaaacgtcgagccgcatattgacggagctaggcgaccggtggtgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttggagaaaatcaacatccgccgctagaggcacccggaccccccttatatatgggaaggagtccgtgttacaaaagataatctatatccctaacggaatatgcagatacagataaaatacagtcgtaaccgactaagtctcaaggtgtttccttgatatacaagttaagaaacaaacccgagatacaaataagatattctatgtatatttggtatcctatattcagcccaaatatcatcgccgtgtagatatgggatatccatgatctccacagtagcccccgagacctttgcagtcaaccatcatagccttctcaaagataataatccgagtgcttcaaaacttatcatgccaaggcctgccgagtagcgaagacgaagactgtaaagggcgaaaagataaagaacgtggtgcatcgaatagatgcacctaattaggtgtagcccccaactatgtgattagttaacaaactaaacatatagttgagaacaaaataatagcacaatcatgcatcagatggcaaaagcatacgcggcgcctaaagaggcattctagccgactgctttttagccataataaaaagaatccgagtggtttacactctaaaaggttcacgaatgaacacactggacaggcatccgaatataaaactctaaagattacccaccaagtattataaaaattatggtaatgaataaatctaatagcctaggctatgactatttaccataatgaaaataggtatataacataccaaggaagtgactatgataaaaacaagtcattccaaattaacccagacagcttttgtagcctaataaagctaacaaaaagcagtataacacctttctgtcgggcaccttttaatttgcattgcaataatttcaaagaattatatgaccgcataaaaaggattttatcagcattgggcaacactattgtgcgcataatattgccaaagcaaaatatgcctaagtccctaaggaacacaacgggccacgctgttaaaagtattgggctgaagtactgttcaggcctaggcccatttgcacctccgatacccttaacaagaaatcccgagatccaagcgacgcttcgtcttccccgccggaactctcgccattttccccactccttgctacagtgcagaactgcgccggcgaactagggttcaccactccactcaaatccaccttcgaaaagtgcatcaaaatccttcccgtgatccaccgcctcaatccctcatttctccctagccatccctcgaatcaaatcagcgcattcgggtaaaatcgatggcg

SEQ ID NO: 45893 - DNA, 5534 bp, Oryza sativa
aataaattcccaaagcgtaccatgcccaagaaaaaactggctggccgtcaaatgccaaagattagaacatcttccaggtataaacctctcagtaccatctccctttgacatgtttctctcatagagattacgccgaatatcgaaagaacactttgcaggaaaccatctgacatagatccaactggaaaagatcctaatccggctgtgacggaaccaaatttatccaaagacgctgagccgactgccgaaaatcagccgactgccgaaagccagccgaccggcgcccatgctttgggtgataaggccgatccgagtgaccggccaccaactggagaccagtcggcaacagctgaaactgcaacaacacaagagcccccgactggaaaccagtcggatgtaggtcccgatgaagaaatccctgaagttgaagcgcagacgacaacttcccaaggaccagaggctggtaaagactcaatgattgggtctctaaataaagaacaaggatcacctcatgtccagccaggaacatcctcaggtaacacatcctctcaagtgatgccgatttaaataacttcagcttactcgtctaatgtcttggaaatacatcaggaacactaggcgatgacgaagaagcaattcctcgcataaaggcggctgatgactcccgtcctcctatcttgctcaaatggtgggacgagaactcgcaagttgccggcatcgttataaatcgtcaaaaagaagatgaggaagtgtgccagctgaagaaagcacttggagaagccactcgcattgtgaatgtaaatcttccgggtgactgcctttaataactttgttcttctctttagcagaactgaaccatgatccatcatgcagagaatccatcttcgcaatgaggccaagactacaactttggaaaagctggttcctcacttgggaactcttgaagcagttagggaccagctgcatgaggccaaggagtatgccaaaaagacagagaaggagttaagggaccgaattgcccagctccaggattcgaacttcgagctaagtggttcatcaaaaggtaatcttctagatctgtcccattaatttatgctgtcatagctgtatcctcaaacatttggatttcaaacagcgcaagctaccaggatggctcaaatggagaaacagattgaagccttgaaaagagacaaagtagaactagctgcgcaaagggactcggccttgaaagaggttgaaggtactgccagctgacaatttgaactgtcctctctttaatgcagcagattcttattataaaatgtgttttgtagaccgtaaaatcaaatctcaagctcagtttgatgtcctggttggtaagatcaagaagcttgaaggagcaagagacgaagtcgccaatgtcgctgcaccactcgtccaagctatgttccttaataacagtggtccgagtgcacttgacgcaaccgaaatctttgacaagctgagagttgcaccggatgtatatttcaagaatatcaagaaagctggaagtatgggagctagtatggcattggcgatgaccaaatccttgtacccgaggattgaaattgataccattgatggctttgcagacgggacaagtgaagaagctgctcttgatcttatcagtaatgctcaaagtgcagctgacaagattgcaagcgatgttgtagagcaattccgcaacaacgaccttcagccgagcgataataactctgatggtgaaaggactgattctgactgagtgtaaatgtaacaaatggaggctcaatttgtacaatactggtgtatttatgctgtgcttgatagttctagccaaatctttgatttcttaaaagcttttatcaagctttgttgagcctaaaacccaaagaagctattaaaaactttcagtcctcgcagactaagtagaaaaatcgaacaaggcaatgataaaccaagtaagcaaattgaattgataaaagatcacactccattattatgataatagcccccgactgacgacttcaagaagaaaacttgatgttgacagtcaagatagggaggtacaatgataaacttaagcgtagaaacgacgaagatgttcaatgttccaagagttgtcgacgagagtaccgtcttcgcgcttgagtcgataggaacctggccgggtgacttcagagatgataaatggcccttcccatagaggagataacttgtgccgatctcgtgtagtttgaattttccgcaaaaccaggtcgccgactaaaaaggcacgagatcgaacattgcgattatgataacgccgcaacccttgtaaatatcgagccgaccgaatcaaagctgcttcgcggacttcttccaatcggtgcaagtcatccactcggtcctcttcgtagcgttcttcacggaaatttcgaaagcgcaaagattcaaattcaacttcactcggcaacattgcttctgccccatagacaaggaaaaaaggtgactggcctgtggcccgactgggtgtagttcgcaaagaccaaagtaccgatggcagctgttgcacccatttgccggcatagggttttagccggtcaaagacacgcgctttaatcccttgcagtatcatgccattggctcgctccacctgtccattgctcatggggtgtgccactgaggcgtagcaaatcttaattccaaaatcctcacaaaagtctttaaaaactccgccagtgaattgtgtgccattatcagtgatgatccgattgggtactccaaatctatgcacaatgttgatgaagaagtctcgagcgttatctgctgtgattgtgacaaccggtttagcttcaatccacttggaaaatttatcaatggccacaaagagatgcgtgtaaccgccgactgcctttttaaacgggccaaccatgtcgagcccccaaaccgcaaacggccaagacagcgggattgtttgcaactcttgagctggtagatgaatttgtctggcgaaaaattggcaaccttcgcacgtgcgcacaattttgtcggcgtcggacactgcagtaggccaaaagaaaccctgccggtaagctttgccgacaatggtgcgtgcagcagcatggtttccgcatatcccagaatgtatgtctttcagcaattgtctcccttcctctaaagatacgcagcgttgcagaattcctgaagggcttttcttgtataactcagcttcatgcataacataaagtttgctccgccttgaaatccgctcggcttcatctttgtcttgagggagttcttgagaagtcaaaaatcgtatgaggggctctcgccagtcggcttcaaccatagctacatcatgggtgcgcgcaacttgagtagcatctttgtgaggtactgtcggcgagtagaggtgttcgacgaaaacatcagagggcgccacctcgcgcttggatccaaaattggcaagtctgtcggcggcttcattattgtgtcgaagaacgtgactgagctcgagtccatcgaacttatcttccaatttgcgtacctcttgtcgatatgccatcatgttgtcgtcaaggcaggaccactctttcatgacttggttgacgaccagctgtgaatcgcctcgaactattagacgctttatccctagggaaattgcaatccgcagcccatgaaggagggcctcatactcggcgacgttgtgggacgccgaaaagtgtatccaaagcacatagcttaatctttctccagttggggaaatcaaaaccactcctgctccagtgcccgaaagtcgttttgatccgtcaaaatgcatggtccagtgctccatcttctccgcaggggtatcctcctggcactcggtccactcggcgacaaaatcagctaacgcttgggacttgattgaaattcggggcttgaatgatatgtccaaagacatcaactccaaagcccacttagcaatccgtccgtttgcttcgcggttgtgcaatatatcaccgagcggaaatgatgtgaccaccgttaccgagtgaccttgaaagtagtgagatagcttcctggcagtaattagaataccatataacagcttctgaacctgagggtacctcgttttggagtcggctaggacctcgctgacaaaataaatcggtcgctggactttttggacatggccttcttcctcgcgctcaacgaccaagactgtgctcacaacctgggaggtggctgatacatacagcaacaacggctcctgcgggcgtggtgaggctaagactggtggctcggtgaggagtttcttgaaatcttcgaaggccttctgtgcttcgggtccccactggaagttatctgttttcttcagcagcttaaagaagggcatcccccgctcgccaagtcgtgaaacaaatcggctgagcgccgccatgcatccagtcagcttctgaacatctttctgggtacttggcggtttcatgttgaggatagcagtaactttctccgggttggcttggatgcccctatgagacaccataaagccaagcagcttccctgacggtactccgaaggtgcacttttcagggttcaatttcatcctgaaagcacggatgctcgcaaaggtttcttctagatccgagatcaaatcatccttttgcttggtcttgacgactacatcatccacataggcttcaacgttgcggccgatctgcgttgagaagcatctctggattatacgttgataggttgctcctgcgttttttagtccgaacggcatggtgacgtagcagtatgccccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttagggcaggtgtcgcgaccgggaaaattgccttttcccgaacgctagtgtattaatccccgtcccaggaaaagccggggtacaccatacaaacatgatataaaagacacatctttattatatcggtaatatttacattattacaaaggcacttaaggcctgacaaacaaaaataaacagcagcggactagcggcctacggctccatcttcacaggcgctcaactggggtataagccaggactccaccaaagacatcttctccaaagcttctcttactgaagaggggaaggattgagcaagaatgagtacaaccacagtactcagcaagccacaccggagatgcataattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggttccagctcgtcccaagccaacccaggccaaccattccacattttacttgttgagcaaattt

SEQ ID NO: 45894 - DNA, 11751 bp, Oryza sativa
gagagagagagggagagggaagtgggccgagccggcccaagaagggaggaggagggggaaaagacttcttttaggattttctttttataaaccttttcaactttgtttatttcttttcaattattatttgtgctctgaaaattccactaaaatttgagggctccttttagaccaaggagaatttaacaaaaattctccgggccatatttgaatttttcttgtacgtattttagtgtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtttgacttcttccgttgcgtcttgacgaacttccagcaaaactttaccactcggaactgcttggcttgacctcctgttgcggatggaatcttctcttcacctgacttggaccagggtgcaccttttggctgactcagactaggttgcggtagttcagtgatgcttccgttccagaacttctcatgattcatatcttcggagtcaacctcggacaagttatcaacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaggggagccaacttatcctacttgatatactttgacgtcttcccaaatggctttactgctggatttgttattgtctaattattatcctgccaaatctgaagcttcgttgttagaggtgatcttaatctgacctctgtagactatcttcgaacatatcacttggttcataactgggaatagctcccacgaacaagcaactcggattcactttctttacattcagtttacttcccattattatcttcaggttgtcctcacttagcattcaacgtattcctttacacctttaatcttgatgtgttctttcccattggatcatctcccaagacatggcattacctggtaactggtgcttgcacttttcactccgtgtagcatctgataccgagttgaagatttcactccttgccttcatagaaacatttttacctaggtcctcttgcttacttaatgacaaggtggctgttgtggggcaattacaattaggggtcttccttgagcgatgcagagcatgtttctgtttatcaatcacctttcggcctacttcttttatgctagagaacatctttgccaatctcttttatcaatcatctttcggcttatctctaacaggtggtattctttaatgtggattgcggacgcttctggggatgatgaggtcctttggcttgctgcctttcagtggaaccttgatgtggttcgtcaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgataccagataaactaattaccaaccctcgactattatgttctcaaatattgatgtctcctggatctccttatctgttggcaggtatatccgatcttatcaacgtagaggtatggcaggtacccttatgggtttcatccaacaatccttatcttgatctgtaaaaggcgtatcccaactcctatcctcaactactgtctcgttggctttttaacccaacacagtttaattggttttcttttccatcaacaggttggttattaactcgaggttggaacatagttcctctgaaatgagaccctaggtctcctatgtcagtaaacaattatacacatgatcacatatccgcatcttccaaaagaatcctcttaggacttgtttttattacaaatttctcccatattacatgaatacaaggcactgccttaaacaaaaagggacggtgcttaacatcggtacattgtatcctcaacatgaatcatccataagcatagcaagctcactgtttatagacatgaatatatttctgtattacatgattgctgcaaactttcgattacaccatgataagtagcggactgaaaaccacaaacatggctgctcattttgattctggagagatatagctggcattgttccagtgactgcatcctcgattggttctgtgatgatgtgataggactgcataatgctatcattcacaggagaagcttccttctgattgctggttgaagcggatgacggtcttctgcttggtatcgccctccggaggttgattgcccttggctcggcctgaagtaggtcggggagagacacaacttcttccatctacgacaattctttgctgaggctgtcgatgcagagaatggttgctaagatttattgccaagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggagtaatgcccttcttcactgcagttgtaacaaacaataactttcttacactcgggttcttcatcttgtacttgatttctcagctgctgtattggaacttccaaaggtacaacgcagatactggcctctgtcttgtcagctggtggctggggctgaaattgagcattgacaccttgtggtagtgcactcattggaattggagttgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaatggtgatcttggcggggatgtgtgttgccttgatgcttctctccgttggaactggcgggttggttggccatcttcttcgtcagcagaaaactgaattgacaatcttttggtacatgatcagttccttcacagaagaaacaagtgatcctgctcgttggacacctgtcgggcggatggtcttcctcacaatgaacgcatgtagaggcacacgagctggcaacatgaccgatttctccacaacgagagcatgccttaagttctattttatcttcatcatctgaggagacttgatctgaatcttcactatcagacactctacctccactagctaaaagatgctctgtcaactgttgtgcacctcggaaggaatctcttctctgatgttttgtcattcctggtggaggccattctgtgctggtaatgatcatcttacggacttcatcttcggttcgcattggtgcttttcttttctgctgaggacagttccttgcatagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacttgaggttgcatctgactcgggttcaaaattggcatccgatgctgctgtagtatctctataagcaattggttctggttaatcaggtgttggaccactgccacacaactggtgtctggtgcttcattcactcgggagcttgaggtaccaatgtcctgacttctgaccttattgcctttctcattgtcagccatctgttgcaaaggtttggagaggaagagagggaaaacgaaggggagagacagattagaaactaaggataggaccttaacagatctaagtcttttgctgttatgatgtatgttaggcttattctgcaagttgattaagcaaacaacctagcatggttacatcacaacccaccgatgcaaaccacgcgctacacacacaagcaagaaacacacgactaacgacactaccctagagggtggcttaggttctgcgacgggttctccaagatcttcactcctgcttcttctcagctggcttcactgcttcctccacttcgctagcggatcctgcagccttctggagcttcggcagacaattgacgacatcttcttctttgcaaaactaaccatctagtactagttgaaatttgaagaaggaagaaaagggtaaaccttttgcaaatagcattaggggaagaagaaaagaggaactttcgcaaatagttttatttataaaatatgtccttaggttttatccacttggcttatcctacagtcgagacggctctgataccagcttgtcgcgaccgggaaaattgccttttcccgaacgctagtgtattaatccccgtcccaggaaaagccggggtacaccatacaaacatgatataaaagacacatctttattatatcggtaatatttacattattacaaaggcacttaaggcctgacaaacaaaaataaacagcagcggactagcggcctacggctccatcttcacaggcgctcaactggggtataagccaggactccaccaaagacatcttctccaaagcttctcttactgaagaggggaaggattgagcaagaatgagtacaaccacagtactcagcaagccacaccggagatgcataattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggttccagctcgtcccaagccaacccaggccaaccattccacattttagttgttgagcaaattttaagaattagaacactgacttgggtacattgctcggcttgcccatatccgagggctcggctattcgaatagatttactctgatcagaggtgtacatctttacccacaagacacatctccctcacgtgcaaacacgtgccacataccaccacggtatacggacggaagacgtgacatagttcccaacccatcctagccataaacaagagtaccgacccaatcccacctgcggccgggatacccgggacaggcaggcagaactgagcccctagcagcagggcaccaaccctctgccgtatgacatctcgactaccgggccgcagcccgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccgcaactggcatgcacccaaaccccaccgaaaacaggttttaggggttttgaaagaggaagagaggtgtgtgtccaattccacattaaaccaaccattccatagtgtccaaatgatatgagaattcccaaagtctaaagttataaaaaccacctaatgttgtcctatttaatcagcgaagcatctacctaaattcaaactagtggaaccaggaatagagtgtccactagttggggttttgtttactctagggtgaacaaggaaataataacaataacaataataataaggtcataacaaaggtaaataggtatggctagataaaacagtgataacgcgggaatttaaataaagcgataatgcaataatttaaatcaacataattttacaaactgggattcgatatgttcaaggatgatgcgacttgccttgctcgctttcccaaacgacggcttcgacttccacgaagagcggatcttccgaagctgcagcgtctacacgaccaacggaaaagaaaaggcttttactctaataaactccaaacaacaagcaggaacaaagcacaaaaatgggttctttacatcttaaggaaaaattagagacttgaacggtccaattccgagttcaaatggccaagatatggccatttgaagtttatatgctctttaaatggatatttacgaatttcttcatttaaattttcaattaaaaaaacccatttattgcgtcagccaagggaggggacgcgcggaccgggtccacgggggtgggggcccacgcgtcagccgctcggtccacggtggaccgggcgcacgcggctggcggcggtcggcgccgtgggtcccacgcgtcagccgcacccgcgggcgcgggcggctgacggccgggcccacttggcagccgcgagggcgcgcccgagggcggcctcgccggcacggccgacgggagcggcgcgcccgcgccccgatggtcaccgccggcgaccatcggcgcggcggagcggcgcccgagagagaggagggaagggggaaggcgaacggcggtcctcggctcaccccgggacaacgacgacgacgagaacggcggccggagcggaggaaagcggcggcgcggctcgggatgacgatgacggcggcgctccgacggtcggcgggcgaagcggaggcgcggacggagtcggcaaccactcggcgaagccgaaggaggggtcgccgagtcggaaggaggaccggagcgacggcggcggcggaacggagctcggcggcgacggcggagagagaggagcacggcgcgagcacgattccgacggcgagagcgagcggtgaacggcggaaacggaagagcgaagcacggggatcgaatatatagcaacgggagggggagagcgcggccggggagagaggaaaccgcgcgcggagatctcgggcgccattgaagacgccggcgaacttcgcgggatgaatccggacgaatccgagggagagagagagggaaaagagggggaatcgggagagggaaacgcggggagtaattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcggggagccgatgggccgcgggagaggagagagagagggagagggaagtgggccgagccggcccaagaagggaggaggagggggaaaagacttcttttaggattttctttttataaaccttttcaactttgtttatttcttttcaattattatttgtgctctgaaaattccactaaaatttgagggctccttttagaccaaggagaatttaacaaaaattctccgggccatatttgaatttttcttgtacgtattttagtgtttgccaatttcttttcgaattttaattaattctattattccttttagaagatgatttttattttgggatgaatttatcaggacgtgacagcaggacttgttgaggtcagtgtaatcaacacacatgcgccattgccttgttttcttccggactagaactgggtttgccagccagtcgggatgaaggacttctttgatgaagcctgctgctaacagcttggttaattcctccttgatcgcgtctttcctgtcttgtgcaaatcggcggagtcgttgtttgataggcttggcgtcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactctttgaaatcttggtagcgggcacttctccttcgctcgccgtggctgcagccagtcggatatcctctcgggcggacgccatctcgcgagtttgggccatgtcgcaactctccttgtcgcatgtgacggcttgcttgatgtcgctccgtagggataggactcctcgtggaccaggcatcttcatcatcatgtaagtgtagtgcgggacggccatgaacttggctaacgccgggcgtctgagtatggcatggtatgctgtctcgaaatcggcgacttcaaagctgatgttctctgtgcggaagttttcccgagtgccaaaggtgaccgggagggtgatctggccgagtggagttgcggataatcctggaattactccgtggaaaggcgcattgcttggttttagctcggaccgagggatctgcatgtcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggctgccgaagatatggttgagctccttgcggtgatcttgaaaacctgccggggtgtcgccgtcgtccttcttcctcgacgtgctttgttcttcgtcagagttcttccgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacttccacctcctcccgtagccggcgtatccttttttggcttccaactgggacccgactgctttgatgcggtgacggcgtcttcagctttggcgtactcgttggctttttcaaacataagcttgactgtcctgggaggcttacgcccaaacttgccgactagttcttcgtggcgaatccctttggtgaacgcggcgatgatgacgtcgtcggtgatgtcggagatcttgttacgttgttcagaaaatcgccagatgtaatctcgaagggattctccggacttctgaatgacgttgtagagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattcggggttagtggtgccgtcgtacttctctattccagtcggcttaaagccggctggccaatccactcgacgcaggtcgtcggtgaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggtcgttccactcggcgctccctatggtgatcgggaggtgagtgaacggaccgctcgtcgtgacccctgctcctgcgattggatcctgcgccggtaatgctgaggcttggatgacggtagtcatgagatcggaagtgggggactcggctgccagtcggcgtgtggacgctttcggagttaactgggaccgaagccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgttggccgatgagatcacgcgctcggcgccctgcttccaaagctcgctgacgtcggtcctcagcctccttcgcggtccgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagctgatccgtcgaaaccgtgctgagtggttggaggatgacgccgacttccctgaagctaggcaaaatcggtgttgaagccgacttccgcctaggcctacgggatgaagacgctgtcgtggtggagacggccgctaaatcgtcggggagcttcatcaggactggtgggtaagccccatcatcttgatctggtgtcgttgaagaaaatgcgatctcggccgagtggtttgaagccgactcgattgagatggtcttgaagtaactttcagccgtgtttgggagtccaaacggaactgaaagccggttctctcccgactggtctgattccgagtcgaggagggagatcttgccgaagttgttggtgacgaagtcgaggctgccgaaccgaaacgcctgcccgggtgggaagacgaggtcgtcgatgccggagatgggacccattgcactgatcggcgaaaagcttgacgcttcccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttggagaaaatcaacatccgccgctagaggcacccggaccccccttatatatgggaaggagtccgtgttacaaaagataatctatatccctaacggaatatgcagatacagataaaatacagtcgtaaccgactaagtctcaaggtgtttccttgatatacaagttaagaaacaaacccgagatacaaataagatattctatgtatatttggtatcctatattcagcccaaatatcatcgccgtgtagatatgggatatccatgatctccacaggtggtgtcgcgcacacacctcagcagcaagcaaacaaggaggaacaagctgatggcatctatcgtggatgcctctccaagctcatcttcgtccatgtctcgccaacctgaggagtaaccactgaccaaaacggtgttctacgctgcgcacgccgtcaacatacgggatcatgcgccgtcaagatgaagagagcactggccgggagatcatcggagtagtcgcggacgccgtcgagccacccgtgtccacagctaggctgctgcctcgccgaagatgctatttcgggcac

SEQ ID NO: 45895 - DNA, 6074 bp, Oryza sativa
  unsure (1)..(6074): unsure at all n locations
cgttcgtgctgaatctactctaacaaatgctcttgccattccgccgacgaggcatttacttcttgcaaggtcgtcgttgttatcggcaccctcatagagccccttttacgggctcgtcatcatattaaccggatcaatagtagatccattgtccgaaggaggtgccaaagccacgttcgtccggctgctgtctgcactgacttcttcatcaacatcttcattacaagtccctgttgtataaggggcatgacgggtcatgaggtgcccagccatgtttaatccggcagccgtctacaccaactgtcttcgtcaactcttcgttactttgatctcacctagccaggaggtgcccagccaagtatattcggctgtcgtgtacaccaactgacttcaccaactcctcttccctttaacaccattccgacgctgctgctgtgatgtctctaccgtccaagctacacgagttccatgcatgtcgaagatcaacctatcaacaccagcacgtcgcttaagactgatgaggcggaacgacgagggcgggcggagtctatatgaaggctacgccactaacaccagcgcacggaccgacgaggctgtggatgcattgccggcgcccacatatatatccaccatcttcaccaacattcatcatgcatggagaacgggaagcgaagacgacgagacgaccacaagtagcttaatcggaggtgctctgtaggcttagacatgtggagctaattaaccaggagcttctcaaggccctaggaatcagaaggccacatcgttaatgtcaagatctgtccaacgacaggcaatggcgcgcgtattttatattatacatggaaactgtatcttgttaattcaattaataaagattgcgtgtttctgtgtcccttttgtgtttgttttacattgtgtattttgatacactggcacgcccgtacttattttctttttaaacatagagggatacattcgtatttttctatcctaaacacagtgccgctccaaggtttgtccggctccatctattcgtaccacagccaccttagcctgagtgctcgagcgaaccggtccaagtcgagcacaccgaggccacccagatgtttcggcctgcaaattctgtcccaattcactttgcattcacccccctccccctacccgagatgtcctctcctcttgcccagaggaatttccgtctcatcttgtcaattgaatggagcatgctgtccggaactttaatggctattaggtgataaatggtttgtgccgtgaggacggatttggtcagtgattttctaccggtggtcgtcatcatcttgccttgcctgggcgccagcctggtcttatatttatccagcagcggctgaatgtggacctttttttttttttagcttggagaccgttagatggaggccgacatactttatccgaaagccggttacgttagcggggaagacttatagtatctcttggaggtctatgccagtgcaatgaaaggacgcaatttgacttttcgatatgtttatccgaaatctggttacttctccgaaggaatgaagaatttgggtaagatgtcgcatatcattgactgttggtcggacgaacatggcaacatcattcgcataaagggatgtacgaaggtgtgctgttctcccattgagttgtgcgagcatgccgaagtcggttgccttcagtagcactgcctttaaggggtcgatggctaggatgaagaggagaggggagagcgggtcccctgcccgcatccaaattttgaacccttgattaggatgatcattttggagcacgattttagattaagatctaattgctgatggtgctttaagtccgagggatctgcaccaccaatagttaaccatatgtgcccctgaagacacggaaccaaccagcaaagtctcgatagctgctcgcagcatcaatctggaggaatagatcatgaccaattcctgacagcctgtttccaaaatcagtcagttgacctctcgaccattagaaattaaaatacaacttaagaattgatggtgtaaggaatatgcattatttaccatggactcacgacaatttgagctacggctgatcagctgcgggggaaaaaaacaaagcaaccttttatttatctgtgctgttagcagtttagaagccaatcagaaaaaggactacaatttaaaaatttccaaaactaactctaaaattaaatatgaaaattcaaatctggaatgtggctcataaggtagcagaaggtcagtggcaaaagtttcaaatttttttactaaagtcaccgtcctgcagcacatcatgacatcccacctcaaaatttttacaccctatcacatcggacgtttgaacacctgtataaaaaatattaaataaaggctaaaaaaataactaattgcacagattgcgactaatttgcgagacgaatcttttaagcctaattgctccatgatttgacaaaatggtgctacatcattcaatgattgcagtttactggcggattctgtaattagtttttttattagtacccaaacacctcatacgacaccctatataatatcggatgtgatacgcgaaaactttacaccccttgatctaagcaccccttaatacatggtatttggtaagtattcccaccaactaagcacggctgatcctctttaaaaaaaagaaaagaaaagaagagcacgctgatcctacaagagtggaaataaatgggacgaggtgaagaattgcatagtttcaaaaatatctgtaaagttgtttcgatattaaaagagtagttgcagcaaatcctttctttctatatagtcacccaaagcttaactatggttaagccacgtcaccacttaatcctcagccgttcgatctaatatgaatggttgcacacgcgtgaagcccagcccacgtctctttccggagtttgttggtttctccagttgtcgtaggctctccggacctctcattatatttgaaagatgaagtgaataattcaagtcatcaaacaaaaataatgaaatatccgacgcctagagagaaaaatattggagacattgttaggcctttagcttctcagtcaacttcagcctgagatgtgcccgtcaaaccactcaaaggcagcgaccagatgtgctacacattcaggagacttgacagaatggctaaagatctacaacatctcaaatattcttaactcatactcatgtgaatctagttcccaggatgtgcgaactagattcatactttcatcttaaacatggaattacatagcaaaatacatttaagacgaaagtgatctaagatttacaactatttatagttataaggtccgaccggccaaatatagatatatcagagaacagcggaagcttgactacccaaatacaagcacaccgactaggggtttacccaagtaagttcaagtcctagaagaagcagtcgaaacccgcatcactcctgcacaaatggatatttcaacatatcaagcatcagtacattaatcaaattaatgtattgccaagcacaagataatcctacatactacatgtaaggcatatattcaaagaaaggcaatatgtagttcaatttcaacataaagcaagttttgtttcacaattcttctgtaaagggagttggtgattcagttaacaaatcatttttgcatgtccatcataaatatcattatatcatcataagcatactcttgttgtcttccttggcaacaagtcatataatcatcatcacactcacacaactcaacataattaacccatttcaatctcaagttaaacacacacatttaaaaacataagtctatactcatgacacttcactatgccgctcatgaccgtgagcacgactaatcgattagttttagactctgtagagtttgtacagctttatccacatgatatgaattcctctagtttatccggtacccgtcagtaccaccacactctacatgttaaatgcggtctagaggtcataacgaggccgtattgcctaccgtctaaccttgcttgagcacgatgcgtgttattccacactaagcctagaagcttagtgtcgtcaggacggctggcctaccgaccctgatgccgtggcatagcattccctacccacgaggcactacactgttgtattggacacgcgcagacgcccatgccacaaagcgaacatcagttcctttgctagaaggtggaggaaggaagaaaaaggaggaaggagaagggcttcccctcgaccacccangggtcggcgcccacgtccacccaccgcccatcgaccagggcaacaacggcagcaaccatacctcgcttccccttgaccacgccggggtagacgtccacatgccggtactcgcccaactcaccaccaccgggtttcacccccgcatctcgtccacgcatgggtcgtcatccaccaaggcgaaggtgacgccggccgacattgatgtcgacgacgacgacaaggccgacattgcagatacggcccgcatcaacaaggttagtcatatcaagctctcatcgccctagataatgttcattcatgtatttatttttatggtttggagtatgtcaacaagtaattcttgtttcaatgggtgatgttgctcatcaatctacacaagtacatccaatttcatggatgagtgaatagccatgatcagtgtcgaaaagattatattcatggatgattgatgatcaatgcatacaagttaattgtcatgaatttaatgtgctatggaatgcatttatatcttttttattgtgaccctgctttgctgttaaatgaaggataatgaatacctttatgagttcatctatccacatatgaaaatatgtttaaaagactttgatgacgacgacaagggtctcgaaggggaggttccatcttacaaggaggtgatgatccttctcttaggtattatatatatatatgtatatatatatatatatatatgtatatgtatatatgtatatgtatatatatatatatatatataggtttacaaacgttacaaacttggtaacaccttacaataaaatcttacaacattaccataataaaataaatattacacatacttattgacaaacatattaaaaacttattgaaatataacgtcatgcagcaaacatatcatgaccgaacataaataaccggacagtgtaggttataactactgcaggtttccttcctccctatcgtgagcaccctaagagccccttctattcctcctcgcacgttgtttcctaggttccatgcttgaagatgtaccctccttgttattcttgcaatctctagtgcggtgcccgtactgaagacagtcctcacatcgcctcacaggccctcccgttttgaatgcatccatatcacttcttaagcgtcgtgtttgtcttctacccttaccagccttcaacaaatccaagtctagcacatagatccttttatcacccccagtttcgactaggtgttggagggacctccacccgaggatctcagcactccatgcattcagaactctatcctttagggagaacgtctacacgtatgatgttgaatcaagcttaattttagcacacgcggccaggacatggctacatggcttatgaagaagcttcggcttattgcaagagcacgaacatgtgttatcagattcgtgccctagagtaacttcatgagtgatgaccccagtagaagatccaaaaccccccttagtgcgacatgtgacttcccaccttagtctggcgttcccagtggtaatgaccgtgtgaaatcttgccttgttagccttctcttggaggtactctgccatcctatgggttgttgttggtctgctcatcgaactttgtagactgatttgccttgcacaaccgcttgaatatgttcatcagccgccgactgttgaattgtttgaaaaaattggctcccatgtgctgcatgcaccaacggctatgcatgtaggccagtagtatgcgacatcaccatcctcctggagttctttgattgctttcaacagaccggcattccggtcatggatgatgcatatcgatgtg

SEQ ID NO: 45896 - DNA, 3191 bp, Oryza sativa
  unsure (1)..(3191): unsure at all n locations
cgaacttatttgtgcataaaatcctcgtccaggaatcagccgaggtacacaaattgacaatttaatatacagattcatcaaattaactaaaacgataaatcttacttaagaggcactcagtcctcaccaagaagaaaattacagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcgaaagcagcatttagcaaagagttaagagtagtaaaacagtagagtaattaatcagaaattttaatcaacactgaacagcacacccatgctgtacaggcccaaccatcctgaacaaccatacccggctgtacagatctaactccaaaccaggagctaagcaaattgttaccagttataacatccataattattgtgagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgtaatgaatcatgttatacaaaaggtaaagccgttgcccacgctggcttgtggttggcacggttaatgtttcacaatagtagcttgcgaaccggtccttaattgtcatgagcacgactctcaaaaccatgtgctcacaacccaccattatcaagttttagttggcaagtaattaattaaccaatcacgattaaccatcgtgaactatcattaaaccatcattaaataacagtgaataataagttatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacactttcgacgcactcacgaaccttcgcaacgacggaaacgacaagctaacacgcaaaacgaggaaaaagactaataaaaaccaaataaacaatacaaatatgtagatcataattttagatgaattatgagacttgaacggcctcattctgacttcatatgaattaattatgaattttacaagattaaattccaattaaacctattaaagaaaagactattccaaattaattaaacaatttacaaatgatttataactgagagaaaagattaaagcaacctccggaaaagattagattatattggtagatgacatatgataaaaagaaaaaggactaatatgccattgaaaagatagaacgaatttatattgattttggacggctgagattaatcttgaccgagagttgaccaagatcggatggcttagattgatctggcaagcgggcctcacgagataccgactcaacgagtcaattctacgtgacacgggatcacccaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaaaccggtggactagaaacgattcacggtaaagccccggtacgacaaacgatagaccggtaggaatttagggatgcacctacggctagacaacttgactaccgagcaacggctaaagcgacggctaggttaaagcggcacacagctgcgacacggcggcactagggcgacttggcttggctaggcggcagctcagcggaaacacaaagctagggttagggtgacggcacagccgatagcgatgcacgacagcggcgcggcgactgcagaacgtgcactagggcaacggctacgcggcggctagcagcggacaacagcgggtacggtgcacggcaatgaccggctcgacgctaggaccaaacaagattagattgaattaagaccctagggataaagtacaccggtgaacgacaaaggagcggcggttgccgacgaaataatgcaatcggagggcaccgggagaaagaggaggcaacggcgattcttaccaacacttacgcgacgacggacagcgacggaagatggccggcgacgcgcttcaaagggcggcgaggtactgtccacggcggcgacgactttccggcgatgtgcggcgacaacagaggggtggccgggcttcacttcgcagctgcgaatccaatggagtcgatggcgacagagggcgatgacgggaggagcagcagggcttcgccgaagatcaaaacgcgacggcgaacttcgggttgacggcgacgatggagctccggtggattttggcttcggggagatggctgccgggcttctcctcactgctgcgatgccgacagtggatacggcgtggtccggcgaccacggagtcgacggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45897 - DNA, 5907 bp, Oryza sativa
ctctccgcctctggaacaccgccgcctcgtgcaccacctctctcccccgccgccgccgtcttcagccggccgctgctgccgcgttagtcgtcgccgcacctcgtcgtttgcgtcgtcggcaacgctgtgccaagctctacctcggcctctgctctgtttccccatttcatcgccgcaaccacctttccgccgtcgacccgagctccgctaccgccgttgtcgtctcaaaccaccgctcctcaccgctccggtcgcctatttctctccctaaccgctccaatattttccctaggtcttgccggccctcggccgcggctccaccgtggtcgggcgtcgtcggaacgccgttcccgtcgcctcccgtgccggtcgccgccatcttttccgccgccggccacctccccgtggtcgtctcgccgtcgccgtcctcggtgagaatccccaccgccccctctcctttttccccatccgccgctccccatgcccgccaccgcgacgcgctgccgtcgccggtggtcgtctggccgcgtgcgcgtagccgccgtgccatggccggccgggtcggtctcggccgcgcccgtgccccagccgcgccgcctcgtggccgtccgatcggctttgggccgatccgggccgtcggttcccgtggaccgacggtggaccgcctcggtggtctcggtccacggtggaccggcgcccttgagccgctgccggtggggcccgcctgccagccgccccctctccctttcttagtgccgctgacgtgtggggcccgcgtgtcggcgccggccgcccctttgctgacgtcagcgaggtcctttttcctttgtaaaaataattaataattgcacaataaatcgagtttagttctagaaattcatttaaatggctcaaaacttctaaaattcatatctaattcattcgaactccgaattgagccattcaacttgcaaaattcatctaaaattgagctctacatgtttgtttactttttatgtactgtttcctgggtttttatgagagtttttcctcgttttgcgtgccagcgtgtagtttccgtcgtttcggaagttcgcggtcgcgaggaaaagagttcagaagatcaaagtgaagaagcaaggcaagtcacacattccccttgagcatgttgatcccaatttataaatgttttaccgtttacaaataaatatgcatgttttgctaattacacggggtcagggtttacctatctgctcgcttgtgccatgtttacttgatatctgtcctttgtcaaccttgggtgataaatcgactagcttgtgttacttatgtgacctagctagaactttatgcttagccatgcttaattaccactagctcagtcgatgggataattgcagtattagacattctagtatcttgttgagccgcgtgctcgagacatctggccatgtttcatggtcgtaattatccaactaaaatgcgactgaatggtgggcagtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagatttaatattactttaattactcaacagttttactgttttgcccaataaaatgttttacaaccgcctttatgcaaatagccacagaccatccttgtatccccttgcacgtccgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacatgctagcctcacggtatgttgtgtttggcagatccgagttggatccaagaagccgataggttcttttgtcttcttagcatccatgtattgcatcctacagaagaagtttgttagtaacaatcacatggatttgtattgtacatatttttcatataattaattaaaactcatactcacatgcaccaaacaccgacgtagttgacgtccatcttatcccaacgatatatggcgtggagatatgagaaatctagccatacgtaaccttctttgccgaaacaatctgccggtgatcgagctgttatattgcccaagcctttcttgctggcctgcatgtagaaggtatgtaaccttttcatctcccatggtacttcgttcagtgcccattccggcaagagtgctttcccatgttcgtactcagccgggcaatcatcggttgtgaagtatgttggcccggctagttcagcggccttctgggggtcatcatctctaggcttgccacgttccttaccccctctgaagacggttaccatgaacttctccttgttctcatctttggacttggagtcgtggctcctaagcattctaggcacctcagaactggtagtggccttcttagggatagtggtctcttgcacctcggggtctttcgcaggagaagggtcatcaaatatttctggctttgtaccgtcccattccaatcctggtacttcttctatttcggatccgactgatgccacaaattgcacctctggttctgccactgtaatctccatgggcacttccggcactggaatctccatggctgcctccggcactgcaatctccggtggcacttccggcactggattatccttttgcatctcgggttcctccgccttatcagtcaccttcctcttaggaggtctcggaggttttcccaaccccggttttggcaccacaggtttttccgtggcgtcggtgcccaatccaaaggatatgtcattcttgtgccagagaattacaagatcgaccgcatccccaagtacggatacaccatctgcagtcgggaaatcaatgtcgtaggagtcaaacccttcatggaccacttgcggctacaccttggcatacgcatcgggtatgaactcttcgttgtatgttctcccagggatagcaatggctgtagcagcctcaagagttttcccggagcgtccaatgggaacatgcaatctgcagggcgtattctccttgaggtcatcgaaggggtaatctggctcaggttctttggtttcggggcgaggcaaaatcatgtgcttgacgcagaaatccatcatttgcctttcaaactccgcagccccttcgtctctaagtttatccttgtacgcttcacgcttcttgtgggggtcatgtttgaacccttccttccaactcatcttgctcgacacacctcgaacccttcccccatgctcaggagtacccagcgccgtacttagcacatctttctccctcttaggcttgaaaaatcctttcttctgtgaactggataaattctctattttatcagcaatgctctgcaactccggatcttcaaacgatacttttccttcatccgtgatcttaggagttctagctcttacccagttccttgatctttgtgtccattcctccattggtaccagttgccccttcttcctcatttcctcctcctcttttgtttactgctccacctttggtgcgtatcccgtggagcctaagcgatgaggaaatttgttctttttggccaaatctgcatacttttggctcctttgaatttcttccggggagttcttcaacgtcagaaagtcgtccaactgattcgaggttatgttggcatacgtcgaaaacggtgtgcgtcctgtcttgacaaatttcgtgttcaaggtggttttccaaccacgccaagacttggccattgtttgcagtgcacaattcctcactgctacctctgatccatccgtgaactggaagattttcttcaactctttccataggacttccttatccccattcgatacatgatcccagtccttcaccgtgatggggatcttttcccttactattatgccacactgtgaactgaatttcgcacgtgccgtcttaggggcgagcggctctccttttggcgaaacatgggtaacaacatggaaaccttcatcctttctattcacgcttctctcgcccttccttttcttcgccttagctgaccgttcgcttttctttgagccggttgtgttagctgttacctcgtcaatttgcgacggaacttttttcttcggctgccattttgatcgccgtggcgccgtttcctacgagaaggtatacatgacagtttcgaattagctcgggctaataattatcacggtgaatagtttacatattacgtttacttaccccttctttagggggaatgtagtctttgtcgccttcttcactgtcgccttttttccttctcttcgggcttgggcttggacaaggatcacttggcaacgagtactcatcgtcttcgtgagctatgtcgctgccggaactatcttctggtgggaccgttggttccgaagcaaccacaacagcaagggactgctcttgctcccctaaacccttctcttcagtccctttagtactatcggccatagtttcaaacctctaacataaaagaaaaagttatcctccacattttaaattactcaaattagtacaaacaactttaaattgcgaaattaattaccacttactattatgctagaatagatatgttattaattagtacttatgctattaattagtacttactattatgctaaattaattagtacaaacaaatttaaattgcgacatgtaattaattatacttactattatgctaaattaattagtacaaacaaatttaaattgcgaaatgctattaattagtacttactattatgctaaattaattagtacaaacaaatttaaattgcgaaatgttatatattagtacttactattatgctaaattaataatgctaaattactatcatccacaatttttttaaaaaaatgttaacataccctcctacatgttatttaaaaaatttgacaaattcacatatcatgcaaaattaaacataccctcccaatttcattcacatatcacccacattcccaaattcacattcaaaatcacatataacccctcattcacatatcacccacccctcatttccattcacacccacacgcacacacatatataccccctcacacccacatgcacacacatataaaaaggaacacccacatgcacacacgtccgtggacgacgaacgaccgacgacgagcttcggtcgtggacgacgaaggaagggccgacgacgaggttcggccgtggacgacgaaccggccgac

SEQ ID NO: 45898 - DNA, 2495 bp, Oryza sativa
gcctgcgaagatgtaaaccctactcggcataataatcttcgcaggcagaccggccgcctgcgaagatatttgcaggactgactctttctatttcagaattattttaaaatcatttttgtgatttgaaaatgtctacagtggttgtaataacaatggtaattgtacgtacaaatagataaaccttagtattactacttttcaaatttaaatattacttaaatgtttcaaacattaatattacttatatgtgcacttaccatttttttaagactttttaaaataagttttcaaacaatcgtaagtgaacataacaaaatgctactaaatttttaaacctcttttagaaaaaacttttaaaaaataaaaaactgtaaatgtcaccctacaagtggtaattgcacataaaattagtacaaactcatatgaaaaatgttgcgtgcaattgttcgtcaatttgtgatatgatcacacatcaccttacataccaccattacataactactaacttcttagatgcttacatgcactcaacaatcattaccctttaacattttttcccacaccgtccgtgcgcatgtaaggcttcacgatcttctgagtagatgtctcgacattcttaatcttctgtacaaactgattataaagtggcatactatcgtattgattgtaatcttcgacatcttcaaccccatccactcccaatatcttttgtttcccgggtagcactatatctttcttcaaatttgatgggtcttttacgtaaaacacttgtgccacgcgattggcgagtacccaagggtcatccttgtaacccacactcaccaggtcaaacgaaagtaagaccgaacttatcaacattgaccccgttcaggtattttacccactggcacttaaatatggggaattgcattgtgtgcccatagtcgatttcccatatttcttcaataaacccgaagtatgattgtttttccccggcttcataaattgcctccacacggacaccactgttttgcgtacaggtcttattatctcgggctcttgtactaaacaagtatccattaatgtcatatccctgccaagaatttactgtagttgatggaccacaagccaaccgcttcatagttatttcatcggtagtttgttcctcaggtaagtctaggtctcgcaaccaatctacgaagagacgcttgtgttctttcattatccactcggtggtgcgacccttattgttagctcgtattagttcgatatgttgatcgatgtacggctcaacgatagcaaactgatgaagcacgctgaagtgagcttcttggaatgatttgtgatcatgggtgacgaatctcttctttcctatcgttcccctgccactcaatctgccctcgtgtcagggcacaggtactccaattgcatatccatctttgaggtaatcgatacaacactcgacaatctcttcagtactataaccctcaaccatcgatccctctggatgtgcacgatttcggacataacccttcaaaactgccatgtaacgctcgtatgaccacatttgatggaggtacaatgggccaagcgcaaccatctacggcactatgtgaacaatgaggtgctccatcatatcaaaaaatgacggaggtaaacacatctcaagttggcactgtgtctcatgtgcgaatgtacggagatttcctaactcttcgagactaatgaccttctgtgacactgtgttgaaaaaatagcacaaccttgtgatagcaacctttaaatgctccggttttatggcccttattgcaattgcaagaaacactgtaagcaagacatgacagtcgtgtgaattataaccagataccgacaaatctttcattgaaactagtcgactgatgtttgatgagaaacctatgggcactctgacatcacggagtgagttgcaaaatgacttcttctcctcaagtgtcagtgtgaaataggctgatggaagatatactttgccatttttttctccttcttgagggtgtaactcttccctgattctcatctcgactaggtctatccttgattgcagaccatctttagtcttgttcggcatgtccaacaatgttccaactatgttgtcaaacacattcttctctagatgcatgacgtctatggcatgccgaacctccagatgtttccagtatgggaggtacttaaaaaatatggaatgcttcttgactgggggagggagtttatcatctggcttcgaactatcatcttccttcttactatccccttgtttcgtattcttctcgggtttcttgcgctttgtcccctttgatggtttcttagtcacttttccaaactcgcaaacaattttctctatcattgcacacaccttttctcccgaggttggtttgggtgcaggatctgtctcttcagtgccatcgaactccgccttcatcttgcggtacttgtgatttgtgcgtaggaaccgccggtgccgcatgtacacaagggtgcag

SEQ ID NO: 45899 - DNA, 12832 bp, Oryza sativa
aatttgacgttaagattttaaccctaggtgtaatacaattgaaagtatgtgtatgattttttctagatttttttgtgacattttttagttggtgtgcacgtgtgtgcacgtgagggcctgtgtgcataggatatgttgcctagttaaattgtatgcatctcacctatattgtctctcatttttcccttttataagacaacttcctgttttgatcgttcttattaatctgaacgaaaacagttcattacaaaaacgatgacaagcttttaaatatatgctacatacaaactcataatcacacctatccatttgtatgcatctcacatatattctctcctttttcccttttataagacaatgacaatattgttgttacatgttgatctagaaaactcaatctgttgtttattttacttcctgtcagattgtgttttcacgatcgatgaaattttcatggtttgattccctttatgatcatgcttacctatgtactactaatctcaaggtgagcacaaaaaacccgttttgttgtgtccaccatataccagtttgtatgcagattccagactttcagtctagaatttgtatatccttttgaacaggtaagcataatccatgatttgatgattatttcaaatttattactgattttttatttacctagctctagcttacgttttttttaatggtttacagctaacaatctaactgtctttgtaactctatatattgctgaacatttagtgtaacccagctttcccatatgcatcgatttggaaaaaaaaagttgctcacttaggatcttcaaaaatttatatgttacatattattttcaactaacaattatttgtagataaccttggcttattgattgcttttacaacattttacctcctgggaatgtaaaattagaaatggcatgcttctttgttaccttctcctatgatcatgttcagctgatttgctgccctcctcccttttccccttctactttgaatagctgaaactcaagctctcttcgactaacaatgaagacagataattgacctatgcttaagataatcatatactatcatcaccatgctgttgtatttggctaaaataccaggaacaagctccatagcttattgaattatattgtgataactacattagtctgtaagtcaagacataattccaagatatgatgcatctagccaaaaattatttgaatatagttgcagcctcttattcttatgcacgcgcgcagcgtagcgcgcgattattgctagttactctgaaacgcaaatgggaagtgaatgtgttggtgggggtcagcatgagaagataacactgtttaatttattgtatatttttgttgcttaattgaatgagtgcttggagcactcactaaaaccagcagcaacatgcatgctgatttggtagcaataattatgatagcggttttcaactgaattcctggattccagcagtttgtcatttgacagtgctagtaaaattttcagtggcatgtcgtatgttttccttcactccatttattccagggatctctatctggacatttgtacgtgcaaataaagaggcaaaacaggtctactgcaattgacgagcgtatgtgctgcatggaaatttagaaacaaatatgtgcagcaattgctttgataactacaatctgatcttggtcccgcagtttccacagaaaaaatgggataacttaaatccttatctgcttttatatggaagttgattccttctcttaattatttacctctcttattattgttatgaaaccggcggcacatgagaagatctaacccggttacccactaattagcccattgctaaatatggattctatctattgttatgcctaaaagtagaggggaggttgaattagtgaatgagaaagaagtgacaccctcatatcttgtatctctttttagatattatacaacccctctgaactacacgtgtacattggttgcataataattatctcaatgatatatatgtgcatcacgcgtgaatatgtcatatgctttgataaagtaagaaataatgctcctttcatccaaaagcatatttcttttgtcactaaaactacagaggaattaacaaatcgaccatgtaacaaaactaagaaatcatatttatacatgcaatcactgagtaataagatatctctctttgagttaaaaaaattaatttagcacggcttatactttttgaaaatcagaaaatgaaatatgtcttaggctgttggatggagggagtatatttataaagctgtagtaattaagaattttacaggaaatcaactgacatgaaaacaacgtacattaaaaaaaaggtgtcttgctcactcctcactctaggcatgttgttacttgtttctatgtgctttagttagttcatatcagttattagttctgaatgatatgctacttcaaaaagaagaacaattaacgacctccaaccatccatccatccatgcatcagtgcatgcatgttggtctttagtggtcaacaacaaccttctagcttgctgattttattatatgataaactgttgctctgggtgctgcatgcttaaccataacataaacaaattcagtgccactttgcacatactgccagacctttttttagaacaattaatgaaagaggttagtgcaagaaggaaagcaaggtagctagtagttaattccagttgaataaagaggtgtcatctattaattggttcatgcatgctgccgtgagaagggaggacaggaaattcggtttgtaaaagttagtctagcaagtagcaattgcccacaaatataagtacaataatatggcttccttcgtggcagtagctgtgagagtatatactgattggctcaacatgtgtaccatgctttaatttgctatagtcatatcccaccgagagtgtgtgcctcacgatcaaattgtgtacgtacgttgtatatataacttttcatatttatgtacatctggtttgggaatatgccagtcatgtgtaacagtttcttccatcggatctaatgacactttggagccagtcttcactcgtgcttattcatatatttatattttttttattcaactgaagtggccgtccacttggaacttgcacttagagcaagtttaataatatagccaactactagctagctccaaaaattaacacatcattcatttatagctaacttagtatatagcctactaatacaatagttaattatagatacatactacaccaataatgctttccccatatttctctctcacataggttatcagagtttgtgctatagttgattataaatctgtagcccacttttactctctccttcacacactactggagaactaatctttaattagctcggatgccaaaaacatatttgtcccggttcgaataggaaccgagactaaagattatatttagccacggttcgatagctgtcaggccatgtcagacccccaacaatcattagtcacggttggcaaggtgttaccaactgagactaaaaattgatctttagttccggttagagacaccaacccagattaaagataattttagtcctggttggtgttaccaacctggactaaagatgcctccacggttaaaaaagcatctctatccaagttagatgtgtgtagtagtgggggtggtaacgcgcgtgagggtgttcacggctattaaatgccaattctatgccgccaatacctgcataaaacatagttaattaaacatccaacataatgataggatttaattctaacatattcaacgaatgttggtgcatatttggatgcaggtactaaaccgtcaaagttgggaggaaatttagactaaagtgaagaagaacattagaaaatgggcccaattaccgagaaatggataaggcagagcgaggaggaggcccagaccaaatctaggagccatctggcccagcccaggttcggtcaaacccttggttcggccgaaccttggtgatcgccattggatccaggttttggtatggacgctccagatgctctcctgatggcggttgcgaggcaattcgaacaattcccatagttataaccgccattacctgcctataaatagagctcccattctcacttcactcacacactccaagcttgagctgaattataagagactctattgtactttattgtatactagaattagggagagagtagagtagaaaaagtcggaggaattccaaagttgtcagtaatcctctcttatttcgaaactcgagttaaattttaactcatggtgatgtggacgaatctcggacgtccatttctcgatccaactgtagtttccaagtttcgactacatatgtagtttgcactgtatattttccctaattactctgctttaatagaattatcattctgagaaattaagatttgctcggtgagaattaactcttggttagttcctaattagcatgcggtatcattgatcactatagttcaataaaatatagtggctgctttagtgtttagctagctctaaaatagttattaattgcgttgacgtggtgtccaggtaattaattgtcggtggttgtttcgtatcccacggtaggtttgaggtgggtgtagaggtagtgatagccctcaattacactgaagttctccctgtccgggtatgcagtagagcgatatttgagagcagcgggctggccaatacctgaagtatcgcgttaggattaaactgagttttacgtatatgttgtttttcgctaggaaatcctctctaccattttcctacatgtgcttctcccttggatgaacctaaagagtatctgaatacacacgttgcctgaggaaattgataccttggaatactcccgggtgaagtgctacatcggtatcttccgtgcgcttgcagattttatctgtgacattaagaaataccaacagagggctgaggtttgagatctcgagttcaaatcccacatcccagacattttttttgacttggtatgcatctttactcccggttatttcaaccgggactaaagatgggcatctttaatcctggattgtgtgtcccgtttgcacaaccaggagtaaaaacgattgcaaagcgggactgaagtccctttcttcagcagtgacatgagcaaaaatacgatgtgacaacatgtatagcccacttatatcatcctattatacgcgctcttaatttactagtaataaagaatcaatatgttgtatgcatctaacatttcgtttaatcccctttcatgccctagttccagatttgaggaatcaacactatgacaaaaacctccatttgtagaggcattttgtatattgcatctaaaatctggagttttaaagtgtggagacacattttataattatttaaaaatttacaagaaaacttttactctaaagacactcaacatttttagtatatttagttaaattttatcttgtagagatattattttggcacaataaaatatgtatggcatgtaaaggtattttcttaagccattttaatctacacttgttagaataacaatgtatgccaagagactagatataataaattaaacaagtcacaaacgtacaactaataatatgaggttgagttagtgcattgaagacgatacggtttgccaaaggatttctgagctcaaggattgttaatagcaagaaaattatttcattcttttttatacattggttagatattggtttcacagctaaaacgaattgtcatatatataagaaaacaaaatagaaattagagggcatgcatgtagggggatgataaaaaactactcaaggatatagtggggatcgagtgagaactgagaactcaagagtgtagatataattttttttgttactaatgtacttactctgtctcaaagtatatgcatttttagcatagtgtcaagttaaatatttttaactttgactattaatagaaaaaataaaaaaaagattaatcatgtaaaattaatattattatatttatcattaaaaaaactaacataatatgcaactctttttatttaaaatatcttacttttataaatattattgatcaaagtagcatctcgaagactatgtcgaagaaaaaaatgcttatattttaggacagagggagtaggttttattgatgggattgaagatataattaagcaagtgatcgaatatttggacgataaaaaattattccataaagaatttatggaagatatattgacgtgacggcaaagtgttgaagcagcatttgtgggagttgtctattttgccccatgcatatgctaatccaatccagtggctagctgttatagttgttgtgagccaggccagacatcaacttcaggtgttatggtcaaacatgcacgtctatctccatggagccaaaccttccaactgccattgatgttgaccatacatccaagagaagccatggactttgtactagtagtaatcaacaataatgttaattaggtcactatcaaaacctaactccggctgggccggcatgcgaacacgaggtcgatcacacggatgcctgcatcactaagattctcacaggaaattaaggccaagttaagcaaataaaagccgttattggccgcatgcatgcagatgtcaccgttgcctttgattgctcgtatctccttttgacgctgcaaccgacactgacagacacgtctcgtttttgtactctctcttcttcattagcgacatataactaacctttccccccgtaagtacaactccctccgtcccaaaataagtatagttttgcattatttatgttcaattttaaccgttcgtcttatttgaaatttttttatgattagtatttttattgttattagatgataaaacataaatagtactttatgtgtgactaattttttttaaattttttataaatttttcaaataagatgaacggtcaaacgtcggacacggttcctcacgactgcacttattttgggacggaggtagtataacactcagtttggatttataattattggtttaccataatctatctcgttactaattaatgtagtaccatacccttggtgttaccgcttttagacatttcagctagcttttggtaaactgcaaggtttatatatgacaaaataataatattattattatatattattttaaaaatattggacaattcaaagggatctttatagttgtacaccaatttcgatcacttaacttgatctgttaaaaatttatagggaatttaagctattcattttcatatcaatatcaaatagatagcgtgccataggttgtgttcagcacacagggttgggaacctttccttcccctgccacgtacaatggtattattgtgaataagcacatgattaattaagcattagctaaaaaatgaaaaatagattaatatgatttttcaaaaccgataactttcctatattttttttcttttgcaaaaaacaccctaagatcgaggacaatcagttggtcctaacaaaaacacataacaaactattgatttaccttattcaaagaaaatacattgggttttgtatgatctacatggtttactgtgaattatgactttactgggtatttgaattcggatggatagattccatttaaggaaacttgttgagcttagctagcctaagtttgtgtcaccttaccaaattttgccaaagaaaaaaataaagcacaccctagacatgccaactatgcaaaatttggtagctctgacaacactaacatttaggccgaggttagttccaaaatttttctccaaacttccaacttttctatcacatcgaaactttcatacacacataaacttccaacttttccgtcatatcgtttcaatttcaaccaaacattcaatttagcgtgaactaaacacacccttaacatgaggtgtgtacaccactctaaagtgaggcaagtcattaattagaccaaaatataccttggcatacctatccacttttccaaaatttagcaacttggtgtggtcgattttggcaccaaaccaacactactggagaagaggtctttggagggtcggccgatttccacaatagtcccggttccaaaacgaaccgggactaaagtggcttattagtcccggtttattactttaacgggacgaagggatctttagtcccggttcgcctcctgacagggcatgtcagacctctgtcagggggcttgggatctttagtcccggttcgtgttaccaaccgggactaaagatcatatctttagttccggttggtaatacaaaccggaactaaagtgatttgagatctttatgcccggttggtgttatcaaccgggactaaagttgcacagctttatataccccttcttcctcctccagcccgagccattgcttcaaaattaagctttgagggagggaggtgctgccaaaattttaagcaaatatttttggtggtaatatacaaatttgaggtcttcaaaaggttagcaacttcatcctactctttcttttgcttagcatctacatttggagctattttttttacatatttttccctctagaaaatgtgatggaagatgatgagagagaaagtgtgtgtagggaataaagaagattataaatacttgtttgactaattacatataattttgtatgaaattataaaactaagctaatttaatattaaaataagaaaaacatattaaatatttgtttataatgtaattaaaacatgaaaaatatgtacaatgaatttaataataatgattaattgtatgaataattatattcaattattgtattattatgtaattaccttttaaatcttggattttgtataattacgatttatatgtatttcatatagatggatcggcaacggatgtacgcggatcggcggtcgaaagtgtttgttgacggcgtgcattattttttgggtgtggccaatgataacaagcgtaacggttttataagctgtccatgtgacaagtgcaaaaaccagaaggagtattccaccacacgaactattcatgcctacctgtttcagtgggggttcatgcgtagctacaattgttgacctcgcacggagaggttggggttgcaatggaagaagatgaagtagaagatgagaacattccggactgggctcagtattgcggatttgaagaaaacacaatgggcgaggcggagctggatgttgaagggaatgacggtgctgatgaacttggtcaaatattgcgggacttacaggaggactgcgaaagtaaaaaggaggtgcagaaactggagcacatgttagcggaccacagaacagtgttgtacccaggttgcgataagggctacaaaaagttgagtaccatcctagaattcttgcaatggaaggctaaaaatggtgtgagtgacaaggcattcggcgagttattgaaactcgtaaagaacattcttccggaggggaacgaattgcccgaaagtacgtacgaagctaagaagacagtctgccctctaggtctggaagtacagaagattcacgcgtgtccgaactactgtatcctgtatcgcggtgagtacgaaaacctggaagcatgccctgtttgcaaagcactacgatacaagataagacgagataatctaggtgaagttgacggatagcctttgaagaagagaattcctgctaaggtgatatggtatttccctataatatcaaggctgaagcggtttttcaggaacaaatcacatgctagaatgatgcggtggcacgtagaagaacataaacaggatgggatgctgagacaccccgctgacgggtcgcagtggcgaaatatcgacagaacatttaaagacttcggcgaggatgcacgaaacgtgaggttcggtttaagcacggatggaatgaatccgtttggagagatgagcagtggccgtagcacctggccagtcaccatgtgcatctacaatcttcccccttggctatgcatgaatcagaagtacatcatgatgccgattattattcaaggcccgaagcaacctggtaacgacattgatgtgtacctaagaccattggttgaagatctgaaagtgctgtggaggaaagagagcgtccccgtgtgggatgaggacaagcaggagcaatttaacctacgagcgttgctattcgttacaattaacgattggcctgcacttagtaacctatctggacaatcaaacaaggggtacaatgcttgcactcactatttggatgaaactgaaagtacttatctgaagcattgcaggaaggttgtgtacatgggccatcgtcgattccttgctgcaaaccaccctgtacggaaaaaaggcaagcattcgaacagaaggcagaccatcgtactaagcctaaacatcgcaacgggaaagtagtatttggaaaggggcctggcagccaacctatagagagcgaagatggtcatgcggcgatgtggaagaaaaactctattttttgggagctaccctattgggaggtcttggacgttcgccatgcaatcgacgtgatgcacctcactaagaacctttgcgtaaacctgctgggcttcttaagtgtatatgggaagtccaaagatacactcgaagcacgcaatgatctcaagcatatggaacaacgcgagggccttcatccggaaccgaacgagaaaggaagccattacttaagtccggcgagctacaccctaagcaaggaagagaaggagagtatgtttcaatgcctaaagagcatcaaggtaccatccggatactcctcgaatgtaaagagaataataagcacgaaggataagaagttcacaaacctaaagtctcatgactgtcacgtgcttatgacatagctgcttcctgttataatttgtggtatccttcctgataatgtgcgggtaacaataacgaagctttgtgctttcatgaacgcaatttcacagaaagtcatcgatccagaaagtttagccgcccttcagcatgacgtggtgcaatgccttgtaagctttgagttgatctttccaccgtcattcttcaatataatgacgcatcttctgtgccaccttgtaaaagagatcggtattctcggtcctgtgtacctacacaacatgtttcctttcgagaggtacatgggcgttctaaagaagtacgttcgtaaccgttctcgtccggaagcaaacatcgcgaaggggtatggaacagaggaggtcattgagttctgcgtagattttattgaagacctcgagccaatcggagtacccgaatcattccatgaggggagactacggggaaagggcacacttgtaaggagagcaattatgactgtagacaacgatttattccgtaaaacacatttcacggttttgcaataatcttcgttggttgctccttacatcaatgagcaccttgcgattgttcgctcagaaaacagtggcaagtctgatgcctagattacacgccatcatattgatactttccccgcttggctgcgagaacacctcctgggtaacgagacgattgaccgacaactagccttcttggctaggggaccctccggctcggtaactacattccaaggttatgaaatcaatggatacactttttacacaagagcccaagagaaaaagagcacgaaccagaacagtggtgttcgtatcgatgccataggacacgatggtccaactagcacgtattacggtgtcatcgacaacatttgggaactagagtatggacccctgaaggtccctctgtttctgtgccaatgggttaggctgactggtggaggcgtaacgattgatgacagcgggatgataacggttgacctaaacaaggtaggatactcagatgaaccattcattctagccaatgatgtaacgcaagttttttacgtgaaggacatggatagcaaaccaaagaaggggaaagggcccgatgagccaagacgccatgttgttctcccaggcaagaggaaaatcgttggagtcgaggataagactgacaaaaattacgatctgtttgaggggcaacctccgtttgcagtgacggttgacccgagcatcatactatcaaaggaggacacgccgtactcacgcaacgatcatagcgaaggaacaatagtgaggagaaagtacgtgaggaagacagtgacctaggttgtttgatggaagatgtaaattatttgtattgtattgaaggtcgaacaatttggatcaatatattattctcaactgcttaatttgtaatgtattactatttttcaaccatatgatatttataaatggttacttccatttatttacactttgaatacaattaattaggcaatatgttatttataactgattattggtatttatttccactttgaaaacaattaagtaggccatatcttaattataaatgataatttctatttatttacactttgaatataattaaattggccttatgttaattataaatgattatttctatttatttataccttgagaccatttacttaggcatatcttgtttatttctatttattaaaattttgaaaacatttaattcggccatacgtaaattacgtacgattttggtatttatttggactttgaaaccatataaatcggccatgtgctaattatattggatttattggtatttatttcgacttgtaagacaatttaagaaggccataaatcggttttgtgtacacatctttagtcccagttattaacagtatccgggaccaatacaaattttggaatagcgggaaaacatcttttgtcccggtccgtggcttccaccgggactaaaga

SEQ ID NO: 45900 - DNA, 5193 bp, Oryza sativa
agattaccgggtataaatatccactgcatcggcttccccgcgccacacttagacttctccacgatcgatcttcttcctcccgcgccattaccgccccagacgtcaccgccgcctccgccgtcatcatcgtcatgctcgccgcgctcatccgcccttgcgaacgccaccggcagcgttgccttcctcaaggtgaggggcgcaaatcttacgcctccgatctcgcactctctctctctctcgatcgatcttgacacgcgccggccgaccgaacctcgccgccatcgtcgtcgccgactccaccgccggccgccgccgccgccgcgcgccaacaccactgccgccacgcgccgactccacctccaccgccgccgccgccgccgcgcgccgactccacttccaccgccgccgcgcgccacctccacctccaccgccaccgccgccgctgcgcgccgactccacctccgccgctgccgcgcgccgactccaccgccgccgccgccgcgcgccgactttacggtggaacgtttgaacgagaacgttttagcgaacgacgacttagcgacttagcgacttagcgagaacgacgtcttagcgacttagcgacttaacgactttcacgaacgacgacttagcgactaaacgactttcacgaacgacgacttagcgactttgacaggcaacgacttagcgacttagcgactttcacgaatgacgacttagtgactttcacgaacgacgacttagcgacttagcgactttcacgaacgacgacttagcgactttgacggacaacgacttagcgacttagcgagaacgacgacttagcgacttaacgacttaacgagaacaacgacttagcgaattatacatgtatacttgtagggtttagatgtatgagctatacatgttgatgtccatgacctcaccgtctttttttctttgcacgcacagatggcagaccgcgatgacgaacaaatcctgttagacacgatcgcagagggcagcagtcagtactgggtggatgatgaggggaacgaggatcccaaccaatacctgaacgaggagggcaacgatgagggtaaccaggaggctaaccaggaggggaccgaggaggggattgatagtcaaccgttggccggatagaagaggccacgcgggaaaagaggtcctgcgaagaagcttgagggaaggcacatcgttactgagattgccccagacagtgaaccagtagccccagcgggtataggacgaaagtttgtgaatcattgtggttgggtcgtgagagacaacgtccccatcagcatagtgtactggcgtcgaactaggtcacgcggggatgaagatagctttctccctgacacagagaaggacatgttgtggaccaccatgctggagacattcacgatccctgaggcagattgtcccagatgcaaagaatggaccctaaagaaaatggcagaactattccagagctacaaatcagatctgtacaagagatacatcctcaagggcttgacacctgatttcaacgtgcataacaagcttagggatcactaggatgcgtttgtggcatacaagactggagcgcaagtgcaagcacagatagaaaagaacaaagccaatgcagctaagaagaaataccatcaccggcttgggtcaggtggatatggaaaggcaatccccaagtgggacaagttggaagctgacttgatagcaaggggtatcgagccggccatggctaattggcctgagcgatcgaggaactggttctatgcacagggtggatcgctcaatccaggtgatggctccctcatattcagcgatgagattcgagatgtagcacgccgacttgcggatgcaattgaagcctctacgcaggggactttacggcccgacagagagaaggatgagctcaccctcgcactacagaatcttgagcatccaggacgaacgcgaggaaaaggcgtccttccttggaaatatggattcaaagaggacatccacacgtataggagtcggatgaggagcaagagggatacagaggctaagatcgtcgatcttgagtacagggtgtccacctacgaggcaaggatgcaagaggaggtgacaagacaggtggaccaatgcctggccgagtagcgcggaatggaaacacaagcgcccgtcatggtgagcccctcgggcaaccgcagcagctgcgcttcaatgggccaagttggatcagagggcattgaggcagtggcagctcacgaagcaacctacttcccggttgatgatatcacgcagcgaacaccctgcgatatgcatactcccttcaggaacttgtctatcaaggtatgcgaaatgcgaaatttgttacatatatatgttgattagtaattaatgaactatatttcttatgaaggttgcgtcgggcatggccatacccacggacccttcgagtacataccattgcaggcccattccacatggatatgcgaaggtcgagatagagctggtggaacgaacctacgaggatctcgagcttgacatcctcggaggagacggggagaagaaacttggagacacagcccacgccatcatactctggcataagaagtacatcgtgtttcccgggcaagaacggccgcccgctcctccttcccggccgcaagcatagtctcctccgccatcactgcctcgttagtctcctccggctccttcccctgcaccaccacctcctccgcgtgcaccagctgccaagtctacaccgtcgggcccgcgggcaactactcctccgcgtgcacctgctaccaagtctacaccgtcaaggtcccgcccatatgaacccgcaccttcaaggccgaagaagaaagccagatctgacgagccacggctccccgctctcaagaaaagggcgtacgacttgactccggaggagctcgatgaagccgttagagcagaagttatggagcagttgaagccacgtagtccggaaaagaagatccctatagccccggaggttgaggatcactttattatgatggccgaaccaggcaaaccggttgaagtttctgactatgatcgaacattgaggaaggctcttaaagccaagccttcagcagtgaagtgtggaaaggaagtccctcagctggggcaacagccacgacaagaggttgaaccgttaatcgtagaaccggcacaactagagatatgcaacttcttgaaagatacgggactgagtatggagcagttgctagaggacgcacctatcgaaacggctccggtcatgtacacgtttaaactcggtgaactgctagtcacgcctgataagatcagagagctacctacacagatgtaccggttccatcaatggtacatggacaaatcagggatgggtagagagatgttcggagctagggtgcgaaactcagattattaccaaggagaagatgttatttggatccgctacaaagaagtcttcgacttataccacctgaaggccctcgacgtctctattctcagcgcgtggactttgtaagtactgtttatagttcaattttgttcctcatttgaacgttgctcacacacattccttttccccgttgtagaatggagattcagttatgccgtcaacacaacaaattcaatactggattcgtggacccatgcaaagtgaacacgctgatgatacaacaatacgagaaacaaactaaggacaatatcgtccatttcctggtgcagcagcattataagaggttcatactacttccctacaacacatcgtgagttcctacaatcataattaacttcaattttgttcctacaaagttcctacaatcatactatgtatcatgtaatgcaaattgcagattccattgagtccttcttttcgaccttgagaaatccaaagttcatgtctacgattcaatggataaaccggagaaaacttttgcaaagattttcgaagtgatagataggtattgtcatatattgcactgtcattatgaatcattgtataactactagatctcggataataaattaatccttcctaacaactctaaatagagcatggattcggttccgtacattggtccgcgggatctggaatgaaaaactcacccggaggttcaattttctggttagtacatgctagctccaattttgtattgaatcattctttgttctaaatcagatatgcatactaaatctcttgttgtttctctttcagtgtgcaaagcaggaaaaggggactaacttgtgtggctactacgtatgccattacatgcactgcttagcacaccaaatcaggactggccaggaccttgaagtacgtaaatttattcttccgtcaattattgcttactggtttcatatatataatcccgtttttttccaaattacagatgatttacctgatagataacaccacccacgatgatttcataagggctgttcaagaacagataatgggattcatcaacaagcatattctccatcccacaggagaattctattatgatggatcgactattcataaagccggtccttcttcttcctatgtcaccaagtcgtagtagcaaaaacaaagattacaacgtccaaacgaattgtaatatatatctatatattcatatatgcacacatgcatttacttttgtgtacttggtttggtaatatatgtgtatatttacttacttgcaaactcatattttgttaacatatatatgcatattgcctctaattacttaagtgcacacatatttgtatatacatacatacatacatacatacatacatacatacatacatacatacatacatacatacatacatacatacatacatatatatatatacatgatatatattcatatatatatatatgtacaccaggcagcacaatcaaattaaaaaaagagtaaagtccatcgccggtccctaaacttgtgccgctgtgtcatcccggtccctaaactcgcaaatcgaccgttcaggtcctcaaacttgttcgactgtgtcatctcggtccctcagatcactcgtttaggtcctccaacctgttcagttgtgtcaccccggtttctaaacttggatttgaatattatatgggtcaaataggacggtcaaaagactttatattttaaaatatataattcattaaattttcatgtgaactctaatgaagacaaactttatatcaaacttgta

SEQ ID NO: 45901 - DNA, 2297 bp, Oryza sativa
agttttgggaagaaaaactgttggaagttttctagcaatcccctccaacaacattgaggcccatcaactcacaatgattgcccatcaacagtctggttttcactacacatcctccaatttcctgtcccatctccatttcgtgggcctttttatttcttgtttctggattgcaaaaagtccatttggactccctcaaacataggtcaaatatgattcataccctctgccgtaatatcctatatattgaccttccaaatattaacaacagtgtaaaataaactctctcgatggctggaaggaggcaagcaaatgaagagaagcatggagagccaactacaagaagcaaagctttgtaaactcgacaagtctcttatagaatgcggactactttttttcaaaagaggggaaacaaaacttaacgagctttaattggctgactactacataagccgttggcggagaaagctcgaaccttcattcgtagctaagccaaggtttcaggtctccaagtcagcccatgctttttcgaagaatcctacacccatgagcatggcaggccttccctttgccggagcttcatgggcgttgccccggggatgactgattttgtggtttaggtgtgtaattcgtacatctttataatttagtggtatttcagatattttcctaatttgattgtgaaatgtggttcaacattattgaaaaagtggtttaatacaaactgataacttacagacggctttggaacttggaagttaattacacatagatagataagcataagccaactagtgttgaattaatggatagtgggcctaaactccaggccctcaacgatgaggccaattttcttgacatggtcgttcacctcgcggaaatccaccatcaccgctgcctccgtgagcatcctctcatcgttactgaattctgccagcttcacctccatccagccgtcgtccctctcggtagggtaggacacatcggaggctccgctgcgggctgcaggatcaacactaacacggctggtggcgacgaccctctcaccacagagccgcagagacgacgtctaaacaccttgcaggccactggtgccactggttagattgtacactaggtaggctgcatagggtgtgtcgatgactgccaaccaatgcacgtctagcagctccgcgcactcggcgaatcttgtcacccagggtgaaacgatagtgagcaatctaagtttagattttgaagactggcaagtaaaattatgaattttggaaggtcatgttggtaagcaaacctagaattagggagggagatccatctccagtgtccgggcgtatctccccacgttatccttaatgatcttgatacccaaaaaatctgttcacattgatcaaatccatgttgcaacatttctaattaattaattagtagtaagtaacttcttcaaaattccggcacacaccttgttggttggtggtttggacaatgatggaactggtgagaacacttcgtatcgctcgactcgagttgatggttgacgggaaaaagttacagccatcaacttcaagtcattcatcaacttggagataggagtagaacttatctgcaacaaaatagaaatattaaaatacattatatgaaatcaacgaggctctgatcctgccgtacgtacgccatcaacaaagaatgactttattatataacgtaacaacgaaaactataaatatatgttctattaatttttttgttgaaaattaattagtttaacgccaacacaaacatatggtagttaaaatgtctgtaaaactagtaatttattgttaaaccaaaagctaacatgtattgagtcacatcaccataaaaattttaaccattggagtgctagctatagtgctaggaaaaactgggtgatgatacgatatacttgcatgttgaattttaggagtcagtgggtatctaactttatagtaacataggatatatgcttaaatttgttatacattattttgtaaaccctgaatacccttgctgaaaatcgtgactctgccatatgcgtgcatacctgcgctagcacaaccgaacaagttgcatggacagtttcagtctcctcaagcttatggaggatttcgagggtagcaggcctgttgtccagattagtatcaggaaaaaattttgaaattatactatttatcgattgattgtgcaaaaatataccggatagcgaacgatttgcggaaataaaccatcggtatcgccgatgttcgctcctggaaagtgcgatagcatggcgaaatcgctatctgaaa

SEQ ID NO: 45902 - DNA, 5092 bp, Oryza sativa
  unsure (1)..(5092): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagggtccagacaccagccactgatgtcaagtactgaagtgcagtcaggaggccagggtagctgaacttggtcatggcatacttgttgatgatcgccagcaagctcgagcacagagaggcagccgaaccacggagccctagcagctacaaacgcctctcaccaatcggccgagatgcagatcccgcaggtgagattcggattccgatcgcattcgtgaggaaaggggaaatgcagagcagtcaccgctccgacgaggggtcttaccaagaaagctcaagacagtatatatctcgggtggacggattcccgcgggagggggagggagagctccgccgctggcggccggccggcagctgccgcgacccgcgcgtgggcgaggttgagcggatcgggagaagagggaggggcatgtttgtggtgtaatttggcttctattatttaatcttggtaggccaaattatttagtttagctttcattatttattgaatgtttggagacgtatacgcgtcggacgtacggcgcgagccgaaaaatcggacgcctcgcacgaccgtccgatgcagcacgcgcgcgccagccgtccgattggagaaacaactgtcacccgacgcccgcgccgttgcaacacccaaacacattaatctgtttcattcaatgtgtcccgccgttgaccactagcacgaggggagatcttcgcggagcgactggcgctgcgctgccaccggcgattctctccagcgccggcgaccctatccctcgcgcccctatcctcctcgcgccggcgaagcctgcaacaacgccgacgtgccgccacaccacacgcagtcaccgccctgcaacttcgccaccgacgccatggctcatctgatacaccaagttgagagggatttttcgccgagctcatctagtgcaaacagaggaacaaccccaatgcataatgcaacgaatttggtgagtaaaaaatttctagggttttacttgtttcactttttttttgaaaaagtttcaataaaaaattgaagtatagatctatgaaacaatgtcttccctcatgcaacatttatattcatgtcttatttttaattgtaacttctgtataaatttggactggaatttgacttgaacaataatccttaacttgctaaaacataattgtacaagttaatgaaacaagataaaatgttacagattgatgtccaagcaccaagctcatctggtggcttccttgatgtgctattatccaaatcctctgggcatgaaactgacttggtgagttgtccttggatttgaaatatcacaaatgtaggggggatattttgctttgaaaacacagtatgtaacttagtgaaacttttttgtgtactaggttgtggatgtggaaagtgttgacaacacagatgtggctgctgtgactgttgaaattgatgaacaattggatgaagatgcatctgaaaatgatgaaaaagaaaaggatgttgtttgttccccaccaattgttccatacattggaatggagttcgatatagtggaagaggcaagaaatgtttacaacgcttatgcttataagctaggatttggaacaagaattgcatcatctagaaacagccaggcatcatcaggggaaaaaaagcatcgaagaaatgtaaagtatctgaaaatggagacaatcatgatgatgaaccgaagttgataaggagagaatttgagtgtgttcatgcacgtaagccagaaaataccacaaaagatagtgctggtggcagtagcttcatttctgaagagaacaaggaaaatccgcccctgcttgaaggtaacaaaaagaaggctcccttgctggtggaagggaagaggaaacgaccaaaggttgcaaagtatgattgcaaagctcatatggctgtagggcttagggacaacaagtggagagtcattgctttccaaccaaaacacacgcatccgatggtgaagcgccttggaagaaggagatattacagatctcataggcacatctcaaatgaagactatgaatttctaaagactttgcattatcgaaacattgcaacatcgcagattttggcgttgttaggagatttgcacggtggtgtaaggaatctaactttcattgctaaagatgtctcaaatttgaggacaaaactgagacaacaagtttcactcaaagatgttgcaatgactattgattatttccagtaaactcaagcagatagcccctccttcttctatgctgcaagatatgatgaagacaacgtgttgaaggcgttgttttgggtggatggcagaacacggaaactgtatcaaagctataaagactgtgtcttctttgacacaacctttatgactaaccgttacaacatgccatttgcacctattgttggaattaataaccacctgcaaacaatattgcttggatgtgctttgatttgtgatgaaacaactgaaacattcatatgggtctttgaaacatggatgcaagcaatgaatggacagaaggtaggttcagtgatgacagtccgagataaagcaatgagagcagcgattaaaaaggtgttccccggtacaattcatagatgttgcttatggcacgtgacaacaaaagcagatcagcaactcctgcccgtgtatacttcaaagaaaggcttccgtgaagctctgtatagatgcatatatgactctgaaacaatagatcagtttctatcagattggcaaaaaatggtagatgaatatgacctccatggaaaccaaactttgaataacttgtgggaaacaaaagaaatgtgggctccggtatactttaacacaagttttttcccttttactgggacgacagggagatcagaaggtctaaatggactattcaaattatttgtacacccacaagattcagtgtggatctttgtcaaacaatatgagcatataattgagacaaggcttgacagagaggacagggagggctacagagtagagacaacagaacctagaatgtattcaaggtaatgtgatatgcctgtcttgaaacaatttgaaaaagatgtgctttctgtttttaattagaaaaattgatgaaacaaataatatctgtactgtgtaacataaactgtgcaagtgtggaacaattgacattaatgggttgaaacattgaattatgcaggtcactgattgagaaacaagcatcgcagttttacactacaagtgtgtttgcagacaaattctagtatgaaatatatgaagcaacagggctggatgcagaaaaaacacaagaagtccccgacataatatataatgttatgccaagtgacatagaaagaacaggtaaaaaatatagggtcacagttgatgcagcacactcaacctactcctgctcgtgccacaaatttgaaagagatggacttctttgctcacacatcttgagggtgatggctgtccttaacatccatgagattccaagtaagtacttgctgaaatggtggtcagagcaagcgacattgcaaatacgtgatgagtacaatggtccagcaccatcaattggagtcccggcaacaagcaagctgagattcaacgcattatgcagggcaatgacaagccttgcttcagatgcatgtgttaatgaggaaaagtacttgattgtttcagctgggattcagaacctacacgcaatggttgcaacaccacacactgttgagacacaacatcagtaaggtatttttcctagtcaacaagacccatcaagttcagctaagaatccagcaaccaagaaaaggacagggaggctggtagaaaaaactcataggatgaagccaataggggaacaaataactgaaagcagcaagaagaggaggacaaaaaagaagagctcatgctcatattgcttcaacgagacacacaatgtttcaacatggccgtatctcaagatagcgaacatgcgagacgctctactaaaccaaaaatggtgcaagagacggagttgacactctgagaaaaaagagtttcaagagctataaatttagatgcgatgcactatactgttagaaaatatagtggtaattgccatattacaatataaaactatcttcttgtgttaggtgaaacaaattatgttgtgagatgcaacagacatattttttttaattcacatatgggcagaatgttggatgattatgtgaaatgagtctttcttatgatttatgtgaatgattgttaagtggaaagaagggaatgccaaaaaaaaaattacatctctgcactaatgattacagtggaaaaagaatatgtagagctggtgaaacattcattaagtgtagggtgagacaactgtataacagtaggtgaaacatttgcttcttatggaacagaacatgtggagctgtgaaacaatcattaagaacaggctgtaactattatgtaacagtaagtgaaacattgcttcttatggaacagatcatctggaactatggaacaatcattgataacaagctgaaacatataagtactagaaggtgaaacattgtttcactctaaaaagaacatcttgaactatgaaaacaatcattcatgactgccccctagtagatgcaacattatataaagagtagcagttcaacttgatagcacaacttcagtgcacaaacaaaaaacagaaaacacaacacacttcagtgcacaaattcagaccacacatagctacccagagcatccactttgcactattttttctaccatttttacaacttcagtgacacgactgccccctacactaatttgcttgaagttgatcatggttaacgaatttccggtagttcggcatgtccccttcattgaatgcttgcaggtttttcccatcccaattctcaatgtatctcaagctggggctgcaggaat

SEQ ID NO: 45903 - DNA, 1070 bp, Oryza sativa
gggggtggttaaaacatgttaccgtcaagccaggggaaaaacaaatttttttatgcttgatttcatcttagaatcttccctacagtttgcattgaacatctcaatccaacatgacataacttcattgttcaactctcctctaggtttcattgcttcacggaaatactcaagtgagacatggaattctccaatccttaagaatggagttgtcctgtttttcccaaaaaaaaagttgggaaaaaattcagataaagctgttctgaaacaaatgttttgcatttattgagacatgtcatagtgactgatgaaacaataggggaacctacactgaaacatattaataataaaaaggttgaaacatattttgcgcaaaaaaaagtgtgaaaacacttacaactctttggcatctgccttccttgacctatttggcaaagaatcaacaacagatcttctgtacacatcatctatttcagaagcggtcttcaacttcttcgcctctacatcactatcacctttctgtgcccttttcttcctatttttcttctcatgggtgcttggaccactactaccagcacctactatagaggaaaaaacattagagaggggtaggggtgttgttcatagttactttacccacaccgaaaagagagagagagagagatagagaaagagaaggaacaaaaaagtggtgattttacctagaggtagcgagcttgtagcacgtggcggtgaagatgtagctggggatgttgcccttactgctgctagagagagaactactgaagttgatgtttttgttgcaatgggtgaagggggggctggagaaggtgtccttgcagtgggtgaaggagttgcagaagatgtccttgcagaaacaggtgactgaggtgatggagaaggtatccttccatccattgccgattgaggaacatttgaaacatccaaggagagcatctcaacagccaagtcctgagtactaatgaaatcaggatcagattcattgaagagtctgaatgacggtgcatcacatgcatcatctagatttgagatatcagagtgggaagcaaaaa

SEQ ID NO: 45904 - DNA, 4480 bp, Oryza sativa
  unsure (1)..(4480): unsure at all n locations
ccccaaaatctctctcaccttctgctccaacaaaatctctcacttcccgtgcctgaaccctccttggaatcctcctatacagcagcagcagatcagatcttcgactcctccaaggtacacttcgtttcttctgttgcccttccccatttcccaagggagatattcttgatttggccatatagatctagagccctataatctcccacaatctttctcctcaattcgaatcccttctttctttgcagaagtgaacaatcaatccgactggatctggggatgatggaggaggacagcttcatcaacaacgatgttggggaggaggtggtggttgcgaacggtggtgacggcgaaggggtcggggggatggcgaggagcgacgacggcggcgatgggggaggggggaatgtggtgcaggacccgccacttagcttaggtgaggtgcgagggatcctggagcagaaccacacgctgatccaagagatcagccaaaaccacaaggcccgcgatgccgatcgcctcacccgcaacgtcgccctcatccgggatctcaacacaaacatcgcccgtgtcgttgacctctacgccaacctcaccggctcctctcactcccacaccacatccgacgttgccagcgccaccaacaccaacgccaccaatagttcctccccgtccgccgccgccgccacagntgaggtgagcaagcaaccccacaccaccgacacngacgctaagtagagcacctacaactccagcaattcgatctcttctcctttctttgatgtctagaattttagatttactgagcaacaggaggagaggaggtagatttggaatcctgctaaacttttttctcttaaatttccgttttctttctctcgatgtaattcagcgatgagatagacatggacaaccgtaaacacccaacttatcagagatcaaagaaagatgcagacatggtaacaatgccatgccagcacccctcattgtagtgagaatggtagggacttttccgactcgatgccaaatgcaacatggtcgtatgctttatttcacaccaaggtatactgattttattcggaattaatatatagtttgttatatcagcactcagcagtgttacatggacacgaacatccgactcaggacttgcgtctccaatttggcacaaaagaactatagatgagaatccttcttggagtctcacacgggtgttagactcaatgttgaacataaatttggatatagggtgtccgattcggtaaaaatttaggagtccaggtaacactgtatatcagaactgtgaaccgattcatctgtggagctttcagtcataccataattgtttattctgatatcttaatggtataaaaggtttgtcatgctgtcataatggtatagaagtggaaacggatcaatagagatttatttcattgagctagatatatatatactagaaaatcagcttggcgcgctgactatatgaccatcatgtctttatcttatatgcccattagtcaatggcacgtacatatattttagtgaaatatgaatttgctaaaggagcttcaaagaacctcttaatgtgttttagctttcaatgtgataagtatctataatattgtataatattgtagtgaaatgtgttgtattttgaaaacaaaacattttttttcttttttcctaatgctacttttcctcatctatttatttttctattagtgactaaattaatggacctgtaaagtagtacgatggaaaatacatttagtgcataatcagattagtgagctagaggttgggtattgaaacaaccgatgaagaataagagagcagatttctatctcattctagttcagatttgagaaagttctagacttcccttccttaacctcttctctctgtttttgatgcagcacaaatgagtttttctccttttttttcctattagtaattgcatgatttatctcagtttttatgatgccatgtggtccaatcacaatccggtaaaattgccggcttgagaataataagatatgccgttttcctacggaatttatgaaaaataccacaatatattggcaactcataagaacgaaacaaatggcgtgcttggttttgatgcatttaccgaacttttttgtatggtgttgagtgagaatggttttagaagtagacaatttaggtgtggaagaatataagacaatgtttgatgttcggttggttactttaaaatgctaaaatttgttgtggctgaaaatggtagcaaaccaaataaccctcaagccttaaacttaaccttaacctcttacatggttagtgttgacgctatgctactgtaataatgtattttaaccagtgacccctagcttaatttgaatctttgacaatagttgtatgtgaagttaatttataacataaataaacatatgattctggttttcttgttgctatgtgccatgtttttatttatgtactgctctgtctgttcagatagttctgttccaaaaattctgatatatgcgattgtggagaaacggaggtaattgcaatttgcaaatgcaatctccgcccaatgatgtggtgtagggtcagttaaaaggagtggcgagttgcacgtacgcttgcattagaaatttagaatatcgtatcttcatcatggatgaaacttgctgttttatttttttttctttgcgatcaatccacaaacagcgtttggcactttggcctgttttggaaagaaaagaaaagaaaagttcatttatttttctctcatctttacgtcttgatgtttgaattgcatccttaaactgcaatatcagataacttgcaataccgatatacctgacgtttcagggcagaatagtccctgatttccatcaacgtgggtcaaagtgggacctacatgtcatacacacacaaaaataccttccacccctcacttacagaccacccgtgagcagtccaccacactgatactggagccacagttgccaacgccgtgagatggaacgtgggagcggctattggggaggaaggcggcaaaggcatgctgccagtggaggagagggacgacggagctcaaggaggatagagagatagtcgttgctatcatcgatgaagattaggtcgaatgcgtcggcggcgcaagggcacaagcagacacggtgatgtactcggccatagcagccatagcagtggggagttgctgctgctgctacgacggctcgtcctagaggaaggtggagcaggtttacccacgccaagaacatgcaagacggtagatcttgtcagtggtggccccgtccgtgcaccgtcgccgaggtctattgaggtaggatgccgaagaggatggcgttggtggcgtcacctaccctctccagccaagcttcacccctggccgctccgtctaccactttggcatagagaaagagaggggagaagtagagagagatggcaagaggagagaatgaaagggtggagaagctgacatgtgggtcccacacccgactcggctaggttgaccgtaagcaactcgccatgtctgcactatactgctctatgatcttgagtacactgaaattgaggtacaccggaattacaagttaaaagacgcgttacacaattcaaattcaatgtcaagattatggacctaaagtgaacttatattccatgaaacttccatgttgctgaataagcgttttgttgaggcgagcgaaccatggattggttttcaataactcgtcatggagaaacattttatttaactggatgagaatctcatgttactgcaggagaattatatgataaaatggtaattcgcttgtgttcagattacactgttgatataacgaattgtgtgcaaattccaaataaaatcggtatacttcgtcagaaaaaccatcaaccatttccaatggggcacggttggaaaattccctaacattctcactacaaagaggggtgctggcatgacagtgaaaacatcagtctatcatatctgcatctttctttaatctctgacaaggcaggtgtttactgttgtcatgtccatctcagctctgaattacatcaagagaaaaaaagagggaaaagagaaaagagtttagcaggataccgaatctacctcctgtcctcctgctgctcagtaaatctaaaattctagacagaaagaaaaaagcgagaacaaaatgggggcgagaaggagaagaaatcggatagccggagttgtaggcgctctactcggtgtcggtggcgcgggaccgcttgcttgccttggctgcggcggcagcagaaggggaggtgctgttggtggcattggtgttattggcgctggcagcggcagtgacagagcgggagaaggagccggagagattagcgtagagatcgacgacacgggcgatgttggtgttgagctcccggatgagggcgacgttgcgggtgaggccatcggcgtcgcgggcctcatggttctggctgatct

SEQ ID NO: 45905 - DNA, 8526 bp, Oryza sativa
tgatgacgctgtcctcctccattatcccctgatttgatcgctcgctcctgcatcaaagaatggaattggaattgaggagaaagattcggggagattgtgagcctaaatcctaccaacagcacacacataaatatactacaaaaaaatcaaattttggcagcaccacctctgcaaaaaggacactagagactagactaaccaaataatcatttcaacataagactaaacaagctcacaggtacagcagccatacacacataaccatgactgacgatcattaatgtttcgcttgcagccaaagctcaaaagacaccagcacttcagccctacttgatttagattatcgagtagattgttgttgcagattatctactctaatataggggtaaatcaaatatttcgagaaataaacttaacatatactgtagcttaaaacaggtggtctacacaatgtggtagaagttttttcagaaaagtgtggagcaaataatatgtttaataatccggtgaataagcttaaatattaactaagcatctaaagtagtgataaggttgcataagtgatatatagtggtctcatatggagctacacccgttccccatgcatatgttggcttcaactattacctaacaaggaaaaacatcaaaacaacaagcatgagtacaggattcagcaaagcatatgaattaaacagtaaacatcacataggaactattctattgccatgttaaacatttatcatactccaaatgcaatgaatagctaactacatgctcatttgctcatgtcattacttatattggtattgcttgggtgaatgccagtcaacattcaccctctttcataacatagaaaagtaggcccatatgcccacacaaggtgggccttcttcataccatagatgcatataatgcaaatgcatttaacattaaatgccgacttactccattttcaccttgtaaccgttattataccaccataacatttccataacttcataacaagcattaatgatacagaaagaacaagaggcggcatcttgtgacattataatttataatcaccgcccatttactgtttaacaatatacttgccttaaccgcgtgaagatgagcgatgggtggaggtttccacttcttgattcgcaccacgacctgaacattcatcaaataacattaaaaaaacaactcaaaacaggacaggatgacaaccaaagagaacaacaatcgtgctacgtgcaacctgctagagctctgctctcaaaatcgtcacttaacactccgtccaaagtaaaatacttttcaggtaatagactaataaaagttcgctaactattcgttattagccgttgtccctagtttgcttaaaaagactctagttttaaccgatgattgctgttctgtccaaaactggacagttgcttcgcaagcacataaccgcctcattctttctccaactcctgcaacatttggttctgtgaagactttctagttatgagcccacatagccatcataatttataagggaaagactgaaactgctacatgtggtcatcaaattctaaacagcagcactcccaggggcttttctcccaaaccacctgaccaaaagtttaagttctaatactctacggaaagcttagagagaaatctacaacttccatttagaccaagagccccgattccccatgaataaatcccagatttcgaaacgatatatatcagctcataggtcgcaagaacagattccaatcaactatttgatgtctaaaaaaccttggttcctaagtgtaggtagtgcaactagggactaacaagagcttaccctggcagcaagaaccacaaatcgaaggaggatctgacgaaacccacagagaaatccccgaattcttccctttccccgtttcttctcttcttcttcttcttcttttttcccccctgtgttcttcttccttctcctttttactcctcttcctttccccccttctcttcctctctctccctggtcaggtggccgatgcgggcgaaagcagaatcagcagcccgcggttgagggcggccggcggctgacggcggagacacacggcgacgagggcgacggccggcggcgagggaggtggcggcgtgaggttgctagggtttgggtggaaccggcgagcacgccgaccatgggggaagggatcggcctccacaatgccctcgggatgccctctttaaccttccttttttttcttctctcttctatctttcttaaatctaacgcccaaattaatctgattaccatgaaatcagagtaactctaatttcatcagagtataaatacacaaataaaacaaaaaaaattaaaccctaaggtgaatctagacacacatatgtccagattcatctctagggtttgattatttttttcttgacagagagagtactcaactatatcgacacgaccgtgtttcttgatcggcgattcaagcgctctagcgtaaaaaggaaaaaaagcatgttttagcactttctcgttcgagttattatatgatgatatcttctctaggagtgagcaaggcagcgcagctaatggaatataccttgtaggaatcgaagatctgatccactcaggaggattccaaggaatgttctggtaacaggaagtgagagattttgttgaaactaatggtgaggagattttgttttgttggaaaggagagagagagatttgggggacgatgagaacgggggttagggcagagcggatgaaacggagtcaacaggtgccagtattacggttgagatcacggggctgtgctgcatggttttgacgtactagataaaaaaatacaaaattatatcaagagcataatgcatgaaaagaaaagcaaaagaaaataatgattatagatgtctaaggtttaatgttggttgtataccaagatgggagggtcatttggaaatttagtttagcattaatggtagggttacacgcttatactaatttttagaataaagcctaaaatagacattagtcaaaattcattataatagcacttcactcattcttaggaccagaagataagaaggatggtgacattttcaaatgcatgatcctcttaaccattagaatggactttattgaatccacccttgtatttcacttagaaaaggtcatagactaaaaaatgtatatatacatattatacaaactttatacacgacttcatttaatgaataggcaagtacaatattagtacataaaataggcaagggtttatctatatccgacggatatggattcagattcaggtagttcggagatagatgtggtattgacaatatacgtgggatgcggattattcgccatttcaagcggattatccaatagatgttttagtagactatccagcccatgcatccactctatttggcctattccacataaggcaatccatccataccatctattagttaatctaagtaacgcactctctctgtcacaacaagcataaccagaggcacgaggcgctagcattggcaccatgcgccatggtgaaacatgcaaaatggtctgttgcgccgcagacgcctcctaaggtcctcagcttctccctacgccgttgattgccaacctccaccgccaacgtcgtctctccatctcctcctccttgcagaagtccacataagagaattcggaaatcggaagtactcgaggtgaagagagtcatgcagtggacgctaccaaccctgcattagatcaaacgtttgtggaccccacccacctaggggtgaaaacggtacggaaactttccggattccagacttattttcgaaaacggaatcggtcggtcggaatttttttggaatttttcggaaacggaaacgaaatcggaaatattttctcggaaatggaatcggaaatgataagggcagttttcgtcggaactcggaatcggtcggaaacttcttggaaattttctcggaattttcggaaattttctcggaattaccagaaattttgtgactgaaataccctggattcttttttttaagcgctaaatagtgaataccatggtgtttggctgttattttttaaaaaaatatttgttatgcaaatctaaaattacataagaatattttttttcctacattgggatttatcaacaacattactcttttaaacatagataacttattcaattggatttattagtttgaggggtttttttattccgataaattttcgttaccatattcgcgccggttcgtttttgctccgttttcggtttcgataatattcaattccgttttcgtatccgaggtttccgattccgattccgaaaaaaatatgaaaacgaaaacgataaagatggtttccatccgtttccgtaccgttttcacccctacacccacctacccaatacataaggcctgttcggctgccattcttgcggcagcactgcggctgcagcgcttggttgtgcgaccgcagctgtgctgcttgcagctgcgataaatggtagccgaacaggcccatagagagcatgagtgaggtgaaaatcaccgagagtcacattcatccggctttcaaggttataagcaatgatagtataagagttaattcattatctccaatgcatcctaacactatgatagaaagggatcctctagtgtggactcccctctgacatgttcattaacatgtgggtttatgagtccatggacccacacatgtcactgaccacatccctctaacttcacgtcagaggatccctttcctctacatatagtgtgtcggagattggttgtgtttctaaggctatgtatttttccttacctttcccaatttctacactctagttttccacgtgcatactttttaaactactgaacagtgtgtcttttttaaaaaaatcaactgaaaagttattgtaaaaaaattaaactaatccattttaagggttttttttaaaaaaataattaatcattacactaatgagctaactcgttttttatgtgagagaaaaaggttcccaactcaatcaaacaaagacagcctgatgttcatgctcaacgtctgacctggtttgttacaagggagaaatcacaacgagacgaatgccatatagagaggtataggatgcagagacctgtttaacatagtcctataagctaataaatttaattttcttcaatgctcttactaaaaattggaaaataattaaattaaagaacttgcttgcaaccacgaacgtggtaaaccatacaatttcacaatcatgcattccatacaagaccccagaactgaactggaacctccaaatttcagtcaaatccgttcatttaacacaaccaagaacacaatttcaactgctgaatgctgatcaccattggcgcaactggacaagatagccacactcgaacagcatgcacgaaaatatatcagttgtaaacagccaaagagatcattgatattttaataaacatcatgcataaaccacgcaggttatcaagtcagttttaaggtccagcacaactcttgcacactagggactatgacacacaaagagcggcagcattacaaggtttgcgacaacataatagttattcagtattcactcatgcaccaacagaaacatcctgcatggtatcaaaagacccagcataggttacgcaaacattttggctttggttgctccaacactatgcttcagggcctaatagtagaacattatttcttgccgcgcagctttgttccaagagccctttcaagcttcccgatgatctgctggttcggaatagctttacctgactcgtactcctggatcacctggggcttctcattgatcatctgtttgcaaaacacaccatattttagttgaaggttagtgtatgtgcgagtggctgtggtaaaagttaatgtaacgctaggaaattctaaaattgtatggttggacagggcacctgtgcaagctgtgcctgggtcatcttcttgtccagccttgcttgcatgaggtttttcttcaggtcacttgagacacgctcatctagcatatgttgagaataacaagggattagagaacagtagaaataatgaaaaggacaagcaagtccaagtaatagattgaatttatgctttctcggggctaaactttggagataacacaaggacctgatccatccaatgaaattccatgtaaaaaaatcatcttttagcaaagaacagacagtcaaaattcctgtcttcaggcaattatatccgatggatgtttagaatgccccatcatttggttgtacgattgcttttgcacccatggtaaattttcatttaagatgtaaaaatgttcatatcaaatatatcttgtttaggcgcacacagtggcatataaagtcaacatagctcaataaaattatgatattgcatcaaagaagattatcttccatttagctgtttgattgctgtagatcagcaccatcaaagctacaaaaacaattatagagcgagcccattgaataagcaaacttacgatctaaatatgggcccaagctaggaagtaggatctaaagttacaccccagatttgtaaggctgagaccttatagtcatgcaagatataactggaacatcatctcatcaccctcatcgttcaaagtggtggtactgacctatcccatccaatccaattacatgtcacacccaatacaagcatatatatatctccaagttacgtgacaatcttttttggagcccaccagcatcagaggtatatatcagagggtcagagcaagtgcttagaagtatatagtgaagattcaaatagaattcaggtgcattttgttacaaactacagatgcaaatattctaacatgaacaaatgttagcaagaccaaataacatgtagaaaaaaaaactagtgatgtaccaactaggggatcttgatatgcacaacatggagtatatatatatatgaagttcccggttccgatttgaccattcatgcatggtgcacatacagacacatatatactgcttgtgaagcttgcagcatccatgaagatgatcataaaaggatgtatcaagaagacataggtccttacagtacatattcagcaagaatttgaataacaaatgtcaaggaccattttaataatatgaaactcattgttcacagaaaatcaatattattaatggaatccaacaactgtgaaataaccatggaagaatttaagcaatttgaagcaagattgtcatgaagcgcaaatgtacacttcaatcaggccatcaatgaggtggaaacatttaggagctacaaaactagacaacatcatatatctatgtaagttatatatcaatatatgcttagaacataactatgtcatgagaccaataacctcgaaagagaaattgaaacttagtgatacatagtgattgttcaaacataatcagggctcgtcagtgacaaatactcttgacagaacaaacagggcatttggtaaaacctaacctagttcataaagaattgttcttgtgcccccaaaaattaaaataaaataagaccacattgatcaacctcagtatccaacagaagttttcctatggtcgtataacttttaggataaataagctcgcaagtcgcaaccaaaaagattattagtagttaacaaataagatgatacgggcttgaagatgactcacgggcaaggctctcggtgtcgtcatccagccgcttggtgttgagggatgtgccactggacgccgccttgtttgttccagcgttatctgtgcatagatcaaacagaaagaatcaatatttaagcgaagaccagaataaaagaaggatctttgaacaacatatagatcgaacaaaaccctcaaaatcagacatcaactccgcccaaaaaaaaacgaaatcttttttcccaaaaagagtccatcagtaataagcccaaaaacctataacctaaaaagaaatcaacagaaaacaaaaacgaactccccaaaccgaatcgatcgattccctctgcaccggagcggcagggatcgatcaaatccagaagaaaaatcgcacccaaaaaaaaaagaaccccttcgattcaaagaaaaggagagggaaaagcgaatcgaatcaaatcaaaagaaaagggtaggagggggtgggggaggcagtagtacgcacacttcttcatggtctcgatctcggcgccggagcggcgggcggcgttgacggccttctcatccttcttggcggcggcggtgggcgccttcttccgcaccaccaccggctcccagtcctgcctgatcggaccaatcccggccatctcgacgagacgacaagaggaagaacaagatgaacaaagaaagggttaggggatgaacgaacaaggaagaagagaaggttctggagtcgcaattgatgggcacaccccccaccccacccccgggccgggatattatatccactgaacgcgtagagtccgtgaccctgacaggtggggcccacctagctttgggaatccacggtgggaccggcacgacaagtct

SEQ ID NO: 45906 - DNA, 2474 bp, Oryza sativa
caatattgtcaaaatatataaaaaatggcatcaaccattatcaagttttggtagaatttcttatatatttaccaaagtttagcaacaaactaaacgtggtatggctaaaaatggtatcaatctgaccagcccctaagcatcatgttttgagattaataaaaccattacagacatcttgttgtcgatataaacattatttacctattaaagaatagttagagatgaatacaagtggccaagattgaaaatgaaagtcataagttttttcttcgcaaacagtttggttttatcatgtgctcatgatcaagtcacgggtcatggtaaagtcataagatattgttgatgcccaagggatagaacttgacatgtgcaattctaattgcgcaggataatggtttccttagcatgagcagtgataataatgttattagtattcaactgctatactcaagtcattaacatttttgttcataaaagtggaaagatgcttccgtaaccatcaaaaaagagaaaaaaaaaagaatcgaaaaagaaattgattccgtaaggaatttctacactggcgtcggtagcaaaggaaagaaaagccaaaaattcaagagaagtataatagaatctgctttaggccacttttcgtaggtaccattaatttgggccagctctacaaatctgtttgggccaagctgagccaaagcacaaaggccgaagagagaaggaataaatctacttcacctccctcagctcttgctcctaattgaatcgtctcccacaaccgtaaataccggctataacatctccccaatcttcgaaaaccagatcaaatcgagttcctcgactgtttgggtagcggtttcgtcctatgtggctctcatatgggagtcatcggagctagtgaagttcgtcggcgtctagtgacatgtgggtcctatgagtgacacgtaagacaaacccgctattcaaacagcctaagactcgatttgctctggttttcaaagattaagggggcgttatacccgctattgcggttgagggaatgagttgaaggatgcaaaatagacttatttgaagagagaattggtcaggctcaaatgccattattgggttcaaggcccatagcaaagtagacagtaccacaagtgaacagccgccccagtcgcaattacagtaactaaatgatgcctcacactttactgtaggatatatgttagatattggagaaatgatgaaatggtttagattgaaatattataaaaatgatgatttagcatgtatgtgtttagttttagaatgaaataaattgtagatataattactatactagaaagtaaccgcggaagtatatataggccagcacaattgaacgcggtttatttaattatcaagtcttatcatcagctaaataaagcattaatcatgttctgattggcaagctcatattgcaagcccgaaattcctcagttctcctcgaattacacgattcaaagtacgaagaacgtgtcgaatgaattctttttctttagaccaacaatgcaatttttactctaggtacaagatatacctgtatactccatctcgaatatatgcaattcttactctaggcagcctatacgttaccctgctcaatcatgactcaaaaaaagttccgagaacatgcaattaatgcaacaattaatcatgtttgtcattagtaaatcaaatacaatatcaaccacaatgctttgagtaagtaatagctctttgttttcagaaaatccaagtttttctcacacttgaaacatcaagctattaaataaaggtgtagttaattacctggcgctattcatctcatcccgaaatctgatgaacttgtagatatgattgctgcactggagacggcaataatttttccaaaaacatttgcaaaaagaaatcaatagagcgagacaatgatgtgaacaaataatatcaagaagcaagaaagggcagaacttaaggagtgcagtaaataattcatgtacagaaatcaatgaccatatggtaattgaatgaccttggatgggaacattttcactttctgcattggacattgaaagatcattgtcttgtggtagccctggatgaattctactttgttaaagcataaacacaaatccctgtagcaaaatcagagcaacttttaaaagcttatctcagtttgagcaacacataagatgcgcggctagtcacccccctcccccaccgcgcgactggacacgtggcgtgcggagagggggtggggggtgaacagtgtgatttcctttcttttctttccccacttctttttggttttttatacaaattttgtatacaagtatataaactttgtatacgtgtatatattgttttcgattttttatacgcacatatacaaactttatatacgtgtgtatacatataaactatatatattgtatataaatacatatgtatatattttatatacatatgcataaact

SEQ ID NO: 45907 - DNA, 3903 bp, Oryza sativa
tttggatgagggagtatattttattctctctagtaattatggagttagacttagggcctatttaggggagtttaagattctactaagcagctgcttggtagtcaacttctaagaatatggaaaagctgggtttcccagcttatggcttctagttcatttcttggattctacatctatagcttctcagaatctggaccaaaagctgaattgtttggaggagcttttgattttgggataagctgcagcagctagaagctctcccaaacaggcccttagaatagtcttcggtcctctagtcttctcggagattccggtatgtctttagtaccttactcttctattaagactattagtgttcatagttcatatatagtccattagtcatgtgttcaatgagtagattatacttcatctatatgcttcacctaattaggctagtcgatctatgctacaataacggtgcaatgatcttaacggattgcactagttttaacttgtccaccgaagggtgggagtcatggagaaactagtgacattatttattaacataagcatggtgtgtatgttagttagatgccattggatgtgggtatgcccccacggaaagtgaggtaggcaacaagtggtgatagctctgtccgtccgttgtattcctccacgttcaggtatgatgtaagagttcgtaaaatttcacaaccacactggcaaactagcatggagtggcttctcggtagtacctgggtgtctagaattaaattctagccttgcaagcatgtatgtgttcagtgtaaactaaacattaataatatagaagtacatatgaaccttggctttctatagttcttctccactgcctagtgtatatttataagagataaatctcctgtgtgtaattaaacccattatcatttatcaattaacccatatttagactatggcggcgaagcaattattgtttgaactatatctttacaccgccacattccccgcggaaatataaatacggtatccttggaatactcctaagtgaaatgctacaggagtatccgtgcgcttgctgatttatctgtggccataagaaataccaacaaatatttatagcatgttgccaggagaggcactggttaaagatttagtcacatatattcataatcatactatgattagtgaaccttagtccaaacaagttaaccttgatttgtcatggtcttccgtgcgtgcatctgcaccatgcttcctccgccagcgcacatgcgcgcgcgcatcaggcatcaccctacaaaggtgttgtttagaaatgtattaccactcaagtttttctttaatgtactatatttttttcctccaatacactcgaaagttgtatggtattgaaatattaatatcttatttggcatggaagttttggtatcaggaagagaccttgattgggagatctttctgccatctatatatagtaatagaatacggaaaatatactagaaaaaatctaaatagcctaggttttttaaattttaactagctatagttactcaccaattgtttcttgtaatctctactttccctgtacaagacctgaaccgctccctttacgttcctacgattaataattaaatgtgcacttcacaaagtgtctttggaggggcactccaataatgatcggttgtgttctgtagcaggcgtcatacgccatgcctgcgggctgcaacttgtctatatagttgcatttacaaaacagatgggacggctatttacgtaggcaatccttccaacttagtagtggagattgacttcgacatggcgtatgcatcatcaatatattccaaccttcgaggatgactacaatatttcaactgccatatgaccatatcctagttttaaaaactcaagttgtcaaaaccaacttcaattcatcatagcacaaagaatatatcagcaatacacgttatttagatatgcggctgcccagcctagaatacagaagatgacttttctcatgggtgtgttttatgcgagatgtcaaaactcaaggaacttaagattgggacccatcaaatggtggtgtgtatgcatgttcgtcttacatctgttccgatcggaagaaaagggaagagagaaaactcaagattggggcacatatattgatagcgcaaatggaaacgcttcgacaagtgtatagagtagtacatttgtgtggcagttgtaaaatctctggggagaaccttcgaatagaacaagtatcctaaccaagttcctccagctagccagccagttggcaaagtgtgtggtgactcggcgcagtcatatagtccacggtgaatggaaatgttcgcatgaattcgaccgacaaatggacaaggcctcctttcactctctttgatgtgggcattcgttgggcgtttgtgcagtgtgatttgggaagaatggattattcaaacttggctagctacagctgataatgagagttttcggtttctttgcctagagggaatgcattgtgcaaaaaaaaaaacaattttgagtttttctaagggtgactgaaatacatggtggacgtggtcacatgcaaactgaaattgtgctcactttgtatggaggatagaattaccaagacactgatgtaaaacatgattcactacacctttagttcattatcttaaaaactaatgtttaactcaatcccttcgttcatgtcacttgctgattaaattatactccctctgtcccatgttagttatccctccaaagtattacttatcatatcaatcacatctctttcaaatttatccctattctatcctcaaccacccttttattctcaaccatgcattatttgataagggcactataatcttttactctaaacctatgcatatgccaaacaatctagaatactccctccgtcccattttaagtgcatttgcggggttttttccaacgtttgaccatctgtcttattttaaaaaaaattatgaaaaaataaataaaaaagtcacataaagtattattcctattttatcatctaataataataaaaatactaatcataaaaatttaaataagacggacagtcaaacgttggatacgtatatccacaactgcacttaaaatggaattgagggagtaaaaagtaatagtaaggtttaaagtgttatagataacaaaaggtaacagcaatcatggataatgtttaaagtgggtagataatagccatgcattacacatcgattcatttatactttaacaaagtttgtctggttttttccgataaaaggccagaacacagtttatcacgtgacaaccaaattaacttgaatgactctagaataaacaaaattatataatttccttagattccgaaattaattataaaatggagtaatgtccatctgatatgcaagaacggaatgagatatattatccattaatagcaaaatgcctaagctttgctatgggcagaagaaaaaaacatcataatatgtcatagtaaaatatattcttttatcaaatatcttagtatcatttgtttgcttatttgactatgtagtatttacttgtttgaatcaaatgttagactatttcacaatattagaaaaatatataggggcaatttgtaaaaactgtaaaatcaatagtgggagtgatatattcaccaccataccactggatgcttttaaaggagtatatatatgtatgcctccagcaccttaattacaaatctcaattatttcataaaagaaattggagatgttgccttctccatgtgtaccctggacttgaaaagtcaacagatctcaaaataggaagatataggacatttacaatagaaaatcataattcacgaagtagatgattggatggaaatagagccaaaaaaaaaaaaaactctagggaagcacaaaa

SEQ ID NO: 45908 - DNA, 9074 bp, Oryza sativa
  unsure (1)..(9074): unsure at all n locations
tttatgttctacctctgtttcaaaatgaagatgttttgttttttttaagtaaaacttcttcaagtttgctcaagtttatagaaaaatgtagtgacatattcaacaccaaaggagtacttcccctctgcaattcctgatgaccactattaaaaatatttttataatacgtttgtttagcattaaaaatattgctatggcctatggtttctataaacttagccaaaaagaagtttaacttagaacaacactaaaagaatctatattttgaaacccgggagtaaaaaggtagccttgtttgaatttcttttagcaaactattcccttcaaattcatgtgatttttttgtgacgttaggcgatattgttatacccttcaatttcatgtgattttttttgtgacgtttgacaatactgttatcttatatagatcaaggttatcaataatggccactcatgtattagagtggctgatcagctttcgttttcgatgtgtcaatagctttggcacatgatgctccggttgcatggctttttgctttagcatgcaacggctggctactatttgctatggataaatttatggtcggctatgcttattttgagaaaggggtgtcaccactcaccactattaggtgttctcttgtatctttgacagagtgcacattattaaaacacaggttgattaattatagaacatttgaaacttaaatctgaaagaaagaaaatctttttatttactactaagtgaaaccttcttttaatataatttgaaaattacacacaactagatcctttctattaagaaaaaccatttttgtttatgcacaaaattaactctgtttttcccagacaaaaatgaattttgtttgctattagggggcactacaagtaaatgcaaactcatttctatgagatagccttctgtaaaactaaaattcaatacaaattttacaagtattgtaaatttaccgctaatatccgacttccaagggctcctttgaatcgcatgtgaaaaaacggaattatatgaaaacatagcattttgacatgaaagcaaatgcaaaatacaagattacacctaggaatcagatgattgaaacttacggctccatcatttcgcttattattgaatatttgccaaacgaaaaataatttgtgaatagaacttttatatatgtgttcttagcgacctaaagcaaaggatgaaaataaacttcactgaaaaactccaaaaacaactccaaatttaagcttgataatttaaatttcgactgataagcataattataagcgaaaatataagaccgttagaaggaaatttttcaagatgttacaactctgactaacttcctttcaaaatctctacatgaatgttccttctataagaattccagagaaaatgagagtgctgtagaattaaaatcctcctatagtataaataaagctactttatgtgcttatatttttttttctaaaagtaaatattaaagaaaatgtcttttgtggccctccaaccccaatgatgcccattgcgagggttttttttttttatatataaataagcgacccaaccattccccgggagtcaaggtggaagagacggacagaggccactacccgtgcaccacgccccctctcccacaatctcgcaaaaaagttgattttctttttcagcttcctcctcccctcctccgcttctcatcaatccactagcatatcagatcagattcctgtacacttccctttcctcgcatccaatcccgactatcaaatcatcaccatccttttgcaaaaccaaaaaaaaaaaagtagataaaagaagaaggttcttgcatccaagagaggaggacactgtccgtcgtgcagcgtttcttgcttggttgaatcgggtggttttgggggggatggcggggaaggtggagaagatggcgtcgatcgacgcgcagctgcggatgctggcgccggcgaagctgtcggaggacgacaagctggtggagtacgacgccctcctcctcgaccgcttcctcgacatcctccaggacctccacggcgacgacctccgcgagctggtatgctggtgctactctctctattcgatccccaatgactgattaaatctttttcatcatctgctactcctactctgctacctgcatgttcatgctccagatcagcagataatgcttgcttgtttgcttgctgcctgcgtgtgcgcgcttgtgaatatcttctttttttttaatggagtgatttggttgcttgtggactgattgactgactcactcactgaatgattggattagcttttgtgagtgggattgtggggattctgtgcttcagcataattggaacatggagagtgcccatgtttttgggggtgctttctgctttttctttattttaatttgggggtaaaaaaccaaaatattccaacagtttcttcctttattttttagtttgtcggttgacaagttggtgcttccagtgagggtactgagtggagttttcgttctggggcctgcccctttcttcttcttcttttttagagtattcggattatgtttctgggttaaaatatgtgtttgaattattgtgttcgtataatggaaattcagaaaaaaaactggcatcttttgcatttggagctgttttccaggggtgtatgtactgaaatctgaatatttactgtttgagtcaaatctgagctgaactttaattatctatcctgaattcctgattgattaacaactgccactttgtataaacaacagtttcatagacatccatcgtaactgaacacttcatttttatcaaattttaagcagaggaagtcaaagacatgggtgtcaaatgtttgtgttttttatttttgttgtttcgtcaaactgaatgtgacatgtactcattagttggatctttaggatatcaggaaatgacaactgtatattaaaagttttatattgacaaaccaacatgaattctttggtattgctagagccttgcttaagtacttactcctgtgcaaaaattttgaggtttagtgccctagtgtgctcaggtttggtgcttttgtatttgaagtcttcatttgcagacgtggctgcaattttttatagaagggtaaattgtgaatgaaatctgagttgatctttaattgtatattctgtatatctatcaaccactttaatgattacaacaaaaattccagctttacatgaacatgccatgaacttccgttgaaagtgaataacttggctttgtcagttccccgtgtggccaatgttcatgcacgagactaatattgaatacaatttgttttgtcaaaataaactgatacctttgttgcagacccttccatggatgtatgacaaggaattttttttttactttgatgtatagtcaattagtttgatttttttttgttctgaattgattggaaaataatgcctgtatttacaattttatatcaacggaaaaaccatggattgctaatttgttattgatatgtgtaggtccaagaatgctatgagatcgctgctgagtatgaagggaagcatgactcccaaaagctcgatgaacttggcaacatgttgacaagcttggatcctggtgactccattgtgatggccaaagctttctcccacatgcttaatttggctaacttggccgaggaggtccagattgcatacaggaggagaatcaagctcaagaagggtgactttgctgatgagaactcggcactgacagaatctgacattgaagaaacttttaagaggcttgttgttgacctgaagaaatcaccagcagaggtctttgatgcccttaagagtcagactgttgacctggttttgactgcacatccaacacagtcagtgaggaggtcactgcttcaaaaacactcaaggtgagttacagaaacaatactatgatatcaaacatcctatggtttcttatcatctaattgtgaaatttcaaatataatttaggataaggaattgtttggttcaactatactcaaaggatatcacaccagatgataaacaggagcttgatgaggctctccagagggaggtaagataatcaagttaatcactgactcatttatagtcttgattttttttttcaaattgtatgtgccttttcgattatttatagaaattataaattactttcagcatgatgctcaacatgccagattttgtgctccaactaaatttattaatgcattaataaggtgaatcagaacatgttcttatttttcagattcaagcagcctttagaactgatgagatccgaagaacccagccaactcctcaagatgaaatgagggctggtatgagttactttcatgagacaatctggaaaggtgttccgaagttcttacgccgtctggacactgccttgaagaacatcggaattgatgagcgtgttccttataatgcacctctcattcagttctcttcttggatgggaggagaccgtgatggtatgcaaaggatggcttttgacttctgtatagttcagttcttgtgcatttaataattttgtgcattgcaccaatttaggaaatccaagagtgacaccagaagtcacaagggatgtatgcttgcttgctagaatgatggcttcaaatttatactgctcgcaaattgaggatctcatgtttgaggtaagaattacttcatcccttatcttccacacatataaatcaattttattaaattctccaaattctggcagctgtctatgtggcgatgcaatgatgagcttcgggcacgagcagatgagctgcatctctcctcaaagaaagatgcaaagcactatataggtaaatatcgactacccattttaatagtgatggctatctgttatgattgacaatgttggcataatatcgtttccttgttcgtcttagaattctggaagaaggttccgcccagtgagccataccgagttgttctaggtgatgtgagagacaagctgtacaacacacgtgaacgagcacgccagttattatccagcggatattctgacattcctgaagaaaccactctcaccagtgttgaacaggtaaagtattgatcaaagaaccattggatgcttgtaactctgaaatgggcattctttcttcatcacctttgttcttaagtctaaacaactgtcttaccttgcagttcttagagcctctggagctatgttacaggtcactctgcgattgcggtgaccgtgtaattgctgatgggacccttctggacttcttgcgccaggtgtctacctttgggctgtgccttgtgaggcttgacattaggcaagaatctgacaggcacaccgatgtcctcgatgccatcaccacatacctgggaataggatcataccgtgagtggtccgaggaacgccgtcaggactggctcttgtctgaactcaatgggaagcgcccattgtttggcccagaccttcccaagaccgatgagattgctgacgttctagacacgttccgcgtgatagctgagcttcccgctgacaattttggggcctatatcatttccatggcgacagctccgtcagacgtgcttgctgttgagctcctccaacgtgaatgccatgtgaagacaccacttagagttgtcccactgtttgagaagttggctgatcttgaatctgccccagcagcagtggccagactgttctccatagattggtacagagaaaggataaatnnnnnnnnnnnnnnnnnnnnnnnnnnnnnnnnnnngggtaaggacgccggtcgtctctcggcagcttggcagctgtacaagtctcaggaggagcccatcaacgttgccaaggagtttggggtgaagttgacaatgttccatgggcgcggtgggactgtcggaagaggcggaggtcccactcatcttgccatcttgtctcagccaccagacacaatccatggatctctccgggtcactgtccagggtgaagtcattgagcagtcctttggtgaggagcacctttgcttcaggacactgcagcgtttcacggctgccactctggagcatggcatgcatccaccaattgcgccgaaaccagaatggcgtgctctgcttgatgagatggctgtggtggctacaaaggaataccggtccatcgtcttccaggaaccacgctttgtcgagtatttccgccttgtgagtgttttgtttcttcataatcatcagacttggaacatttcatataatgcatttaaggcacttagctaaacattgttcctttcaggcaaaacctttgtaaattaattttctttacattttcatgaaatcaggcaacaccagagatggagtatggaaggatgaatataggaagcaggccatccaagaaaaagcgagtggtggcatcgagtcactccgtgccatcccatggatcttcgggtggacgcaaactcgcttccaccttcctgtctggcttggcttcggttctgccttcaagcacatcctggagaaggacatcaggaaactccacatgctccaggagatgtacaatgagtggccgttcttcagagtcacgatcgatctggttgagatggttttcgccaagggtgaccctggcatcgccgcattgtacgacaagctccttgtctccgaggagctatggcctctgggagagaaactgagggccaactgtgaagaaaccaaacagcttctccttcaggtgcgtcgactgaccttgctagagctgattacactttggaaaccaatgatgcaacatctatgagatactgaaatgttccattgtcattcactcaatgaaattctttggccacttttgaccttcaggttgctggacacaaggatcttctcgaaggtgatctctacctgaagcagcgccttcgcctccgcaatgcctacatcaccaccctgaatgtctgccaggcttacacgatgaagcgaatccgcgacccggactaccatgtcacgctgcgcccccacatgtccaaggagatcatggactggtctaagccggctgcggagctggtgaagctgaacccgaccagtgagtatgcgccggggctggaggacaccctcatcctgaccatgaagggaattgctgctggaatgcagaacaccggctaagcgaactatcaactatgaagtgcctgaattcacaccgttttatatggactcttatcttgatttcggtcatttgctctcggccatttaattttgccgatgcagaggctcgtgcagtttctaatttctttcggaagatattttcaataatggagttgtacaagaacatcaattaatcaaaataaagtggatattatgttcattatcgtttagagcaacctggtaaagccatttttttgtgtagaccacatagtgagtgtgttgaaattccatttgcttaatgaaactgccattatctaagtaaagtcaaagggctcctttatattgaaagaaattcaaaagaattttgaaggattacaaacctactccctccgtcccataatacaagggattatggagggatatgtgatacatccctccaaaatattatgggacttcttgttcaaattcataatattagaatgtgtcacatctatctactatatactaaaagtccattaaacttcctagaaacgctatcaggtcgccacgtggcattcctacaaatactcttaagacgccacatggcactgtttaatctcaccgtcgattttcacttaaatttgtggacccattattttacatcattagattagatctattattaaaaataataataaatttctcctatacttatatcatacacatagtataactgttctacgtgcgtacgattgaaagcaattacctactgttcacaaaaagaatcatacaaagttagataaaaaaagacagtcaaaatacatgcatccataaaaatcgatggtcaacagacatacgtaggtgagagagaggacaggaagaaattatttattcaatctaatctaataggttaaaacactaaacccatcgatttaaatgaaaatcgagggctatgtttgtttaaaaactatctatctatctattatatgctaaaagtccattaacctttatacaaacacttttaaatcatcatatgtcacttctataaacactcctaagacgtcacgtggcgttctaataaatcaaagaaaatcataagaattctaataaaaacaaaatctaaccattgattttcctttcaataaggtggacccatcatgcattctctaccattagattcatcttaataaaaaaataagacacggaaaagacccatgtttttctaaggtggactcggacggtccatcatgctataccgtgcgtccggttacgagccggtttggccgcggcggcaagtttatcgctaattaatttatctctgtatatacgtagcacaagctaagattaattagctcccatattatgttactactaactcatagctatatttattatatatacgacaatatatataaatggaagctaggagattaacactaagattatacatatatagctaattaaattagttatacatgatttgtgaaaggagattaacggcaatataacatagctaattaaatcagtttgcatggtttgcggcaacattacatagctaattcgaaccaatgcatttggcagtctctagataaattgtccagcttaaatcgttgtatctaagatctgatctgttttaagtcatcgtgatgtctttaaaatttaaaaaagattttttaaaaaacaaaatgcatgataatcggttttaacttaaattgtttagaaaattagaaaaacaaagtcccctccacctcaccctcaccatcacatacgcacaacacttttcgccccatccatttttggcttgggttctccactctccacttctctctgtatcttttggagtagcaatgataaaaagagaaacaaccaataatatcgaaacatccacagttatattaagctacatgtcgcatatctattctaattgttgatctatacataattaaactaacaaattaagattcataataacttgtataaaatagaaaaaaattatcaatag

SEQ ID NO: 45909 - DNA, 2171 bp, Oryza sativa
tctaccttatttttaaataactaggaagaccgtaaataattagttgtatagatgaattaagtactattatatagtataaagctaacagatagcttagaaaatttatttgagcaataccgatacgataaagaaatttgtgaggaaaacgaacttacgaagcatggtatgtgccatctgtttgatattccaccgatataaattcatcaaaacgtaactatgatacatgcccgcgtgtatgtacgggctaccttcctagtttctctaaaatctcttatattatgaaacggggggagcataattttttcctatgtgtcatttggaacaaaggatttgatcatgtcaaattctctattgtatgcaccgaaaaattaccatgagctaaaattctcattttatttttcttttaagaagtccaatacagaactctttgtatttcctctcttaatccatcaaattcctatagttatattgaaccatccaaaaacaacatacctcaaattcttgtgttttgaattcctatgggacttatacatcccaacattctaactatatttttttctgtttctagtattcttgtgggatttatacatacgtgacattctaatcctatttattgtgttcctgcgtttctcaaatcagatcctgcattttacagaaaccctactaggaagcttgtttatgatggagctataagtagatatcatgcttataccattcgacatgtacttgtcattgatccattcatttccacaggctattgacattttcctgatacttggcataattaatactctgaaaatttttattgtaaattgtatttgaacaacaactattgaatgattttcttttaaacatatgtttatgggcatataaatgttctttttacagttaatagtctaacattttatcaaaaaaatacataatttaatttttcaatgttcttgaaatgatagttttattaattagttcaaaataaagttaataatcccttctttctataaaggtaatgcccactaaacacctaaagctcaacatgcaagcacaatatttattagcactcctaaaatctatatgtaagtacgtcacatcaacttattaagcacacaaaactcaacatgcaagcatatactgtagtaattatatctataattttttttcattctaaaactaaacatatacatgctaaatcatcactctcaaatcattttcaaaatatttcaatccaaattatttcatctagttacataatgcatttaattatagagttcatctaaacgtcgctgtttcggattggattcttgttttttcccttatatttacgtatttgtttggcatagctatctgtgcgcattgaatttgaaatttgtaagttaaaatataaaaatttgaaaatttatatttcattaaagtaggaagaaatataatttttcctcctactttaatgaaatataaatttccaaaatttttggatagctctcacttataaacaagtatacacataataatagtatggtatcaccgtataagaataaatggatgacttgcaacggatgatatgcaattaatgttatattagttattcaaagctatttgtttaagtatgcaaaatatgcaaaaccactatccaaaatcatcttaaagggtaatatggatggtattataaagttcagggggttagatatccggttttaaagtttagggtgctaggtggacttacatccaatgtttataggggtatttagattttttttatgatttattaactagtagtagatttgaagttcttaagtttaataagtttattagtggagtcatatctccacccacataagcaaaaaaaaaaaatccaacctagcttttagcttaagggcatcaataatgtatatagaccaagtggtctttattattcccatttccacgatgtatatataaatagtaattgacattaagaatgggacccacactctaaaaaactttatatccaaatgctatagttctcttgtagaaaaagcaaaaggagggagatattatattttaatttatatggatgatccttatagctatgggtagctgatcatatgactctttctaatatcatctctcacaatggcaaaggtacctatataaagttataaggatggccttttgtcacattgtgaatgccctaatcg

SEQ ID NO: 45910 - DNA, 9748 bp, Oryza sativa
gaattcctgcagcccgtaaaagagagtggcttattgctttaaaagaccaaacaaaaaaaactgtttgtttgtttagatttaaaatattcagctcataagctagcttataaaactaaacaaagaaggccagttaaacaaagcagagttactgcgagaaccaaattctatttcttataaaactttggttacctatgtttgggaaacttctgacaactacagtctttttttagagttcagctatcaaagtccctgaatagtttagatttacattcaaattctgagaaacgttattatagttataaaattcagaagatgaaatccaatttcctcatattctcaccgtgcctgcgtgccaagcaaacagggtgtagaaaactagaaaccctcgcaaaccccagacgcgttgggcgtcgtctccctgcgccgcctcccctcccttctctccccattccgcatcctccctcctgcgcgcaatcgcttccaggagcccctcccgccgcagccgcagatggattcctccgcctccgcctccgcctcccccacggcggcggcggcggctgacgcggaccggtacacgtacagcccgaggctgcggtggcagccggaggtcgaggagtacttcgccgccgcgtacggccgcgaccgcttcgcccgcatctccgaagccctcgcgtgagccgccccttccccctctcttgcttcattcctattctattcattgatgaatgggtgtgccttaacttttaggtcatctagtgtcttggtgttgtagtttgttgctttcctcgatttagacaagctggagcaaattctgttgcgtgcagctccaaaattttgcgcgcgcttggtcctgggcagagcggccattgcttgttttatactttgttttttctcagtttagggaacttggagcaaattctatccgaacagatgctctgattaacatgaaaaggattggctgttatgttatcctgtaactggtttagtaaaatgattgctcgagcggagttcgatcaagctaaaccatgctagattctggagctagccaaaccaagtatgattcgaattgatgtggcaaagcgattacaattagcaaaaggagcaaattccagcttccctccaaaaaatgaacactgcttaactgtaaatgctgtctcacgattatttatactcgttttaactttccaaaaaagttcttttcatttggcatttttcaaatagttgtcatgcaaaaaagcttgaactagtgcttgagaatcttctggctatcaggctatatagtgctaatagcacagaatattgatttgttagccgtaattattacatatatgacccatcatttgataaacatatcttatcacttttaaacaaaaggggaaaaccacccgttgctactaccattggattagcgaaggatatagatttagcttttgcgaagtttgcacccatttgctggattgtttttacttctccattctttttctccaaatttcatgctaatcaacacatccatcagagaccatttctagatttgctggattatgccatctaatcaaatgtaccatgtttcaatcagttctggtacttgcagttgctattttcttgttctgaactttcagcttttaaggacaatgtcttaatactcaggcaaatgatttgtgtacgaacaaaactgcatggatgtacttgattggatttacttagtgataaattctctgtggttccaaggtggtgaacaattcaaatgtttaggctggagaaaatgattcaaggaataatatcttggagcagcaatgcgtcaatctactagtgtttttttcgtagaaattgataagactcttagctaaagactgttactggttgttgacttatctggttccatgattttcatttagcttcctttttcaatgtaactaaagaacatggttttccagggaagagatgaaaatgaagaggcttctgtgatattggaaacgacaatctttatctatgctcacctttttattggattctctgttcttgcatgtctactataaagattcttttgctatgctcacctactcagtagttactaactacagatcagtgaaagactgaagttcttgatgacttgaccaaaacggtcaaataaaagattgagccagttctacagtttcatgctagtttccattataagtaaatagtgttaattttgtactaactattactttcttgattaggcatccttcttgttactcttgtattcgtgtcaatactctgaagtcttccactgatgctgtcatgcataaactgatgaatttggtagatcagaacggactctgtggtggaattaatggtttggagattggtcagcagaatggtggagagcaagcacatgaagggaattctgtggtgcataagtgcccatattctggccttgacaacgttttgtttgtacaaggttcaggaccacatgcactgcactacaatagccaacctgaccaatctattaaggaagtgattgtaagtcgaaaatgtgcagagtcggttcttagaggagcccaggtatgttttcttatgtttgtgtgtttgtgtgcttttgtatgtgcattatgttgagatgtaccgaaaaatggctagtcctagcataggagaataagttgtttcaaactttccgttgatcattctgtaattctttttttttttgctgcatcacctcaatcctatgtggagcatggggagtgctatataagtgtatgaattcactgtagtacttgctgttggactggatggtgactagtagccttcaatacctatcttgtttttttaaataatgcttttccgctcatgttgctgattgtcttttactttttccttttggatttggaaaattcaacatttcagttcgaggttgtatctttgcatgcttgttgccagttcatgctactagaaagtccacactcccaaatattttaactttccttttcattttctttatattcaggtgtacatcccaggagttttagcttgcagctcacatgttgaaaagggtgacaaagttgcagtgtcggttgctattgaacaacctgctgaggatggtggttggaccgttggtataacacgaggaactgttttacagggattgcagtcaggcaagcttttcaactgaaaaatttaaatcctttttgatagcttattgataaactgcaaatactctttttttttttctgtacttcatgtatgttagtcactgttacagttttaagtgtgaggttgttttccccagctaaaagtcatacacataacgctatgaaattcaattctttgcagatgcacatcatgaagaaagaaagggtttgtacattggtcaagggatcactgcaatgtcaaggtccggaatatttcgtgttcctcatggagttgcagtggagatgactgagagggtgtacaagctcccatctttcaatggtacatttacttctttgctgcatttcttggctatttgtatgtaacacgggtacaaatacactattgtatttcattcttttaatataaggatagaactggcaatttgataggtgaattattttcccccatatagtatgttgtgtgccaattcatgcaactaactttgaaagatgtgagatctccagtttggcgatcacattcatagctgacttctttagaaggagcattcattataagtagtcatgcatgggtttgacagccaccacgaaccaaacaatgaaggatatgaattagttcacgaacaaagtaattcctttatcttgtcatttgaattagactatttcttgaagatacagagttcagtgttaccgggacccgcgtgtccaaaaaagttttgccgcgtcgacacacatctctatgtcgacgcaggatgacatgcatcggacactgctagcgcgagtccaagtccaaaaggagagttgcaatcgctactgctgtgctgcagcctgcagggtgaagaaataaagctctagcagcagtcttgtagtgtggagtagtactactctactccgtagggataaagcatgtggggggagagagagcaggtggggggagagcagtgttactgggacttggactcgggtgtacgacttggcgagctctagaaaataagattcggtgactcgtctaatatatagaagttctaataaaaaatattatataaaataagataccaacacataaaatagttggttagacacaatactactgcacagaagatgccatttatatgaaacaaggaagtcaaaagtgcatgctctctgagaacagcatcctgccatctctcgtgaggcaaaagcctgtaaaactgcaaaaaggaacattatctctcctctctcccctagtgttaccgggactcccgtgtctaagaaaaatttgccgcgtcgacacgcatccccgtgtcgatgtgtatcagacgcgggacgacgcgcatcggacactgctagcgcgagtccaagtccaaaaggagagttgcaatccctgctgctgtgctgcaaggtgaagtaataaagctctagcagcagtcctgtagtgtgtagggataaagcatgtgggagagagagagcagtgagggagagaggagagagaatgtcctttttgcagttttgcaggcttttgcctcacacgagagatggcaaaatgcagcatgcacttttgacttccttgtttcatataaatgggatcttctgagcactagtattgtgtctaactaactatcttatgtgtaggtatcttattttatataatattttttattagaacttatatatattagaccagtctccgaatcctattttctagagtttgccaagtcggacacacgagtctgagtcggactccaactatcgagtctgagtcggattccgactcttgagcctgagtcacggtaacactgacagagtttgtatgcatgaaaaaaaacatctgagcttaattgttattaggactgtcagtgagttctgactgcaggcttgatcttggttcggattcggaggaaacttggtcaggcttgagcttggcttgtgtaagctcgtgaacagtatagcatatgtttcaagaacaatctcttgataaagacaataaatttattgttaatcacattggcaacaggacgaggactaagagaaatatgtgatgctaagctgctgtgtatgcatactaatttatacttgatctactagtttatcaaatacaaaaaaattgtgcgcacagccaggttggcgatctattcaagctcggttcaacaaagcctgagagcctaggctttggcttcggctaagctcatttaattttcatttcacttctgattgtagattatgcctactattgtggcctactgatcacatgaccacgcaaatcctcatattagagtttgggctttgcatattcttggtttgatgcatggtaaaaatattgcgatctctgcatagagccaaatggtatagggttgttgatgggcatccctacttttgaaggttgatcggttgacctcttctttgattcgaatttcttaactgaatacccttgttaatgcctctatgaatacttacatttttcatttcatatttgcattttatttatttagtattgactgatcttcaaatgcatgatcctaaattttgtttctttatgtcgtctagatgtgctcgaaggggagatatttcttcagaatcttccaagtgttgtggctgctcgtgtccttggtatgaatataatttttaagttagcaaaattttcaaatttatggcaatatggctgttttctgaaagtcttaagtcatcttttatctgatattatgtcctttgctgtgtgatgtatcgtatatttatgtggtagaaatgctgaaaatcttaggtttgaatatagttattgaagcaacaaataaataagcaaatgttactgctaaaagattgaactagcaaatgttacagtaattgaatagttgtcacttgtcagtttgtacatagcatatagtttgctgacttttctttctatgcagaatatgataaatatttttctttttagttctgaatagcttaggtcaaaattttacagcctaatttgttatgtacagtacataattttctatttatttgtagatccccagcctggagagcggattctggacatgtgtgctgccccaggtgggaaaacaacagcaattgctatcctgatgaaagaccaaggagaaattattgcccttgatagatctcacaataaggttaattcttatgtcagattgattatatgatgtcaaatggagttattctaaacagataaaatgaatatgagggaacttacctggttacgtttttccctgcatgtcgtgtctgggtcatggcttcatgaacagtctacaaaaggttatatactcagataaagacaacaaattgaagtgttaatagacttacaacggctataaaaatgaatataaaaatttattattcagccaaaacacaaagtttgttttagcatatgtaaagaacagtaaataatgtccctatgttttgcaatgcaatatggcatcttgtgaaattataatgtgctaaaagatatactacattttatcaccatcttttggctaatttttgttggttggaagctaaaatccataacatgcaagatggagcagcagcaacacttcttccagtttcttggccaatttgtttattatgtcttcttccagtttcttggccaatttgtttattaggtcatttagtgtagcatacttataaactattgttttgcatatcttatctcctacccttattgattactctctccatcccaacaaaaactcaacctaggataggatgtgacctatccttgtccagattccttgtcctagtataggccccatgctatcctaggttgagtttttttgggatggagggagtagatatgattttaggctaggtggtccagcttcatgcaagggcattttttttgtggggcacttaagggcatttgtctatgtaatttatgaaggaaatagaaagataaccccaagtctcctattcctaattacttttttctggaacatgcagaggaactggcatgtcattattttaagatgaaagacaaggccttggacaaggtcatggccctataacccaaactcaaacactaagtatgaagggaaacctacaagaaatacaaaaccaaccaaacaatcatgaaacagagctatctatctaataataatgcatcaatacaaatagctccaagccacaagagcatccttgaagttcttctagtctttcacttaaccagctattttggttatattccttcctcaatcagtcccccgtccttcacaaagtgccattttattaaagtaatcatcccccagacagatttttaccccttttttatgtactatcctgcatgccagcattcttctagaaaacccccaaaatatatttccacattttttagctgtatggaaacagaaactagttattatgcaacataagggtctttgaaggtcattttcatgtcacggtgtaggttgtttgaaggccattttcaaatcgacacattaggaaattttgtgtggcatcaagaactgagtaacacatgtactccctctggttccataattcttgacgttttggacaatgacacggtctccaaaatatatgttttgactttatttttctattataatatatgcaataaataaatgcatgtttacttttttcatagtactttgaaggacaaatttatatatgttgttctagttcctttaaactaaatacttttaaagttattgataatcaaagttacaaaagtttgacctcaaccttatccaaaacgtcaagaattatggaaccggagggagtaatgtgcaatgacgatacctataaaactaacccttttttcaatcatgtgctcccactttacatagggtgtatttttcatcttagaagtcatattactttgcactttcataatattgaagtagattacaggtgatggatattttgaagttggccgctgagatggacctaaattgcataaaagcttataagcttgatgcactcaaatctgtacggaagaccaatgaagcaaaatatattggcgaagcaggcagccgcactgatgcaattgtgacactggcagaggactctgagccttgtattaataaagtcgatgctgggactactaatgccagtgaagacagttctactacatcagttgttcagactggtaagggacatgcaaatttgtacccatttctcttcattttttattatttaattttataatggtgggtgaatgcgcatgacacaccctgggatcacttatatttaattttattatttattatttaaatctaacctttttttattactgaagttacagctattttatatggttacactttgcactttgcggagaccaactaaacactcagaacataattttccctaatagatatatgcacctgtgccttaagtatatgtcgttcttaagctgaattcagaaatttgataattttgttttgttagataacaaaaaaacagatgataaaagatatgtgagcaaggcagacctcaggaagaacttaaggcgaatgaggaatggaccaggaagaaataactgctcaggtggtagagttgaaaattctaaaggatttttgcccaatagctttgatcgtgtcctccttgatgctccatgttctgcacttggcttaaggcctcgcctctttgctggtgaggtaagggtattgctagtttgcctcaccatatttagagatgcggttggtcataaattgagaatgccttttagaattgcccttttactttgtctgtatgtactcgttccaattctaaatgtagattgttttagccttcttaactctttcctaatataggtcattttaaaacttgtatgcaccttgttcacattttcttgttttgccttgccaaataaatggtactactcccgcaaataaatgactcatcttttccaacgtaatataagtgatggacaacaaaatcttttcagttactttcttaatcctcgtgcacaagtaaaaagacttacaattggaacaagatggaggaccacttttctttcatttgtagaaaaggtgcaatgcaaatgataaacctatctttagcaagtaaacctacatgttcaggatctgtttctactctgacaatgggtatttatgtttagtgtccatactcttagctatgcatcagcacgcacacctacaatggtacattgggaaatgagttattttatcatgtgtaattcttttaacaaaaaatggatgtttttagtaaattaaaatattggacatccaggccaattatgttcattcataatttgtaatcaatattgaaaatgttaaccaaagattcgagtttaccatattttaaaataaaagaatggtatgtgtggcattatatgtatttgaggtattttaaagagtaaattgcattggtggtacacgaacttattaggtgggtgcaatttagtacatgaatttgtaaaatgcacgttttggcacacggacttatctaatccgtgcgaactaggtccaaaatggtttagcaaggttaattttacctagctgatgttaattaggatgtggcatgcatacgtatagtgagtatcataaaacatgctatatttataaatttattctctactttatcttgaattttgtatgtttctaacccatgcatcattgctcatttgcccggtattttatatctttctctac

SEQ ID NO: 45911 - DNA, 22656 bp, Oryza sativa
tattttaatatgttggttaaaattatctttgtaatgcttattctgattaaggaaacatttttatactgtaatgatatgctaggtacatgaaattcattaataagttgaaatttatcagcctatggcatctcatattctgtaaacctgtaccttgccatgttattggaatttccaaatatgtcatgttgtaataatcttctaattgttatagaagtttgatttgcatctttgcattccaccaagctcaagtatttatcattttatgagttgctacaacttctaatatttagtgcatttcaatgtggcaggaaacgctggaatcactgagaaatcatgcgacgtaccagagaagaatgtttgatcaagctgtcaagctagttcaccctggtggggtgattgtttattccacgtgagtgttcaacattttatgttattactgtgtatgagaacaaaaattatgttactaagaaagatgttaaacacacacacgtgtgtggtaatcagatatccattctatttgtacttgaaattgcgataaactacagagctctagacaaacttagtgttggatccagaagagtagtgttcaacggctatagacgtatcagtcgaggatattacttactgagcatagctttaaaattagataccttctgtattccctaaacccaatagtaggtctcccctttcctctgtttatagattgtacataaataacataatccagatttcgtgtacagtacagttagctagctgatgtaccagtactaaagaaaacataataatgttgggcatgacattctagtcatacatgcacattttgttggtattcaggtagtgaaacagtcaaatttgtcccatctatatgtattgatcggtatttggtggaagctttttatgtggtcattccaaaaaacacataacttacacggttattctatctggaatctacaattctacataccatttatcctagttgtttctgctttgtaggtgtactataaatccaggagaaaatgaagctttggtcagatatgcattggataagtacaagtttttgtcgctcggatcacaggtaagttccatgatgtaatttgctaaattgctatggtgaggatttttaattagtaatttattagatggagaacttgaaatgtaccagccaaattgtatgttttacaaattataattttgttcagtttcgttacagatatgatgactaatggattgatttgaaactgatagatctcactttagacaaagttgaaccaaattaaagtctgcacatatttaatcttgctcatgcacttctgtgacaaacatgcctttctttttcctaacttaggatagtaaatacttgccctatctctgcagttacaatcaattatatttgttacttttgtatgctctataatttcattgtcattgttaatcttttcagcacccaaaagttggaggacctggtattgttggttcatttgagcgatcaaccaagaaatatactgagtaagattcttgctatatatttcttggaacatgggacctgaacctatccaatttctgtgattatgttatcgcacacctatctgaaaacactgaaatacggtattatgccataatttaggaaaacttgtatgtaacggaatacggtagatttggattgcatcacaaagtaatgtagttttgtaggaccgatatctgctatagaggtgggtgaatatagcatcaaaaagttcttccccaaaataatcgttcaaaaacctctctgaaatatcacccttagaccatagttacgtgacaagctagatctaggaggaggtgaagaaaagttgcaaagaaccctactcagatgagggctttaccctctcaaaaacttctctgaaatatttccctcaagactatatatgacaagatagatttaggaggagcttaaaaaagctgcaaagaatcaaagggcctttttggggagctttaagattctgagaagtagctggttgatagccagcttctgagaatctaattcattttctggattctacaactacagcttctcagaatctagaccaaaagttggactgtttggggggagcttctgattctgggagaagctctagtagctagaagctccccaaacaggcccaaagtatctcgcttaaacccacaaaatccccaaatccttcgcctccctcattgctattccgtacttcaccacccactgctccctcgtcactacctcgtacttcaccgcctcagtcgctaacctaagccatcgggggagaaaggcgagggattttgtgggtttcagggtggtattgtagtgcgaaggggcaaatttgtaattcttccaccactcttctctgcggaggggctagctgtaaatgtgttgcctacgtggaatgccacgtcggtggttagctttggtcaaacgagatttggatcggctatggttcattaaaccaagattgtggacctggatgtgcaattttcaagtttacggacctaagtgacacccgctctcaagtttaaggactggccatatattttactcatttgaatttatttatgcagtttaaattcccgtcatttaaattccgcagaggtttctgcttctcttccttcctgtttcttcgtgaaccctatgcttgcacaccaaaccttgtgaagcccgttgcaaagatcgccctacacggtgtacgtccatcgtgtgccaccttgtgtccaatcttgtcacccggcgtactgatcgttctggaccccaactcctctctgtgtttagtcccgatccccgccactgaccaagattgacctctaaggatcttaacttcagttacaccttgtcacatggcatcccgatcgtgctagacctctgctcctcccttagcataattctggtcctcaccattgaacaaggttgacctaaatcacctgcacacacatagactaaacaactgattttgggcacaggggaacctgacccacgttagtcgcacgcaagtccataatcgccaacattccaaactaaatttccaaccaaaaccaactcgtggtgttcccaaattccttgccaattttccaccacaagtaaaccaaaacaacacttggtttcacaagttcctgatgagaataccattttgcatgcctaggcattagcaatctttgttagcttgatgtgttgtccttgtacaagagaactgtttttgccaaatgagctggtgggtcaatcaaactgatggatgggccattttaataatcctatcgttatgtgctatatggataataatctccttgctatttgctactgaaactatgtttttactttttccccccaacagtatgttgaactgatagaatgcttatgcagggagtggttgacaaagcatgaatcacaacttgtccagagattcgatccatcatcaactctggatacaattggtttcttcattgcaaagtttgatgttgggcagaaagacgactgacgtaaggggttctcttgagcattctattttggatcctacactctgaaacttgctgttcctgacttcaaatatctcagcattaacacttgctgcagttagatcatttcagggccccaatcatttttcagtatgaatgggaaccaatatcccatatctggtttcccagaaattttgtgctcaactgtcaatattaaattattctttgtccaagggattattgtttgttgtaatgaaatgccaagggtgactggttgaaagtagaaacatttgtaaacccaaaatgatagggacttgagattttagatgttgggtggtggggatatggagctggaagagtggagttgtgctttgtatggcttagcatatttaactaaatcaatttcttttctatcacatggcagtatagcatactttctccgaggaaggtggtttctgacctgcatttttaagaatattcttcatagtgtttgtgattttacatgtgtgcttccattggcttcttctcccagcaaaagtcattcgtgtgctttgcctctaaagtttaattctcattcctccgctaatttcttgtagcgtctcacgtttagcttcagtagactctcactgcatataaactgtcttacgtcttttccacgagagagtacaactaaaaaaaaatgtgcataacctgtatacaccacactcatgaccatcaaacttgcatgtgccctaaacattagtaccaaatatatcaaacggcacagacgtgcggtgcgcggatatacgcattcctacggaacagacgtatgcgacgagcagcctcgtgataggatatgctctgtgctcgagcttgctctcgatcatcaacaagtatgccatcaccaaggccgtgctgagttcccttcaaacttttaaaaatttcgtcacatcgattgtttggagacatgcatagagcattaaatgtagaagaaaaaaccaattgcacagtttacatgtaaattgcgagacgaatcttttgagcctaattacgctgtaatgtggtgctacagtaaacatttgctaatgacgaattaattaggcttaatagattcgtctcgtagtttggcggtatctataatttattttcttattagtctatccgtatacgtcacaattttttttggctaaacaactaaacacagcctaagttcagctacctggccacctcactgccatgcagaccacaaagaagtttgcgccagctgctcatattcatataaatgtcatacatatgttagaatatatatatatatatatatatatatatatatatatatatatatatatatatatatatatatatatatatatatatatatatatataacatctatataaatatggacaatgctaaaaagacttacaatgctaacggatgaagtaccttattaatagccgttattgttagaaaataaacagatcaatatttccttttttgtaaaatggttcatgttttaatgaactatcccgtatgggtgttcattcacaatggtaatatataattttatttatatagcaaaaatgtcagagggttctaatatctagaagagggttttcggaaaataactggtattaatatatttcgtaatcatggttctttaaataaataatatttgaaaccaaaatagacacatattaccaaatgctcatcatttagcccatgcataacaagaaaacgaaaaataaaatcaaataaattccaacatgcacgggagttagaaaagatttttgattattccgaatttttaattatgtatttcagaattgaaaatttcagggtgttacacttatcaatggcatttcttagattatctccaagttaatacatattgctttacttttcattgtgtgagccacgtatttctacgtaggcagttgtcgatcgacaacaattttcttaagacatgcttgaaaggaggcatcagttcgctgtagaggatagaaattctcgtattattcagtgaaaaatgaaaaggagagttcaagtatgaaaacaatttataaataacttaaattcgaaattaaacaaagggatattggaataacggtccatatataacgtaatacgagattaattaaaattcgaaattagaaaagaaaaaattttaagtaggaatgcaattttaaaaaaactgaaataccgagattaaaacataataaattcctaaattagaaaaggaaaaaaagtttaagtaggaatgcaatttcaaaataactgaaattcggaataaaaataagaaatattaaaaagatagtcaatctagaacaaaacacatgattaattaaaattcaaaatagaaagtaaaataaattcagaagttagaaaaataaaaataagaattgaagtaggaatacaatttaaaataactaaaatttggaataaaaacaaggaatattgaaaaaggtccatatagaacacaataagatattaaatattatttaaatttgaaataaaaaataaattaaattccgatattagaaaaaagtcaggataaaaaataagaaaatattgagacagtagactacctagactacaatgatggcaaataccaataaagagggggaggaccctggcatgctgtaagaagtaccgttgtggtaatggtagataggacacctaaaaaattataaaacaaaccccaatcatgactagattccattctaaaattctaatgactattaaaagaatgggccacgggtacagctgcgaaggagtaagattgcagtagttgaatggatttatagaagggaaagaagaactcaataatgatcaggtttgatttttttaagatcacaataacaatcatacagagtggtgcaacgggtggccgtaatggagtgaagtggtgttaacgataaaatttggcaatttccgttagtcaagaccgggtcaaaggaagatttcacatcgtgactttagaagattcggttagtaaagttatccaagttttggcatccttcggagttaacaaaggtgtatcttagtttctatttttttaatagactcctgagccgatggaatcctgttaaaattagactcggatgtgtttggcaatgtttagctgatatgagttgtgtgaaaagtcggagtctgtaataaattccttaattagagatagagcctagattaaaccgatcataatagaatcggacttggtatagtctatgggtataaatatgtacacccagggtctttataatttaacaatagttcgatatacaaatttcggtgcatcgccaacgtttagtctcgacgtgatcttgttttttgagttgggctacatcggttgagtttgatctcggcaagaagtaagtactgtcaaatcttcgcctggtatcgacgggatcagtactttcacggttaagtccgatatattagtttaacttttgcatggggttgcttatcaaatatctcgactctggcttggatcggttttacgttctttgttagggtttctatatcaaccacgctaaatagcatcaatcggctagtttaaaacctatccagtttatctttagatcacgaattgtcttgcttaacttcaatcttctaagatttagtttgttggataagtttactcaagtcaacaggtgctagctatcatctcattggtgtttcagccgataagttatctatttaattatcatatataaacttgttgtatcggttcattcacaaaatttgatataattggctagttgttgtttttactagattcaatctcggttaggcctgataaagattgagtttagtaaatgtaattctttatgatcatattttagtttgttataatcggtcttagtttatttgctaattacagggcaatgaaaagttttaattaatacttcaatacatcaacctatatttagagattatatatacttgttaaatccagttattattaccttcaatcttataatgtcttggttgggtctaatctatccagattgactgtaataaaattaaggtttagcaaatactccctccgtttcacaatataagattttctagcattgtccatattcatatagatgctaatgaatctagacattattttatatatagatttattagcgtacatatgaatgtaagcaatactagaaagtcttacattgtgaaatggatgaaatatatatatagagtccatattccaggtgatgttgatctagtacgtaatattcgtttccattgattatcgtcgatcgacctgaaattatcatcgacatcggctggacacatggtattatatcagctccaaagtcgtttggcccaaggactaacatttcttttattatcttgttagttgcaggattaaactaactggcacgctctgaacccgatttgataggacctacactagagtaaagcaaacctcttagacctttgtgtgtacgatgaatttcatgtaaacaagtggtaacattttacaagacttctaaaagttataaatacggaattcgattagacaataaactccaaaaattacatgtttgatttttagaggtcccaaagaatatgaaaagaagtcataacaggaaaaaagaacagaaataggggacgacaagtaaagggtgatggttggcgtaacctttaaaaactataaaattgaatcctgctaatggtaatgtttgattttttaaaattctaaaataataggatgactatataaaaaagcttaaataaaaccatacgtaaaaaataaataattttgtatgtgctagctgcacaattacaccgcgccacctgctagttactttgaaaatttcgttttcaccaggggtagtagcatgaagcatacgatatttggggcaagtgtgttcttacccctgttttgttttacaattgtgattttaccttttttttagggtttgtgattttgaaataaagcaccagtttacccttcctttggatgactgtttggtgaggtttggttgagtgaactaaaaacaatgatcaatataataagaaaacatgtacacctgccttgccgtgtattaaccgtcgctgtatctaacggctgacaagatccgatcgactagtccatatctagctgcgtggcatgtaacctgtccgtgcgtgcgtgcgtgccgtgtcggtcggtcatggatcgatttgccatgccatgccaggtctctgttgacctcgtccatcgccattcgccaatcggtgtagctatgctgctagctgatcgatcagttatggcgatccagcaaccacgagctctcaattatgaaggcagccgtaatcacacgcagcgagagagagaaggcgcaacgagagtaatggaggtgtttttagtttggagggcacttgtatggctggcgctgatcactccagcagcggcgctggcgcagcaggaggaggcgccgggatgccggcggcggtgcggcaacgtgaccgtcccctaccccttcggcatcggctccgagcgctgctaccgcggcggcgtgcgggggtttcgcctcgactgcgacgacgcccgacgcccgccgcgcctcacagttgccggctacggccacgaggtgacctccatctccctcgccgccgccgaggtcaccgtgctgctcaacgccagccgcgcgtgctacggcggcggcgactacgggcgcggccgccgggggcgggaggagcagcccatgtccctcaacggcagcgcgttcctcttctcgtccatgaagagcaagttcgtcgccatcggctgccccggcctcgcctacttcgtcgacgacggcggggactacgtcaccggctgcatgtccgtgtgccggccgtcggcgcgggcgctgccgggctcgtgccggggcgacgacggctgctgccagagcaacatcccgctcgggctcgcctcctaccggccgcgcctccgcagcttcggccgccgccagggcggcgccttccttgccaacgccaccgcctgcgcctacgctttcatggtggacgcatggtggttctggtacgccggctcaaacttcaaccggacgggcgacttcgccgtgcccgtcgtgctggactgggccatccggccggacgccgggagcgggagcgggagcgggagctgcgccgccgcaagccgcacgccgctgccgtcgtacgcctgccggagcgcgcacagcgtctgcatcgactccagcaacggccctgggtatatctgcaactgcaccgccgggtaccacggcaacccgtacgtcgtcggcgactgcacaggtctaaatctaatttttggttactcctccgttttagaatataaatcgttttttattaagtttgtagacaaattttaatatttacaacatcaaattaattttattaaatcaataattaaatatatttttataatatatttgtcttggctaaaaatattgttatcttttttactaacttgatcaaactttaaataacagtttgacttttactaaaatcaaaacgacttataatctgaaatggagagaggtacttctctccctctcatcatcatcccacttcagttcatcctgatggtgatgtttttctggcctttaattaattacttctcatgttatttgtggatttaaattgaaacaaattattaagacatcaacgagtgcgagcacaaagatgagtacccctgctacggcgtctgcaccaatacggcaggcagctacgcttgctcttgccccaagggatccagtggaaatgccagcgtggagggtggctgccgccgcgacgacaagttcactctagcactcaagacggtcacaggtacctacgaaagattttttttatatattttatatattttttatatacctttccaaaaagtatttttaaatatgaattttgactacgccagcctgtggccaaataactttgtcacgtcacgcacagctggcgcggcagtgctgtcctgccacactagcctcttgccacgctaccatggctggcgtggcaaaacaacgcttcaacgccaaaaggtttagtttttgaaatattttttaagaacggtatattaataaaattaaaaaataaaaagtctaaaaaaataaaaaaattctcctacaaaacgggattcttcaccttaacaacaaataatcttgactttatatcactatgtcactgaaccgaaaatcacctgacactgacgttacagcagaggatccatatctgttgtaccaatatatgatacctctgtcccaaaatattaggacaagatgatattacttgttcggattcgtaatattaggaaatatcaccttctacactagtcgtaataatttgagtttggagaaagcagtgacagataagccagcagcttagtaaaaagctaatccctccgtcttaaaatttttcagatgtattttgtttgattaggacaagactttaaccaataattgcttcattagtatattatttatgtggcacaaacttatgatcataagaaattacttttcactataaatttggtaaattttactacaatacatctaaatcaatctatctatatatctatctattatatactaaaactccatgaaacttcctacaacgctcctaagccgccatgtgtactcctacaaatactcctaaaccaccacatgacatcttaacaaattggtgggcctaatatttttatctattaaaattttattaaaaaaataaccccacaaacttccctcccctcttctctccccatgggcccatccttcaaccggacgaacaactcaagttcgtacgtacttaggtacggtctccctcccctcctatccaatctcttcttcttttttttctttagttataaaaatttttaaacaataataaatcttaaataaccatattttttctatagttatttgcatgttgtctatcaacaattaaaaaatataaggtgttctttaacctatatgaaatatttaatttttttatcacatcctaaactttgcatatcacgtaaaactgtcatataaaataggtaaaaattgataatgtagattacacgatcatatatcaattgacagaatatacataaacaaattaagttagatctattatataacaaacgtttctaagccaccacgtggcatcctgcaaacgctatgtactacgatgccacgtgtcactataataaattagagaaatttttaaaatttttaagaaaaagaaaacatctagacattaatttttattaaattaggtagacccattatttaccactattatatttatctttaaaagaactccttaacctccaaaccggatccaaattggacctgtacgtagcgtacgttttcttaaggatagtacgtacgtacgttagtaacgtacttccaccccttcttccctcaatttcttcatatttttgcacatatttcttcccctattatcatatactttattagttagaaaatatattttgtgttaaacaattcaacaactataacatctaaatcatacaactaacttttaattcgcttatatcttaaaattattttatgactaaatctacaggcaaataccaaatttccacaataattcaactttgagaaagaaaatgacactttggattatatttccagacttttgcgtaccgttgaagcaattacaaaaaaaatgaaataataatattgtagactctatcattgtgcataacttcataagaattaaattatatctacaatcataaaatctaaaataaaaatagctatgagtaatgttcccaaaatatataagttagaaagcaagagttacacgaaaaaaataagcagctataacatctcaatcatgggatcccctaaatcatacgagtaatatttttcttatgtattttgattattttacatttaaaaacccatatttgaggttatattatctgacttttatatgcaattcaaacaattataaaattgtgaatagtaacgatatatattttatcattgtatatgtcagggttacgggtcaggcataccctctacccttcgatatacgttacatatcgacatggcatacccacgcgcacgcggatgttttctacatatcctaaggaaacctttcacgaaatctacagatgggaagaatccttctcgacagaactgggtcgtcgacgtatcgtattgggtctgatatctctgagtcctacttggaaacctccagatctatgatataaaagggaccccccggggagggcatggatcatcgaatctcagagccaacacaacccacacagcctacaaagccgaagtctgcgaggagcgaagtcgtcgagagctagttgaatccactcgactacgatctcgccggatccgacaagttccatcgttccctttgtaacctgtgttttccaccatataatcccatatcaactggattagggctattacctaccaaggggcctaaaccagtataattcttgtctttgattgttcgatgtcgtactacgtagatccttgtaccaacgtaccccaataccatctatatccggtctacgggtatcacccgtcgacagtggcgcgccaggtaggggtatttggtactcaaggttctactactatgtcatccagcttcgtcgacaacaacgtcaacaccagcctcagccaagcgctccctgcttcaacaatgctggtatgaactcaagtcggcgaaatcgtcttcccggtttacaccacaacgccaatctcaaccggtcctccaatgaccggaaacgagaacgcagtggctacaaaccaaggcgactccatgtcaaaaaatccacccgtcgaaacggagaacggatcatcgacgacatccaagcacgggaaggattctgatacggccaaaccttgtccttccaacataaaccacgagccggcaaagatgacttccgaagccacaaggtcttggtgtcctatccacaaaaccaagaaacacaccttgcaagattgttgggttttcctcaacgtccgtgttgaaattcgcgcctgcaaagaacgtggaattcagcgtacttctccaactcgggatgtctattgtcctattcacaagacaaataatcacgacctctcgagctacaaagtcttcctcggcgccatgaaagctccgtctcctaagtcatacgtccccgtcagggataacggcaaggaacaaggagcgactccagcctcagatcgattcgttggggtaatcgatatcgatcctcacgaaccatcggtcttacatcttctcgaagactatgggtcatcaacaacgagcgtgccacgggaggtattggctatcgatgacgttggcacgtcagcgcaagccaacgcagaagcggcgaatcaatcgactactccagcccaacacatcagggtcgttcaagctatactgagggaaactccttacgatcccgttctgaacgatgacctcgagcgttggacagaacgactacgggaatcggtgaccaacctcagcaacgcgtttgaagaagccgctaccgcagcgcaccaagatcagccgccaactggcgacgccaatggtgaagatccggaacggagggaatcacctcaacgagccactcctccacctcgcggagctggcgatctctgagatcaaatcaatggccgccgagaagcacgacgcacacgagacaatgtaaatcgctctcggcgtcatgtctcttcacgactccatgataacggaaatcgaggagaccgctcaaacgaggaccgggatcacgacaaccaccacgatcgcaacgatcgcgaacgacgggggccagacaatactggtcatggccgccgccgtaacggcgacgataatggagatcggcaccgagacaacagcgagagacaacgacaggattcccgagatccaggccgttatcctcgtaatcgtacgccagaaccaagcgacccatcgtcatcatcatcatctgcgtcctcctcatcgtcagacagacatccacgaaggacacacgaccgccgacaacccaccgtccccaacgctcggtcgttccctacatgatgtccgatggcctaagagattctgacccggagcaattgaaaagtatgatgggagcaccgacccagaagaattccttcaagtctactccacagtactctgctaccggagcagacaacaacgcactagcaaactatttaccaaccgcgttgaagggttctgcacgttcatggctgatgaatcttcctccctactcaatctcttcatgggtagacctgtggcaacaattcgtcgccaatttccaaggaatgtacaagcgccacgcgatcgaagacgacctacacgcgttgacacagaactcaggtgaatcattgaggaaatatgttcgacgcttcaacgaacgcagaaacacaattcctgaaatcaccgatgcttctgtaatccgtgccttcaaatccggtgtcagagattgctacactacccatgaattggcgacaagatgcatcacaaccactcagaggttattcgagatcgttgagcgatgcgcccatgtggacgatgcgctaagatgcaagaacgacaagccgaagaccgggggagagaagaaatcagccacagacgcatctgagtcaagcaagaagaaaaatcacaaaaatgggaaaaggaaagctcaagtggaagtcctcacagcagaatacgcgaaccctcccaagcgcccagacccacaaggcagcgacacaaagaaatcttggtgccccatacacaagacggacagacattctctgaaagattgccttgttttcaaaaagtcgctcgagaagcacatggcgtttgaaaaaggcaagcgagtacgcgttgtcgagaagaacgaagagacggctcctcacgaatcggattctgcatatccggactccgacctccacgtctcacacattttcggcggctccacaacgtactcctccaagcgagaatacaagaaagtggaacgtgaagtctgttcgacatggcggggggggggggggggggggctgcacccaagatgaagtggtctgagcagaaaatagagttctcggaagaagaccaccccaagagcgccgttatcccaggacgatatccgatcgtggtcgaacccactattcggaacattaaggtagcgcgagttctcatcgacggtggcagctcgatcaatcttcttttcgccagtactctaggcgcaatgggaattccgcatagtgagttgacaccaactgatcaacccttccatggaattactccccgatcatcatccagacctttgggcaagattacgttgcctgtgactttcggccaagccaacagcttccgaacagaatggatcaccttcgatatagcttacaacgccatcatcgggagaactgcacttgcgaagttcatggccgcatcccactacacgtatcaagtactcaagatgccgggaccgaagggaacaatcactattcaggggaatgcaaagctggcggtgtagtgcgacaagcggagcctcgacatagtcgagcaaacgcccagcccacccgccacgactgagccacccaagaaagtgagcaagacaaataagacgccgaagccggacggcgccatcaagatctttccactctccagtgccaatcccgacaagactgtcaagatcggggcgacactaaacgagaaataggaactcgcgctcatcaccttcctccgcgataatgccgacgtgttcgcttggcagccgtccgacatgccgggggtccccagggaggtgattgagcacaaactaatggtgcgacccgatgccaagccagtaaagcaaagactgcggagatttgcaccagaccggaaacaagccatacgagaagagctcaacaaacttctcaaagctggcttcatcagagaagtacttcatctagagtggctagccaatccagtcatggtgcggaaggccaacggaaaatggagaatgtgtgttgacttcaccgacctcaacaaggcgtgtcacaaggatcacttttctctccctcgaatagatcaattggtggattcaacagccggttgcgagctattgagcttcctcgacgcttattctagctaccatcaaatcagcatggcaaaagaggacgaagagaagacagcattcatcacgccgttcggggtattttgctatgttaagatgccgttcggactcataaccgccgggaatactttccagcgcacggttcagggcacacttagcaaccagcttggcaacaatgtcgaggcttacgttgacgacatcgttgtcaaaaccaagacaagcgactcattgattaacgatctgcgggaaacattcgacaacctccgacgatatcgcctcatgctcaatcctgagaagtgcacgttcagagtaccgtcgggcaagctactcggattccttgtctctggcagagcaatagaggcaaatcccgagaagatcaaagcaatcgagaacatgaagtcgcccacgagactcaaggaggtacaaaagctaaccggatgcatggcagcactaagcagattcgtcgctaggatgggagaacgagcacaacctttcttcgctctattaaagaaacaagacaaatttatatggacacaggaagccgaagaggtatttattgcactcaagcgctacctatcaaaccccgctgtacttgttgctccccaacctaatgaagaattattcctctatattgccgccacgccatattccgttagcactgtcattgttgtcaagagagagaaagtacagcgacaagtttattacgtaagcgaagctctccatgatgcaaagacaagatacccacagatccaaaaactgctttacgcagtcatcatgacatcaaggaagctgcgccactacttccaagctcacagagtcacagttgtatcctccttcccccttggagaagttgtgagaaacaaagacgttgttggccgcattgcgaaatgggtagtcgagctaagccaatttgatgtccactttctaccgcgaacagccatcaaatcccaggtactcaccgacttcgttgccgattggactatgccagacaacaaatcagacaaccaaggcgacaacgaaacatggacaatggcgttcgatggcgcactcaacagccaaggagcaggggcaggatttatcttgacgtctccttccggagatcaattcaagcacgcaatccacctcaactttagggcgaccaataacactgcagaatacgaaggactactcgccggatacgagctgcagccgcacttggggccaagcgactaatcgtcaaaggggactccgagctagtcgcgaaccaggtgcacaaagactacaaatgctctaacgccgagttatccaagtaactcgcagaagtcaggaagctagagaagaggttcgatgggatcgaggtccgacacgtctatcgcaaggacaacgtcaagccagatgaccaagcacgacgcgtgtccagacgagaaccgctcgaacctggcacctttctcgatatcctgacgaagccatcggtgaaagaagttagcccgaacacccccgacattagctcggaggtcactgaggcagaacgcgccgttgctgacatcgaaactacagacgactggcgcaccccattaatcaaattcatcagcagcgaggagttgcccgaggacgatacagaggccgagaaaataacccgtaaagcaaagatctactgtatggtcggtaatgatttatacaaaaaagcgctaaacggggtacttctcaaatgcgtctctaccgacgacggcagacacctcctcctcgacatacatgaaggcatatgtgggtcacacgccgccggtcggacattggtcagcaaagcttttcgacaagactttttctggccaaccgcccttaaagatgcatgcgacatggtccagcgatgtgaaacctgtcaattccacagtaaacacacaaagctacccgcgcaagcgctccagactatccctctgacttggccgttctcgtgctgggggctagatatacttgggccattcccacgaggacagggcggctacagattcctattcgtggcgatcgacaaattcaccaaatggatagaagcagtgcccacgggggaaatcaaggccgacaacgccatcaaattcatcagagggaaattctgcagatacggactaccgcaccgcatcgtaactgacaacggctcccaattcatcagcgccaacttccaagattactgcatcgggttgggagtcaaaatatgtttcgcctcggtctctcaccctcaaagcaacggacaagtcgaaagggcaaacggcatagtactacaagggatgaaaacccgcgtctacgacaggctcatgtcataagacaaaaagtgggttgaagaactcccatcagtactatgggccgtacgcaccacaccgacaacgtccaataaggaaacacccttcttcctcgtgtacggctccgaggccatgctccccggcgagctacgacatcaaagtacacgagtacagaagtattccgacgagaaccaggaggaacagcgagacatcgatgtaaatcttctcgaggagcatcgtgagcgagttgccgtctgagcatccagctatcaacagtccctccgccgttatcacgagaagcgcatccgagcacgcatactttcgatcagcgactatgtcctccaacgagttcaaacccaagcagggcgaaacaaactctcaccaaaatgggaaggaccttacacgatcacacaagtcttgcggccaggcgcattcaaaatcgcagacggcgacggtcgcgaattagcaaattcttggaacattgaccaactacataaattctatgtatgagtcaataccactgtacctataagtacccttacagcatcaataaagcctatttctaggtcccatatcacaatcaaagtgttttcacccgatgatcccttactctgatgacacctagcgttgaaacttgtccttatgtccctttacgctgtctcgacaaggcctccgaggaacctaagggatcttcggctggggacgcccagagccgataaggccttgtcagatcctgtatagacaaaagaccatgtaagatctggtcgtgtaagagttctcgccgtgcgtattaaccaagccgtgaaatcggaaatcaactttccaacctcacggctgggggctaggatcagagcttattcaaccaaggcaggtcaagggtccaagagccttatcccccgagaaaattcctccgatgacaaggctgggggttagtgagagtgtacgactcaaacggctgaccaaagtcgttaactgagaatacactcttacacacgacatctagagtaagatatatttgtttaaggaatatttctttattcacaaaataattcttacagtttttacataaattttccactacattacatctttccctaagatatctgtgacaggacacgagtactaccaagaaggccaacgccagtccatagactggaagatcttctcggccagcggcgacatcgacctcgccagatggtctatctccgccggagttctccgagaacgagcaaaaccatggcggagaaactcgaggtcctggcgcgggcggtgatctcgtaggcaagccagcatgtgccctccggcatatcggctcgctcgacgacactcttgcttcaaggcctcgtcgatatgcttgccgatgccatcgagttgggcacaggccccgtttagccaagagatgtacccggccgccgactcctcgggatcaccgcggactactcgaagttccctgcatactctagccatggaggcacagcaacttctcaagtaagagttgaaccacacctcgcgacctcggagcatctccacaacctgctcttttttcacggccagcatggttctctcaagttccgccacttcaaatttcgtcttccagtattggatacgacgatcttgatttgcaagggcaccctcgagatctgctaaacgtgacgaccactaagacaagctagatacctcctttacaacataaataacctaatcaggaggttactgagaggtgaaaaagctattcacttgaggtggccgttgccatcccggcctccgcatcaagagtttgatccacattgtcagacgaaacatgtggttcaaaatcgagtaccggaatcattgccagtgactcaggctgcccgcgctgctggacatcttcgtcatcaacatctctacaatggacaaaaactcccgagatcaacatacaaaattggacaagggtggtaatcgcacgaacgaaggcggccggagttcaagatttacacaatatataacaaatacaagaagtcctactctttaaaaagggagagaatagactcccccagatcaccgacttcttccatcacctccttacgcgtgtcgcttgccgccccctgatccaagatctcgcgcagatcgagctcaggacgcgacaaccttacacacgcgaggacgtgacacgccccagtgtagatgccattcgacgtctccttcgcgatcctggccgcatgcttggaggggatttccccaatcgctgtcgccagttccgcaagagaggaagtcagcgaaaactcgtcgggattcgccgggatcgtggacttgacgccgcactcctcggcgagctgatggaggccagtgtaggtgacccgcaacgagccacggatcttggagatattgttcccgagttccgacattcggtcctcgagcgccttccgttgacgatcgttgccggccaccaactccctcatcttcgtgaggtcctcacgggcttcagctagctcgcgcactaatctctcagcacgcgcgttcgccgtcgccgcttccgacctcgcctccgagatctcgcggccgatgccgcgagcaccagcttcgagaaggcgccccatctcgacttggagctcctcccaggtgagaatggccgctgcagaccacaacccgcagcgagatcgctgacggggctgctaggcgtcgcctctcggctcccggtcacgggcatgacatctgtcgaggccgtggcaggcgatgcgctggaagctcccccggacttggcccgtgcagccttcgcccgcgcctccctacggacaaccatgaatcaaacaccatttgaacgaaaagcacgagaatccaagaatctatttacttacttctcgccaatcgtcacaatgcgctgtcgtcgtggaggtggagaggacgcgtctgaagcctgaaagacaatcaatacagagtaagaagaaaccctccttgctgcacgatctgatgacaagatgaaattactgagggggtcgctgccttgcggcgatgtccgagtatagacgagaatttcctcgccttggtcaagactttgccaccgctagtggtggccgcatcagatgcctccttgacaaccttctcctttagagatgtcgccacctgatggtccgcgagtggcccgatgatgtcagtcaaaggaagggcctacgcttaatcaggtcataaggtgatttcgaaaggagaatacgagatgcttatcaattacacttacgttgatggcttcatcgcgttccgccgcccccttttcacaaaggggcacggggatgtcgctagccgtggtcggaccgctgatcatcacctgaccaacgcgccgctccacagctttgctgctcagacctgttaaacgggaaccaacttttgataagtcaagaggaacgcgagtacaagcacgccaagatgaatacgagaaagataccccgaggagaaacccgggtcgcgtcatccggcccgagatagttataggctggatgggtccgagcctggagcggctggatccgcctaccgatgaagtctgcagcgacttcatatcccgacaagccccgttctcggagatcatcgatgatgtcgataaacgactgaagagagggggtcaaagggggcttggcggtccaggtcggaatcttgtccggttgattctcgggaacaacgaagacagggttcgagtccttgatctcaagatagaaccacctattccgccacttactgcgggaaggacactggaaggggatataacgcgacttcatgccatcacgaagtcggaacccgacgcaaccagacaccctattggattccatccaacgcagttcatagtagaaacggaagagatcgagaaaaagctctaccccaatgtaggcctcacagagatgaacaaagatactaagaaaggcgatggaattagaattcaaatggagaagagaaaga

SEQ ID NO: 45912 - DNA, 3624 bp, Oryza sativa
caccaggagaagaaactcggaaggtggagaaagaaaatcgcagagaacgtaatctttgatcgcaaccatgcgacccaagaggggccgaggatcagtacctcctgcttctctctccatgtctccacggccgggaagggcgccgtcctcctgaaggttcttcaacgtcgcgccggtggaagacgacttgccgagatccattgctgtgccaagatcgccggaaaacaagcctgagttggcgaactagggtttcttgtggtggcggagaaggcaaggagcgctggcaggtggtgtgtgttcaacaaggttggcagacttgaaaatgagctcccaaaattcctttaaataagcgcactaccgacggtgcgaattccaaggaacggagagagatccccgccggaaatctctgggcccgttacgcgcagcagttttctggacttcaattcaaaattcactcatgaccgttgggcttcaaacggcatgctcgactacgttctatctccacggtcctcgcaccaggaatgacaacgttctcgacacccgaagtcgtaaatggttgcacgagttcattttaagcagaagttgggggctactgtcagggttacgggtcagacataccctctacccttcgatatacgttacatatcgacatggcatacccacgcgcacgcggatgttttctacatatcctaaggaaacctttgacgaaatctacagatgggaagagtccttctcggacagaactgggtcgtcgacgtatcgtattgggtctgatatctctgagtcctacttgaaaacctccagatctatgatataaaagggaccccccggggagggcatggatcatcgaatctcagagccaacacaacccacacagcctacaaagccgaagtctgcgaggagccaagtcgtcgagagctagtcgaatccactcgactacaatctcgccggatccgacaagttccatcgttccctttgtaacctgtgttttccaccatataatcccatatcaactggattagggctattacctaccaagggacctaaaccagtataattcttttcttttgattgttcgatgtcgtactacgtagatccttgtaccaacgtaccccaataccctctatatccggtctacgggtatcacccgtcgacagtatataagttcacaataattcaattagacctgtaatgacaaaaagtaaaataaacctaataacactatgtattgttaaaaaaatttactcctcccattctgatattataataaataaaaataacattagtagatttttagtgttcacattttcaatattgtatactatgtaggaaaagacgagtagaaaagatagatcttaatcaatcaataaaatttttattctatttttagttaataaagtaatagtaagtaaaacacaataaatgtaaaaaaataattatatgtgcacgtactttgtcccattcgactttctcttcttctcctatctcactcaactcctttttcttataatttttaactaattaacaaaataataaaaaatgatcaataattacaaagctaaataattatgattcttatgtcatatctgtttttagtttatttgaactgttattttgtttataattaaataaataattcaagatgcatattactcatatttcacttcgtaaaaatgaaaatataccatttaagcatacacacctatcctttgcatggtaaccaaatagaaaaaaaatagagcattataaaaaaatgacaataagtattacatcacctcaaatcattatacatcctctgtagcgcatgtagcgcatttacagtggtacgtaacttacgtgctacatcttaattaaaagtaagaccttagaaattgtaagaaaagacatttgaccatcaattttcacttaataggtggatccattattttaaccaatagatataatattagagaaaatcttaagctgccatgtgttacgtcttaaaatttagacgcaaaggatatgaaaaattttgacaaaaaaaagcggatcatcaattttcacttaaatcattagaaaaaaagcccccccccacttcgccctccctcacatgtgcacaacacaacactacccgtgtcccctcctcccctcctgtctcagcttgagttctccactctctcctttacccctcctttctatagtgagaaataatcaataatattaaacatgcaaattttttagctgtacatctgatttctaatctaactattgctctattcataattaaatcaacaatttaaaggttcataacctctatagtttgaactggtataaaataaaatttaaaatataaaatatcaatagggactaaattgaactatttggagaaaatcaaataagttcgcacctttcactaaaattagacaacccattacatgttccatttttataatattttttaaatgcttacatgttaatggccttgcatctatcctatactatagtattatgagtttgtcagcctattaagccacactatggtagcagtatagatatagttagttgaaaagatatatttattactattaaatttaatttttcgaactcatgttaactatattttattttagaaaagatactataggtcaaacgtattactacgatatgtctttgttaacttatatgtaaatatgtaacaacttgcatgaatctaaaccaactaaggctatgttcgggagtgagggtgtcgcgaccgggaaaattgccttttcccgaacgctagtgtattaatccccgtcccaggaaaagccggggtacaccacacaaacatgatataaaagacacatctttgctatatcgacaatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaaggggggagaaagatagagcaagaatgagtacaaccacagtactcagcaagccacaccggagatgcacaattaatgcaagggagtacaaggggataataatataggggttacgttttgcagtaaacagcatttaaaagtcacttagttgcccaaagccattttgtaaagacgattctagagctacacagtattattaaacaaggctgtgaaccctcacgaacctgccttaacccaaggcctacgatgatttggaccgaactggcaacccgacctgggtcccagctcgtcccaagccaacccaggccaaccattccatgttttagttgttgagcaaattttaagaattaaaacactgacttgggtacattgctaggcttgcccatatccgagggctcggctattcgaatagatttactctgatcagaggtgtacatctttacccacaagacacatcttcctcacgtgttaccacgcgccacataccaccacggtatacagacggaagacgtgacatagtttccaacccatcctagccataaacaagagtaccgacccaatcctgcctacggccgggatacccgggacaggcaggcagaactgagcccctagcattgggcaccaacccttcgccg

SEQ ID NO: 45913 - DNA, 9955 bp, Oryza sativa
aagagaggtgtatgtccaattccaccataagccaaccattccatagtgtccaaatgatatgaaaattcccaaagtctaaagttataaaaccacctaatgttgcctaattaatcagcgaagcatctacctaaattcatactagtggaaccaggaatagagtgtccactagttggggttttgtttattctagggtgaacaaggtaataataacaatagcaataataatgtcataacaaaggtaaataggcatggctaaataaaacagtgataacgcgggaatttaaataaagcgataatgcattaatttaaattaaaataattttgtaaactgggatttcaatatgctcaaggatgatgtgacttgccttgctcgctttcccaaccaccggcttcaacttccacgaagagcggatcttccgaagctgcagcgtctacacgaccaacggaaaagaaaaggcttttactctaataaactccaaacaacaagcaggaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaattttcaattaaaaattcctatttattgcgtcagccgagggagcgggcgcgcggaccgggtccacgggaagtggggcccacgcgtcagccgctcggtccacggtggaccgggcgctcgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgctcgcgccccgatggtcaccgccggcgaccaccggtgcggcggagcggcgcccgagagagcggagagaagggggaaagcgaacggcggtcttcggctcaccccgggacaacgacgacgacgagaacggcggccggagcggaagaaggcggcggcgcggttcgggatgacgatgacggcggcgctccgacggtcggcgagcgaaacggaggcgcggacgaggtcgacggcgatgcggcgatgccgagggaggtggcgccgagtcgggaggaggtccggagcggcggcggcggcggaacggagttcggcggcgacggcggagagagaggagcacggcgcgagcacgaatccgacggcgagagcgagcggtgagcggcggaaacggaagagcggagcacgggcaacgttttaatagcaccgggaggaggagagcgcggccggagagagaggaaacgggcgcggagatctcggccgccattgaagacgccggcgacgattgcgggatgaatccggacgaatccgagggagagagagaggggaaaacgggggaaacgggagagggaatcgcggggaataattcccccctcattaaggcgcgcggggaaggcgggatgcggcggatttggcggcggcggcggcgctagggcacgggcggcgacgggcgcggcgcgaggaggaagatgacaggtgggccccacccgtcagcgagggtggcgggcgggcccgcctgtcagcggcgcgcgcgcgcggggagccgatgggccggggggagagagagagagagagagggaatgggccgagccggcccaagagggaaggggggggggaaaagaacttcttttaggatttttctttttataaacctttttaactttgtttatttcttctcaattattatttgtgctctgaaaattccactaaaatttgagggctcctttttagaccaaggagaatttaacaaaaattctccgggccacatttgaatttttcttgtacgtattttagggtttgccaatttcttttcgaattttaattaattctattattccttttagaagatgatttttatttcgggatgaatttatcaggacgtgacagagggttgggaaccttcacttcccagcacacaaaatgaagcagcgtttagcgcgtgattaattaagttttagctattttttttcaaaaatggattaatatgatttttaaaacaactttcgtatagaaacttttgcaaaaaacgcaccgtttaacagtttgaaaagcgtgcgcgcgaaaaacggagaggaggagttgggaagatgtcctaccgaacgcagcctaaaaagaggactaacttgatggtacaaataaagcatctttactaacaataatattttacttttttaaaaaaagccactaaacattcaattaaaaaagacaaaatattttacttttaatttacgtttaattcgttagatatgttttttccaaacaaactaaatagatacttttgaaatatgagagatgtttatatggatcatagataattgtttgtacgaatgaattaaatattatatattttaaaagctaacaaatagtttggaaaaattatctaagcaatgccgatgaagtaaaattatggagaaatagtacttatgaaacatggcaatgtcattgagttgatattcgatctatataagtttttcgaacgcaatctaaaatacatgcccgcgcaatgcgcgggctaccttcctagttttatataatttgctgatagacatcgaaaaaaatgtgtcacggatgatagataatttttttttggtaatttgctaaaggacactttcggctcaattgaaaagataaatttttaagaaagactagaatgcgtctaggaacacatgcttcaaacatgacgttagtgtaaaaaaaattagaaattatacaactcaaaatttaccatcaccccaaatacatcactagcatactacatcatatttcatcttcactccagccttagctcaaaagtttttgatcatagagacattcttgtcgtttttaagattttctatctccaattaagtcgaaagtgtcctcagcaaattactagtttttaaaagtgtttttttagcagtgacacttttttacgatgtctaccatcaaattacatgaattttgaatatcttgtagcaaattttgccaattaattttgtgtcacaaagattatatgccttatcttttaagaaaagtagtactattttaaaaaaatctcagggtatgttcagattgattccaaaatgaaccttacaaaaatttgacaatatcaaaattttggcaaattgacaacattgctaaaattttggtcggattggcttaataatattgtcaaaattctatacacattaccaatatttggtgacaaactaaacgtatcgacataattgtcaattttaacaaataatgatatgattgaaattttcatcaatctaaacaagccctcgtaaccagaccttttatgaatgttgttagataacaatggcacacttcctccgttttatatattgtaagtcgttttaactatttttttcaaactttattagatataatcaaattatagacaaattagcaacatctaaaacacaaaattagtttcattatagaatatattttcataatatatttgttttgtacagaaaatatgattatattttatttataaacctagtaaaaaaaaaggttgaatatgaaaacgggaggatttaattggattgtaatgttgttttgagttttcaggcgtcagcgcaggagtgttggtggtgctagtggccttgttgttggcgtacgtgggcatggagaagaggaggatgctgagggcgaagcagaggttcttcgagcagaacggcggcctcctcctgcagcagcagctgggttccctggccgcctccggcgtggcgttcaagatcttctccgaggaggaggtcagcaaggcgacggacggcttcgccgaggcgcgggtcctcggccgcggaggccacggcgtcgtctaccggggctccctcgccgacggctccacggtggccgtgaagcggtcgagggtggtggaggagaagcagctcagggagttctccagggagatgctcatcctctcgcagatcaaccacaggaacgtcgtcaagctgctcggctgctgcctcgaggtccaggtccccatgctcgtgtacgagtacgtccccaacggcagcctccaccggtacatccacggcggcggcgccggagccggcgagggcctgtcgccggcggaccgtctccgcgtcgcggccgagtcggcggacgcgctggcgtacatgcactcgtcggcctcgcccccgatcctccacggcgacgtcaagtccgccaacatcctgctcgacgccgggctcacggccaaggtgtccgacttcggcgcgtcgaggctcgcgccggcggccgacgaggccgaggtggcgacgctggtgcaggggacttgcgggtacctcgacccggagtacctgctgacgtgccagctcaccagcaagagcgacgtgtacagcttcgcggtggtgctcctcgagctgctcacggggaggaaggccttctgcccgccgccggacagcgccgccggctcgcaggacgacgacgacgacgacgacgaccggagcctcgcgttcttcttcctcactgcggcgcacaagggacggcaccgggagatcatggacgggtgggtcagggaggaggtcggaggcgaggtgctcgacaacgccgcggagctggtgatgcagtgcctgagcatggccggagaggagaggccgaccatgaaggaggtcgccgacaggctcgccgggatgagaagccgcgcaagcgattcataaggaatggcagtacccagtccaaaaatataacaagctatctatatgaatttaaacagacactaatttatagatttatagttaaaaaatcgcaaaatctaaatcgagatcccttcgttttagtcttatcgcgcgatgctgggagagccatccgatcgctcgcatcattgtggactcgccgttggtagcttgaaaacctctctccttctccgacctctctcctgttgacactttttcatggccaacacaagatcatctaacgatttgcggtgtaatcagcagagtcgccaaaatcgatagatcaaaattggccagtgaaactgatttcaagattaattcactttcgcggaatcacacgactaatttacaagcaaattaacaaagaggataaaatcttacttacgtgacgacgaacgactagtttccgagcaaactagcaaaggataatcttctcgctttcgtggagaagcacgaccgcctttcagcgcaaacggcaaagattaactaaatcctagggttgctagaacttaaccatgaaaacgaaatagaaaagaaccgaaaagtaaaaaacgagaaaaatagtagattgataatttgttcggcgtcccttgccgacgtctgggatgcaaatttataggcggcgcacaccgcatcaaaagtctctcttcgtgggcccatccttccttcctatccaaatcggcactgcacgcatgcaatcaggccgttgatcttgcataatcttctcaacgtatccatctcattcaccgttgtagcctcatccggatttcctaataattcggctgcacctgcatgatccgtatacatatatatctccaaaccatgtgaaattctacagccacccaacaaactacgcacatatttaaccagttcttaggcaaaacattccataaataatgaaagctaaactaaataatttggcctaccaagattaaataatagaagccaaattacaccacaaacacatgccccctgttttcggtataagtagaatgtataacttttctttttaccgaaaacactgtaaaattaaccaacctaaaccacaattgtcatgtcaaaacgatactccacacacagtatcggtcccgagtccatccacagtcgtcctctcaaaacgacactccacacatggtatcggttctaaacccatccacagtcgtcctctcaaaacggtactcaaataagtattcgttctgagacaatcaagcttcctacaatacataagcataataatctttcaaatatttttcatgtagtacaaattttactactaattcggttgtccctaatatccacctaaccgaattagctcaacttatggtagttcttggaccaaaacattttaagaagagtaaatgacactagcggtccttaaacttatcttaaagtttcatccaggtccataaactatctaaactgtagttaacctcgttaaacttgttttattgtatcaatccggtccggagctcggtttgactggtttggtgcatacgtggacagccaggtgtcgcgacgcgtgtgacggccccatcctcgtggcctttttcacccaggaccctccccttcgtcaaatttcacaaaccctagcctcactctgttcgtagcatggatagatagtggcggcggagaggcgacggcggtgcgagcagcagtggccgacagttgagggcggtgcaacgagtcttgatgagccatggccttagcaagctgttctttgtgttcaagtcgtcgtcgtcggaggacctcaatcccacttatcttgtgcccttgatgcggggtgaagcaaatcgtggagcttactgctaacacggaagctaatcaaggccgcatattcttcacatgcccttcacacgaggtaaatcgattgaggttaattttttattgtgggggtattactgtttttgggggtaaatcttctgaaatctttgcttgttctaaaatgtacagaagggtggaagtggttgcgatttttggtattgggaggaagggtatattaaatacctgaataggaaaggcttgattgagcaaaacacttgtgcaaagttgctgaatgaagcaaaccagagggaaatgcagaggggaactgaagaaatcaagctggatgcagatgtgaagaagaagagcacggttcaagagattagaaaagatgcagatgttgaagaatttaagcaggctgatcatatgttgctcattttgagggagatgatggtgatgatgaagctcatgctagttggtggtgtgtgttcagttggtttgatagtgtgttgtttccttgttctatggtttaagtgatgtgtgcccattgtatcagtgaattttgggttgtattcaggctaaaccatactgtgttggtttgcaatgtgcaatgagatgtgaaacttttgaaatggtaatgtcaggtttgcagtctttagtacatttgtcatctgaaattgattatggagatgcaaacaaaatgaaaatatttacagactgacagtagatgcaaacaattttgcatagcagttttgcatagcatatccatcagttttgcatagcagtgagccatcagttttgcatagcatccatcagttgtgcacagtagatgccaaatatttcatgacataaagtctagagtaaatggcagcccaacatccatcagttttgcatagcagtgagccatagtttggcattacaaaagaaggtaaggtaggccattaggttggcagctacaaaagaataaaggtaggccattagtttggcattacaaaaggacaagcatgcttaacttctagcattcagttgcttcttaatctgttcctaatcctaagttatttctttgcaccatcagcacaatccttctacctcttcttagtagctttctttgctggagcaacaactgcagcctttcttttggttgctcttgcttttcctgcctttgttgcagtggtgagaagggttggcctgacagttggagtgttagtcatgacaaattgattgtcaggtaaaggcccaggtgctaggttcatttgagaaacttgagatgactcatcaaacatctgtgataccattgcattaggtatttgtgtcaacagttggtcatgggtaggaaaatgaggttgagattgagcctacaaaacaaaaccatatcatgacagttgcaaatcaaacctctagggtgacagttagtcataacagtttaaaatttgaaattgcattacctctgggctgattggatcagattcctcaacagtagtagtggcagccctctgtggctgttgtgtgggcctcagtccagtttttttgagcttgcagcccctttggttgtggccaggctcattgcaatacttgcaatgcatctcaacaccatgcttggacatttttagcccatgcttcccctggacttcatgtggtgctttcctcctggacttaggtggcctgcccactttcttttcatatactggaggcctcacttctggcccatttgtcttctcccatttagaaatgtcactgcatggtcaaatgttgaacccatatgcttttgaaaatgcctccacactgtaacaggatggcaacactgactcagactagaagctgtcgcagcggcttctccaatcgtcgcattcccctctacagctctacccccaccacactctcaccctgcggctgcgtgttgctgcggttccgaccagcggcggcggcagctgtctccatccccggcggcggcttctagctccatccccggcgtcgaggtgagcccttcgtttaccccctttccccactccacacccaacctcttgctaccccatgctttttctcccccaaatccgaaaagtttttttttttgtgttttgcatgtggtctactagatgtgaatgtgttctagtaatgacattaattttttttcagaatgtttttaggtataatttatgaggatgcatttatgagatccccctagatgtgaaaggaatttttttattgtctgtgttgcatgtggcctcctagatgtgattgtactctagtagttatattaatttgtcacagaaggataatctatgatgatctattatgagatatatttgataatctataatatatagtttgcactgtgattgttttcatatggtggtttttttgttttaccatttttgtactgttataatctattatgcatttttttattttttcccttttttgtgttcccatccatgcatatacaatgttgtagtacacattaatattatgtttcatagttttccctggtttgtcttacatagtagtatacacatttttttttgttgcagagcacatgttgtatttttgtctcagacttttttgtgttctatgtgttttttttcaaggatgcctgattggtgtagtggttccaacttcaagcatagatggggcggtgtgaggtttaagcgcactatgcttgagttgaaacccgatcaaaagaaattcatcatagataatggctttgagtcttttctatcactaagcaatttcaaggtccatagtcgacttgcagaatggattatgcaaaagatgaacccagagatttgtgagtttaggttccgtggcaaggttatcgtgtttgataagttgttagtacagaagattactgggctaaatgatggcgatctacctgttaagcttagtggtgccaacagtgaagttgtaaaagagatcaggaccctgtaccatccatattttgtcagcaatagacttggtacaggcatgtgcgagaaattgttgctttctctgcatgatgaagagaagttcttgaggactttcattttgtacttgcttgccaccatcttgtgtcctgccaccggcaattatgtgaatctcgactatttgcattctttggttgatgtcaagatgtgtagtcagtatgattggtgcacacatgtggcgagctgtttgatgcgggaaatcaggaaatatcagggattctctactgagcaacgagattccatttttcagattggagagtgcctccccttgcttgttgtaagttttttattgtttcaccctgctatatatatgttttattgttttcattgtcgtgcttgatccaatatttcagtaaaatacatccatttgtctcatttaacatatatgttttgtttcacacaactgctgtcatatgtttcagtaaataatcagtctagcatgctaataacctacgtatatgtttcagcaa

SEQ ID NO: 45914 - DNA, 14000 bp, Oryza sativa
tcgaccagtctggacagaccgtatgaaattgagatgtaaaatatttttggtcataaaataatagttatttaaattatgtttgcaagactgataaaccacttgttttttcttgtcgacacggtctggacaagccgtataaaattaggatgtaaaatattttttctttaaataattgttatttaatttatgttagcacgaccaaaaaaaccacatgttttttcgttgtcgtctcggtccatactgatcgcatgatcaaatccataacatattttgtcctaaaataatagttgctgtggccaaaaatatttatattgaaaaaataagttttcgatcggtttaattttaaaattaaaaataaaaagttcaaaaaattctcgttatctggccagctaagaaggatagggaaaaaaaagaaatggaaaaaatgcatttgttaggatttgaactacagtcttcaatacggctgaagaagccatgtaccaccaggccatgtccacttcatgttggagttgtccgttcgacttacttattcacattaggtgccattgacaacataaataattttctccaggtatttatatagttggaaatggaataacataacacaatagatgcaaagattataaacgcccattcctttttctcatcatataaacaatatgatatcctggatatttaaaaataagatctaaccaccaattctgtatataactaatgtagaacattattacaggacttatgtatgcaaataaaaagttgaatcgatctggctcaatcacttagacaatccaaggaaatatacgaatgacattttcatccagaaaagctattgtggtgaagaagccttcatcgcagtaaatctccatccaaaattactgccataaaaataaagtgctccccaagtgaagatataaacaatataaggaaatcattgataatggatagatagatagtgaaaaaccttcataacctcacctttaattagttaccatgttatcgacagttgttccttctatatctcttcgaatccatgtctgaccatcatgtgcactgtcaaatagctccccaagattactgacatggtatggttcgcattccacatcattccattcttcgcccagttcaaatacatctctgggtttcatcttccttacaatagaccaccctggatttaaatggtcttcaatgtaaaacacttggtcgacttgatttgcaaatacaaagggctcatgctcaatcttttcaccggtatgaattttatttgagaaattcacaagtgtgcagccaaacttatctattttcactccttttcctttagttacatcgacccattcacatttaaacaacacaactgagaaatttccatagtagtctaactcaattatatcaagtatccttccgtaatacatgatatcaccaaggacagggttagtatcactggcggacgtgtagctcgatgtttttgcagtcacaacaactccactgttttgagtcaccctgtcataacgctttgatctgaacctatacccacgggtattgaatgctctatgtcgttttgctacctcaattggtccacgtgccaaccatctaatatcctcgtcaatactatcgatacctctttgattctccaactgcaagatctacaccaaaccaaaagatgtattagttgtactcatatttgaaaaagagaaacctaaattttgagacttacatgatctctgaaccaatcagggaattgttcattttgcatgttctcaatgttttttggagttagccttttgcgtttcttcctttgtaaatcagcagcatgttctctgcaaaacaaataaacataaatttgaagcaaaacacttacaacacataaaaaaaaaggctatgtgtcgaaacatgaattcggcaataataaaaggggtagcgcacgagacctaaaagtggatggatgcggagacaaaggatttagacaggttcaggccctctcaatgagaggtaataccctactcctgtttggggatttgaatccgccgagtatgtattgatgtgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataattttctctcgaaccagattactccaaagccgagtgcttcaatcatctttgtcatggtctcccgagtacttttaccaaatctgaagactgtggaggctgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatctgagtaaataaactcataaaggatttaccaaccgcctagaaaatgaccacaatatataatcagcctaagccataatattggtcaataaaaatgcacacttacgtggcgaaaagcaatgatattgtacctaatcaattgcttaaaaacccaaacagcaccttgacttatatataaaaaagtcagcgggacagttatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtgacatgctcccgagtaataaatcttccgagtaatatagaccaagcgtagctcatatgaatagcttctgatctgagtggttatcccttatgggatactccaaaatagatgtaacaattgaatcccgactggcgcaagtattcagttgataacccttacggggaataataaataatccagtctttgagcatataaaatagacccatgatcatgaattcatgttgcatgtatccggagcaagtccaaattgaagatataatacttgtatttgagctaataagcccctgaacacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttataactgttgtagatgcttcacttggaggagagttgatgttgttgcccaactcgtctaaaccgaaatatttgaagttgttgaagtagaatgtctgctccgaagcaaagatgaagataatgactcctggagttgactcgttggttgatgaattaatttcttcagcttgacataaaatttgtcaaattttgagccttgtatttgtgtagcccccgactctttgattagttgggaaacaaatgaacatagagtcgagaattatagcttcttgtcgtcgagtagtcattgcttgattgaagatatgtgttgaagatgtccaagtagaaatccggtagtgaagacgcgcagttgtgaagataaaagcaccagtcggcggcggcataatcagtcggcgacggaagatgatgatgtccatcagtagtggtagctgtataaaccagatgtagaggcgaggacactagtcagcagcagacgagatgaccagcgatgaagatggtaaggccaatcaacactggcagaatcatgcagccatggaagtgaagaaaccagtcggcagccatggcaaacgtaggcagcttgtgttgaagatattgatgcctattagtagtgacagcgatgtagccagccgtgaagaagatagcatcagttggcgttataacaggccagctgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcggcataaaggccagccgtgcaggcggaagcaccagtcggcggcggacgaggcggccggtcggtgaagacatagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtaaagacgtagacgcccaacaacggcggcataaaggccagccgtgcaggcgaggacaccagtcggcggcgacgaaggcaagccggtcggtgaagacgtagacgcccaacaacggcagcataataggccagccgtgcaggcggaaacaccagtcggcggcggcgaaggcaagccggtcggtgaagacgtaggcgcctaacaacggcggcataataggccagccgtgcaggcggaaacaccagtcggcggcggccgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccacaagcatcgggagtcggcctaggcatttcccaaacatgcatatgagtgatatgagttcgtcattaatggaacaaagtttcacggatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattagcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaaaaataaaataaatgatgacttagctttgtaatattccccttggagatggcagaagtggccaatgtgggaacaaagtcgtccatcaataacaatgaagacaccagtcggcggcgacgaaggcggtcgacggtgaaagcgaaaatgcccactaatggcggcataataggtcagccgtgcaggcggaggcaccactcggcggcgacggaggcaggccggtggtgaagtcgtagacgcccaacagcggcggcataataggccagccgtgtagacggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaatcagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataacaggccagccgtgcagacggaaacacaagtcggcaagagtagtgccgcggcgttacatgcaaaaagcagaaaataccaagagagattaatctgacatttagagatcaatctaataaacaacaataagttgaaaaggaaaaaaacccggtgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaagggggtagcgcacgagacctaaaagtggatggatgtagagacaaaggatttagacaggttcaggccctctcaatgagaggtaataccctactcctgtttggggatttgaatccgccgggtgtgtattgatctgacgatcaggttgtctcatctgccccctagagggcctcctgcccaccttatataggatggggggtaggattacaagatagaaaccttaaccaatacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtatgggtatggggtacccataatatccacactatgttaggacaatacgtacttcagatatggcactacagcatcacagttgtatagcacatatctatgtgcttgcaatttctctctatcagttaaggagtacgccgatggttttcccaatggttttcctactggaggaaacaaagtggattcttgcctactcatgggagtctcaaattgatctggtttgtcattattccttgatggtatgttatgcttggtagggaaaccttccaagtatcgtgaacaaaatgccatgcactcatctgccaaatatgattctgcaattgaaccttctggacgcgctttgttgcgaacatacgacttcaatttacccaggtacctgtaatatacatacaaggcacaaaactaataagttagtattgtatcatatgacatatgagaaatattataaattgtatgctaatatatttttagtacctttcaataaagtacatccatcgatagcaaactggcccagcaatcttacattcagtagctaaatggacgactaagtgaaccataacagtgaagaatccaggaggaaatatcatttccattctgcacaatgtgattttaattgcttcttccaaacggtcaagctcatcaacatggagaacttttgaacatattcctcgaaagtaagcagataagtcaaacaagacagatgtgatttcatcgggaagaatacccctcaaagcaattggcatcaattgttgcattagaacatggcaatcatgtgttttgagcccatgaatttttccttcagcagagttcacacatctagatatgtttgaagaatagccatcaggaacttttatatccctaagaactttacagaacaattgcttctcacttttggacatagtaaagctggcaggtggtaagtagaacttgcttgaagttctttgttgtggatggagctcccctctaatgttcatttccttgagatcaagacgagcttggagattatcctttgactttccttctaaatttagaagtgtaccataaatattatcgcacacatttttttctatgtgcatcacatcaagattatgccgaagaagattccatcccaataaggtagtgtgaataaactacttactgccttataagtttttgacttcttaaaatcaccgatagcatttatttcatccaataccggacgcccatagtaagtcataggctctgtactaatctctgtggttccatcaaaagaatttctatcaaaacgaaattcatgattaggtggcaaaaatcgacgatgacccataaaacaagatttcttcccatgtgccaaacgtttggaccatacatttggaccacaaggcgggcatgcaaattctccatgcaccatatgtgaagcaagcattcctaaagctggcaagtcatttatagtccacagtacagctgccctcaaattaaaagtttcatttctagatgcatcatatgtggaaatgccattgacaaatatgtctcttaaatcttctagaagcggctggaggaaaacatgaatgttatctccaggacttttgggcccaggaattattaatggcattagaagattaggttccttcatgcagagccatggtggaagattatatattactaaaacaactggccagcaactataggtagagctcaacataccatatgggttaaacccatctgtagctaacccaaatcgtatattacgagaatcagatgcaaattgcttgaaccttttatcaaagttcttccatgccggagaatcagctggatgtcgaagcacaccatcctctactaagcgctcttcatcatgccaacgtgggagcgatgctgtttctctacacatgaacaatcttttcagcctctcctttattggaaaatatcgtaagactttgcttggcgttgctttctttctttctttcttcgttaacttggtttctggttttttatctttccatctagaagccttacaagttgaacaaaaatcatcattaaccttctctttccaaaacagctgacagttattgggacatgcatgaatttgttgataatctagaccaaattttgaaaccaccttcttagcctcataaaagttttttggcaattcttttccatttggaattgccatgtgaagaatatcaagtagatctccaaatgatttatcactccatttgttcatggatttcatattgaacaaaagcactagcagagataagtgtgatagttcacttccatcccataaaggcttctctgaatctttcaccaacttataaaatgcttgagcttctaaatttggtccatcagtgtgtgtacatggcgaatctgcagaatcactcataggcatgtcgtcatacacagtcctaagtgcatcattaattaattcgtgcatgttagcacgcatgtcttcattgtgaggctgtggttgttggttcctaatttgctcctctgaagactcaccatgaaaatcccattggtcataactctgaagcattccattgcacaccaaatgatcatagacatcattttttgaaagtagcatagtatgtacgcatgtttcacatggacaataaatcaataaatctttgtatcctctaacttaaatcaataaatctttgtatcctctaacttatctttatatacaaattcaagaaatccatctactccagctaagtactcaacagaacctctagggtagcgcaaaagaatcttgatggtttctaaatccatttcgacctatataaaaaaaattgatatttcaggttcttgtagataataacaatgacaaggaattgtctcttatgatcatgatgtagcaaaaatagggcaattagaaaagtaccagtataaaatcagtgtcagctaattttgtcacaacctaatagacctcctttatacactgaaacaaaagcttttactctgcaaaaatagagaagagctaaatcaatttacagaaaaaacatccagcaatctaatgtcaaagctgtcatctccaagttaaattccttactataaattacctctagttaatctacagatgatgactccagaagcacatgtgtttaaaacctatgttccaaatatccgttcggatgaacaagaaaaatctgcaggtgttattaaactcaatcagatagactcatgatgcaacaaacctgaataataaaaaaaaaagctgacattgacctggatctgacactgacctggatttggggccaaatggggaatcaacctatgagaagtggctaagaaaaggaccgtgcttgccgttgacccgctgtcgtcggcctcggcccgtcgccggcctgccgcggccgatcccctcgcgggctcgccgccgccgctgctgagaacgcgccgctggccgccgatgcgcgctgccgccgccgccgtcggtgtgcgccgtggcagtgatgtgcgagagcgtgagaagaaaatgagatgcagtgtgggaacaggatggggcggcgctctcgtgcgtgttgggtgaggtgagagacacgagaggagaggagagaaggtgggagattaaggttgcctgctaaagtgcacagatcgtattttagttgttataatataaacaactaaagaaatcatttaataagaaatgtgattagctcagttggttcggttgtgcatattctatcctagagacctaggttcgaatcatctgtttgcatctttgcccccctaatttattcctatcaggtatcagcagcctatttttttcccctatcagcagccacttcgcttgtggcatttttttttaaaaaaactcgcttgataaattttttagaaaacaaaaacagcacgcccagtacacaatgtaaaaaaacagctcgctcaattattattattttttaaaaagcatgcttagtccaaaagttttaacaggaaaaaaaaaagcaactcacttcataatttcttttaaaaaacagttcgctagaggtccgaaatgtaaaaataaatatctcgctcgattattttaaaaaatacaataagttcgcttattctaaaagtttttatagggcatcaagaccattgcaacgcatgatatctgttgtaaagtggattcggccgttgcaagatactcaatctctgcaacgcatgttctgcaacacatattatctattgcaaattgggctcacccactactaagcgttgctagggtcgcattttggcaacgcatgcttaatgcgttgccaagcatgtattgctagaggggggttcttgttgtagtgttgcaagaatgaaaaaaacaaagtcggcttgatgcatcggctcattcgagcagctccagttcacaccgaccagattccaaagaataatagaatgaacattttaacaacttgatcaatcgagttcaatcatagaataaacattttaatcggctcgattcaatcaagttcgatctaacataaaagaacaaaatcaacacacaacaacacatagaaagagttgatgaagccacactaagaacacaagaacactaagaacacaacaatagtaagcctgccgctcaccgttgccaatgtcagggagcacgctgctaccaccacctctgggtggggaacccaccgtctccccttccgttggatctggcgtcggggacggcgccaccgctactactcacgggaggagaggttgttgcctccgttgccaccactgggtggggagcccgccgccatccctcttgctggatctggtgaaggggaaggtgccaccaccgccactatgtagggagccccatgcctaccctccaaccagatttagcggtgggagggcgtcaccgctcgcaggtgggaagagagaggcgcgatggagagtgtcgttcacttctcaccttatctgttcgtgaggataaagatgaacagtcggcttggtttgtcttttactggtgctgtttttagaaaaccgacacctacaatatattataggtgttggtttttaattaactgaacttatgataaattaaacgtgttggttttttttaaaaaaacaatgtgcacctataatattggtttcaatttatctctagaaccaacacctatagtcacttaaaggtgccggttgtttattttaggtgccggttgtttatgttttcagcctacgggggtgggaaaagttatgggaaattttgctacagaacactttttatgtatggttttacccataggacattgcccagactcacttttgggggaaaacactccgtaaatatggtaatttgtcaatggacaccgcgccgattaaaataataatttccggttgaagaggatagagaaatcgcgtgaaatgtcaaaaatgcccttgggcccacatgtcagctctatctcctatttctcttctccttctccttctcttttctcttcttctcttcttcagctaccacggcgacgaagcatgcatagagcggcggcggcggctagcggcaagcgtgagccgcggctggtgtcgtgtcccaacacaactctaaaatacatcctctaaattatgcctagaataattaaaaaccgtgtgaaagcctccaacaattaaaatgtgcaaggttaaaagtcaaataaggcttagaggatttttgtatatttcctaaaagcctaaaatacgtaaataaattttagtggaattttcagagcacaaataataattgttaagaaataaacaaagttaaaaagattttataaaaagaaaaaccctaaaaagtcccccttccctcccttgggccggcccggcccatctctccccccctctctctctctcctctccccgcggccaatccggcctctccccgcgcgcgccgctgacgggcgggcccgcccgccaccctcgctgactggtggggcccacccgtcatccccttcctcccgccgctcccgccgcctcccccgtgccctagcgccgccgccgccacgaatcccgccgcctcccgtcgtccccacgtgcaataaagtggggggaattactccccgtgatcccctctccctttccccctatttttccctctctctctctcgttcaaacgggcggatttgcccccgcaaatctcgccggcgccattgatggcggccggacctcccgcgccggtttccttccccgccggcctctctctccctcttccaaccctatttaaacc

SEQ ID NO: 45915 - DNA, 18235 bp, Oryza sativa
gcctccctccgctccggccgcctcctatgcgccgccgtcgacctagggtgagccgtggaccgtcgcctcttttcccccttcccttcccctctctcggccgccgctccgccgtgcctatggccgccgccggcgaccataggggcgcgggcgccgcctcccgccggccgcgccgagtggccgccctcgggcgcgccgagtggccaccgcgtggggcccggccgtcagccgcccgcgccctcgggtgcggctgacgcgtgggacccacggcgccgaccggtgtgagcccgggtgcacccggtccaccgtggaccgtgaggctgccgcgtgggccccactcccgtggacccggtccgcgcgccccctcccctcggctgacgcaataaaccctttttaaattaaattttaaatgaagaaattcgcaaatattcatttaaagagcacataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccattggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttatctttgttatgaccttgttattgttattgttattatttccttgttcaccctagaataaacaaaaccccaactagtggacactctactcatggtaccactagtatgattttaggtagatgcttcgttggttaattaggcaacattaggtggttttacaactctagactttgggaatattctcatcacctggacactatggaatggatggattattgtggaattggattcacacctccccctctattcaaaaccctcaaaatagttttagtctgggctcggggtgcatggttttgatagtagcacctcggccatataaggatcggtcttcgggcctctgttgcaaagcactaccgtacttccacatgtctagtgggtaaggcttagtttgtggctcagtctggttataaacaaaagtacacggatggagatggatgaagtcgggggtcgatggacatctctaggacaaatgaaggctacacgagctgcggcccggtagtcgagatgtcatggcacagggccggtgtcctgctgctcggggctcagtcctgcctacctgtcccgggggttccggccgtaggtggggttgggtcggtactcttgtctatggctaggatgggttggaaactatgtcacgtcttccgtccgtataccgtggtggtatgtggcacgtggatacacgtgaggaagatgtgtcttgtgggtaaagatgtacacctctgatcagagtataacctattcgaatagccgcgccctcggttatgggcaagccgagcaatgtacctaagttagtgtttttaattcttaaaacctgcttaacaactaaaatgtggaatggttggcctgggttggcttgggacgagctaggacccagggtcgggttgccaattcggtctgaatcatcgtaggccttgggttaaggcaggttcgtgtgggttcacggccttgattaataatattgtatagctctaggaccgtgtttacaaaatagctttgagcaactaagtgtcttttaacgctgtttgctgcaaaccctaaccctttatactataacccccttgtactcccttgcatttattctgcacttgtggatgtgtcttgttgagtacggtggttgtactcagtcttgctcaatttttcccaaactcagaagaggagttcctggaagatgaaggctttggtgtctagctcgtgcctgccgtcaagcgcctgtggtcgtcgccctagtcttccgctgtttttcgtttgtcttcttgtgtgctgggccttcgccgcccatgtaatagattaattaattacgcttccgcttgttaaactctgaattgtatcaacttttggtgtaccttgcctcctgggataaggaataatgcacgcacgtaaggaatgcccgttgggttatttccggtcgtgacagctggcgagagcggcggtcgcctcttccccctctcccgctggcgcagccttatcctccccaccttctcccgccgccactccgccagccgccgagcgatcgcccgccactgccggcgctccactccacctgccgccgtgcaatcgcccgacgctgccgctccgccggccgcgcgctcgtccaccgccgacgccgccccgctccactccgccggccatcgcacgttcttccaccgccgacaccgccccgctctaatccaccggccaccgcgtgcttgcccacctgcttcggtcggccgcaagctccgctccaccgcagctgacgccttgctccactctaccagccgccgtcctcaccatctcctccgctgcgacgagctcaagccctggcgaccgacgccgccacatgctcctctgagagagaatatagagagagagatgagaagagagataggagatagagctgacatgtgggcccaagggcatttttgacatttcacatgatttctctctcctcttcaactggaaattattattttaatcagcgcggtgtccactggcaaattaccacgtttatggtgtgttttccctcaaaagtgagtttgggtagtgtcctagggctaaaaccacatataagcagtgttgtgtagcaaaatttgtcaaaatttatatagttgtcagttttaaaacttccggcacctataggcacgtcccctttttgcttttctgttgtagtggcatattgatgcagaacataagtaagtgctaacggaaattcagttttatagtttacaaaaaaatgtgctaagacttattttcaatacaggttggccatcatgggattcagaggacatcaatatttagatattcgctgttgttagcttgagttattcattccgtgaagtcttattagtttgattaattcaaataagtcatttaattatcttatttgatttacaagttatgatggatcataaagctcgagaagaaagctaacatagtcctccctccgtatttcaatgtatgacgccgttgactttttaactaacgtttgccattcgtcttattcaaattttttatgcaaatacaaaaatagttacgtcatgcttaaagaacatttgatgataaatcaagtcacaataaaataaatgataattacataaattttttaaataagacgaaaggtcaaacgtttgttaaaaagtcacggcgtcatacattaaaatacggagggaggatatgccaacaatccatctttgtttcccttgtcatgatctcaccacaccattcttctcttttctgtaatgaaacagagtccaatcccgcaaccccccccaaaaaaaaaaaagaaagaaagaaagaacaaccaaataagtcaggaaactttcctaaagaactgatccgtgtgtgtctaatctgcctcgatgtttatcatacactagttaatgaaatggcagagctcttccctcgaaaaacaaatagctcattatgtaatttcaatatcgttatttttcacgagaatcttggtgctgcggatgatcatggtatgcggtgcaaccaaagcaatccatgtggcatcaggctggctgcgtgagataacaagctgcatgcctcctaacacttctcttggaagttatatcctaatttcaagtgtattttgcacctatctaaagtagtgaaattactaaagtttctccaatcttgattgtgccacgtcatcaattaaacacagaccgttggatacacaaggaaatcaatagctgctatcagatgcaaagtaaagttgagttgaaaaataaaatctggtcaatggtagaatcctccagattgtggcaaacagcccatgggccatggagctgaagcgtcgtgtacgtatataaagataaagagaatcacggagcaggtaagaggatacgaaaaagaaaaaaaaaagagcgcagaacccatctcctcccgaaacccatcgccgccgcctccccattgccgttgcctcctctgcctcctcctccaccgcgcccactcgcccctccatacccacgtcgcttgcgcaaccccaccgcctcagatcctcccctaccatccggcgaagttcctcatctgcctttccatccaccccgactcccacgatgtcgccttctcctttccgcccccggcgtcgtttcccctccccctctctgcaaccggcatttcttcctcgcacagtccaccgcctcctcccctcacccattgccgccacctcctcgcctccacgcaccctccactcactttctcatccccatccccatccccatcccatgatcccaatcccaatcgcagctccaaaacagcatcggatcacaactaaatattttggtaagtcacaaactcagataatcccatcacctcctatctttgctttctcacactgtagccgggaactacatataaggtcaaaaaaatatcagtaataggatggactgacaaagagcaatgctataaaaatatattaaaaaacacatgtacaattatgtttctgttaaaaaaaaggattgttgttgtgttttgttcagcaagggaatttaatcttaaaggcggatagccaactcaaatgattcttttttcttggacgatggtttttttagcatcatcagcaatgatctaaaggtttggtttgacattaatgtgccttcgatgacagtaaaagacacttggtttcttgccctgcgtcagtctgttgtgcaaatatgcgaatcaagggcatcgatgtattaggagtttaggacacaattaaatgctaagcacatagaatatctattattacctgttcactttaatatttttgccttctgagttttgaagctaaaaaccaagcaaacagctcatggtcactatgttattggttctctggtgtgttcattaggcctgatggcaccttaaccttaacctgttaattaacaacaaacatcgatggcacctttttagttgtacaccaatcacctgaatagtgtaatttctgactttgcatttagcgtatgtaattagtaaatgtcaatcatatctactttctcaggcctacagggaagagttgagaagtcctccttagctttgggctgaagggtttttggttggcaacaatgaacaaacagacaaactacattaattgtgatgactctggattttttactacacttcataacaaaattgtgcatttttattttgtgatgtttattatgttattttcttgagatacttagaggtcaaatgatctttgagcaatttgtgttggtttcaaatcatggactagattgccgtttagtttgctaatgtgtattgcgttaggtttgactattttatgccttatgcatcatattgctgagtaaacattctcatcttttgatggtatacggtaagaggttgatcctggacatattatttgaaccttcagttcaaatatagcttgagctgaatctatagttctaactaatagtttatcaagttgtatgattctgtaaaagaaaaaaaatcaaaattaagtatgattgtacattacgggcacccaaagtcgtgcaacgcacgactaagtggctagtaatggtgattcttcatacatatagtttcccgatgcttcctaatccaagcatataatttccttggattatgtagggtcttggataaatatacttccccaatgcttcctaatcgaaacatataagataaggctacaaaattcagatgtatggtcttggatgttgtgttacaactagcattaagaaaatgttaattataagttcttgaaagtaaataattgactatatgatgtatatagataactacgaaaacatgtaaaagaactatagctggttccacaatgcaactgttttttttattttcatgccttagcagtcaatgatgtgaatggagaaatattacattcactaccacataacaccacatcagtgctggttgggaaccccacatagatgtcggttttcccagccagcacaaaggaggcagcactgatgtaagtattcaaaggtgccggtttaggaaccgacacctttgaggtcccaagaatccaaaaaaatagggctcgatgaattggctcgaatcgagccgatgcatcgagccgttccccgtcaccccgagaccattgatccaaaacaaaatcacagatgtttctcacatgagaccaccttcgatccaaaacaaaatcacagaagtttcacactatcaccatcgattcatccaacacatatccctcgaagcaaatcacagaagtttcacacaaatgacagatgaaagaatcacaaatcacagatccctcaacaatttcatagaaacaatcactgttgccactgcgtcgcaggatccatcgcaagacccgccgcagacgccgacccctgatgcggctccgcccgccgtcgccacccgaccgccgccgaggccggatcagtcgtgggagccgccgacgccgacgctgccaccaccaccgccgaggccgcctcgcccacccccaccgccgcatccgccgcgggagaagcagccaacgacgacgccatatgcggggagaagaaggacggggtgagagagagagagagagaaactgagagatagaggggcgagagagagatcgagaagccactagcgagcgccttatccttatctcgtcttggtggggctagccggctcagctcgatttggatgtcagtctttttaaaaaaccggcacctataatatcttataggtgtcagtttttaattaactgacacctataatatattataggtatcggtttttttaaaaaaatacacaatatataataggtatcggtttttatttggaaccgacacctataattgcttaaaggtgccggttttttacgatttcaacctgcggaggtgggaaaaggactataggtaccagttttagcactaccggtatctatagtggcgagaactatttgatgttttgtagtagtgattgggagaagagtgaagttcgcagcaaaagagatgggtgctgaatatatgcacgaagcacagaagaagagatcgttgttagttatactaaatgtcaataatagaaataggattaactcctataatattttaagcgtgcataattttaagtatccctttgtacttactagtataaaaatagatggttgttcgtataggattgttgtcaaatggacaactatgccacgtcgaaaggcgtggttctcctaacagtagttggaatttaaaagtaattgtattgattcgtagaattttttgggatcccccattacatggccctagaggtctatttatagccttagcacaagcttgcaccttctagggcttagggttataggggattttacatgggtgcccttatgaaagggacatttacatgggtacgcagtgtcatttacacatatgggcctttaatggactgataggctgggcctggtctatagtgaacaggcctaaaagaccgggggcagcctgttgggcctccttgatgccgaactcgtcatggcgaagtctttgtagttcgctcgagatgccttcgcccaagatgcctttactttcggagtaccgacgcggctttccagccttcgccatcttcgcttatagctttcgctatagggcttcgcttgaaaggtcttgacatctttagcttgaatccttgctggtactatggtttcggcaggtccggccgaagggcttcatggcatgcctccaacaaggatcaacattgcaataagtactgattgacttcccattgcaacccaccgtttatatatatagcgatgcaagagaaggaagtaatacctgcttcttctccttcctacaatcctaagcggaccaacaattcagggtgtttaaaactggtagagatgaaatcttataatacgaatttcatgcaaaaaattgaaagaagaattgtgccacgtggcaacaccggtttcgcgggacggctcgatcctgcttgcgtgcgtacagtgtgaaacgctcgtgtgcgtgcgtgcagcggttgtccagaaggtcgtccagaagtttctattgatcgagcaattaggtccatgggggcacagcaggctatgtgatttttcgcgttgccgccgtacggctggcaaagctcaggcagctattgcttcctcctaccaccggatattgaggactaaagaactaaagaagtaatgatacatactttggttagagactaaaagaggattaacaggatgtaatcaaatcatccactaaaattcctacgttgcaaacatccatcctttggcagttcctgcgtttccttattttgtatctgtactcatgtgatttatattatttcttttctgtgttttcctctacggaaatcatagaaccttttctctttgggggcaatttcattcttactcctactttgatgtttaacattgatgttgcccagtattttgggttaattcgatccatgccactgcaactttaacaaattaaaaaaataccactactattcatcatatcggtttcatgccactaaaaaattctaaaattggaaccatgccactcccgtcgctttttacgtcctcctccctcacgctgtttcccttcccgttgtcgacaccacaccacatcttctttgtccccaacgccaccgcaccacgtcggcctcgccttctccccgccggcgagggccgccgccgctgctcctccctgtcctctccccgcacgtaccatgccgctgctgctactcctgctccagagagcaaccagccggaggagagctccagatccggcgccgccaggaccgccgacgaggtccaccgccgctgctcctccctgtcctctcgtcgcgcgcaccgtgccgccgctgctactcccgctccgcagagcaaccagccggcgagcagcgttgcggggatccccgtctcctctagatccgacgccgcgggcaccgccgatgagggccgttgccgccgctcctccccaagctcttgtcgtcgtcgcccaccgcggccatctctggtgagaacctcaagatccccgtctcctcctccagattcggtgccgccggcatcgccgacgagggctgctgccgctgctcctcccccatgctcttgtcgtcgtcgcccgcggctcctcggcctcgccaagaagctcgccaacgattcctcctgttccgatctcctctgccgttccccgtcctcaagaacggcagcgccgcgtacctcctccacggcacaccgccgccgacgacgatgatgatgccgcggtgccccatccacatcaagagcttatcgtcgccggcgcagcatgttcagggagttccgtgacgcggcaccatctcccgaaacgcctgacgctgacgccaccgacgacgactacctcggggagcttgacttcgaagatgaggatggattcgacgccgactctttccttgccgccaacgtcctgtacagtgccgccatacatccatacataagaagcctcatggtgctcggtctcatgttccggcaaggctggctcaacaccggccaagcaatgaagcagcatggcgatgagagtgattggtggatgtgccctgctcaatcgccgtgagagaggacgaggacgggaagggaaatggcatgagagaggagacggaaaaagggatgagagtggcatggtttcaattttagaaatttacaatggcatgtagccaatatgatgaatagtagtggcatttttttaatttgtcaaagttgcagtggcatggatccaattaaccccagtattttagggttttgtttttgcccatggtttcttgaaataaagataaattttgctcctacttttgatgggcagattaacaatgttaaatctttagcgagaaggcattaaatacccttactcatgttgcaaacttcccctgtttttgtttatgattgagaatttgcccacatttagcacatgaaccttgcaaattcgataaacttttaccaatatgataattttaacataaacatcaacaaaaatttgcttcaaaatttcatatcttgaaaaaaacaaacagacaagtcaagcaaatctgttgcctacatgtgccaagctgtcgtcgtcgcctcctctcacaaactgccgccaccgttgttgcctcctcttctcactgagccgccgccgcctcctccccacgtcgagccgccaccatcacctccccgcgctaagctgccgttgtcgcctcctctcatcgagccaccaccaccgccgttgacctgttgtcctcctccccatcgcctcctcgacacgtcgagcagctgcacctcctccctacgctgagctacagcagccgccattgtcctcctctctaccatggcctcttgcgcaatgcctagcctcctcctgcacgctgcaactgggttgggtggcctgcacttgctcgggtcgtgcccgttgcctggccggccagcccacgaacactgccgccactgcttcagaacggggatttgggttcaggaagggaagagtcgatgccaagtgctcaagcctggagggacaccaagcggtacttggatattttctaggggtaaaagggtcaatcgataatttaaaaaatcgttatctcttttttttctctaattctttgccgcattaagtccaatcccactcacttccatcaaaaacaggggtaaactcctcattcgtttgaaaaaaatagggcaaaaaacaacaaccctaaaatgtagggtaaaatcagtattgggcatcaaagtaggggtacaattgtactagcaaaattgtccctttctcttttctccctcggtcaaatgcaacctatatatgtcttgtaagggctactttgaaataaagattgagggatgaataggaaaaacatagaattctgacaaaaaatcaagcgcaaaacaaagaattataaaacacataaaaaaatatataaaataatcatttgattggacggtacgaaaaatgcaagaattagatgagagagataaactcataagagacttcgcgtgatattggacctcatgttaaaaatactccaaaacttgtatgaatttgggcattccttagaaatttgataagactcaatagttttcaataatcctttggttcaaagaatcatatagaaaattttcctatagcaaaatttattgtttctatacacaataaaagttcctatatttttctttcaagtaaggggggccctaattagttactccactaaagtcgaatcagctgggttcactttaccatgcgtggcgaagccacgcggtttttctagtttaacttagcgcacgtaaaacgaaaaaatcatttgcacattattaattaattataaattattataaacttaacaaatagatatatttgatattttaaagtaacttctgtatagaaatttttcacaccatttagtagtttaaaaagtgtcccgacggaaattgaggtaaaatctgaatcttaataagaaaaggaaccgaatgtgagtgaatgtgtttccgtaaatgcaataagctgagtggttatagttttcataaatgcaataatctagagtgaatgtaaccaaggctgcaatgtaagcctcggttgcgaattcacatgtgaaaattttgagtcactaaagattgggagatagaaagaggagagagctgcttacttgttcgggtacttcttttgcattttgtttcgtgtttttatcagcattaacagcaatataaccagctagcatagtcacgacgacagtattcttccatcctgctcacttgccgaggtgaattcactaatcagaaaaagttaatctccgtgatagtcaccagtacgtaaaaagaatggagtatgtttaaacagatcatggaagtagacagtatttgaaaataattgaataatgtgtcatttaatttatttgataaatctattggtttatcgatctatcttaaacaaataggatattaacaactgaatcatctagagaatgctgtctcggaaggaagaaaaactgaaaatatatgttttttccttaaatttgtaagaaaatattggttgggaattgtataggaaaaaaaaataggagacgactccgcgtcagatattccaccaaatatgcctacgcgcctgtcatgcctcctgcgtgcagcatgcatcctccgtctatcatgcacctccgtatgcctccgtatgccacatgcagcctaccacgtatattctagcacatgtgcctgtcacaccacctcttgcttttcctctttccttctcacatatactagcacttttttctcctttttttctttcaccaaaagttaatcaaaattttcttttaaaatatacatctagtttgtgatttaattataccattaagtttgttatatttgaaatttttataacatatcttatacagttatattttgattaaaaatatatgtaaaaaaatcaactgttgtttcacaatttatataaaattgtttcacctcactaatgaaatgtgttctagagaaatgcaacatataaaatatattgattataacaatgacaaccattatacgaaacattaaatacgaacgggtgatacacaaaaaattcatatgaatatacaaaatatttgtaaatacttaattacttttaatattttctttatctcatccatgtagcacagagttgtaattgttgaaaaaaaaacctgctgaaacataaaaaaggattatgtgcaacatttgtaaataaagtaatacttattgaaacatttatataataccatatgcaacattaaaaacatccattaaaaaaactttaaatgtgcaacattgtctaattttaaatgacacattctcttctcaccaagtgaaacatcgaattttaacggttgaaacatataaatatatgttatcgaaatataatcatatgatatcttattttgaaaccacagattacaaaatgaataacagaactcgatgataccgacgagaccgtagtcgagttggtttgactagatcacccggtgacttggctcctataggcttcgacttcgtaggctgtggtggtttgtgttggtggtgagatttgatgccttaggtccgggggtcccttttatacccgtagaccggatatagagggtattggggtacgctggtataaggatctacgtagtatgacatcaagcaaacaggaaacagagattatactagttcaggccccttgataggtaatagccctaatccagttgatatgggattatataatggaaaccacatattacaaagggaatagcagaactagatgataccgacgagaccgtagtcgagttggttcgactagatcacccggcgacttgcctgctgtaggctccgacttcgtaggctgtggtggttgtgttggcggtgagattcgatgccttaggtcctcccggggagtcccttttataccgcgggtcagttggtctccaagtagaactcagagacatcggaccccacacgatacagtaacgacccagttctgtccgagtaggactccttccatccgtgaactccgtttctattacgtcatgaatttccttaacgtgtacaggaaacatccgtacacgcgcaggtataccatatcagtatacggcatacatccaagggtaaagagtataccttatccgtaaccctaacagtagcccccgacttctgcttaaatgaactcatgtggccgatcatgacttctgatgtcggaatcgttatcgctctcaactggtcgatctcggtatgagaaccgtagagacaaagagttatcgataacattgtatgaagttcaacggtcatgagtgaatttaaattgaagtccgaaaactactgcgcgtaacggacccagaaatttccggcggccatctctctcctttccttgaaattcacaccatcggtagtgcgcttatttaagggagttttggggatccattttgaagtccgtttgctgcaaaactttccagcccccaagcgtccctcgtcttctccactcccgcagaaaaaccctagcttgctcatctcggtctattcaccggcgatctccggcggcgatggatctcgacaagtccacctccaccaacgcgtccctgaagaagctgcaggatgacggtgccctccctggtcgcgggaccatggagagagaaccaggaggtattgaacccgaacctatcctgggccgcatggttttggttgaggattatattctttgcggttttcttcctccgccctccgagcttcttcttcttgtcttgaatttgtacggtctttccttgctccatctaaaccccaattccatcgccttcctcagtattttctcttatctttgtgaggcctacattggggtaaagccatttattgatctcttccgcttctactatgagttacgctggatggaacctaaaaaggtatccagatgtgtcggtttccgacttcggaatggcctgaagtcgcgatacatccccttccagtgcccctcttctcgtagtaaatggcgggcgagatggttctatcttcagatagaacattcggatccagtctttgttgtccctgaggaacaaccagacaagatttcggaatggaccgccaaacccgccctaactccccccctccagtctttcatcgatatcatcgatgacctccgagtacgagggttgtcggggtatgaagttgctgccgacttcatcggtaggcggatccagctgctccaggctcaagcccacccagcctttgactattctaggccggaggacgcgacccgggtttctcctcggggtatttttcttgtatttcggatttcattctttatgtgcatgttcctcctgacttattgagttctggttctcgatcctacaggtttgaacaacgaaaccgtggagcgccgcatcggccaagtgatgatcagcggccctacgacagtgagcaacatccccgtccccctttgcgagaagggaaaggccgatcgcgaggctgcgatcaacgtgagtgtttttgatgactcctttacttttgctttcctgggatcgcattgtgacatcatgtatgcaggctctccctttaacggacgtcatcgagctgctcgcggatcaccaggcggcagcgtcgttaaaggagggcgttgccaaggaggcgtccgacattgctgttgctgctgccacgacgagtggcaacaatgttccaaagaaagggaggaagttctcctctgtacttggaaaccgtcggaaagcgcctactccgtcggtaagcctctcatgtttcttaatcgtgtagtcggaatactttgacctcatatcgtgctatcttgttcaggcctcggatgcgtctcctccgcccaagcgaaggcaaaggctggtgacgcttggcgagaagtaagtagacgttttagaagtcatcctattcgcaaactcttgcttgcatgtcttcatgaaattgcggaaatccttcccagggcggcatggtcgaaggcggcgcaagatgggtccggcgcgacctccaatgtgtctcccgtggtggcctcgacggacatcgtagtcacagttagggaccgggaggcgacgctgagtggacccgctggcggtcttgcgcccgctcggggcccgccagttgatgccctcacctggggggagctccaagctgagatggagcgcatcctccaggctggtgcccgcagcgtgggccgcgagatcgaggaggccagggcggcggcggtgtcggcaatccaacgcgccgagcagctggcgcgagatctgtcgaagacccgcgaggacctcctcaagatgagggagttggtggccggcaacgaacggcagcggcaggggctcaagcacaggatgtcggagctcgagaacaacctgtcggagatccgcggctcgctgcgggtgtcttacaccggtctacaccaactcaccggggagtgtagcgtcacgaccaccatcccgacaacccccgatgagttctcgctgacgtcctcgctcgcggagctagctgcggcgatggaggagatcccctccaagcatgcggccgggatcggcgaggagacatcgaatgggatctacaccagggggtgccacgtcctcgcgtacgtgaggttggcgtgaggattctggatcagggggccgccaatgacgcgcgcaagggcgtgatggaagaagtcggtgatttgggggagtctattctccccatttttgaagattaggactttatttcccttgtactccttactcaattatgcttgtaaaactttcgtaggttcaaactgcttttgtgtatgaagttgtttccttcgttttctttagcatgttgattccgagtactttgttgtcgttgtagagatgtcgatgtcgaggatgtccagcagcgcgggcagcctgagtcgccggtagtcgttccagcacttgcgcttgagccgtatgtgcagcgggacgatatggatcaaagcctgtccggggaggcggacatggcgatgactttcttaggttggtacttttagtcttcatctccttggctcttttgttcggatcgaattaatttgtcgtgttctcgaaagaggagaatgacttgacttagtcatttctgtgttgagcagacctggagagtgtgttggccggccgagatcatcggatctaatattggaggacgaagtccgaggtggccaaactcaagaggactatggtggaagtcaaaaaagaccaagccgtggaagcgctccaaggttgcgaggtgtggttcaactcgtacctcaggagctgttgtatggccatggctggagtctgcagggaactccgagtacctcgcgggaatcccgaggagtcagcggctggatacatctcgtggttgaatggggcctgcgctcagcttgaaggcatcggcaagcgtatcgacgaggccctgaagcaggagtttcgtcgatcgagccgatatgccagagggcacgtgctggcctgtatccgagatcaccgcccgcagcgacatctcgagttcctccacgaagggttttcacattctcggaggactcccacagagatagataatctggcgaagtcgatggagccgcttgcggagaaagtctttcagtctatggactagcgttggccgtcctggtagtctttatgtcctgttaaaattatctcaaggagacgtgtaatatattttggagcaattatgaattgtaagaagtacttgagaaatagaaaaaaaaatctatctaactaagttttcttactctagatgtgttgtgtatgagtgttttctcacttcacgacttcgatcagtcacttgagtcatacactctccctagcccccaaacttgtcttcgaagaattgttctcggaagataaggctcttggacccttgacctgccttggttgaacaagcactgatcctagcccccagccgtgaagttggaaaactcagtttccgattacacggcttggttaatacgcacggcgagaactcttacatgaccagatcttacatggtcgtttgtctctacatgatccgacaaggccttatccgctctaggcgtccccagccgaagttcccttaggttcctcagaggcctcgtcaagacagcataaagggacatgaggataggtttcaacgctaggtgtcgtcgtggtaagggatcgtcgggaaggaacactttgatcgtagtctttacctgaaatcaactttattgaagtctccacccgcggtgactgccagcgaagtccgctcgggagagccggagaggatcactgcggtgacctcccaaccagcgcggggctccgcgtcgtctccctcctgatccggaagcggcctggcctggtagtccactccgtgtggataccctaagaccacgcacatgccccgcagctccaagacgaagccagtcatgtccaaaccacgacgggtgacgctgccggccatctacaaacaaaaacaaaaagaaaagcaagatttcaaatgtcagattttgatgataagtgaagcagcaagacagagagagactagacagttttcacaaataacaaaggatttttatttttgaaaatattgctaaggcttgggatctacggctcgtcctaaggtcaaggatggct

SEQ ID NO: 45916 - DNA, 1086 bp, Oryza sativa
tgggttccaatcaacaatttaatttagcacatagtgactataaataggacttagacttttggaaaaaaaccaaataatggaataggtcttagacttttggaaggagggagtacggaatgagagaattgctccttgaaatatgtgttgtgaagtgagaagctcctctacttgtatagcctgcatatgatggttgtaatggtggtttccaacgttggttcacttgtaactgtcattgagagcctatggggagccgccatgtggaagatggcggttagaggtgccaaggctggttccgtcgaattacctccaccgcctctggccaccgtttttattgtgtgtatgacatgtgggctcctatggcggttgaggatggtttggctccactttaggtcggttttgactgacgtgtggtgcatgccggctcatttcaactttattttatttgtttattccttgcatacatagtatttctccaagacaagtgggactacataatatacatgtaagaaatgttagttctcccttcatttattgaggtagttgacagtcaaaatcggtacttaataaccgtcatatcctcctaggttaaccaaacttctctattttattctataatggatttagatcggttaggtacataaaaattcattttccatagccaaaacattcatttcattgaggacagtaggacaaggaacaatagctcaggttcaagtagatcagttaggtaagtaactagattagttatgtcaatttgctggtattatgttgctctatgcaatatatttttttgaagaacgctctatgcaatatattcacaactctcattttcaaaccaagaacacttactggtttcaaccaacctgagccatctaacatggttgtaatcctaccatgtcttagagagcaaacaccaccagttgcatggaaaaaggccaagagcaagataagggaaagccactatgttctgttgctcctgacatgccagctatgggcacaaggaacagaaataagagtcatgcaatgggcactagttgcaaaagaaagattatggagtaaattagagatatggctagctgattaggt

SEQ ID NO: 45917 - DNA, 13879 bp, Oryza sativa
ggcggcgctagggcacgggcgggcggcgggcgcggcgcgaggtcggggatgacaggtgggccccacccgtcagcgagggtggcgggcgggcccgcctgtcagcggcgcgcgcgcgggggaggccgatgggccgcgggggagaggagagagagggagggagagaagtgggccgagccggcccaagaagggaaagggggggaaagaagacttttagggatttttctttttataaatcctttttaactttgtttatttcttaacaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattattccttttagaaaatgatttttatttcgggatgaatttatcaggacgtgacacatatagaatcatatccaccttgggtctttggaagtccggtgatgaaatccatcccaatttcatcccatttccattcaggtacttggagaggttggagaagtccggccggtcgttggtgttctgccttgacacgctggcacacatcacatagggccacatactctgcaatttcccgcttcatgctaacccaccagtatttctcccttaagtctaagtacatctttgtactgcccgggtgaatggaataaggactttcgtgagcttcctgaagtatcagctgtttaagttctctgttatctggaacgcatacccgctttccgttccatagggttccgtgttcatcctctgtgaaaccagcggccttaccctgtttcatattcttgaggagtccatgcatgtccggatcattcttctgagcctcgcggatttgatcgagcaaggtgggcttggcttccaatgcagctaagaatccacgacccactatgcttagattcagggcttccatctgttggttaagttcgggtggaatgcctcggacgttaagagtgttgcaatggccctttcgacttagagcgtcggcaaccacgttggccttaccaggatgatagtgaattcccacatcataatccttgatgagttctaaccatctcctttgccgaagattcaggtccgactgagtgaagatgtatttcagactcttatggtcggtatagatttcacagcgattcccaatgagatagtgccgccagatttttagagcatgaactactgcggctaactccaaatcatgtgtagggtagttgccttcatgaggacgtagctggcgtgaggcataggctaccacataaccgtcctgcatgagcacgcaccccaatccttggcgcgaagcatcacaatacaccatgaagtccttgcgagtatccggcaagattaacaccggcgaggaaaccagcttttccttgagagtttgaaacgccttctcgcattgcgggctccacacaaatttctcttctttcttcaacaactgtgtcatgggtcgagcgattttggagaagttctcgatgaatctccgatagtatcctgccaaacctaagaaactgcggacttgagtaactgtcttgggttgcttccaatcggtgacggcggtcactgtttcgggatccacagcaactcctttagcagatatcacgtgccctaagaatttgacttcggacaaccagaactcacacttgctaagcttggcatacaattgatgttcccgcaactttcccaacaccagacggagatggtgttgatggtcttcctctgattgtgagtatatcagaatgtcatcaatgaaaaccacaacaaacttatccaagtattccatgaacactttgttcatcaagttcatgaagaaggcaggcgcattggtcaaaccgaacgacatcaccgtgaattcatacagcctgtatcgcgtggtgaatgcggtctttggaatatcttcttcacgaatacgtagttggtgatatccggaacggagatcaatcttggagaatacagtggcacctttgagttggtcgaacagatcatcgatccggggaagagggtacttgttcttgatggtgacttcattgagagctctgtagtcgacgcacatcctcttcgtcttgtctttcttctctacaaaaatcacaggagcaccccatggggaagtactcggacgtatataccccttttctttcaattcttccaactgtttctttacttcggctagttcatttgctgccatacggtagggtcgcttgtgcagaggagtggttcctggagcaagatctattcggaactcaatctctcgcttgggcggcataccaggtagttcttccggaaacacgtctccgaactctctgacgatggggatttctgacagttctatctgatgaagttctgaacttctgacagaggttgggggtgcaaagaaaacaaccggttgttctggccctcggtacagagtgacagtgcgtcttgcgcaatccactactccttggaattgagccaaccaattcatcccaagaatcacatccaagttcttggtgtctagcagaatcagatccgagggaaaaggaatcccctgaatttctatagggacggcaggactataatactttgctgtcataacccctccaggggtggtgatgagcagagggttcctaagcctttctacccccaactgatttctccccacgaatggcacagatataaacgagtgggaagctccagagtcgaacaaaattgtagcagggatggaatgaacgaggaacgtaccaacgatgacgtccggagttgtcagcacgtcctcggccgtcacgtgattcacacgaccccgaatgacatccttcccgccgttgttggagcggggaggcgcttggccttgctgacgccttggctttgggcatttatccgcaaagtgcccgggctcgaagcagttgaagcacagacgctgcggacctgaagcgtccctgcggccttgaccaggctgcaccgttggcgtaagaggacggggcgcacgagtcccttgctgattctgctgctgctgcggctgtgggacgcgcaccacgaattgaggtcgaggcgcggagcgaggttgctgctgctgttgttgctgctgcgaggaggatccccctggatagggattggtgtagcgaaccctctggttagcaccctgttgattgcggaaattcgccaagcggcgcttgtgcgattccagctccttgtgcttggcttccaagcggatgctcttgtccaccaatcgttgaaaatccggatagtccccagagactaggcggacggacagctcggggtccattcctgccaggaacttctcttgcttctcctcatcttcccgcacatcctctggggcgtaacgggccaagttgttgaactcgtgcaaatactccatcacggagcggttgccttgcttcaactctcggaattcccttttcttaagagccacgactccagcgggcacatgggttctccggaaagcggcggtgaagcgagcccaagtaataggttgctcccctggctgcgtagcctggaaatggtcccaccatagagatgcgggtccccgcagctggtgggcggcgaagacgactttctcctcatcgctgcactgcaccgtgtctaacttcttccccacggcatgcaaccaatccaaagcatccacggggttgttggagctggagaaggtaggtgggcggatgcggaggaactcggcgagtttagagtgttggggaggtggtggtggagcattctgttgtggcggattttggaggtggtggaggaaagcggtcatcatgttggcttgctgggcgaggatttgggtgagaatggcattggtgtctggtggtggtggtggaggcggaggaggaggtggaggtggattgccttggtggttgtggttgctgccttcaggttgattgccatcaccggtagcagcgtttctcctggtcgtcaccatctgaaaaccccacacagaaccagcaaacagagaaggagctaacaattaaaactaaccacccacgactaccattattcttacatttattactgctattaaattggttcattaatgttcaagttgcttaggcgaataaaataagacaggctccgacatagttatgccacacaccggcataaccatgtcccacacgactcaacaagaagacaaacgagaaaaacacacgcgcaagcctactaactgctcgtctactgctgcgacgggccaggacggaaggtgagcaacagcgcaccctccgtgctaccaacgccggaaggcttccccctcctggggaaccacgggcgcaggctcggcacgaggggtctcgacgaagcaagtccacgccagggactgacgaacaagctcgggcctggaggtgctcttgcgggcggtgatcttctggctgcgtgtaacgtcccgccttcccccaggccgggcccgcttacatctgatagctttcacaggtcatagactgccctcacagaccaacacatgtcttttctgcacactttgtcctcactcgtgtgcaccgggaagaatttcccggtcggtcacccatcccaaattgctccaggccaagcatgcttaaccttggagttctttggagattggcttccggaaaagaagttgcaacttgttgatatgaatattctattaatcctattaagccctagaccgggatgttacaccctcacccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacatgcgcccgtgaaaccgcgagagtcggctctgataccattttgtaacgtcccgccttcccccaggccgggcccgcttacatctgatagctttcacaggtcatagactgccctcacagaccaacacatgtcttttctgcacactttgtcctcactcgtgtgcaccgggaagaatttcccggtcggtcacccatcccaaattgctccaggccaagcatgcttaaccttggagttctttggagattggcttccggaaaagaagttgcaacttgttgatatgaatattctattaatcctattaagccctagaccgggatgttacaccacgcttgtcgcgaccgggaaaattgccttttcccgaacgctagtgtattaatccccgtcccaggaaaagccggggtacaccacacaaacatgatataaaagacacatttttattatatcgataatatttacattattacaaaggcacttaaggcctgacaatcaaaaataaacagcaacggactagcgggcctacggctccatcttcacaggcgctcaactggggtataagccaggactccacctaagacatcttctccaacgcttctcttactgaagaggggaaagattgagcaagaatgagtacaaccacagtactcagcaagccacaccggcagatgcatgattaatgcaagggggtacaaggggtaataatataggggttaagttttgcagtaaacagcatttaaaagtcacttagttgcccaaagccattttataaggacgatcctagagctacacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttaggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcctgcctacggccggaacccccgggacaggcaggcaggactgagccccaagcagcagggcaccaaccctctgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaaccacctaatgttgtcctattaaattgcgaagcatctacctaaaatcatactagtggtaccatgagtagagtgtccactatttagggttttgtttatcctagggtgaacaaggtaataataacaatagcaataataatgtcataacaaaggtaaataggcatggctaaataaaacagtgataacgcgggaatttaaataaagcgataatgcaataatttaagtcaaaataattttataaactgggattcaatatgttcaaggatgatgtgacttgccttgctcgctttcccaaacgccggcttcaacttccacgaagagcggatcttccgaagctgcagcgtctacacgaccaacggaaaagaaaaggcttttactctactaaactccatataacaagcagaaacaaagcacaaaaatgggttcttggcttcttaaggaaaaattagagacttgaacggtccaattccgagttcaaatggccaagatatggccatttgaagtttatatgctctttaaatggatatttacgaatttcttcatttaaattttaattaaaaaaacggatttattgcgtcagccgggagagagggcgcgcggaccgggtccacgggagtggggcccacgcgtcagcctctcggtccacggtggaccgggtgcacgcggctggcgctgaccggcgccgtgggtcccgcgcgtcagccgcacccgcgggcgcgggcggctgacggccgggccccacctggcagccgcggggcgcgcccgaaggcggcctcgccggcacggccgacgggaggcggcgcacccgcgcaccgatggtcgccgccggcgaccaacggcgcggcggagcagcacccgagagagaggagggaagggggaagtgaacggagcggtccacggctcaccccaggtcgacgaggatggcggaaacgacgaccggagcggaggaagacggcggcgcggctcggggtgacgaggacggcggcgttccggcggtcggcgagcgaagcggaggggtggacggggtcgacggggacgcggcgaagccgacggaggtggcgccgagtcgggaggaggtccggagcgacggcggcggcgaaccggagctcggcggcgacggcggagagaaggtgcgacggtgcgggcttgattccgacggggagagcgagcggcgagcggcggaaacggaggagagaggcacggggaacaattatatagcgtcgggagtgggagagagcggccggaggagaaggaaacggccgcggagatctcggccgccattgatgcgccggcgacgattacgggattgaatccggacgaatccgagggagagagagagggaaaagcagggggaaacggagagggaatcacggggagtgatttccccctctttatggcgcgcggggatggcgggatgcggcggattcggcggcggcggcggcgctagggcacgggcgggcggcgggcgcggcgggaggacaggaatgacaggtgggccccacccgtcagcgagggcggcgggcgggcccgcctgtcagcggcgcgcgcgcggggaggaggccgatgggccgcgggggagaggagagagagggagggaattgggccgagccggcccaagaagggaaggggggaaaagaagacttttagggtttttctttttataaaacctttttaactttgtttatttcttctcaattattatttgtgctctgaaaattccactaaaatttgagggctccttttagaccaaggagaatttaacaaaaattctccgggccacattcgaatttttcttgtacgtattttagtgtttgccaatttcttttcgaattttaattaattctattattccttttagaaaatgatttttatttcgggatgaatttatcaggacgtgacactgcggcagacgcggcgacgcttggggcggcagatctctccctgggcgatcttgagctgatgcagctgcgcctccactgcgtcgaggtccttcttgagctgcaggttctcctgacgcagctccaggatcttcatgttgttctcgaccatcccgcggcgcaccatctgatggaagtcgatacgagccgcgtcgtacgcctccaccatgcgcgccaggtgcacgatggtagcgtcatcctccgagctagcatcccggaaggtggcgtggtcgcaggctcctccgcgacgagggtggtagcgatagggcgagtgctgcaactcatccgggtagcgctggtgaagggtgccgatggcgaggagagcggcgttctggcaagcggcggggaaggagtctccacccgcggtgactgccagcgaagtccgctcgggagagccggagaggatcactgcggtgacctcccaaccagcgtggggctccgcgtcgtctccctcctgatccggaagcgtcctggcctggtagtccactccgtgtggataccctaagaccacgcacatgccccgcagctccaagacgaagccagtcatgtccaaaccacgacgggtgacgctgccggccatctacaaacaaaaacaaaaagaaaagcaagatttcaaaggtcagattttgatgataagtgaagcagcaagacagagagagactagacagttttcacaaataacaaaggatttttatttttgaaaatattgctaaggcttgggatctacggctcgtcctagggtcaaggatggctctgataccaacttgtcacgaccagaaataacccaacgggcgttcctgacgtgcgtgcattaatccttgtcccaggaggcaaggtacaccaaaagttgatacaaatcagagtttaacaagcggaagcgtaaatagttaacttattacatgggcagcgaaggcccagcacacacagagacaaacgaaaaacagcggaagactagggcgacgaccacaggcgcttgacggcaggcacgagctagacaccaaagccttcatcttcaaggagctcctcttctgggcttgggaaaaaattgagcaagactgagtacaaccaccgtactcaacaagacacacccacaaatgcagaataaatgcaagggagtacaagggaattataacataaagggttcgggttgcagtaaacagcatttaaagacatttagttgctcagggctattttgtaaacactatcttagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggcggggtgaacccaatttcacaattcaccaacaattccacagtgtccaggtgatatgaatatttcccaagtctaaagttataaaaccacctaatgttgcctaattaacttgcgaagcatctacctaaattttaaactagggataccacgagtagagtgtccactagttgaggttttgtttaagctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatattcaaagatgatgtgacttgccttgctcgctttcccaaccgacggcttcgacttccacgaagagcggatcttccgaagctgcagcgtctacacgaccaacggaaaagaaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaaccgggtttattgcgtcagccgagggagagggcgcgcggaccgggtccacgggagtggggcccacgcgtcagcctctcggtccacggtggaccgggcgcacgcggctgacggcggccggcgccgtgggtcccacgcgtcagccgcacccgcgggcgcgggcggctgacggccgggcccacttggcagccgcgagggcgcgcccgaaggcagcctcgccggcacggccgacgggagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaggaaggcggcggcgcggttcgggacgacgaggacgacggcgctccgacggtcggcgagcgaaacggaggagcggacggggtcgacgacgacgcggcgaagccgaaggaggcgacgccgaggggggaggaagtccggagcgacggcggcggcgaaccggaactcgtcggcgacggcggagagagaggaaagcggcgcgagcgcgattccgacggtgagagcgagcggcgaacggcggaaacggaggagagaggcacggggaacaattaaatagcgtcgggagagagggaaagcggccggaggagatggaaaccggcgcggagatctcggccaccattgattgcgccggcgaactttgcgggcacaaaatcggacgaatccgagggagagagagaggggaaagtgggggaatcgggagagggaatcgcggggagtaattccccccactttaatgcgcgcggggacggcgggatgcggcggattcggcggcggcggcggcgctagggcacgggcgggcggcgggcgcggcgcgaggaaggcgatgacaggtgggccccacccgtcagcgagggcggcgggcgggcccgcctgtcagcggcgcgcgcgcggggaggagccgatgggccggaggagaggagagagagggagggaagagaagtgggccgagccggcccaagaaaggaagggggggaaagaggacttcttttagggttttttctttttataaaccttttcaactttgtttatttcttctcaattattatttgtgctctgaaaattccactaaaatttatttacgcattttaggcttttaggaaatatacaaaaatcctccaagccttatttgacttttatctttgcacattttaattgttggaggctttcacatgaattttaattattctttgcacaatttcgaggatgtattttagagtcgatttgggacgtgacaagggattatactggttcaggccccttgataggtaatagctctaatccagttggtatgggattatataatggaaaccacagattacaaagggaatagcagaactcgatgataccgacgagaccctagtcgagttggttcgactagatcacccggtgacttggctcctataggctctgacttcgtaggctgtggtggttatgttggcggtaagattcgatgccttaggtcctcccgggggtcccttttataccgcgggtcagttggtctccaagtagaactcagagacatcggaccccacacgatacagtaacgacccagttctgtccgagtaggactccttccatccgtggactccgtttctattacgtgatgaatttccttaacgtgtacaggaaacatccgtatacgcgtaggtataccatatcagtatacggcatacatccaagggtagagagtataccttaactgtaaccctgacaaatggttttagtcaattccataatttgtacttattaaatttaatatttatatagactcatgtttttacccccacaaacggatttacttctattgtcgtgacaagttactttccttttgttttaagttacttctatatatgcaaattacttttcagctttattgaatttacttttatacgtctaagaagtaatttaatgaaatctaaaggtaatttatatatattgtaaaaagtattatgtaagttttcattaaaaaaatataatcatgtgatatcttgttataaagatttaattgttatgaacacaacagtgtaatcggatcgtagatcagatgagtaatttaagagaaaaatttatttgaagcatagttggtaggaaaatatttctctacttatttaagtagattcttccggtcaatgccccgtcgctagcagtggcagttccaatgggcggttcaggtgatccctggaccaccctagaattttgcccatgaggacaccccctgagctgtgctagggttagggagaggcacagacaaccgccagccatagtcgcacgcattgctggctggcagctgcctcctttgtcttcgcgtcccgactccgactccgactccaccttcaccttaggcttggcacgatggtcccgacacatcgcctccccggttcccgcctttgcctccgcgtcggcatgccacctccccatctcctgcctccctcctcaagtcctcctcggcaccacccgactccgcctccgcctcggcgccgcctctatgcctcctccagtcccccacccctgtcgggcagcgccggtacgccagcgggaggcggcaagcgcctataggccggctgcctaggcgcttgggcccaggtgcccagtccggcggtcgcccccaccccttggaaagggaagaaagggaggcgttgaagcgacgtcgccattctgccggcggccggtgtcaggtcccctccctctccagctctcctgctgcccgacaaagttcaaaggtcagtagacatttattgttggctttttgcaatgttgccctatgcagtagtgagtagacagtagtagtgttaggg

SEQ ID NO: 45918 - DNA, 9317 bp, Oryza sativa
cttcttttagggttttttctttttataaaccttttcaactttgtttatttcttctcaattattatttgtgctctgaaaattccactaaaatttatttacgcattttaggcttttaggaaatatacaaaaatcctccaagccttatttgacttttatctttgcacattttaattgttggaggctttcacatgaattttaattattctttgcacaatttcgaggatgtattttagagtcgatttgggacgtgacaaacctaccccccttaaacggaatctcgaccccgagattcggaagaactggcgaagagaccgggatgggctgccttcagctcgtcttcacgctcccaagtagcttcttcttcggcgtgattactccactggaccttgcaaaaacggattacccggttcctggtcctgcgctccatgatgtccaggattttcactggcctctccacgtaggtcaaatcttcacgaacttcaatttgctctgagtcggcctgctcggatggcactcgaaggcatttcttgagttgcgacacatggaacacatcatgcacgttgcccaaggaggcgggtagctccaactggtaagcgacttctccgcgtcgagcaacgatacggaaaggacccacataccgaggtgcaagcttccctttcgtctgaaacctgtgtacacctcgcaatggcgtgactcgaagatacacaaaatcatccactgcgaattccaggtcacggcgacggttatctgcataacttttctgccgggactgtgccacctttagattatcccgaatgattctgactttagcttcagcttctctcaggatatcagtcccgaacacttgactttctccaacttggtcccacaatagcggtgtccgacatttgcgcccatacaacgcttcatatggtgccatttgtatgctggcttgatagctgttattgtaggagaactcggcataggggagactcttatcccaggtcttcccgaaatctagtacacatgcgcgaagcatatcttctaggatctgatttagacgctcggtctgtccatctgtctgcgggtgataggcggtgctgaaatttaatcgggtacccaactcttcttggagcttcttccaaaagtgagaggtgaattggcttccccgatcagatacgattttcttgggaacgccatggagactcacgatcctggcgaagtagagttcagctagcttgttccctccataggtggtcttcacaggaataaatcgagctaccttggttaatcgatccacaactacccatattgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggtctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggtacaaggggataataataggggttaggttttgcagtaaacagcatttaaaagtcactttgttgcccaaagttattttataaagacgatcctagagctacacaatattattaaacaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaccataatccaacaattccatagtgtccaaatgatatgagaattcccaaagtctaaagttataaaaccacctaatgttgcctaattaatcagcgaagcatctacctaaattcatactagtggaaccaggaatagagtacccactagttggggttttgtttattctagggtgaacaaggtaataataacaatagcaataataatgtcataacaaaggtaaataggcagggctaaataaaacagtgataacgcgggaatttaaataaagcggtaatgcattaatttaaatcaaaataattttataaactgggattcaatatgctcaaggatgatgtgacttgccttgctcgctttcccaaacgccggcttcaacttccgcgaagagcggatcttccgaagctgcagcgtctacacgaccaacggaaaagaaaaggcttttactctaataaactccatacaacaagcaggaacaaagcacaaaaataggttcttgacttcttaaggaaaaattagagacttgaacggtccaattccgagttcaaatggccaagatatggccatttgaaatttatatgctctttaaatggatatttacgaatttcttcatttaaattttaattaaaaacccatttattgcgtcagccgagagagagggcgcgcggaccgggtccacgggagtggggcccacgcgccagcccctcggtccacggtggaccgggagcacgcggctggcggcggccggcgccgtgggtcccacgcgtcagccgcacccgcgggcgcgggcggctgacggctgggcccacttggcagccgcgagggcgcgcccgaaggcggcctcgccggcacggccgacgggagggggacgcgcccgcgccccgatggtcaccgccggcgaccaccggcgcggcggagcggcgcccgagagagcggagaggagagggaagcgaaagggacggtccacggctcaccccgagacacgaggacggcggagacgacgaacggagcggaggaacgcggcggcgcggttcgggacggcgagggcgacggtgctccggcggtcggcgggcgaaacgaaggagcggacgaggtcgacgacgacgcggcgaagccgatggaggtgacgccgagtggggaggaagtccggagcgacggcggcggcgaaccggagctcggcggcgacggcggagagagaggaagacggcgcgagcacgaatccgacggcgagagcgagcggcgagcggcggaaacggaagagcgaagcgcgggggacgattatatagcgccgggagggggagagcgcggccggagagggaggaaacgggcgcggggatctcggccgccattgaagacgccggcgacgattgcgggattcaaatcggacgaatccgagggagagagagagggaaaagagggggaaacgggagagggaatcacgggggtgatttccccctctttattgcgcgcggggacggcgggaaacggcgagattcgcggcggcggcggcgctagggcacgggcgggcggcgggcgcggcgcgaggtcggggatgacaggtgggccccacccgtcagcgagggtggcgggcgggcccgcctgtcagcggcgcgcgcgcgggggaggccgatgggccgcgggggagaggagagagagggagggagagaagtgggccgagccggcccaagaagggaaagggggggaaagaagacttttagggatttttctttttataaatcctttttaactttgtttatttcttaacaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattattccttttagaaaatgatttttatttcgggatgaatttatcaggacgtgacaaatccaccccccttacaagaatctcgtccccgagattcgaggaggctagcaagaagataggttgggcggtcttctcttcttgtctgacttcttccgctccgtcttttataacaacttgcctagcacaacttctccactctggactgcttggctcgatctcctgttgcagctggaatcttctcttcacctgacttatctccggttgaacctttagccgacttcgactgggttgtggcacttgatgatggggcttcagatccagaacttctcacgattcatatcttcggcgtcaacctcacacaagttaccacttcatgtcatgcgtcgtaacctgcttgtcattactaggataccatgcttgtcatcatgagaataccatgcttggcgtttccttccagcttaccaccatacgctttagactatgatatcccgcttactaaggataccatgattgacaacttgccattaactgcctcatattggctttcctggtctccagtgctaggtgcttctgctattcgatgccagggtcaaccactctaactataagttatgcttcccaagagaaccaatttatcccgcttgacatgctttgacgtcttcccgaatgacttggctgctggacttgttattgtctgatcgtgatcctgccagatctgaagcttcgttgttagaggtgattttaatctgacctctgtagactatcttcgaacatatcactggttctataactgggaatggctctcacgaacaagcagctcggattcactttctttacattcagtttacttcccattattatcttcaggttgtcctcagttagcattcaacgtattcctttacacctttaaccttgatgtgttctttcccattggatcatctcccaagacatggcattacctggtaactggtgcttgcacttttcactccgtgtagcatctgataccgagttgaagatttcgctccttgccttcatagaaacatttttacctaggtcatctcgcttacttaatgacaagatgactgttgcggggcaattactatcaggggtcttccttgagcgatgcagagcatgtttctgtttatcaatcacctttcggcctacttctttcatgctagagaacatctttgccaatctctttttatcaatcatctttcggcttatctctaacaggtggtattctttaatgtggattgcggatgcttctggggacgatgaggtcctttggcttgctgcctttcagtgaaaccttgatgtggtgcgtcaaaagctgcactgactaccttcaggggaaatacattgcctgctatctgtatctataccactagggtttaattgccgatggtcatctttagtgcttcctcgagatggggagcatccaaattgttcttctgccacatcacctttgacctttttctgataccagataaactaattaccaaccatcgactattatgttctcaaatattgatgtctcctggatctccttaactgttggcaggtatatccgatcttatcaatgtagaggcatggcgggtacccttaggggtttcctccaacaatccttatcttgatctgtaaaaggcgtatccaaactcctatcctcaactactgtctcgttggctttttaacccaacacagtttaattgtttttcttttccatccacaggttggttattaactcgaggttagaatatagttcctctgacacgagaccctaggtctcctttgtcagtaaacaattatacacatgatcacatatccgcatctttcaaacgaatcctcagggaacttgtctgtattacacatttctccctcattacatgaatacgaggcactgccttaaacaaaaagggacggtgcttaacatcggtacattgtatcctcaacatgaatcatccataagcatagcaagctcactgtttatagacatgaatatatttatgtattacatgattgctgcaaactttcgattacaccatgataagtagcggactgaaaaccacaaacatggctgctcattttgattctggagagatatagctggcattgttccagtgactgcatccttgattggttctgtgatgatgtgacaggactgcataatgctatcattcacaggagaagcttccttctgattgctggttgaagcggatgacggtcttctgcttggtatcgccctccggaggttgattgcccttggctcggcctggggtaggtaggggagagacacaacttcttccatcgacgacaattctttgctaaggctgtcggtgcagagaatggttgctatgatttattgcagagtcaggtgcagcaggaggagcactggtgcattgtttctgctatgggttctgattaacacgaggcctcacgggtacagcgtttgctccagtgaccacaatacgattggaatgtctgcttcgtgtaaattggcggtaatgtggaggtcgattttgccttggttggggacagtttttggagtaatgcccttcttcattgcagttgtaacaaacaataactttcttacactcgggttcttcatcttgtacttgatttctcagctgctgtattggaacttccaaaggtacaacgcagatactggcctctgtcttgtcagctggtggctggggctgaaattgagcattgacaccttgtggtagtgcactcattggagttggagctgttgcaacgcgggctatcggactgcttcgggatgcatggatgacaattcgttgaggagcaagcttctgattgcgggggtttgcgtggactgacgtgctggcagctacgtttctcggttttgggcacttgtcggcgaaatgacccattccttgacaattgaagcaacagatatcttcccggactcggcattttcttttctcattttgattcctctgtcctggcactggagttaggctgaaactggaatcttggcgaggatttgtgtttccttgatgcttctctccgttggaactggcgggttggttggccatcttcttcgtcagcagaaaactgaatcgacaatcttttggtacatgatcagttccttcacaaaagaaacaagtgatcctgctcgttggacacctgtcgggtggatggtcttcctcacaatgaacgcatatagaggcacacgagctggcaacatgaccgatttctccacaacgagagcatgccttaagttctattttattctggttaaaaccttggggaggcttcgcaccttcatcatctgaggagacttgatctgaatcttcactatcagacactctacctccattagctaaaagatgctctgtcaactgttgtgcacctcggaaggaatttcttctctgatgttttgtcattcctggtggaggccattctgtgctggtaatgatcatcttacggacttcatcttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacttgaggttgcatctgactcgggttcaaaattggcatccgatgctgctgtagtatctctataagcaatttgttctggttaatcaggtgttggaccactgccacacaactggtgtctggtgcttcattcactcgggagtttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttcagcgacaggttctccaagatcttcactcctgcttcacagctggcttcactgcttcctccacttcactagcagatcctgcagtcttctggagcttcggcaaacaactgacgatgtcctcttcttcactgacctgaccatctagtactagttgaaaatccgaagaaggaagaacggagtaaaccttttgcaaatagcattaggggaaggagaaaaaggaactttcgcaaataatttttttatttataaaatatgtccttgggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggtctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaaggggggtacaaggggataataataggggttaggttttgcagtaaacagcatttaaaagtcacttagttgcccaaagttattttataaagacgatc

SEQ ID NO: 45919 - DNA, 900 bp, Oryza sativa
tgcgcccttgaacttttttatttttaaattttaaaaataaaccattcaaaaacttattttcagaatatccggatttcatccggtctgtccggaccgggtcgacaacgaaaaaacacgtgtttttgttgtgctatgataaattaactaactactattttaagacaaaaaaatattttacgtacagatttcatacggtctgtccggatcgtgtcgacaattaaaaaacacgtggttttttgttgtcctaaaaaattaaatcactgttatttaattatatatatttttcatgtggtctgtccggaacgggtcggcaatgaaataacacgtgattttttggtcgtgctaacattttttaaataactatattttaagaccaaaaatatattgcatctcttttccatgcggtctgtccggaccgggtcgacaatgaaataacacatgatttttttgtcgtgctaacatttttaattaactatattttaagacctaaaatatattatgccactttttcatgcagtctatccggaccaggtcgacaatggaaaaacacgtgtcttttcggttgttctaatataaactaaataactactattttaagacaaaaatatgttatgtccgaatttcatcccgtttgttcggaccgggtcaacaatgaaaaaacacgtgttttttttgtcgttctatgataaattaactaactactattttaacacaaattttacgtccagtcttttcggtcgtgcttagataaattaaataagtactattttaagaccaaaatatgttacgtccaaatttcatccagtctgtccagaccgggccgacaacgaaaaaacacttgttttttggttgtgctaaaaaaaattaaattactgttatttaattatatataatttttca

SEQ ID NO: 45920 - DNA, 3818 bp, Oryza sativa
acaaatcaaccccaaatcgatctgaatatagcaatttgtgcctctccgaaaattattttcttctccctccactctttccctcctttttttttgctcccgcaatttttttctcagttttcttttttttgccgccaacttttttttttgcccccaccttccccatcgagaaaaacaagccaactgcccctaaaaatctctttcctctatcctgactctctgagtaaatctctttcctgttgtgggattcctttctcctatgaactctcccgtcgttctacggttctcctcctcgtcttcatcggtgttgatctgtaggtaagatgccgggcgctttactgacccacagccccaagcaggcgctcctagatcttccaccgctccgctccgccggctgctgtaccagccatcgctgctgtcgcaccttcctgccgattaacagccacgagcaggcgacccccatgccccatggatgacgtagggcatgcggcgggccagagacgcccccagccgatgtgccgggtgaccggggcactgcaattgatgcgggttatacctcccgacaccggctgtccacttcgctctgctccacgccgcgcggctggcggcaatgtttccaagccccggaatctctgcctccctctgcacatcttactacctctctgagtcgccaaattgcaatggaggctaatcccttccagtactacaatacttaccaatttgatgtgttgtattttcaggtttggagtcagatgcactgaccgtccatagctgaaggagcctggtgtacgtacggctaggcttcacacaactgtaagcaatacaatatgtgatctagttttaccgcgcagccaattaaattttgttatttctacccattacttgtttcaaattgttggcctataaaatggacaaatgaattagtgagtatgacaaacagatccatattatagcattacttttgggacagcagtactctgttgttcttcaaaaacaaatccaaaatggctcagggtataatcaattctgaaattattctttctgaaactatgtacagcacagtcctacttctaaaatgagaatgatatactttcgacgccataaatgacagataggttttttttgggtgcaagagatatggcaaggagtagaagaaggcgtattgttcagagcaatgaggaatatttgtcagaggaacagattgaagaagaaaatacccttccacagcttgccacaccatctgaacaagaaactgtatgtcatgattctggagaaggcaatgaagacattgatgacgattttgatatcaatgatggagaaggtaatgaagacactaatgacgatgttgatattgatgatgaaggcaatgaagatactgatgttgatattaatgttcgaggtaactgctaagtttaacagtcctaatggtaagaaataatgacattattactcgtatccctgattactaaggatcacttttgtctttgcaatttaacaccgaacagttgaaaatggagcacctgaaacacgtggcaagacaaaactgaaagatgtttggaaccttccgaaagggcttagaattgtggttcaatgcaatgatctcaatcaggcggtaggggaagaagctggaattttgggtaaatttcttggaatgatagctaggaatggtagtctgtgtagcttaggctacacagactggagatatgtaataggaaagagagagaaaaatacaaatgaactaaaagttaaaaaggacatacttaagcaagtaaaggtaattccttttcagatcaacatttttgctaacttcttgtattatgttatgcatatccccatatggccatatgagtttctgtgttgctatatgtagatgagattcctttatgctcctcggatggaagagttcatattaaaaaaaattggagaaagatggcggcaatataaagcaaaactaaaagatttgtattttgatgtgaatgagactaaggaagctaattgcaacaatgtcccagaaggtgtgctttctgaccagtggattgctcttgtcaatcattggatgaacgagaaatcgaaggtacatgtaccatattcatttctgtaatggtcttacaaattagaactctgtactaaacaaaacaatgcaatattcttttttgattgctaactctacgagaccataacagagaataagtgagcagaataagaaaaactgccaaaagaagaaggcaattcacacagcagggacaaagagttttgctcgcacaagagaagagatggtaaaacatgtcttgaatagtattcatctatttccatttcaagcatgtatagctactgttaggactttactgatttggtcatgtgttccatagagacaaaaagatcctgcaaagaagaacccacatagagctgttgtttatgtccacacacacaagcgcaaaagtgacaagaatataaatgggcatgtggtatactattaacactcaaccatagatatttttcagttattctcatatgttgttttattcgtattaatttttcatatgtttaggataatttgaagagacttatagctgaacaaccagctttagcggatgctagtaaaggaaagactgcttggaaaggagatgcattgaaccaaatactaggagatgacaagcctgggcgtgtgcatggtcttggactagttccaaagcctaaacaagtgcttgatgtgccaacttcccgacgtttgcagaatataaatcttactacagtggaggataactccagtgaagatgtaatggctattagactgcagatggaaaagttagaacgccatgttgagaataatgatgctaaacttttacaattaaaagagaaggcaaccaagttggaaaaggcacaaaagaatcaggtgaatttaagggagttgagtcttaaaaaaattatatgagcttgtgtgtgacccaatgaatgcatctaacttacctaattgaagttacagggaggtttagatggagcgtctacaaacaaagaagctatttgtgatgacatacctaattcaaaaaggaggctatgtatctttatggaagaaatatcataacattttctgcattatctcataaactgtggtatagatctctgttcattttctgttatggacagagagtgtatggtgacaacccctcgcaagaaatttgtatgtttgaggagggaaacattatggatcagcaggacaacagtttgatggtaatgtgatatagcaccatcttataactgggaatagctgtgtttttttacttgggaatagcatttattttctctcttttactatagaatacacaaagccatgtgcacgatgagaatttgcaaccaccaactaagcattctctgtttacaaggtccttgcctttgcatttaaaatattattatatatatatatattcactattatttacatagcattcattataatcatatgccttcttttactctagaatacacagtctttgggccagaatcacagtgggaagcaaaggaagattacttcctgtgcaaacaaggttaattttcactttttcattaattggagtgcatgatgtcagagtaaacaaataattggaacattatagtttgtgccaattttatgacctattccattgcagcgcaaaggaaatttggaccagaatgagcttatgcaaccagggaagagtatttctagtgcatacaaggtaagttgattaagttctctctttatcctttcaaactcaatgccatagtcaataagtgtttgaaagtagcttaatttcgatatataaatatatatatagatttgtaaaatt

SEQ ID NO: 45921 - DNA, 5769 bp, Oryza sativa
  unsure (1)..(5769): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaagggtgatactataatttcacatgtctatcaagttagaaaattagacaggaattgtgttattctatcaccactggagattcagaaatcagaagttgaattataaagatgacaacattcaaatatcagaccattaatattatgaataatgttctctataaaaatgtgtatactgttcagagcatcaattataacaagaaaacaaaccttaagagacagtagagttttatcagtaaaccgctttactgaagagggtatatttcctgggagagtgttggccactctttgcagctcttcttcttgttgctttgcagttacaacatcagggccactgtacatatctatcagctccttcatatggggtgcccttgccattacatctttcacagcttcctattagtgatacggtacattatactgggtcagttgtatacatcaccaaaaaaaaaaaaactcattttagcagcaaggcgaatacagctgcaagttcaagcatgtactggttcatgtaatagtagaagcctatgagacaagtgtctaatgtggtgtcatacaggaatttccaaacagggacttaaagctgattagcagaaacatggaagcggaataatagatattcttttagttcaataagtccaggactgcaggaaatacataaaagctagaatgacccaatcctgttaaaatctctaatctaacgtagccaacagtccctctttacttggattttagaacaagttgaaacttatctggagattacagtttaacctcatcagaaaggagcaggcacaattactaagtaatcagctggacagcgttcatgcaacaaagataataaatcctttgtataaaccttatatccgctccatttgtaatgcataaatcagcttaccaaataacatgttctgaaaggtgaaacaacacaaaatctactaatatcattttcagcccgatctaggtatatcagtgcaaagctaggccaatctggctgtgaacatacttacgtaccacagcaatatgcatctgcaaactcattagaattatttctgaagcctcaatcaggctgaatgattattccaaacagggaacaagtctattaacatgctcgagttcatcagtttatttatgaaaacttgataatgcagctaggattctaatgccatccaactatagacttgcagcgttgcacccgttgagcatgctataatcctattgctggaaaaacaaagtatcatttacactatttatgcaggctttctccggcattttctaatgcaatctggttcctcaatgctgcaagagaacatatgtaccaaaacatctactcgcacaaacatttctgtggagaaaaataatatagtacaaggtccatcaaagaaatcacctcccattcctcctggttctggatgccctcatacgcaactatgaatggcttcaccttctgtagcatatcctccaatgacataggtggcttctcttcgatatctggattattgaaattcacatgatactctggctcaaactcgatctgcatacataaacccacaggaaacaaataattcaggaaccttgcatgaacggccagatctaacaactctaacaattttgcggattcaaccgcattgctgcacagaccatgttattggtgtgacaagcctccagatatgcatcctgcttcgggtctggcagcgcgttatctgcggcctcatcaaacgcttcgttaaaaatcttcatcttgtcctcgccgagccgcttctggagtctgtcgccatcggcattgtcccccaagtagatcccatgcttctcctccatatcagcagagcggcggccgcggccgccatcacgtcccctgccgcgcccgcgctccctaccacgggcaccacgacccctgccgccacgcccgccatcgtcgtcgccgccaccgcccaggagctccatggcgcgcttcacggcgtcctcgggcgacagcttcggctgcccgctgggagcgggacgcgccgccgacgcggccttcttcttctcctcgcggcgtcggatgaatcggttctcctcctgcggcatctccactggcggctgctgcatccgcggcacgccgcggccagcgccagcggaagggagcgtgcgcggcggcggcggtggcggtggctcggaggacgaggcctcggcggccggcgcgtcgaacagcttggcggggaccggttgcttgggggcgacctcaccgaggggcggcggcgatccacggccgcggccggcgccgggaagcggcggcgacgagaccgacgggatcacggcctccccgcggccgcggccgatgggggccggggaggagaagggatccgcgccgccgccgtcgtcgtcgtccgggacggggctaccgggggcgcgcggcggcgtcgcggagggcgggaggccgcgcccacgcccgcgcccggcgccgccgccgatgccggagaaggaggagaaggcggcggagtaggaggtggggaggtgcgcgtgccgcctcgcggcggcggcggcggcgccgatggctcgcatggtggtggggaatgggtttagggcttggaggggagcgcgtgcgtgaggtgctcgacgaaatggttgggctggtccggtgcgatgcggtggtttctgggccgttggatcgtaccgattgttcttgggaataagttcatctaaggttccttaacttgtcaacgaatccgattttcgtccttcaaccacaaaaccagatacaattggtccctcaactatcaaaaccggtgcatattaggtccctcggcggtttcaatggcggttttggctgacgtggcacctacgtggctaattttgactcggttttgatctgacgtggcactgatgtggcccttacgtggcaattcgatccggaaaataataaaccccgtgggacccacatgtcagtttcacacacaataaaaataataataataataatggtgggacccacgcggaccccacatgtcagtctaattaacccctcctcttctgcttcctctctctcctcctcccctctcttcgtctctctcttgcgctgggtcattctgattctcctcttcaccatcttctctgtcttcatctctctcccctctcctctttctcttctctccggttcacgggcgccggggagaggacggtgtccggctgggagaaggggcgcggcgcggcggccggtgggagggaaactagcggagagaaaggaaccagcccggcggcggaggcagcgccgccgcggccgtggctgcggacgatgttgacgtcgacctcggcatcctcggcggcgggatgaacgtgtcccgccgaccggccgacacacgcgcgcatcctcgaaggcggccgtccacgtgggcgggtgagggggccacctcgccggcgggagaggggagaggcggccgactgcgaagacgaccccagtgatgatgacgaccgtgcggcgcacggcggaggccgatcccgtgagcaggaagctcttcgtccacggcctcggctggggcaccaaagccgacgacctccgctccgcgtttatgtgcctaatcatacaaaggtagaagcaatagcgactagtactagctgactagagtatattttgcttcgtcatcatcatttgcttgtgttatgacggggttgatgaatgaatgaatgatcattgttttaggcaagaaaacactgttccggccggactgacgaggaacccatatcgatccgctcgccgcggcccatggaaacccaacaggagatggcggcgctaccttccgccgccggcgactactaatggtgggtgatgctcgagcacattgacgaactcgaggtcgacgacaaggactccaactacaactcctgctccaccgctgccgacgacaccgccaatcccgtgagtccatgacgacctcgctcacctccgacggccacgtcgtaagagtctacttccgcctcaaagcgcccccagcgacgtcacacctatgcccctggcagtcactcttctccatttccgccgccatcgtcatcgccggccgcatcccctagcacaagagagagatgaaaagaggagagaaagagagagaggaagcagaagaggaggggtgagttagactgacatgtggggcagcgtgggttccaccattattattaatttttttgtgtgtgaaattgacatgtgggtcccacggggtttattattttcccgggtcaaattgccacgtaagggccacgtcataccacgtcagatcgagaccgagtcaaaattagccacgcaggcgccacgtcagccaaaaccgccgagggacctaatatgcaccggttttgatagttaagggacccgttgtatctggttttgtggttgaaggacgaaaatcggattcgttgataagttaagggaccttagatgaacttattccttgttcttgcgcgttatcatcaccgttgattcgtgaatcaggtttttactccatgatttttgtttttttttttggattgtatggcagacgcataacaccacactcacacccgtgaatacgtctcgtaacatatgctctaaagatgaaaatcctgttaaaaaatcatctatacgtgtgtaatattcgtaagcaccaaaatttcagtcttcgtggatagaatcatgcactcacgactctactttttcttttttttcccctatgatttttccattgttatgatcgttttacctgcaaaaatgaacaaagtgaaaagaaattaaaatgatttatagcaattttatgtatatgtttctttgttgatttaaaagccaaagaagaaaataaattatggtaaaaaaaactcaaaattaaattaaaaaaataaatattggctatagctaataaggtaacaaacatataacaagaaaaagtgtattgatgtaagcataccagtgaatcttgacagagagaaaaatgggcatggacgtgtaacagcgtaagaacatcttcaacagcctttctattttactcttcaaaccaaagtttagcaacagtggataaaaattgcattctcttcatcccactcttcaagctatccgactggacaaactccttcccttacttaccaaacttggtgagccaactacacttgccatatgtgggtctaactacctcctattatctttcctcccacttgcgatgcagatcaagtggaactttgccgctgcgcacctcctcgccaccatggtttcccgctcgcaatccccctaacgagacaatcattgtcttcatcgtttgccaccgccatcgtcaccgccacatcccgcacctccccctctactccaccgtcgcagcctacacatacctcctcgccaccgtggcctctactctgtcgttgccgtcttcaaccccacacgaccttcacagcctccgtccctgcatggactcgggggccctcagctctcgttgtctcctctcaacggcgatttttacagcctttgcctccgctggcatggaggaagcccacggcaacgacagggttggggagtgtacggga

SEQ ID NO: 45922 - DNA, 4385 bp, Oryza sativa
cttcccaaacagctaaatggtgcgtctttttttaaatctataaaaatgttgcttcagaaaaattcatattaattaatttttaaagtttttagctaatacttaattaaacatgctctaatgagttttttttttgttcacgtaaagggttcccaaaccttttcttcaaacacgttttatatcggtggctttgcaagcgcaatttgaagggtttttgtttttttaattaaaactagcaatttgaaatgtaatttcatgcttccgttatttattagtgcaaaagagcattttgttgtctgggaaaaagaaagaggttttgcctattttatgtgggcctgcgaactaaacccatatcagcgaggcctgcaacggtggtgtccttgattcaagcccagttccacttccacggcctcatcgcacgctacgcgacgcgagcgttcagcacgaaacaaacgggacagatgggcttctcctgctcggtctcgatcggcatctgctgccgcctgtgacacgggccgcatcagcttcaagcggccatttttcaacggaataagtctactttacattcctcatcttttcatcgagtttaaattggagttttagatgtcactggggagggtatgggtaacccatatctattttataattagctttcccatacctattgggtatgaaaattatccaatgggtataggtaatttatatgtgggctctatatagaaatggtctaaaacttgcaaaaagtgcttctatatacaataaatcatttctacgaattcaacccaatttgaaacgtttttataatgtgaacacgagttttaaaattttggattcgagctttacacacgtaaaatggtatggataaagtgtgtaatgatgggaacatatcatgtgcacacaaatctttacgtgtatacatcgtgcataccaaataacaaatatcataaaaaaaatctagaaactgcgtagacgtacttccaatagtattactcctacgcgtaaaatattaacctcaaattgattatattttagccgtaacaaaaaaaatcacagttttaaggtttctatcaaaaattttgcttttttttatctctatgtaaaatgaatttgaaggtacgactttacacgtagatatacaattgaaaatacatgtatgaacgtacttttatagatttttttgtggcatttgttaattggtatgtgcagtgtgtacactgtacacgtggggcttgtgtgcataggatatgttcccggataacaataggtattaccctcgcttctttatccaaaattaaaatagatatttttctccctatccataaggacataggtatggagatgggtgctatagatacccagtgcagacagtcctagactgcatgcacccgacactcaacacaaccaacctgccgtccctcctcgagagatcgatggtcagatggatcgaaagtgcagcacctcatctcacgcatatggctcaaagaaggtcaagaaagtggtacgtgtggtaaaaaagaacaagagagagagagagagagaaaagcacacaaacgcaaagaagccaaagcaacacacctctcaacgccgccaaagcacacaagagaaaaacaaacgaatgaaagtgccactgccaatgcagtcgcgtgtatacgtccaaagttgattggcctagctagcatgatacacacttttgttgccattcttgaaaaaataagaagaagatgatgatgaatccaacctagagaggcaaggcacctcggccatgaagtgctaactcgagacagaactagacactagtgtggaaaaaaaatatctgtgtcggacgggaaccttcatctgcatcgccgacaggccgcgttatggataattggtcaccgataacagtgatttgtctcaggccgatataaaagaccatcactaataattctaacccaacaaagaagtcaaatcaaagcctgaagataagtcatccgtgatacatggtaacgtactataaaccaaaaaaatgtgatggtcaccttttattggtatcgtcttgagaccattacggatgacttatcggtaatagacttttattttagatccaaagtttaatttgatgcgcacccagcagtcgtgacgttggttttttttttttttctaacacgagagaagctagaccgataaatgcaaaaatatgttgattggtgctcactttagtggatttccttccaaatcatctgtatggtctaggactatagtagtagtataatctgggcggttttgcaaagggacattttgccgacggccgaaagaactcgagtgtgtgcgtgtacccgttttgttcatacgtgttcagacattaatctaaacatcaaatattgggtaaccatgattacgtacttattaaagttgctacttaatgggccacgtcaagcattacatatattttataagattggcaagcaggagaagatctttgtggtcttaatcatttcatgacagagaaagcgtactacccatcactgataaagctaacatatatctattaatcatatatactccactaggaaataatttttccatacggacggcccgtatctaaccaaatgaatgtaaaaatcattgatttttgcaagcgagtcactatgacacccacatatgaagataatttttcaggggaaaaaatagcgcttgccgcctacgtcgtagctggtagcgatcgcgatcgtcgtcactagaagccaacaggtcatgattgaggtcgagatcgttgtcgcatccctagtcatggtcgtcgttgtggagccactgtactagatctaggagcggttgtcgtcaccacctcgactcacattccactgccgccctccaccttacgcccctcctcttcgtaccaccgcccttatcccagaaccgttgtcaccaggccactgccgagccatgaatctggtagcccaaattaatctgatcatctctcgccgcctaggtccgcctcctttactgccgctcttcaccatgcaccccttcccttgttgctatcgctgactcatctctgttgtcatggatctggcagtccatatttgcttcgcccctgccactccgcttgccatcgcccctctcctttgctgcttgcctagatatgcctcctctctcctcggcgaggagtagaggaagagtgtggaggtgggctggggaggacggtgaggatatctgtctccatcctcgctgcctagattcgtccctcctctttgttgcccccaacgataaggaccctcaatcttgatcagctgcttttggcaagaagggtggtgatggtgaggtagagtggctggaaggagtattgagggaacagaggctatagggacttagccaatattgaggctagtcgaagaagccgatcgaggtgactcacacttttaaggtggcaacatttttttacaggcgatgctctttagcacgagattataggagctcattggtattattgcaaactgatttttaataatctgccagtaaaaataataataataaataggtgcctacaaaaaatcgctttggaaagcgatagtagtacgtgtacgctttaattcgggcaagagaaaactcattaatcctagctagggtgatccacatgcaaacatttcacatgtcatgtctcatgggacagcatctcaaatgtgtgcttgaaactcaagctaccatccatagtaactggtgacagcgattttcttagtttaatgagagctaaaagttaaggaccagctttataaaggttgatatttaagtacgtatgcgcgcgcctgcttgcagctggttgctcgctgcacgtggattattttcatacatacatacatacatacatacatacatacatacatacatacatacatacatacatatatatatacatacatacatatatatacatacatacatacatacatatacatatatatatatatatatatatacacatatacatatatatatatatgtatatacatacatacatacatacatacatacatacatacatacatacatacatacatacatacatacatacatatacatacatacatacatacatatacatacatacatacatatacatacatatggatatatgtatatatatatatatatgtatgtatatatatatatacatacatacatacatatatatatacatatatacatatatatatatatatatatatatatatatatatatatatatatatatatatcttcttatatatgtaagatagtgagaattcttcatgtgtttattagcctcatttccttgcttattcacatggttatccatactatttattaacaaacaaaataatttgttttgtttctcggtaaaacttttatatacgtgttctcagctattgaaa

SEQ ID NO: 45923 - DNA, 11265 bp, Oryza sativa
tgtatatatatatatacatatatatgtatatatatgtatacatatatatcgaatctcacttactcctctcgttgcttatcagagctccgcaaattcgcgagctacttggacaagacaagtcaagtactgcttagcctccctatttcaattaatcgaactaaattttagcgtctgttcactttgatgccattttcaaccatgtcatttttttataaagttgttaaaaaatatatatatttaattagtttgttgctaaatttgatcaatacataagaaatcctggcaaaattttaccaagattactatcttgtcaaaattttgctaaacttttggcattgccaaaacttggtaaggtttattttaactacaatctgaacacgcccttacttataaatatatacattctattatgatgtgcgtttgcaacgcgagaatatatacagcgtgatccaccatcacatcatcgatcatatatatcattgcttagccaccctatttcaattaaatgaactaaattttacttataaatatatacattctattatggtgtgcgtttgcaacgcgagaatatatacagtgtgatccaccatcacatcatcgatcatatgtatcattgcttccctagttcccttcgttatttgcttctttattcattaattgtacgtctttctgtgcattgtgaatctagagtttggtgctatatatcggaaatgactaggttattctgaagtctcatcaactatgctaattaatattactctagattgaaaagttcatggtgcaaaatgattagtttttttaagtttaacgtgcatatataatattcgagtctgactgaacacaagttaagagttatttacaataacataacttaagacttaaatgacttttttaatatatattatgaaaatgagtaagtactacaaactgtccttttgtttaatctgttgattttatggttgtttatgcagcactaacctataaattttatattaataagcactagaaatcaaaaccaaaatgggtgtttcattggaagctatctaggaatctttgcttaattgtcaaagaagaaagcatctattccctctcgtgtaaagaaaacggcttgtccatccccctcatggaagagtaagctaggaacgattgagctagagcttaattgctttataatgttctcactcatcctctcccaaatgggcccctcaagccacaattttgaccaccattttttttgtttggatttgtatgtgtcataatgggatgcatgcttagtgacgtgtgcatgtatgggagacaatcttctattgtactaaagggagactactctcagtgagattgattgtaagctgctcacttttttgaccctttgtggcatcaatacctgtagacaatttgttcatcacattaatttgctttgaacaaatcatactagtgtgccaaaaaaaaacagaaatgaaatttatgtatagaaagttctttatttttttctttctgaaaaaacacactgtttagaagatcaaggagagtgtgcattcacctattcatcttttaagtagaaaaagagtagctagcagttccagcattatatatatgtaacatacaaaaggaaaaattgaaattgatggaaataaactaatttagctaccaacaagttcaatatcaatttgctatttggttcagtcaactaatcatgcatgaacctgatcaattcttgacaacaattaatttgtttgatttaccaatatggagtatattactatcaatttatatgcaccagtgaatatctagctagccagttcttaaaaaaaattaagtgccacaagatggcaattaatggtttatggttgtaggaaccaaaccaaaactaaaaactaaagctgcctgactggttgtggttgattggtccccaatgcacactatataaactttagggttttttttttcagtgtatatgttgtgatgtctacttgggcaaccaaccattcccacggggctcaatgcaaatgcatgtctttttaattccctcacaatctgcaagccatcatttggatatgatggtgttttttgagtacactcctttttccatgactaattgcatgatgtgtctagatatatgcatatatattatagagtttgacccacatatatataacgatatgatgattggatgcactagtgataaaagacgaagtcatctcttgtttccactaatctagcttctctgttggcgcgcataattcagcttaattaggtcgacaattttagtgttaattcgtgtaaccggaggacataagaatgtggagtatgttgtatctcctggtaattaattaagtaggtaaaaaaatccttctcatagcatagcaataagaatatatatattgatagatgaacaatgcatgtggaattaataatgcttcttattaataggggtgaaaatggggcgggtatttcccgccctcctgcccggccacattatttcgggacaaattcgggtacccgagacttttcacggatatcaggtccgaatacatgtcttttttggcggatataagatcgggttcggaaatatagtatccgatggatacggattatccggtaaaaaattcgggttttacccggataattatacggatattacctatattatgtttttgtgaggcattttttggtactatgtattggttctgctatgatgtattataccctatttatttcctaagttcctaatggcctaatataattgtattatggatatatggaattgttaaatggttattgtctatgtgatatataaggttgttgcttcgacttgatatccgaataaatattcgtaaccaatagtgtgtgtatctattttggtacgtatttgttccatatttttgcccgacattatacgagtttgtatccgtatttgacactatccttgtccgacccgattccgattataaaatgtgggttaggatatgaaaaggttgagatctgaccgaactcgatccgttttcacccctgcttattaatggataaacctttgcaaattgggtgaagtatacctgctagaatcgagaattcaacaatatatgatttacttatctaacaatctttataagttatacaccctatggtaacaaatattgtttgatttttttaaaaaaacttaataaatgcaggaaaaactaatttaatattttcgaggatacgtatatatgcaccggcgctctgagggtgtgtttgaggagaaaaaaagagaatattaagaaaaaaatagtgagtcattagcgtatgattaattaattacgtattaattatttctaactgaaaaacagataaatatgacttttgaaacaatttttctatagatttttcttaataaaaacacaacagtttcttctctttgtttttaaaaaacatggtgagacttccttttttttaaaaaaaataaataaaagttttcctctccttgtgttgctgccgaacgcagcataataattgttaatatatatatatattaagcgtcatataggagtttttatgtttcattagtacacaaacatttaaggtcaaagctgattaattatgacttaaaaactatactagctagctagtaaaaaaagcttaattattactcccttcattttttttctttgacgttggttagctcaaaaatacatttgtacaaggaggtagtactaacaaatactttctccgtattttaatatatgacgccgttgactttttattaacgatacggagggagtaatataattcaaggtctctctcctcacctctgttacaaagcgaggcggcaggacaaggagaccggcgaggcttcgagctagctagcagttggcggtggccgctttcccccccggatagaatatcacccggtgcgcgcgctttctacgccgagacctagagagagaaaggagaaagagagagaaacaaagcacctaaagcaacaaagagaggtgtagagagagagagagatgagaacatatcatcaagaaaagaagctaagagagatcaagtgatgtggtcgtcgccgtagcagcagtacagcttctctaccaacaccgtagtcctttctctcctcctccccctcccctcctcgttccgcgtgccgcgagaggatcgaaccctattcctttgttcttgaatctcttccaaatctgtaacagagagagagagagagggaggagatctagtgagtctagagagagagagaggttcttaagaggaggaggaaagctagctaggagaatagaatgttcccttcttcttctccttctccttctccttcctcctccaagaagcagcagcagctcagtggcggcgtcggcgtcggcggcgccgcggcggcggcgagctcgaatgatcggccgccgttgtgcgtccagggtgactccggcctcgtcctcaccaccgaccccaagccacgcctccgctggaccgtcgagctccatgaccgcttcgtcgacgccgtcacccagctcggaggcccggacagtacgtagctacgctctatacatgactgatcttgatgctgagaatttgatttgattttatttggttcgagttcggttcttcttaattaattacttgtatgtttcatgatcaaactcttgatcaattgtaaattacttgtatgtttcatgatcaaactcttgatcaattgtagaggcgactccaaagacgatcatgagggttatgggagtcaagggactcacactttaccatctcaagagccatcttcaggtgtgtgtgcagtacatatatagatccatgtctatatatggttttctagttgcactagctagcatggttagaactagggttagcttatgctctctctctctctctctctcatgttttgtagattgttgtttttcagaaattcagacttctgtatctctggatctctcatgtgttgtagattgttgttttttcagaaattcagacttgggaagcagcacaaggatttcaacgaccactcggttaaggatggtaaacacacgatctacttgttaaaatagcatattacattcctaattgtgttcttataattagctggctagttagcttgttagtttgttcgcacatgcatgtttttccttcctttaattccgcttgttaaagtttaccgacttgatatatgttagcagtgaatttctgtttcgtttgtactagctagctatttaaacagcttaatttacttaccatgattctttcagaatagttaatttcacactttctctgaatataatcaaaaggtgaattatattcaaacttatattcgtccattttcccactgcagcaatggacatgcaacggaatgcagcgtcttcttcgggcatcatgggaagaagcatgaatgagtaagttgatttttttttcatagagtaccctagctagattaggttgttcattaattcaaaatgtggtttttaataactatcttattattcaaaatttctatgaattgttagccgcagcgtgcatgtgaatgaggcactaaggatgaagatggaagttcagagaagattccatgaacaattagaggtaattaagagcattgtcagaaacaaattaattttctgtaattcagcatggtgtcaaattaatcacatactgaacttaatagcccaagaaattacttattaatttgctttgctttattctgcatatgctccttcacatgttgcctttgaacttttgcatgcatgcatgaacgttcttgggaagtttacatgcttgtggacagcttatatgtcaatgtttgtccttcacatgttctgaaaatgagatgcatccatgcaagaacattcttgggaagtttacctagctagcacaactttatttttttcctatactcatctgtggcactcatgagtttggcatatatgcattttctttggacacaaaagaagtgaatataactaactttgcatgcaggtgcaaaagcaccttcagatgagggttgaggcccaggggaaatacatgcagaccatcctggagaaagcataccaagccatctcgtcctcaggagattgcgccacgtggcacgcaggatacaaatctctaggcagccaagctgtccttgacattggcagctccatgagcttcccttctctgcaagatgatctgcagttatatggaggaagccatctagatcacctgcatcagcagcatgagcagatggagatcaggccatcaattgataccttcttggcattcaattacagctccagtactgggaagagcccaatggtgtggcccggcgccgacgacggcggcggcgagccggcgaagatctccggcgatcatcagctccagatggcggcgccggcgacgacgacgatgatgatggaggccatcaccatgtcaggaggagactccatgggcagtaaggggtttgagggtcagatgagctctaagcttgacatgagatcaccacctccacagcaaacagtgctacctgtaggaagtgagaggatgagtagtccaattgttggagccaaggctaggaacatctcctatgggtaaactaattgatgatgaattgaagaggtaattatattaactgcatgtttaattttgtggtgaaaccagcaagcaggctgaactgatcttgcaagatcactgaataagcatatgtaactgtcttgttattagttgggagagtatacaaaagtagtattgcattatgcatcgttcaattaattaggatgcatccatgcatgcaattaattaagttcttgagagaggagggtgatctagataattagtcgtgcctacattcttaattttggcttaaagtttgtaaattttaattttgtgttgtcttaattcatccatgcttgtctgaacattaacgaaagttttcttatatatatgtatttggagtcgtgtcacagtacggcatgcatgcatgtgataacatgtttttactcatgggtaaatattttaaggatataattaagtgcaagtgcttgatcgatcgtttcatgaaattctagaaaggtggatttacaagtggagaaaaaagaacgtacctaagataccgaaaatacagcagtgttcctagctgttagattttagttagttcccctatccatgtatctgatgtatctagctactacgtacagtcaacatatatatatcctggcactccaattaatggacgttactgccaattatcctggagactgactgcttacgggcaatccaactaatccagtcaaaggaggaggagcgctcggagttagctttccttgttagggagataagaaacctcatggctgggaatagggatattgttattctgaagattcatcgtaactagaatagtgttagccacgccctggctaataaagggcgtagcgaggctttaactgctttctgaccggccggatgatacttgtaattttatctctcacctgttgggtgctgagtatgagtaatatatccccgttcattgcaaaaaaaaaaacatatatatacttgcatgtcatctagattatattaacattatttctagaaattttcatgattattactcggggcctgggggtaggcatttaaaaagattattaatgagcccaagcacttaaaaatgttatatattattggcgttccttttatcgatcaactactagccaaaattactcgtttgttgctatggattattaaaaggaaaaagtataaattaccccccctgaaatattggatgagtacgaattatcccctaaacttgaaaaccagtcaattttcaccctcaactatcgatattggatgaatccccccagcagctttacaaacggttttggtttacgtggcaatccagtcagcaatttttttctttttaaatcagcgggccccacatgtcagtctctcaccctctcttttacccctcacctctctacctctctccaaaatcctcactcttctcgcttcctcaccttgaggacggcggcgggcaggagcgacgaagggggcggcggagctcgggacgatgtcgggcggagtgggcggcagcaaagggcgcccgcaaccaccggcgctcgggacggtggtgagctgagcttagggctgagggggtggcggagctcggggcagcagaggacagagttcggggcagcgggaggagggggcggcggagctcggagcggcgggtggaggggactggccctcgtcgccggtgctctgtcttcctctcaccgatagagaagcaaagaagggagagaaggggagagagaaagaccaacactgcataacagcacaattaagcactgttcccgaatcacgatgcaatggcttaatttaaagtagctagctcaaatatatccacagttaattagcttggattaattttgctccaattatatcagtgactgagccctgtatagcatgatgcatgcagccttttcttgctgagagtggaagcttcgtttgttctgcgtcgcctcctttctgcaatgctgcatatgtatgtacagtctaatgtctatacacagtgcccctggaattgctgaacttcacactgcttgtgctagtgtacaattcagaattcagatcatatcatatggtcagggacacaagcaactgttctatttttttttcagcagctgttaagattaattattcgaggtataaatgaatgaagtattataaagttaggaaatagatttaaattaaatagtatttactataagaaattcatatatgtacaaatttttcaaaaatcacgtattgttaagagtttgagaaacgtgtatgttaattcatgttggggaatcccaacaagaatcgtgttcgacctttaaaatcccaataataataaatagaagaggcaacatgatagggtggggcagttgacgcgatattaaaaaaatataaaacagaaccaaaataacgattatgtttgatttttaaaagcccaataacaataaagaggaggggcggtgagcaggttgtacaatagtaaagataacggcgggtatgaatcagcccatttcatgcaccccaattatattggctgtataaaaaaactggctgttttcatatccccttgagtacatgggacttgcaattatatatggtcccgatttctttcctgaaatccactagaaaggtggaatatttctggtttcaggaaagaaatatttgttcctgaaatgcacccgccctcgtcccttgtattattacaagcggttttccttggtagtagcgtgatctgcgcatgcaaattaacatatatgtggctcctctgatcatgctaattaattacctgatgataattagggatgattttagaatattaccatagacaaaccctttaactgcgccactgtactcctatatatatctcttattacaccggtcagagtactgattatttcatcatcttcttcgtgcattcgatcgatccatcgccatttcaattcccagtacttcagcaatggacaatcaatggaatgcagcgccatcttcaggcacgaattcagagtaagttgatttaccatggctatattaatttgttgttcattaattcaaaatgcaccctctttttagccaaacaatcaaaattaattttcttttgtctatactttctgatcgatctagctccatgcatgttcatatgttttcaaaattaattttctgttctgtcgatcttcacagccgcaacgtgcatgtgaatggggcagataagaaggcccagagccaagaacaacaagaggtgagagagcatatgtatttttaaattcatcattgcatactgatgactagttcacataagaaattagtacccctttaagttcattatttgctcctcccatttatctcaaaataaattagtacccctttaagttcattatttgctcctcccatttataaaagtagcagatatatgtattaggatcggagcatataaaatgtagtataattttattaggatttgataaaaaagaggatatttgcggaaggaatagcatgttgcttctgaactttacatgcatgaacgttccccattaaattctcacatgttctatctgaaaattaaatgatatgtctcttgcaagaggaacattcttgggaagtttaccctgctagtgctagcacaacttttttttcaataatctttcaactcatcatgagtattatatttggcatatgcattttctttggacacccagaaagtgaatatatttctttgcatgcaggcagaaaagcacctccagatgagggttgaggcccaggagaaatacatgcggtccatgatggagaaagcacaccaagccctcgcatctggtgccacgtggcccgccgccaatgagcaggcgaagatctcacctccaggaaggaagtgagaggataaatctggatttttcacattttggttcttgtgaaaaacttatttcgcaaatagacccctaaaaaaacttatcccataaccgccgacgtggcggggcgatgctgaggtgactagggagagcgcgccagaatggctggcgccaccccccccccccgaattttttatttttcttttatgtttttgatatttttttcacgcttagggatacataagaaccaaacatagaaaaaataaactcaaatggacgtaatatgtaacccgtagaatttttttctctcctctcctctctctccgaactagtgcagaggagagagatgtgcaacttttttatttttatttttttttgatattttttcacacttaggaacttacaataaccaaccatataaaaaataaactcaaacggacgaaatatgtggcctgtggaatttttcaaagctctaccgaaaaacttctctcctcaaaaacacaatcttgcaagtggaatttggaggttttaatatcgccgaacctggcaaagcaagggagaatcgggtgtaactttttatgtagatgtccgtggatatattatttgcctgattccgagtccgtatgagaaagttacgcctatttcaataaatgacatattttgtccgtttcggtgagttttggaaaattctacaagtcacattttgtccgtttgagtttattttttatatggttggttcctatgttctcctaagtgtgaaaaaaatatcaaaaaatgaaataaaaataaaaaattgcatctctatactgtttaacttatggctatcattttatatggttatattttgaattagattaagtaagtaatttcatatagtctaatttactaaaggatctctcctatgtttaacatgctgatcaaaagg

SEQ ID NO: 45924 - DNA, 11959 bp, Oryza sativa
cggccgccctcattcttagggcggcgccagccactttggcgtgctccccctagccacctcagcatcgccccgccacgtcggcagggggacggcgcggcgccagccaccctggcaccccaaaaaggaccatttctgggataagttttttcaggggtctatttacgaaataagtttttcaaaaggaccaatatgtgaaaaatccagaggataatagccttacctccgcttcaaaatatagcaactatattttgggaggaaggtaggtattacttatttagaggaacatcttctatggctatggggtatcataatttatgattaagaggtgtaataaacctcttgcatgatcactcaataagcatatgtgtgtgtgtatatgtacactgtcttgtttgatggtgttccaaaatggcataattaataatatgatatccgaatttatttgtagaggcatatgactcagcacctgctaactgctcccagagtccaaaaatgtaataacctataaccaaacgattttgctaaaaattaggcgcaaccggagtttcttttgtttttctttctctgttttatttttatttttcatcctagagtctccaataggcattgtgccattatcaacttataatatcaatatttattcgagatggtggtgaaactcatcctttataaactgcaatccctcgtaaaaaatatataaaaattagctataatacgaatcaggctgaaacgacgtatccagcccatcagggcccatactagagcccactatcagcccaatacagcgcggcctgcagccggggcccaccaaagacttcccaacgtcaacgcaatattctcctacctgatggatggccggaaaatggcattggacggacaggatgcacaagagggcaactaattaatcgcattttattttgtcttccaagatgacattgtttgaccttgacatttgaattttcaaatttcaacgagacccaaacctaaacggcgatgataacgatgactgttaacttgaaattaagtgtcaatgttctataggtcatggtcatgtgagataacgtatacgatacatcatttatggtcgttgatttttctaccgtaagtacgaaaatgagtgaccaacattgattccatatataatgataaattatcagcaagagagtgatgaacaagtcaaactacaactgtagaagattaattaattaacgactaacggtgttcatcttctagaaaggctagagggtagaggcgcagcacaaaagcaccaatatcttattgccaggtgtcacatgcatgaccaaaaatgttccgtatattgagttcgtcataagggccagattagtctaaggtgaactttgagtacctttcatatttttgttgtgctgactaaaatcacatgtgcagatttgtttgaaatgatacttccgtatcactatttctgccatagtttgtaacacataatcttgctttgtcagagtacagactgtccttctatctcgttttctccataatacagggactatatgtgctattatggtaggtatagtctgttccaaaatataactatttctagcacttaaaatttgttttaaaatacaataacttctccaccaacattctcttctcaaccaataacaactcttccaccattcacttttttcacctaacttaacttcttaatcaatcacaatatctctctatttaattctacctaatttcttaacaatcgtgtcaaactctaaaacctcttttattctaagaggaggtattaacatattatcataaaactttttagcaactacgtaaatatgagtatagtagctacgaaaaatctcaaagattttttttaaaaaaaacccattagtactaaacatgggaagaaaagtgcttgaaaaggaacaaaatagatctaactgatagctgtgaaaaaatctctaaaaaaaagaaaaacaaactatatattagtattaggccttttattttctgattaagttgctctacaatatcaaatcaactcatcttctaaatttataataatcaaaactcaataatcatatgttattattttttttcgtttttgcgtatactttcttaatcctcatatttatcagttgcaaacagggcctaaacctttataagaaaagtccttaaaaaagaaaagaaaaaaatattctagaacaaagacagtgaaaataaaacctgttttgaccatatgaaaaaaaaattaatcccaactcccaattcccaagccaaccaccacagcaaagcctcccttcctttcctctcttcgtcttcctcctccctcccctctctccacaggtcaaatcctccccttccttgcttgcaatcctagcaagctccaagatcgcggcaagctagcctcgagggaggcccgcctgcccgggcctcgggctccgggggcccggttcttgaggtttcttggtcgtggggtcgaggaggtggtgggtggtggtggctgcggcttggcgcgatgaacaaccacgcggcgggcgggagcacgagcaacggcggatccggggtcgacggggatggcggcggcggtggcggcgcggccaggaggaacaccaagatgcccaagtgtgagcgcgcgagatctctctctctctttgctcttctttgcttgcttcttgtctcgtctagccttagtgcaagatcaggatgcgatgagcagagctgttgctgagagcgaagtccatgtagtagttagtagcttgggttcttttcgcaatttcaccccgcaaaggtggtggtaatctggctagcttagggggggtctcagctctcgagatggatgctagctcatgcatgttttctttttggattagtatggtaggtaatgatttatgttgggtgtacttacctctagtgattatatagctagtttcaatagtccaggagaaaccttgattaaattgagctgtgcgcaattctaatattgtttggtttgttctttgcatagacgaacattttaggtcgaaaacgccgatcaagtgttaggggaagcgaatctgactagcgtttccaggttgtgagctgattcttactccgtaaatttttcatgcgcagattccaagttcacgcagcaggagctgccggcttgtaaaccaattctaactccaaaatgggtaagtttaattacttgttgcatacttccaaggattaatagatttagggtgttactagttttaggggataaaagatgaatatatgtgcggagccgttcactgatgttttggctttgtgctacttaggttgtatcggtgtttttccttgtcggcgtcatcttcgtaccagttggtgttgtttcgctgctagctgcacaaaatgtatgctctgtatcttttacacaataggacatgttctggaagtttctgtatttatctgtttgaaactgttgcaggttgttgagatagttgatcggtatgatgatgcatgcgtgccagccaacatgactgataacaagcttgcttacatccaaaacccaaacatatccaaagagtgcacaaggactctgacagtaatgagcttaattttctggcagttacctcatattgaatgattagggtatatagttggagcaacactgcagctaaatatatctgggacatttttttaaaactttaattagcatgtggttgtaagtggacattgtatcaaaatttgttggctaaatgggaactgttttgtttttatctccagattacagaggatatgaatcagccaatttttgtatactatcaacttgataatttctaccagaatcataggaggtatgacatgattctattcaaggttttcaatcaagaatttgattacttagccttcctaaccaatctggcaacaatgaaacctatgacttttttgccttatgataacaataacatgcatttgatacctagtatgtataactctttccaaattcagatatgtgaagagccgaaatgatggacagctaagggacgctgcgaaggcaaaccagacatctgcctgtgaacctgagaaaaccacggcagatggaaaaccgattgttccttgtgggctgattgcttggagtttgttcaatgatacatatagcttcactcgtggcaatgagaacttgacagtagacaagaaggacatctcttggaaaagtgatagggagcacaaatttggcaaaaatgtctatccaagcaactttcagaatggtttgctcaaaggtggaggaacacttgatccggcaatcccagtatgtgaactcttgatctttgctatcacgctgttgcacatgcatgtagttggaggcaaactgttacgcattttattacatatgcttaacatcttgattttctgctaatatcaactatagttcatttgagttcttattcacgtagatatataaaaaagttgcctagccttggaatttctatgagtaactcatatcagttcgcattctatgtgacagttgagtgagcaagaggaccttatcgtttggatgcggactgcggcacttcctacattcagaaagttgtatgggagaatatatgttgacctcaagaagaatgataccataactgtgaagctgagtaacaactacaatacatataactttggtggcaagaaaaagctggtcctttctactgcaacctggcttggtgggaagaatgattttctaggatttgcgtatgttatagtcggaggggtctgctttttcttggcatttgctttcaccttgctatacctcataaaaccaaggttggtaacatatgttccctgcaattaaatggaaatgcatgtgctatatacttgatatgcttgtaggccatgcagttaaccttctcattatagttcactatgtagatgcatatgctgtggaatgctacattcatgacatgggtgttatgcaaaaagctcatttcctggattattatgttttctgagaacatgtctactgtcgatcattttttggtgcatatcattcttacgactattagtgccattaagagtgatgtggcattgctgtactgggttgtatcattgtatcaaaataaagaaacaaagctaaaatgttcatattgaacatgcatactttcgttcctttgctgactgagattttatagaagaatctctttagttgcaaattttgttagggtaaaatactaaggcagcacagggcacagctagttagtatcatactcatgttgcattgatatgcacctgtatttacacacaaccacatgctgtatttggtatatgaaagtcgttctactatatttatctgcggtatttttgcaggaaattgggtgatcacaactacttgtcctggaacagacatcctggaggccgttaagacgtccaaaacacttgtcgcataaaaatggctcatccggtgacatgtatcatgtacttaatgatgatatactgaaaattgtcagggagtgtaatcaggtctttggtttgacctagaccttcatgtacatcttagcataagaaccacgctgttttgtttcattgtttcttttgttatttcggaactgcatatagcagtgatgaatagaatcggtactgattgttttgtgatgaatagaatcctatcattctgaatgcctaaaccgttctgttattggcttaagtggttcattcatcatgctgatatgcatgcttcagtaataaaacaaacaaactgtcttctgataatgggaatatgggattgaataatttttaacagatttgcttgtctaccatgatcaaatgctgcaaacctctcacattatctcaaacacgagcggcagaatcaaatgcctttgcttttttttttgttcttttttttcagacaggtgtggaatagaatgacaaacagaactgaaattgccctgcttttattgcttcagacaggcgaagatgccaaacaaaactagttttcttcgctgaaacacagttcatgggagactacaacaatgctctgccacactgatttgcttgacatattcagcaatcagcatcaacagttcaacaccaaacagcttacataatccagcagccaagaaccatcacataacctattccatcagtacaatacaaatacatcaatggcacatttcttttgcctccctcgtttcataactaggaaacaagagggaattcagctcagtgacaggggaactgaattttctaaggtcagacattttgttcagctgctactggctcatccttgagattcttgctgagccactcctgagcagctaccaggtcagggagcacagttgctccagacttcctccagctctcagcatcggcggtcttgaatcggtccagaagcagcgcgtgcattccgatgctccgtgcaggggtgtagtccttgcgcatgctgtcgcctatgtgaagcgcctcttctggcgcgaccttgcccgccatttccagtgcaatcctgtagatacttggatctggcttctccacaccaactattccagagaacaccccaaagtcccactcggagccctggttaaaaaaaaatcaagagaagtcatgaaccacaacatttacttgtgaagatgataacattagaggagcatgaggtgtaatttgttatgcggagaatatcgaacctggttcagtcctagagcaggcaagatgacgtctttgtaacggtattctgcgttgctgacaattccaaccgtgagccccttcccgcgaagccacctcatgaagggctgcgcatcagggaataccgagtacggagcagacgagccaaaagaagagtaaatccgtttgaaaatcttctcaaatgtctcctcgtcatactcataaccagcctacaagacagcacatatcaagcaaccgaagcacttagcctctgaacacaaagacatcactagttcctgaaaagcttcagacctacaaaacagtggcatcaccttaacaaaagaatccttgacgcacatcctccaccagtcgatattcggcatcttcgctgcaaatccaaagcatgggtattgccttgccatctcggtgtatgcaagcttgaagccctcatgcattcgctggtagtcaggacatggcttcccagcagccttagctgccatacagtagtaatcaccaagctgccctttgtaggcaagcagagtaccggtgacatccacagtgatcaaccgcagcttcgaaatgagcgacatgttttgacgatgatcttcttctgagcagcaaaaaaataaaacgatgaaaattctacagtggcggatctaacatggggaaccatcaaactgttactactactagtattaaggttgagggcagatctctagaacagaagctagaggctaacgcaaatttggagaagaaagacagaaagtgcgtgggtagagaggtgtgccgtgtgcgtaacggatgcgggcagaaggagcagaacgagcgacggatggggatcggcgcaggcgggctgcggtggcgggaggatgtgctcactcaccaggatggatgcggtgggaggatgccgacgaagcggcggtcgcgtgatggatgggggtcgccggaggcggaggcggcgcctcgcgtgatggatggggatcgccggaggcggaggcggaggcggagtcggcggcggcgcctcgcgggatggatggagacggcagcggtggccggtgggcgagatagaagcgtcaaaatggcgagggcagtttagtaatttcgcctagcgcatcccattccttgcaaattgcacatcccatccccaccgtacccgaaatatgaaaaatagaaacaatgtatatatcacttccaatcccatttttcaaattaagcccttgggattaacctttaacacggcgggtttttattttaattttttatatggttgagatggtggataaaaaatagctacctttggggcactgtccgattaggcacggctgaccgaacagccatgctgtgtcggccctatgtgctgggtctagagcccaggtacggtccagtgagatgagatgtcgggtcatgttgagttggcatggcacgattagtttacgtggactgtgttgaggccggttagcccaaatttaacatatactaagaaaaaaaaatatgaatagagtctgttctatcatgttgcacaaacttcggcacatgttgcacaaatgagatcccccgctcattaatagcacattcctcatcctcatcgtcaagcaatgccatggcccttcacttcctactttcttcgccccgagctggtgagtccatagtgatcgctatgcttagtagttgtgctcacgaattgggttggccataccacgatgctaccgtgcagatctatgtcgacaagcatcctccgtcgcttcctcttccctgaacccttggcttcttcaatttttccgttttcctttactccgtcggtcccatcgtgtcgcacgggccaagctatgcgctattcctgggtcatgtcgtgctggctcacacatgcacttgttgtgttggcatgacaacccgggtagcaactgaagcacagcctggctagacaggtcgtgccagcacgaccctccgctaaacggatcgaccatgttgttcttgagctgtgagctgcacatgtgtgctcggacggacacagaagtaataatatagtactttctttattaaaagtaggaatttcttctatttttatgattaatgatgcttccgaattttaccgtttgcttagaattttttaagcccctgtctttttaataaattcagttactttctttccgtggaagatttgcaattttttaagcccataagtttcttatgatataacacactgttttttaatacgctgtttttttgtactactgcaaccggatcaatggtgacacagttaataatagtctagcacatctatttgtacatttttaatagaacaactagcctgtgaatgtggacgtcagagaatacaccatacaaagtggtatgcttttgactctgatactgtggactgtccgaccattcaaaaatgagatatttacttcggtaaatatacttgtgcaggagacccatggattcgattgcccaaaagccttgcaaaacatcttcatttcccgaagagatccgtaccacatcacatgtacacataccggcacccatcataacctacacaaattaatgaaacaaaacaatgtgacaataatcaaaacccattaaaattcatcaataaaattcatgcagaaaaggagaaaattttcagaactaccattccttccttttcatatttgaattttttttatcaactttttttttaaaaatttgaccaactttatagaaaaatatagcggcatttccaaccccaaacaaatttattatcaaaatatattcaatattatatttatgaaattatttgttgttataaacatggtcgaacctaaatatgtttgaataggaaaaatgttttataacatgaaatggagggggaagtaaataaacaagtaaaatgggaatgggccgtccttgggcctaatgagcagaagaaggccttggcccaataatgcaaacgatcgacatggctgcgtacttactgggatccttggtgatgagcatggcggcgccggcgaagtcgcacgtgccgccggcgaccttggtgcgctgccagtagctgttgaaggcgtaggaggcgtgcgccatgagcgtgtccggcaggaagcacggcgccccaggcgccgccaccatgtcgcagtccgcgcccgacgcgcacgcgtagtccatcgccgtctgcgccaccgcgctcgccaccgtcgggttcgccacgcaccacacccccgcctccctcgcccccggcgccggcggcgtcgtcgttgctggcggcgggcttcccgttcccggcgcgatcgatggcggcggcgcaccggcctgcgccggcgtcggtgggtttccagctggcgcgatcgatggcggcgagtcgccggggctcgccggcgtcggcggcagcggggccggaagagccggcttggtaggaggaggagggtacacgcagtacggcggcggcggaacgtcgtcggcggcgaccggagttgatgggcccaccacgtctttgaacggtggcaacggtgagtactctcttgaggtgccatttgctccacctacaatgcacacaaaagataattaaacaaggtaattaactagattaattggaccaaattagacgaaatcatacatatatatgagcaagtacaaaatcaaatcatacatgtatatattagtatgcattttgtagctagattgaattcttgatgcataattaccacattgaatggagaggatgagagctaggaggatgtagcgcttgatgatgatcaccattagcggcacaatgaatttcatctagtcagatgatcctatatatgtatattaaatttactacggccgcgaggctaccaaactgatgcttgtaagacattggagtacggggagagtgagacattgatatagtgttgcaaaggaatataaggagaaggattctaatccttctatggactacaccctctgtcccaaaaaagacaaatcttagcatcccaatgcaaaattaaaggagaggataaatgaccaaataacccttattattagtaaattagtattggtgggtagatagataaggggtattgaaggaataaaattttttgatttgcgaaccgagagtagataagaaggtagatgttgatttattttgggacaaaaatttgaatttcagaagttgatttattttggaacggagagagtcctctattctaaaataaacgaatttatgttatggtatgacattaccataccttacattatcttgcacctatccagattcgttgtactagcaataaattgaattacacatttgcgcgcactaactaattatttgaagccttattatttaaggctggttacaccttatgtcaatgaacaaaggaaaaaaatatttataggtaaaaattttgtatctgtactagtcaaggctagggaaaaaactatgtgtgaatggaaaagaaagcgccaaattcagccactagcattaagtttcaaaatttaaattttggttgcacccaacaaacagatgatgaaagacacaatattatcatattgtttgaatatattttttaaaaaaatataacgaatttttcctatgtaactatatgggatcaatcactaatattttagatgttaggacagaggtaatatgtataatatttgagtaaaaagatacaagtttaaaagagcttgcaacaaatggttaacaagtctcaggtgagcaggcaaaggggaagcaggaagaattttccagctgcatgctagatgctagccagatttcgctatgcaggctaaggtgcataagaatattggttacttggttcttcagaaaattggttatgctgcaaatgtttatttcttttcactgttgttttcggcgcattttgttcggattcttgatcttttctccaggtgcagttttggcacatgtgcttgcttggtcaatgagaaattcaaaaaagaagaagaagaagaagaagaaataaataaataaaaagaaaagaggaaatttgattaaagttgcacgtatgggatgggtcctttttcgttgctttggttccactcaagcagagacaactggctgatacatcattgcaaacttgtttgcacataaatatggaatacttcatattttcacatggccatttcatcgtttaatttgttagagaaattaagaaaataccggtgtgaagattttacaatgtactcatcgcaaaaggtagttaatgcatgaatggtctgctaaatgtcaatgacacataaaaacaataatttttcaactccctgatttatactatttgtataggtatgtgttttcatcttaccaagctataccaagtactccctccgtttcacaatataagttattctagcattttccacattcatattgatgttaataaatctaaatagatatgtaagtcattct

SEQ ID NO: 45925 - DNA, 16540 bp, Oryza sativa
aaatgctagaatgacttacattgtgaaacgtatgaatgacttagaaattaacatgaagctagagacaccggacattgtttatttgtttctcttatgaaaaagtgtagtcaaacatccaataattatcttcttgttgaaaacaacacaaaaacgtcagtaaacgaggggtggtggttgtgccaggttgccaacgtccacgagagatcgaggagactggagtacaataatccgcaattaattatacgttttctttgaaattcatatatgaaatggactatccctatagatattttagagaaaaaaagatcataaggctataccttgtacgatttcaatattttctcttacaatcatagtactatacgtttttgagatgcacctgatagtttagtagaagggggtgtgtgatctcaaccctaagatactcatgtttaatttccaacacgctcataatttcttattaaaaatattatatgttttctccaagtcacataattcaccatatgtagtataaatggcatgctaactgctacttggcgaccagaggtgatttaatttggagatctctgataggctgtttggtcaagttttaataactttgttctacagttaaagtgcaaagtaaaatttagaattgtaatagtaggatataagcagcattggacattttttctagacaaacattataactacatgttactaatagtaatattggtgtgagtacgacaagtcgaggtctagtttgttgaggatcgtgcatacctagaacatataaatactggatgttggatgggaaaggagtgcccataattaatatcctggtgatgtagaattcaatataacgtagttaacaaatagtataatgtcttcatgccatcataaaggcctggtttagttcccaaccttttcttcaaacttttaactttttcatcacatcaaaatttttctacacacacaaacttctaactttttcatcacatcgttccaatttcaatcaaatttttaattttgacgtgaactaaacacacccttatatccaaactattgacgtgtatatcgatgctttacaacaacattggttctagatcttaagagaattcccaaaatgtgtgtagtcaaatcttaaaatcttaaatcactagtagataaaaatattatgatttaaaatgtgtaaatgatattaattagtagattttctgtgcaaaactattcctagagttatatttttaatatgttttataaatactttaagaaagtaattataaagcatatgcattatattgaagcttacgtggatgtccaaatcaccgtccttttgagaattgaggtagtcagagtttaagcactgtactgtatatgcaaattaaggtttaatttggaatcaaggaattttacatgaaacgaactatttcttataaaaatcttgtaaactttctacgtcatttcaaaagagtcatgaaagtttataaacttaactgacaagattaaggatcaattgtggagtattttacatcttagtctgcgtttgtttgggatggttagaaatatggataagtggctaactggccacttatggatatgtttgtttgcaaaacggagtgaccggttggaatggttagaaatccttttctcccaacatgtaaaatgaagtagtaacagattaattaagtatagtccgtatcagcaaattaaaatccaatctctaattaaagtataattaaagtactactaatacagtacccatgttaattaatattcgaggtctactatatagggcccggggtctaaggttgtgtagcctgctggtgaggctgtactactgctccattgatttcttggccaaagccaaagaaatgataggattccagctgcgattgttgcagccagcccagcatgcagatgagcagagcttcctgtggccatggcagaggccctccgaccggccggccggccggccgatccggtcaagatcagtagcagcagcagcagtactacctgcattgcatataggagtatactcatacccctgccctagcttgctgttcatcctacagtacttaactcatgtgcattccccataagagattcctccattccactgtacattaccaaacatagttctactgtgcaagcaacaacaacatcagatatatccatcttctctttgatcacattttataattaacatttgttagttaacataatttcctcggtatgattctatatatatatactagtacttcctacctactagaatatgaaaatgattggaaaaatgttgtgattaattagagaaaaaaatagttaaaaaataaatgaagaacggttatgattagttgaaaagatgaagtaagtgaagaaatagctttattttagtataagtgaatattataaatagctacattttaaaacggaagtagtagcgaacaaaatctatcaaacctagctgattcaggatgcatgttagataagctactccctccgtcccagaatagagcaacgtaggaccagatggtacgtatgttagatatattctccgaaaatttattcactagtgcgtccagtatctgaagatatatagtacagaagatatttgctactggatggttatatgtcaaaatgcaatttgatagttagtgcgatggagtatactctacaagctagtgaagtcatactttgcaacagaaaaacagaagacgtacaatttcatggttctgaaacacatatgctcttttattcagagtctgctgaaatatacacaagttactttcatcagtttcatgcatgcatgcatgatcacttcgtagtgtgttccaaatgactgtaataatcagtgcgtagcatgttttgcagtttagttcctttgggatttctacaatcctattgagatctttagaacatactatatatactagcagtatattacttacacatgatttttaaaattaaatggatgtgattagaacctggttgggggtggctaaagatctgaaccaccatatctctggtgcttgttactgcttccccagagatgcatgatatactgaatcaacaactcgatcgatcgggaaaactatgtttacatatatacaatgtctatgttaggagtacaattctagctagagtaagcttgcaaaagaaaaaaaaaagattggccataaaatttgatcgaccaagggcgctacataaactaagtttgggcatcttactttttcagagtatctagctttatttaatagaggtcgtactaatttcactcacaagaaagatgcaactacacacataagtatgtgtgaatattaagcaaatatatggaagaaatgcatatccaaactgagaaactatataccgatctgaggtggattcaacagacaaagtcatgctggccagaagatcatactcaaatgatcacatactgttgtaggcttcatgtgatcatgataaaccatctaaatcaacactcttcagaaaatcacatgcatgaatattcttcaacagatctcatggcaagatcaaagtagtagtagttgttgagtagaaacccttcagtaggttttctgaattattagtgttttctgaattaacagagatgaaaccacttcagagttcagaccactgtcaatctagcacactaccaactcagatgacaaatacaacctaattaattaattaagctacctagtacatactactaacttgcacatactactagctagaatcatgctaattctcatacctaacctatcatataacacacttaattgctcataagaaattaacatatgatccccattgctgaaacaactttaatacaccacaaacctagcttgctcatgaacatgtgtatgcatgccctaggccataacaaattgattagttgatgcaggcagcatgcacaaaaaagcacatagtatgctcctaaccatcatgcatgccatgcaaggcgacgggcgccgtggcgtcgaggaggccaatggccggcgtcgccagccggggctcgtacgcgaacacccggaaacccgccgcgccggcgccgccgtggtgcgcgacgacgacgtacgggcacggcggcgcccaccgccactcgtcgcggcgggagtcgaacacgagcgcgctcgtgggcgcctgcgccacgggcccgcgcggcgcgagcacgacgtagtcgccgtgcgccgcgcactcgaacccgcgcccgccctccgccgcggcgaactgcgcgtgcacctccggcggcatccgcgccacctccgtccacgcgccaccgccgccgccgccgccgccgccgcgcagcgtccacaggcgcacgctgcggggcacgctgagacggctcttctcgacggccgacaccagcgccaccctcgccgcccctccctcccgccgccgagctccaccagcgccggcgacctcaggaaccgcctcatcggcggctgcaccttgctccatacgttctccgccacgtcgaacaccagaaccgcaaacggcgacgagctcatgcagtagaacctaagaacaacaaccaaggcaagatcagcaaatctgtgcaagagtatttacccatgcgtcatcaatggcgcggcgcgcttacctgccggaggcgaaggccatgccggcgcggggatcgagggaggagaggcgagggagcagggagctgggagcccagaagccggagggcgggacggaggcggcgtcggcgacgaacgtgtcggcggagatgttcttgacggcgaagggggacacgaggtcgtccccggccacgacggcgatgatggaggtcgggccggcggcgaggccgacggtgggggagaggcgcggggtcggggagatggggagcgcggcgaggaggcgggtgatcgggttggcgagcagcagcgtcttgtgccccgacgcgtcggacaggaacgcgagcaggccggcggacgcggccgcgggcgagaacgcggcggggccgccggcgacgggcgggagcgggagcgggaggcgggaccaggaggcggtggcggtggggtcgaggaggaggaggtggccggcggcggggacgacgaaggcgaagaaggggaggtgaggggagaggaggaggtgggagtggaggaacggggaggagaagaggaggtggtagaagcggcggcaggcggcgcggaggcggaggaacgacggcgtcgggaggcacgccaggatgcggtccaccagcggctgcggcagccggcgccacacgcgcgggtccatgtcgtccgctgccgaggcggacgacgtcgacgacggcagaggcggcagccggcgagggttcatcatggtcgtcgtcgtcggcgcgcggcgtcgtcagctgcagctgcgtgagctgaaaattttcaagggtgaagtggagtggagtgaggcagctgtgaagcggcagctgcgatcaaatgatagtgaaactgtggtactagcttgtactcgagatgccaagggattaattcatgtgaggctagccatgccaaagctaaaggtatgcatatatgagaattcatgattaaatttgagaatcgcaatctaagcaaagcaacagttatataaatggatgatggatatcgatggactgtgtgttcttgcgtaattaaatttgagaggggaaaggattggatatggagtagagtagcagttgttgacatgttgttgttgttgtctgggtagcgcaacgccggttttggtttgtctcagctctgatctgttattctatgcatttttatttttattttttgcacacggcagtggttgattttaaacaatttgttggacagtgttcatcatttcctcaaaaaatatcttcggatttttctttaaaattcctttgaaagtgttggacattgttccaaaggagcccacaaaggaattttgaaggattttttcctatatatatctagtgtgttttggaacaaaggatatgaacatgacaattttctatggactgttatcatatgcatcacttccattggaaattttttttactatatatgagctcaaatcttattttagtgctcctttgggacaggtttgtaagaaatttgaaggaactcaatcctaaggaaaatttttatacatggtcctatgaatcaaaggaaatttccatccgaaaatcctaccaaattccttggattggttcaaagtataggaattttgacatgaggtacaacctattggaaaaatatcatttgtgtctttcactcttatgaactgattcctgtgtgtttcctgcgctccatctaaacggattcatgcagttttcctgcataggatttgaagtggtaggggtactccaaacctgtatttttttttctatttctgtgtttttatgatcattcatgcgtttttatgatcctgtgtttggtgaggccaacgcatcttctctctgcccccccccctcccctccattaaaggctcttttgaaacaaagggtttttaaaggaaagttgtaggattgaaatactattgaaaattttcctagctagggagacatatggtttgaatgatttggttagaaaattttcataggattcctttcaagaaaattttcataggaatcctttctttcctccactttttgaaggatttcaaacataagctcaaacctcatggttttgatttcctttcagaagctcaatgcatatccctaagttttttcaacatttgtgtttcaaaagaacactaaatccctagtatatccagtacaacttcatgtattttgaaattctgcgtgatttgtccatacataaaaggcccctttgaatcgcagggttaagaaaaacggaggaataggaaaaacacatgattctaacaggaatgcaaatgtaaaatagtggattgcaaaacacaagaaaaacataaaaataattgtttgattagaccacaagaaaaatcaggaattatattagatgagagagataaactcaaaggaaatttttcaagaagttgaagctcttgctatgttttctcctaaatctacatgcaatgagccattccataggaatttcataggatctgaaaagctttaattctttgtatcaaagggccaaatagaaaaaaatcatataggatttaaatcctatgaaatttctatataaatcaaataagaagcctaaatgctctattttttttctattcttaattacgttcttcgaatgatgcgttccaacatgaatttttttattttttagaccttttatttttaaattttattaatatatatttccaaaaaaatattttcaaaaactgaaccttttggccatgccagcgttgtttggccaggctagccatagtggcgtagcaaggggctagcgtggcaagccagcactgcaaggcgtggacaaaagatttagatttgaaaaatatttttttgagaggtttattaataaaatttaaaagtaaaaaattctaaaaaaatataaaaaaattcttccaacggagcccttacctgtagtcggctgtagcgttatctcacaactactaatatacgcgagtacgtctgcaatggatattgctatagttttctcactgtataaattcgtggctggatttgttttacactgtgtgatgtgttgcttgagactccggctagtagtgcatcgcgagtagtagagataaattaatactctgcagtaatatcttctgtggcgttgtctctttgatgcgaaaatttttgtttgcgtacatggaggacaaccacagtagtactcctactccagtgcagtactagggctaagctatagctagtgcacttggtatcgtagctacacgaattgacttgaagtcgccaactcgaaacttatcatcagcctttctcttccaaaaagctgtagtatctctctcacacacaaacacataaaaagagagagaaggaacacacacagagataagagaaacacacaccatatttctcttcagctcattcatcgattattaaaacagattatttacattacattgtcaaaaaaatacattttcttaaaaaaaatatcttgtgctacattatttagactacttatttcaaattatttaagtttaaattttaaaatatttaatttacctctataatcaagtagataatccacgactaaaatcgacttagtaatataagagctcgtgggacagcttacgactacaataagcagttggttggttgttagctagcttctaatttatttttaagattctacgagttacaattataaattttcaaaatctagaaaaaactaaattatttgaaaaaaaaaattgactctggaagaaactactgctgctaacaacttctgtaaacaaaggcctggtttagttcccgactttttcttcaaactttcaatttttccatcacatcaaaactttcctacacacaaacttctaacttttccatcacatcgttccaatttcaattaaacttctaattttagcgtgaactaaacccaaaatcaaagagagccgaaggaagagagagaagagacagagtgaatgagattaggagagagtttggccttcacaccaaattttcccccaactcctaactttctatcacatccaaaactttcctatatatataaactttcgactttttttccaaactatcaacttttcttgaacttttttctaatttcagaaactaaaacacatccaaactttgtgtgtgtgtgtgttgctagaggccaaaagttgatggcaaaaccatgtctgcactctgcacctgcctatcagaattcagaaagcatgcatcatccagtttgtctcttaccacttccactctcgtgtcactgtcccttgtgctaagctagccctagaaagcaggcagagatccctagctactactactactacgcgtctacgccctagctcagctcatgctccctgcattttcgcgtttgctctgctactgctactccacttccatttttgcacagtgctatcccttcctgaaatgcttcttcgtacattcgctcatcaatcgtttagagagatcatagatcgaccgatcgattggtgacgggatgatcaatctgtttctcctcctgatgagtgacacgatagcaggcaaatcgatagatcgatctagctagctgtcaggtgagtgtaggagagaaatattcaaggctctgcacgcaggtcaatcaatcagttcagctgtgatgaatatgaagcaaccggcataggggtatacaccaaacaactctcaagttctccacatgctccggtcacattttatactcttatcttctactcggtcctaaaataaacgcagcaataaattttcgtaaattttaaattttcgtaaaagtcaatattgtaagataaattatgataaaaaatttcaaaataaaattttaaattttaacgacgacttattattagtagcggcccaaaaccataggcttttgatgaagtgacacacagggtttcccaaatcgttttgggtaggtgtcacgtccagaaattcccgaatagaattccaagcagaatgtgcattaaaaccccccgtccaggaccggccgaggtacacaaacgataaagttgacatacagatccacgtcttacaaacattataaagtcttacataaatacaacggaaaattaacggataactggagctaagccttgacttggactgcagcgggaacaccactccacaggcatcctcgacggcacggacgaagcctataactcggaaaagccaccatctgacgcatactcaaactctggggaggggggggaatagagcaagactgagtacaaccaccgtactcagcaagtcataccggaacagggggtgtgatgtaggatataaccaaaggataggtagagcggttcatttacataaagcgagcatttataaacagtagttgaaagcagtaaaacagttgtattaattaatcaacatcaaccatccactgtccaacgctacaccacgttgcaacaagcccaaccatccacctgaactaatcaattccatcagactaaactagggtgagactaatcacggtgaatctggttgaccgcccataaccgcgggcacggctactcgaatagttttactctgatcagaggtgtacaactgtacccacaagacacagccccacgacacgttaccgtgcaccgacatgccaccatgacataccggaataaggccgtgacaggacctttcgcataacccccctctagccaagcacaccacacctcaggtttcacccccgtccccagcgggcaacgggcagtcccctctcgtgtctaggtgaatccggaagcgacagaggccgtcgcagggcccacccttgcctggatgcgtcagctagaggaaagctacactacaagcccagccgttgcccacgctggcttatggtaagtacgaagaattcttttagggtttcccgcgaaccggtccttaatcgccatgggcactaccatcaaaaccatgcacccacagcccaccatttaatatattttaattaaccaacaccggagcggtggcactaaccaacatcattactaaaatttgatatctatgcattaatgttgtcccccattgtgtgctagttgaactaagcatggctaagcacttcctaatccaacatctaatcatgttacaaccccaagctaacaaaggagtaaggtacaaaaatggcatggctgtaacaatagacaaacatcccatagtaacattataaaacaatgcagtatttaagggaaaaacgatagagcatttgtaatataggttcaatatgttcaagtgacaagcatgacttgccttgctctgctgctggaggaacctcggcgactatctcaaagtacaccggagcgttaggagagtcggaatctaagcgacatacaaaacaaaccatacaaacaggctataagactactgaaacagagaacaaaaccatttttaatggattctttgcatttttcttgatttactgagacttgaatgggcttaaaaggagcacggatgaattagatatgaattttagaagattcactgtgtttttactataaacagaaaaatccttaattgatttattgtgcaattattagccctggtgacatcatcagagagagagggcggcgccgacatgcgggccccacatggcagtggctccgggcgctggtccatggtggatcgggtccatggaccggggagtgggtggcgcaccacgaggtgcacacgtggcgccgacgtggctcacacgtggcggccacgtggacatcatgcagacggggggatatgatggctcctatccactcggggtggatcggacggcggagggggcggcacgcggccggcgtgcacgggcccggctcaagccggcctggcgcccatggcgcgcggcggcgcggctcgacgcagcggcggcgcaaggcggcgaccggggcgaccggccggcggcggagggcagcggcgaagaggcggcgcgggcggcgctagcggcggctgagcggctaggcggcggcgcggcggctaagcggcgcgggagagagagagagaggaaggggaggagggacctcaccgacgaccattgacgatggcgagcgacggagggcgatgacggcagcgggatgagctccgggatcacctaaggaaacaaaagggaggagttagagagggagagagagaccacggatggctagggcgccggccatggcgaagctcaccggcgtgcggtgcgaacgtggttcctgcggcggaaatcggcggcggagaggcggacagcgtggccctcgggctcgcgaacccgacggtggcgatggcgtggctcggcgcagcggctagcggcgaccggagcggcggcggcggcggcggataggcgggcgatggcgctaggacggaagagggcacgagggagctcggcgaaatagtgaaaaagagagggaagggcggtggtggtttatataggctcaagggatcgatcgtggccgagatagccgcgatttcgccgacggagtggggagaggtggggaggagagagaggcgggattcgaaaatcgaatcccggtcgtctcgagcgcgggcgcgggcgcgggcggggaagtggggcggtggttgcggggtgtgcgggagagggccagcaaggcgggagacgtgggtgcggacgcgcggaagaggcgggagcggcggttgcggcgtggtggcgtcggccggaggtgggagacgggcccgacaggtggggcccacctgtcggtgaccctaggggaggaggggcgtgggcggctggctactgggccttggccttcggccggcccagcggggagggaaaggagaagagaatgggccagcggcccattcgaaaagaaaaaaaaaagaggaaaaagaaaaaggaaaggaaaaagaaagaaatgaatacccatggattaaataattgctcgtgctaaattttaattggttaaaattatttctagagctctgaacattccactaaaaatcttgttagcatatttcgacatgtagaactcaagaaaaatcccacatgtcctttccgattagtatttgcattaattcctttagggtttctctcttgcttttacactgatattttctcaaggttatttataaattaaatttagacttcggagaagaacttcggggtgtgatagtagggttcccgtcaccccatagtttggaggttatcgcggtaactggtgcggttaccgtgaaaactgtatagccaccgtgagatataccgcggtttaaaaagctgaaaaggttaccacacagtattgtaaacactggtgacacaccacctggaacaatcaacccccgagttctttgaaagattcaccacggtgaaatacaatgaataactaatgccttcaaaagagttatcaacttactccctcagtcttatcatacatataatacagagagttttagagttggacacgattattaagaaaataggtataattaaataggaggggttatgattagttgagaagtagaggtaggtagaaaaagtgaatagtggagggttgtgattgattgggaagggaatgttggtggataacttattatattttgagacaaatcctactaagtgctaaaagttgctgtattttggcacggatagagtcccatgtactccctccgtcacataatataggtattttgagttttacttgcactgtttgaccactcttcttattcaaaaaatttgtgcaaatataaaaaacgaaaagttgtgctttaagtactttggataataaaataagtaaaaaaataaataataattccaaaaaatttttaataagtcgagtggtgaaacaatacaaacaaaaactcgtgatccggacggagggagtatatacaactgatggtgcgatggattttgattctctaatgtcgtctaaaatattggatgatgatttagcagtgtatatgtagtacgatgatgttaaggtgggaccaacctaattaagatggaacccacacttttaaaagaaaatcgtttttttctctctcccttcgtctcttcttttctcttggtcagtgagagaagggagttatttttcattttttaatgccttgagggcaggctataatcatatggacacccgtatctagaaaccactctatgaccctaacaatatataagagcaggtacaatagcaggctataagccagctataaccatatatcgagaagaaaaaagaaaagagagaagaaagcgagctacagatttgtagccagttacaacacgcactctaaaatattatgtgtatgataggtggaaccgaatattaataatgtagtatatttttataattaactattgtataaataggctataagattaactatagataatttagagctagctgttggctatactattaaacttgctctaaggtatattttgatatcagaataccccacccatgttctcacatcgtgggtgtcctaataactcaacataatcagttataatatgttgttttgaacctggattacacacactagataagtttgtgtatcataacaagctagcctattataagttcggaaactaagttattacaccaagtttatataccatcaacatatgtaattactccttttttaatacaatgaaagcttttgtcaaactcaactaattatataattataaacatatataacagtaccatttgtgtattatctggaagtccccaatcgtttaacaagagcagggttggcacaaagctgtggtagcggtacacagagtagtagtatagtgcgcaccatcttgcttctcgatctaccgatatattccgtgcgcgtcgtctgtacggagtacgtcgtacttataattacggagtatagctagctcgatcgatctactggccaaacttcaattttttttcgctctctctctttcaaatcgcgtccaaaattaaatcttccaagtcacttcacctttattaagtttatacgtacaagcatgcatcgatcgatctgcatctctatactagtacgaactactcgtagcgtacgaggctgtatatatgctgcagcaatacatacgcattcatatgcacaagaggaagctactactccctccgtcctataatataagggattttgagtttttacttgcactgtttgaccactcgtcttattcaaaaaattttgaaattattttttttgacttacgttattatacaaagtattttaaacgtaacttttcgtttttcatatttgcacaattttttttgaataagacgagtgatcaaacaatacaaacaaaaactcaaaatcccttataactcaaaatcccttatattatgggaaggagggagtaagtagttagctagtacaagtactgatctctacacgtagtatgtcagcgaatacttgtacttgtactgtactgtacgacgtgcctcgatttccagccaggtgcatgatacgtgtagggtacagtaaccgtacagtgtatcttttgctttgctccgttgccacggcagaaaatttaatcttccacgagtccggcggccatgcatgtaacaagtataagtcctttcttggttccaaaataagtttatttcttactaatcctacatacatctaccaataaaattttgaaaaattaaaaatatccttattttattaaatcttaatacaattactcatactttatctactcccaatatgtttatcttctacttttataaactttggtataatgattacttaaaaggtattttaggatatacaaaaggagcttaaaaataaatttattatgggatggaccgatggagggagtatatttgcattggtaggaggagagaaacctttatttggttattacaaaagaaggggaatcttttttttttgggtcacatggttgtatgatttgggtctgtgtattgttgtatgttagtccttcatgccatccttcttgccttgactatagtagtgtaggagtacaattaccctcacaggcagcttacagtcccagcagctgtgtggcctcttctagggatgcatgcagaaccttcctactagcattgcatgcatggaaccataaggacatgaaaaatggaggcatcagtgacagtgccaattaagttgaggtcaccggtctaaaatctgagctggttcactgctggaaaagtgatctttgttcgaatgataaaaatcacattagttccggttcgaataggaatcgagactaaataagacctttagctttggttcaaaagcacaacgacacttatataaatcaaccgggactaaaaatgatttttagtcccggttcaaaaaatgtcaggcccctcactatctttagtcccggctggtgtcatcaaccgaccaactgggactaaagatcgacgcgccgtatataatcccttgcacttatcctctcctcctcctcatttgttcctcctctctcctctctctctcttccctctcccttatcctctccttttcgtgcagtagtagcaaggagcgaatgagcgagcaagccggcgagcgggtggcggcagcgccctcccctcccgctagatctggtgggacggtaggcggtaggcggtaggtggcggcgcaagaggaggcgacgggtggcagcagcgccctcccctccgccggatccggtgggaggggaggtggctggctacggcggcctgtgtagcggtggagcgacggcgcgagcgtgattgctggcaccatgtggggcgacggacttggaggcgtgcagcatttgtgatgtctatgaatttgttcatttgtgatgtctgcgaatttgttcattttgtggatctgtgaaattgtgatgtgaatttgttcattctgtggatctgtgagtttgtgatgtcaatttgagtatgttcattcgatctgtgaatttgtggatggttttatgatgtttttgtgaatgtggatgattttgttgttgagttcggttcgaaatcaatatgcaagtagcaaaaataacaatgaaaaaaaagaaaaaaacatttattagtcccggttatttcaaccaggactaaagatggggcagctttagtcctggattgggcgtcccggtttgcaatccaggactaaaggaggttg

SEQ ID NO: 45926 - DNA, 14424 bp, Oryza sativa
actcccagttgcggtgtttctcactctctctcccccatagcctgtcctcaaagaaccggtgaggacctctcctcccatgcgccgatggagttgtactctcctccttccctgtcgtggcaccctcggaccctcctcgccgctatcccttattccttgttgcagaattggtgaggagctcagcacaccctctctttgctgccatctctttcacgagttaatggagaagaagctctatgacgacatgtgggaacgagggaggagctaggtggtggtggcaagctcaacctcggcagagattgggatccgacatcgacggtgcgtctggtagatcaagtcggcccctcttctcctccctcatcggcgagcaaagattgaacagcaatctcaatggtgcagatcaaggcagcgccacctggcaatgagcaaatcaaggtgagcagcatccgcagatgtagtgatgaactcgacggtgtccgtggtggtagtgtcctcttctcttccttcccaccgcacttgttatcttcttcaacctcatccatcgcaccaccaccttttgtcaaatctagcctagttaacacgcaggggcatgcgtcacgaggccacggccttgcccaacatgtaacgactcgtgatccgtacttcgagcgtggttgcctcagccctgcaactcaaccgtgccctctatggggcacgattgcaaccaagctggtgagccacctggctccaatggggcctagcgaagccactcgccacatccctgccttgtacacacgccataataggattaattactagagaccatgtaaaatggaaaacaaaataatactctcttttgtttcacattataaatcattttacataataagtcattttagttatgtctaaagtcaaatatctcccgagtatatagaaagaagaaaatcggacaaatgccatgcattgacaaactaagtgttttattccaaaaaaaataccatcgacgaatgtaactttcaagaaataccatcgcatgaatcaatttttcctagaaatgttatcactgttagggttccgttgttttctttccgttaaaatgtaataggattaacaaaatggaatggatgaaatcctaactatgatgatatttgtagtggatttaataaaactgttgatgtttatagatatttagttttgtctattaaactcggttaaaattagaggtcgaagtttgattcaggacaaaactttaatgttgtaattgagggagtagtatactaaccagctgcagtgtgtatatatatatacacacacactagttcatatcactagtactctcgatgtgtgctatctaataatcttattatcatttactactactactactactatttcgtattagtgtatactcatattacccactgccatgccaaagccggtatttcacttcttttatccgttcggctagcaaacttgggcctcgtgccatccaacattagccccgtccgctccttcctcccggcccaatacggttcactgccatgtgggccccaacaacctcgggcccacacgttagttggcgttttggatctcgacgcggctgcttcacgtacacctcgcaggccgtaaaaggaatcagctacgtacggcccatactatttgggccggaacgggactactccctccattccaaattgatttacatatattttttttagtttatttctaaatgatctacatatttatattcatttattaagtctattcgttatttatgcattggagtaaatgtatattgatgcatgcatccatacacataagtatttataacccacatgtaatatcttgatttgctattggctaggaaataatagggatggtgcatgcatcgagtttgttgctagagtaaatatagtatgagaaagttattagcttttaaatatagtatgagaaagttattagcttttcttgatctcgttgtaactatgaaatatgtagatcaatttagaatagagggagtacgatctacgtgacgctcatatatattgggccggagcggcactcggaaccattttgggcctatatatatttggttgggctggaacgggattgatggcaaacttacgttctatatctgttgggccaactcgtcagttacagtattgatggcgtgatgcagcacgattctcactcaaaaataacgaaaaaacattaaaaaagataaaattattatttttctctgagaatggtactttttatctagcatctacatccaattaaatatatgcagcctcccaattgtaaacttagcctttcaaataatgcagtctgaaattcgattctatagagagttaaacttaagaacttgaacttagagtaactgcaaccataaaatataaaataaagataagcagtactgaacgtctcaacgaattgaattcaattttatttcttgacaaatgtaacaagcaaatccatatttacaatttgtaggctactaggcacacacctaccaaaagaatcgccgccgtcgtcgtcacgattccgccgccgtcgccgccgccgcatccaccgcgttctggtcaatgaagttgaccagcgcgaggccggcggcccagacgtcgtcgtccatcacggactcctccggcgagtggctcacgccgccgcggcaccgcacgaacagcatccccaccttcgtcagcctcgccatcgccatcgcgtcgtgccccgctccgctcatcagcaccggcgtctcgccgccggcccggcgcacgcccgccgccatcgacgagatcgtcgaccgcgtcgcgcgctccagccgcgacgtcagctccgcgtcgcacggcgtcgccgccgccgcgtgctgcaaaaaaacaaacaccaaccaatccgcagttttaacaccagaccacctgcaaaacaaaaaaaacatcgcgaaatcacaagcgaaatgcttcggtttcttggcaccttctgctcgacggcgcagtcgaccaatctgtcgtcgcatctctgaagaacaagcctcgagaagctggtgacgatcgtctccctcaccttgtcgtccatggcgcgtatgtccaccgtgaagttcacctgcataagatcaccaaactccaaaagcttcagcagagccagcttagcttacctggaagcatcatcaccagcaatgatcaagctgaattatacattacattacctggcctggtatgacgttgctggcgctgggccatgtcaggagctcgccgacggtgcagacgagtccggcgagggattcctcagtgaagcagccgcattcctcgtcgtaggtgaggaacttgttgggttctttgcagagcgtctccagtgtcaggacgagctctgcagctgcaaccatcggatcacggcgcaatttcattggaaccgtgccagcatgcccttgtgaaccatttataattacctaaagaaaccagaaagttgctaagcaatggcagttgaaagcaagcccagcttgtttgatcgattatattttggccagcacctactaatctgttactgtgggcatcgagattgaaaactagtttaattagtttttgtagtgtaaggaagcactgctcatgctaaaatcacactgagattaacggatttggataattcagaacaatatcaaacatcaaccttggtgatagtcagctaagctggttatcactgtttattaaagaaagctcatgctataacattttacttgatttgcaagtaccaactctacgctggtgcagtctttcaaaatagtttgttaaacgagaatcttgtgaagtactaataaagttcttcagttgtcactgattaatagtacctgacctcagcgttgacttcgagcactgacattctttgctaaagaatgaccagcaatataattgcttacttgattgtttactaggtcctggtcattttagcatgccaattgtttggaaaagttggtctaaatttagtatgcaatgctacctggtcatcttttagttttgttttcagaaacaagtcatatttttgttttggctcacatatatagttctataagtgtcaccgcttactcttgaccaaaaaagtattaactagaaagtgattgcacctttaatcgcgtctgtcctgcaattccttttacaacaccaagcggataacgaagggcttccaggacaggcccttgttcaatgtgaacctaaccaaaatagtaatgaaaaagaatggtaaatgctaaatttcttatatctgttatacacctagattaaaataatacagtcttgtatacctcgacataactcccgacagactccgggctgtaccttacttcaccaagagcattagcagtgccctcaagagaattcagctttaggacatcttgaactgtcgtgccactgaagaagttgaatgcaaaatatatactgaatcagcaaacaatttcaaaaaacagttcggttgatttatgcgaaaaaagacaacctcttgtcagatacttgtaaaattgattcaggtagtgtaccagctacagcggcgcttcccagaaaagttgtttggaatctaacaccctcctcatcgctgaatgcaatcacctgaggtttaccaggcaaccgtgaggcccaacagctttatgaattatagatatcagaataaggtataggttcttctctacataagcagggaaacagccaactgagtaaagagacattatataatggattcatcctggattaaatatgtctatatctgtagtctttctgataatctattgtgatagcagcccattcacgttctttgaaacctactatgctaatttaaatcaacacgagatcgatgatgtggatgacacatactaagatactagtaaaatacacaagacagagacaagttatgtgcagataaatgtcttatttgtaggacacatgtgactcatcatgcaactagtaaggagtaggatagcgactaatgtaacccaatacatatattcttatgaaagaaacaaactatgatgataaagtagtaacatcactagcacactgatgaaaacattttatctagggtaattaatttttatctaacctctactggtctagtaagtctctgaagtctcccagtaactttcaaaaccttcaaagcagagattgcagagataatacccaaagctccgtcatacatgccagcatcaataacagtgtcctgttttccccccaaaaaaaaacaagatttattttttttatcagtgattttatttaactagaagatgtgcgacagtatgaaaagatatatctatttctcaccatgtgagatccgatcaacaaggcctccttggttgagttggtcggttcaaatcgaccatgaatattccccatttgatcaatccaccttaatataaggcatatattggtcagcaaaggtcaaagtttgagaaaatgactgcagtataaacaagagaagaaaaatctacgtggtaagtccggcatctttcatccagctgataatgacagcagaggctctgattgaggcaggactcaaaaatgtcctctcaaggtaaccttccccatcagatatctgattcacacaaaacgacgccgtgttaggactgcatggctaaactgttaggcaatagagtaaaaataaggtgcagcacggatctttgaaaccaggattttgttcagtttatatatatttaatatttcaactggagaacgtaaaaattgagcaaccttcatagcgtaaggtcatctcacccgaatacaggagatggatatgattctttggaatgaccaataaacataactaatagagaaaaggaacaaaagccttacaaaagtttgatgctttaacgcctagtaaaatgaaattcaccccaaaaaagaagagatgagaagcctagaatatatttgcaatccttttgcataattttcgagtagcctgcagctagctgtcttgatatggtctgtactggtaagttatacaaaatgaaattgtattctctccgaggaaagagtgaaattgtatcctaaaaatgaaatttacactgttcatctgatgaacaaagaagtgtacacacatgaaccccacagatatttttttaaacctatatatggtcatttgggtgtcaatagctgtccacatataacacctagaattaatttatatttccaattatgaagctatctgaattagcaacaaacagaggtagcagcatgcaggagcccaaacaatctatacaatccggacgagattccccttaaaaagtggatcaaagaactgaatattccaacgacatgaagaacctgaccttgccaagttctttgagcctgagcaccgtctcatccctgaggatctccctgtagagcccatctcctcccagctccaatccatctaacaatcagacaccacaaaaaaacatccatcacaaacaaagaaacaaaatcagaaagaagaagcaatttctgatagatggcaatgaagtggatgatccaagaaccaagacccacccaagattgggaggaggaagagggcgtaggcggagaggatgaggaggtggatggatgggtggcgcctggggtaggagaggaggagagccatggccacttttgtgttgtgcttgtgtgtgtgtggcctctctggctcttcccttcccacagcgggtgtggctgtggctcatggcggctgcttttatagcaccctcaatttcccacgagagcccttgaagccgtcagctgtcgcgtgggtccgatgaaccctgaatatactccgggcacatctacagtttcagctccaccaaaaatagaagcgaagctaggtgtagctctctcacaaaataaactaaagaagtgaagctaggtttaggcagctccacaactccactccataactaacttctgaagttaaatttaggagttagagttctaccaaacaggtcctcatctgtcttataatataagaataagcaatcagctgacacgtgggtccgatgaaccttgaatatactcatccgtttcaaaatatagaacctataattgaatgggatatttgttaggactacgaattcggaatgatagcctgtttatattcgtaatactataagatatcctatatgagaatgataatggcacgatatctttagaggcagaggatctcaatgcatatatgagcctcttgccaaatctgcttctgtaaaaccttcccaataattactctcttggtgaaataagtccaatataaaatatgatacatttagtacctattcagattctaataatgtgtaacatttcgtatcttttagtgacacgaaaggaggagagtatgcatggcatgaacggagccagatttgagagcaatggtgaaagcaaggaaaattatagaaaaaggaaaagaaaagaaaagaaaaggagcgaactgaagggattccgtttggcaacacacagtgcccttgcatcacggaagtgccctgagctgacgacctttctggacagaccgtctgcgccgtcgatgcaggacacgtgtacgggcggatgatgcggctggctgaccatgcaggtgcaatgcattgcacacacacgggacaaaactcgaaaagtagaagagatccacacaagtcgatcgtaggtaggagtggcgcgcagagaatctggtggtggtcgcaaaacggtggccgtcgctatccagccgaacagaatctggaatccagcgagtcccccaacaacaacaaacccagcaagcgacctacccaagttgtagctcccgtaacgtcactgacaagcgggcccacgaggatggtgtggggccggtccacgggtggacgccgtggtgcatgcaactagcttatcttatgccgtttagttctcgaacagaaaattttggatatatacatgaagtattaaatataatagaaaaactaattgcgagatgaatcttttaagcttaattacaccataatttgataatatggtgcttcaataaattcgtctcgcagtttacagaaggaatatataatatattttattattagactatgtttaatattttagcgtgtccgtatatttaatgcgacacaaaaaaaactttttcaccaagtgatcgagggagagatggacgtgttggggttggattctgccgctcaagtgcagcctggtgcgtgaggagacccaaaaagcggctttaacggtgtgcggctaaaccgttaacttatttgtagtttagaataaattgtaaatttatttattttgatttattggtgggttcaagtgttagttacttgtgccaaatattcagatcaataggttgagtgtgacgggccaagagctttaggctgaatctgaggacggataagaatggacgaacccacaagtttctctgctcgatcgaccaccactcgcatgtaaagtagaatgaaccgataggatatacatagcacgtatactaaactagactattatatatgtactcaaattatggagtcagcttgaagacacgcctacaactaagttatgtcatcttgccctggttctatatgtaaaatccaagcttttttctctcaaaaaattgtatagaatttgcatgaagcttgtatcctaggcctccaccagaagtgatacatcatgaatctagatgtgtatcttaatatctacaagctatttagggtgtctttagccgctgcggcatctcttacaatcaatttaatcataaagaaattaaaatccaggaaattcactataagtcagaagatgttttttttccaatttttctagatttctaccatctgaattcccattagttgattctcataatctaaaattacttaaacagtccctagtcccatcaaccataacatgctaaggccttatttgtaacgaagtaaaatttttgcggagaaaataaatggctccaataaaagtgttgttaccacatttgaaaaggtggcacttttaactttatgctcaattcacacttaattaccaatatttggcggggggacaaatgttgatttcacgaaaatcagccaatgatagcgatcgatcgtttagttaattaataagcaccagtggtgtgatgtggaaccatatgccatcaatttcaaaacttaatttggcgttcacaagtatcacttgaatcttgttcttcacaaatatatacagtactacttagacatgtgcatttttaatataattttattgatgtagggttttttgccgttgatttttgtcacattaaatgcacgataaaaaggcacgtgaaatgcttgagaatagttttgtatatgcatctttcacctaataaacaaaacgatactcccttcgtttcatattataagtcgttttgactttggtcaaagtcaaactacttcaaatttaactaactttataaacaaatatagtatatttacaataccaaattattttcttaaatcgataattaaatatatttttataataaatttgtcttgggttaaaaatgttactgtttttttctataaatttggtcaaatttgaagcgatttaactttaactagagtcaaaacgacttgtaacctaaaacggatggagtactttctctgtcaaaaaaaaactcaacctaggacaacaaatctggacaaaggatagtccagatttatactcctaagagtggtcacatcctctttttttttttttacggagggagtacatgaataacaatcaaactattgctctcttttttccgcccctccgttctttaatataacggattttgactctttgtttacactgtttaaccatcgtcttattcaagaatttttacaattattatttttttcgacttactttattatcaaaagtactttaaatataactttttatgttgtatatttatataaattttttaaataagatgagtggtcaaacagtaccagcaaaatatcaaattctcttgtattaggagacggagggagtactagtttgtgcagagcatgaaacgcgctggttggacgtacgtggcgtcagatgggcacctgacagccctcacgagtgtggatgatggattaatgcattagctctgaattctgatgatctgctgcttacatatgcaaaatccggccgcatatttataatcaaatctggttctttacatttattctcttcattgtttatcttttccaaaaagaaccatttgcatgccatcactaaaatccatgagtgctgtgttgattgaacatatcctccaaaagataaatacgttatttatgtaacgtagccggaaggaatcaatgttatggcacaatatcactaaatgttgataattattggtcccaagctagtcgaaggagatgatttgatacgtacctggctagctaatataacattttcaaataaaaatgattgctttattcgattgaggcataaaaataaccaatgttcactcaatcttatgatatagtaatgttcactacgatcatgcgccgcaaggcaatattatagaagacgaaggtgccactaaaaatcatcaaaatgtttatgtggttctttcataagaagtaattaattttttaacaaatgataaccttgcaaagaggaactagggggcgataagcaaaattgttttctaatgtgcaagagacaattcaataccatttctttgaatgtcacatagatcgatttgcttgacttggcaatgtatcttatttgctttcaaacgtcctccccacagtgccaaaaatataattgtgaattgacttatgggggatgtcccggtcaagaaaattggctttattcgaagccaatgcataatattggtcaagtaattaatcttttatcaaaggataaccttgcaaaaggggattaaggggtgataagcaaaattgttttctaatgtgcaagagacaattcaataccatttctttgaatgtcatattgagcaatttgcttggcgatgtatcttatttgctttgaaaagtcctcctctccatggtgcaaaaaatataattgtgaattgacttgtggcaaaaatataattgcgaattgacttgtgggggatgtccaggtcaagaaaactagttccatttgaagctggtgcataatattggtaaattaattggtattactaaaatgataaagtttttataatagaaaataggctatatgcaggttatcttcaggtctctcatctggcttcacacttatctttgatgctagcacaaaaatagtaagatactatacactgtggtgctatactcttggaggttgtagccttttatttcgttttggatagcatagtacctatataattaattactaaaatatattctatttatcttaactttcaatgcaacatgtccaatcactctatataattattttaatttattggttgtttctctgtcgatagagtccgaaaatgtaaaccatttttattatcttaaaaacaataagtgctgtgctgattgaagttttttcgatgaatggttaaagtgataatgatgataatcgatacgttttgtgtaagaatctctgactattagccgcaaaaggtgagattattatgcttccacgcaagaattgcactgtataatggagcaaaattaagtcctaactaggcaagttagtacaataatgcatggccaatggttaagaatgcaccgtacgtagtgatcgatgacacgatcgatcgtaaatgtgaccttttcatgtctgcattagctgaaccacgtttttttttttggtatattcagtgctatcatgatcagagaacattacaaatggtttgtcttttgcagcaccgagtcaccgatggcccaaacccctatagtaccgatgatgtgacatgtggcatttctcttgcccttttgacactatcgtgtgccttttatcatgagttcatgacactatcatcgaatcatagcgaaaattaaaaatcgcctacaactttcttctctgtatgtgttgtttacagtttgcttgtgtcttcttcgtcaccaatagccactagtcaatactgacatactccctccgtccaaaaaaaaaaaagacaaaccctggtttccgtgtccaacgtttgactgtccgtcttatatgaaatttttttataattagtattttcattattgttagatgataaaacatgattaataatttatgtgtgacttatctttttaattttttttataatttttttaaataagacgaacagtcaaacgttgaacacgaaaactcggatttgttttttttttgacggagggagtagaaacttcttaaagtctcaatgaaaagcactatgacaagtggccagcattgtccgatactgatgacgtgccatatatgtgacatttctctttgctatgtgctcacgagctcaggcagggcagctagcaagccaggcactagtccaagtccagagaagaactttggactaggatgttaatccctcgatggaattagtgttcagggattagtccattaatttgatctcctgaattcttcattttgtttaaagttcacctttcaactttaaaatcgtgtatcgacacctccttagctttttaataccatttaccttaccctgcttaggccaaaccaaggcggatttcacctgcatgatgttgatgtggctatccaataagaaaaatcctaaaaaaaaaattacagagtccacttgccattgaccaccatcttgctttctctctcccttctcttctccatttccctccctattcaatctatgcattgattactgatgccgagtgtggacttcttttaaagacgttgccatcagtatcctctctgaacctccaaggaaacccgatggacgcaccactgccgcttgggctcatactcgattcgagccgatagcggtggtggcaatgacttcggtgggcgtcgaactatcagtgtggtggaggatggcgtgagctacgctagtgaccatcctctcgactccagcgctcttcgccgccctcctctatgccaagagtgtcactgctctgtcgagctctagcaccgccttctctgcttggctgaccgccgctctcaaacttgacgaggtggttaagcttaggggtgcaaagctcggtggaggggataaatgcgagctcagtgaatgaagcggatgcggtgctccggctagcctctgcaaggatcgtgaaggaggaagtagagacagagcttgagctcaatctcttataccgaattccacgcaccatctcgggtgattagtgcgccacgtggctgccgattccagggtttaatttgcacacacatccattggattaggaaccaacggtagatatggtgaagccttgcaaagaaatagtcgtcccttcaccgactattcgcgggctgtctccagcgtgctgctctgcatcagtaccgtccctcgtcgatccgttcggagcctcccttgccgcacgtccgcaccagagccacccctcgcctgtaagtatgggtgggcatatttagaccgaaccgaagaagtgaaccaaaaagaccgagaccaacactgagaaattcggttatctgttcggtcccagccctcgaaagaccgaattatttcggtcatttcggttattgggctcggttaaccaaaatgaccgaaattttagcccaataggcctaggaaacccaataagcccactaaaacaaaccctagaaatgatacaaccctaccattgccgcactcccatcgcgcttggcctccgcctgactgcctccaccgcgccgccgccgccgccaccgtcctccaccgcgccgctgccgcctccgccctccaccgcgttggcgacgcctccgtcctccatcgcgccagcgccgcctctgtcaaattttttcattccaaacttactcctgaaaaattttggtaagaccgagaccgagactgaatttgctgatcctgagatttttttgatgaaatttggtcctgagttttcaaagaccgaactgaccgaaaaaccgaaaaccgagaccgaatttttcggtaaaaccgaatgcccacccctacctgtaagatgccacctccttccacgatcgtcgttgctgaggcgccagccaatgcggccaccctgcgcgtgcgccggccagccggctcttcgcccactgcccgccccttccctgcgtcgtcaaccgcgtcctactcctactatgccgccgggcgtgccgcggtggttggccccactgctggcctccgctcgaggccgtgaaggccgcgcttatcggtcgtggccatggccagcggtggtgagcaagctacagtgcactgtttgttccatttatttccctaaacgtgtggttgctgttttgtagtgcgaactgtgcattcatggtgttcgatgaaatgaccaagaaagaaaatatttcgttctttcttagagttgcatttgatagcacagttaggactattttgttggatagtgtattattgctctattgctactactacttctgcagaaatccaggagaaacacacaacttggaattgcagaat

SEQ ID NO: 45927 - DNA, 18922 bp, Oryza sativa
  unsure (1)..(18922): unsure at all n locations
tcaaagaacataatcaggaatagttcttgacaaaactcaagtttgatttttttttcctgaataccctttctaataacacttataatcatcctgcattgatacatagtttttttctttggtctcaatcctgcacaatagtttctttcaagaatacttctcctcttgacaaaagaaaatgatctataaaactggcgccatttactgacatttgcatcataattggttagtgccctaattgcaagtgttctattcagggaatgtcctgagtattacttgagaaattctgaagttgcgatcgattgcaactgttcataatgaccacattcttaagttaatacatcatgagcttgttatatttctttccacattctctgtatatttctttccacattctctgtatctgaatatgcatttttgcaattatctgacaaatatataaagaatataatattttctgaggagatatttttttctgaatatcgctccctcatcctatttgttctgttgggtggatgttatcactttgatgggtctatcaacgggttgttccattatcatttgaatgcacccataataagaactaacaattgagaaacaacaattttccttaaaaactaaggaatgttgtttcaagcttttgctgttgtgccactagcccaccaggacaatctggcttaacttatgtctcttgctcttgatctccttctatcagtcagtctaggtccaactaatttgtgttcacctcctgacatttctagggatatgtaagatattgaagatggaaattgctaccgcctacaaggtgctcgaaatcatgacctctggcatttaaaatgtgtgaaagactgtggttctaaactttatttttgttttccgtgtaactacattgttgtgtttattcattgtgccatagctagaagctagaccggaacaactatggtagtatcaggctttttttttatcttagtgaattcatgaaaatatatttatctatagttctatccagttttcgatgatcgttcttcaagggttttttttagcagaagtgccatggaagctaatttagctaaacttgttgcataagttaataacaccattgaatctttcatttgccaaccttttatagacctgaattttggaaactaattagaaagtagacacgagctataatgagcgcgccacttggcgtgctaattttctagtgtatgttggatgtagcgtttgttctgatatgtagttgatttctattgccttcatctgaggaaaattcgttcaagctgatgcctgatatatgatgagctgtaggtgctttgagatgattttgtatgcgccttgttagctttcctcgtgacaatgctttaggctgtgtttagttctaggggtgtaaaattttggcaagtcacatcagatatatggacacacatttggagtattaaacgtagtctaataacaaaaataattatagaattcgcatgtaaaccgcgagacgaatttattaagcctaattaaactatcattagcaaatgtttactgtagcaccatattatcaaatcatggcgcaattaggtttaaaagattcgtctcgcaatttacacgcaatccgtataattaattattttttcgtttatatttggcactctatacatgtgtccaaacattcgatatgatagggtataaaatttttgctagggaactaaacagagccttaggcgcattgtatccaaacattgcagatagaatcttgaacccatgctacttttgagccggatttcagatacattaagaaagtctccaatcgacaatacaaggcatggcggtcttctccgtgggttgtgaaatctggtgatggactgatgcgtaacagtggcagccatcacgtgtccaatactttcctgaatagcttttggtaattacttgtcagctcaaccagtagttctgttctaaccatgtgtgcgtatgtgtgttgtattttgctcttcgtactagctaccttgatcagggttggccagttagcaaagtatgacaccaagatctactgcagacagactttggtcgacactttcgtagcctgtttaggaatgtagaaactttgcaagattttggtaggattagttcattttccattaagttcaggctttaacttgtatacggatataattgaaaatcatcattttagcatcttattatggcacatatttattagaacacatggagattatagatatgggatacctacatatagcctttatatctgactgctatcagaaggtgggccacaactgcgagaaggtacgattctatatccctatttgggttttcttttgtaatatttattaaggaagcttcggtcgagtttggctagattttctacttgcaacacatacccccaacccatataaacagagctgggacccctcttagggcattggccaaaacaagatcatttgatcaaatacaatatttgacggatacaatcctcaaacaagagtagagtattacctcccgtcgagagggcatgaacatgtttaaatctttgtctccgtattcatctgtgaaaagatttatatgcatagatggaagcagtttctacagagttttgaaaggaaaaaaaaanagctttagctccttggattgaagcagttcttttttatatcttcagttaaatggtcttcttttttgatatttattttgtaatctaaggaatacacatatgattattgtcgaatccaatttagatttgggtacactgagtattgtgctatgcgacaagtgaggaaattagtggaatatttgcttgcttagggtacactgactatttaaaggacaaactatgtatcgtttgcaagatatagatgtacttttaagttatgtcatacaagatatagatgtgctaattagggcctaactttttctttgtgttgtcaaacaacttttagcaattcttaaattttatttcccgtatttttcaagtataacgcaagtaggattagaaattcaacgtggaatacaaaaaagtccatagcgtgttaaatctgaagcctgcgatcgctgtacactattgagcttatattacactttaaatagctcgaggacttttttttttatttttttaaagtgaaattgctgaatcattctgctctaaggttgtgcttgcagaaacggtgaccaagagaattctattgttttgaagcataaattggatgtcaggtgttcgaattctattattctgaagcataaattggatgttaggtgttcaacgatgacaggagcctagatgacttgaatatattcgatggcattacaatgaaccatctggggctctcttgatctggtctagactaatgttttgaacaaatccaactatgcaaaggttgcaatcaggaaacgaaaagaaaaggtgagaaagggtgtcacttgaagttcctaaatggcttagtacacctcttgagtgtcgatgtgtcaattttagtgcaaatgtttattggtattgacatgtatactacactgtagttcatggagaacaagaataatgtgtatttagtctacttaattgatataaatcgtgtagaactttatgattttcttcaattcacaatatttctaaaaaactgtcaattgtagcttttttttctccatttttctttgtttccctataaagcactgcaagatacttttttaccttgccaaactaacatgtacacttttttttaacaaagatacaattttacatcatgtgtgtgaggacaactgatgtatggtatcaatagtcttgatttatggatggttgatgatgaaacattgcgatgtacaggcgatggtcaaagagagggtgctctttttcctcatcatttttgaattttcattaaggaataattcctcccaacaattggtgtcatgtgaattctgtttaggccataaataccctgaagtgttgattcctgtgctgttaggttatgtagttaggtccagatttgagggaattcaatgcattcattagttcttcattttgtcagagttgtaatttttaaataattcatgtttttcatattatttttctattctaatctgctactagaaaatcatgtgcctcacattttacaagatctttgatgatatgaatgcttgaggatgctattttgaattgctatttttctcagcaatcaaaagtttatgtggagtattgtgatacaaataatatatgtatatatgatgtgttctcatttgaatatcactttacttgtagagtgaaataacttagaatcacaactagaaggggtttctttggacgaagggatgggttcaaaatcattggcctttgataagtttttccttattgaattatttttctttcgttaggaggggttgcaactgctaggatgatggacatgtgcagtgtgaaatcccttccagtgctcaactaatatagtttggacatgttcacgggatacactgtaagtccataccagaaatacagagttgccatttcaatttttaagacgtttccagcatgttcacactcgacatttccttctgttcactgcagttaaggcaactacaccgagtactattccgataacaatttactagagtactattacgtgacaattaatgtcttgaaagtaactgagatataaacctctatggtttgcttaccatataaatttctactggtcacacgatagaatattattgttgatcatgtaaatgttatttactagagtactattttgagacaattttatacttttagtactttgtatatgtcgtgtgatatacatatcattggaaaatcaatgcattaaactttgagtatgcttatatattatgggaaacgtgcaatacgattactagtagtaattagtgtagtacttaattaaaaagaaaatatgcccaatgtgttccagcatgcacgcaacaaattatttgaagcaagtaatgtaattattttttccgtcgcacgaacatgtccagaacaatactaactatttcgttcataatgaaaataaaagaaataacacaaatactggattggatgcataaattgataactatttcgttcataatgaaaataaaagaaataacacaaatactggattggatacataaatcgataaattaaggataatgtctctttcatccataacaagagaacaagttcacaaatactacactaatacattacactggatacatagatttgagcctccatgatgagaatcaaaactccacaaatataattgcatacatagatttgacgcttcgtcataagaacaaagataggtccacctactaaactggataataagaatttaagacaagtcacaaataaactagtagtgcgccatagttttgaaggtggtagctgcagtgaatgaatccaaaactgtctctaactacatagaatgttgatgattttccattgttgattccaatctctgaaccaatcaacactaccgagtgataatgtgcatctagcattggaggataatatatttcgccatcattcagaaatgtaaacaaagatgtaaaggggatattaccaattaaaggaaacccattggccataaaccgagttatcaagtgaatatccctgacattaactttgaagtagcctcgaatccgcgtacatggtaaacgagattgttgttggtatttcttaacgtcacaaataaaatctacaagcacacggagaataccgatgtagcttcagtattcagtattccgagtatcgatttccacaaggaacgtgtgtgctcagctcttctccaatttcatccaaggacacaaagcaaacatatgcaaatggtagagaggattttcaagtgaaaaacagtgtctatagaaagattaattttaatcctaacacgatacttcaggaactgtcaacccgctatttccagatgtcgctctaatacgtaccggacgaggacttaagtgctcttgaggttgtcaccacctctacacccacctacgtactgtggaggacttaagtgctcttgagggttgtcaccacctctacacccacctacgtaccgtgagatacacagtaatcactgaaaattaattagccagacaccgcgtctacgcaattaattactactctaacgttggccaagcattaaagcaatcactacatattactagaccatagtgaacaatgatcccatatagtaattaggaactaaccaagaattaattctcactaagcaaatcttaattactcagaatgatatttctattaaagtggagtaattaacaaagtacaagaataatgagaggattaccgacaactctggaattcctccaattttttctactttactctctccctattctaagtatactatagaacatataaagagccctaagtatacttagagcctcttataattcagctctacatcttgatgtctgtttacaagtgaggatgagaggggtatttataggtagaaaagtgtcttgggagtatggagatgctccaagcatccaaagagcatcttctcttttgtattgacaagtgtccatgcttatgacggtttctaccggtgaaaacggccataaccgtaattgggaagcggatttctaccgaactgaacttgggcctgggccaacggcctccgtgagggttcgaccaaacccgagacggctatgttcgctccggttttcggcctggacacttattttggtcccctcaatccattggtatgaatgtttgacacatttggaggtgtttaattaggtttttgggtccaaaactccataagttcggatacgagtttgattctcctcctctttcatatatatttcttctcaatttaggtagtttgtcacctgcatacgaatatacaccaacactcgtggaaattgttagaaataaactctaccactatgttggatgttttatatttacggtcttatgctggtattgacgaatttaatttggtacttaacagccgtcaacacacctcctctttactcgtccaatgtcactctacagttatctgcaacatggtcgtcagccttggttttctgtatcttctcaacaacagcgaggagcacaccacgccgacggaggagaacgccatgcaggcgccggcgagccacggcggcatctgcagcctcgtgaaggggaacagcgcgccggcggcgaccgggatggcgaccacgttgtacaccatgtgaacttcagacacgtcacattgtagtaattaaaaaagaaattaagagtaggaagcaaacgttgttgaaaatatgaacaacgctatatgtattaaaagaaaatcttacaaattaaactcttaacaaaggttaacaaagttctcacccgtttgatttaactaggtcgatgtcatagtagatctagattgatttactacaatatgtaacattagcgttagcaaaaattttgtaagaaataaaatccatatgtatagctttttcctaagcatatgcatgacatgtagaaatggatggttcattacactagaaatcaaaggagataatacgtgagagcacggaatgagaaatccttaatgcacgatcagtccggcccttacgtagttatgtgtacaaactttcggagccatcgcgaaataagagaaacggtatatttgcaaaatgaaaagtaatttgtgaatagaatttttatatatgtgttcttagcgatctaaaaacaaaggctaaaaaataaacttcgataaaaaaaacctcaaaatcaactccaaatttaaggatgaaaattcaaattttagctgataagcataagcataagcaaaaagatgagaccctttatatgtatacgtataaagtttatgtttatacgtgtaagtgtatttttttatctttgtactccctccgtttcagattataagacattttgactttaatcaaagtcaaactactctaagtttgactaatttgtaaaaaaaatagtaatatttttaattcaatgacaaatatattatgaaaatttatttaattatagatttaatgaaacaatggtagtgttgtaaatattactatttttttctacaaagttagtcaaacttagagtagtttgactttgaccaaagtcaaaacgtcttataactgaaatggtggaggtagtatccaacaaaattatatgtataaactttttcatatgtgtatacactatttagacataaaaaatttgcacgcatatatacaaagtttgtatgtatacgcacgtatatacgaaaaaaaatattctgttggcccataaaatacagacggatcgagcccaatacaatattgaagcacaccatctaagaaatctgaagtagtagtagtgaaataaagacctaacaaataggggtggaaaaaaagctcggattcgtgagctcagctcgggcttggctcgagcttggatggcttggctcggctcgtaagccaaacgagctaagcccaagtatccttttcagctcgttgctgaaatgagccgagcccaagctggctcacgagccgtttgttttggctcgctagcctaggccattatgtgtttatatcgattatttaactttttatagagttattatttgacaacttgaaatttatcattaagatttttaagaattgaatataaaaacttatttaaattttacatgttgatgatttgttcttactttttttaataattacaaattatatatgaagaggtgtttcaacaggaaggcttgcaagctggctcgagctaggaaatgagccgagccgagctcaagttttagcttgtttctctaactgagccgagccgagccaagccaagcctagtttgttacaagccactgcaagccgaactggctcggctcgtttccacccctactaacaaatcactactaggtcaaaagaggaaagaaaattttgaatgggccctccagcattatgaatgttttttttagaaccgatgccaggatttgctggtgttatattaaataggatagaagttatttacaaacacactaaaggtagataaaagatgaaaagaaactggaaaaaaaaggacaggctgaaagtgggagatgcgaaactaatccggaaatgatccaataacaccgctataatttgattagatgactttattcgttgtaattaaatctttataacaagatctcacatgaatatattttaataaaaatatatatgtgtgttcttagaaaaaaaacaaacttatgttgaactatttaaaaataattgtttcatcacttgtggagatgtttcaacccacttcacaaattgttccaaagaggtacaacatataaaaagtattgactgcaacaataatcattattacatgaaacattaagtcccgactagtgaaatattttttatatttagactgaaatatcaaattataattattgttgaaacataaaaaatgtatttgctgaaacatataaaaaagataacatgaaacattactaatgcactagtaaaacaccaacaaatgcttgttggaacatttcagtaaaaatgtgtgcaacatttaaaaagtaaaataaaaagtcgtcggaatgtagtcatgtgatatcttgttataaagatttaattataacgaatccaatgatatagttagtttgaaattcggataaatagtttaagagaaaaaatcatttaaattttgaaacatgcttgaatgcattgctccgttggctcgtgagtacacctaacctgtttcactatgcacctacactgttgtcaactgagacgtccgattttttatttctagccggacagccgatggtaagcatttccatgagaactgctttgtagcgaaaagataagcaaaaacgtacaaccgattactgacagctggtaattcaccaggagagataaaatggaaaataaaagaataaaagaacccgaccaaaatcgaaaaaacctgtaaagcaaacagcgtccagagcgatccacaaattacaagagacgccatcggccttccttttctcatctcatttcatttctgtgatgaaacggtgaagagggggaatctatgtacgtatacaggagcaatgtcaatgtcactctacagttatctgcaacacggtggtcagccttggtttcctgtaccttctcaacaacagcgaggagcacaccacgctgacggaggagaacgccatgcaggcgccggcgagccacggcggcatctgcagcctcgtgaaggggaacagcgcgccggcggcgaccgggatggcgaccacgttgtacgccatggcgaagaagtagttccaccggatccggctgaacgtcttcctggacaggtcgatcgccgtgatgacgtcctccaggttgttcctcaccagcacgtagtccgcggcctcgatggcgatgtcggtgccgccgcctatggccatcccgacgtcggccgctgccagcgcaggggagtcgttgatgccgtccccgaccatggcgacgatgctcccgtccttttggagagagcggaccacgtcggcttttccggcaggcatgacttcggctctcacgtcctcaatgccaacctgcaagagcagaaaatcgcagacatgtatatgaagaggtgttcaggtaaatgatgaacattatggatcaaggaaggtaatagagattagagactaacctcctttgcaacggcttttgcggttctccagttgtcacctgtgagcatcacgggatgaacacccatcttctttagtccttccacaactacagcagcctctcttttcaggggatcagttatccccattaaacccacaaaatcatcgtcataggacacaagaatgcctgttttagcattcagttccaggtctaccaagaaattttcagcttctgggggaacattcacaccattttcagtaaccaaagtacgatttccaacctgcaaaacagttatgtctagataatcagtggtttgcttaaaagaaatggtacagcagtagatgggttagacttgtacactgttttcaactcagctgcaagaagggcaaggaagagttatggtagcttatgtgactcaccagaactctcttcccattaatcaagcattgaactcctttgccaggcaaggcagagaagtcttcaacttgaaggagcaactgagataatctgtcttcttttctttgttcaatgccatcttttgatgtagggagcttgccaaagaaatggaaatggaatgcatattccacaattgcttttgccagaggatgctcactgcttgcctgagtagaaaacaaaagaactttttttacttttgacaagtcaatatgaacaagaccaaaacactttttttttaactaaaaccctgaggagcaaaacatattttggcattaccacattcatatgaagcatagttacaataccgaaacacatttactacagcttgatatgaaccatacaagcaacttaagttcaacctcacctctgcagatgctactaatgtgaggaaatccccaagatccattcctgagaaaaccttcgctgttgtcacaactgcttttccttgtgttagtgtgcctgttttgtcaaaaatcacgtaatttacattttgagccctctctaatgcatctccccccttcacaagtactccatgattagctccaactccagttgccaccatcacagcagtaggtgttgccagaccaagggcgcaagggcaagcaatcacaactacagctattgcaaacatgagagagaaaacaaagcagttgctagttccagaaatccatgaatttgggtatgctcccacccatccacataaaaacctacaaaagcagccaatgtacatgtcagaaaaattgaagtttcaaacatagtatcactcaaaaattgtgttagtatatgttgaacttaccatacaaggaatgtaatcatggacaaggtgagacaattggaacaaaaatgctagcaacctgaaagcaaaatgtaggcagtgtcagcattaaccataacaggcctctataatcattaccgcacatttaggagacacaagagcttttcacagataaaagaaactagtctattcttccaagagttctgttaaatttttcacgaatatacaaaagacatgtatgtttgtattaagaaagcatagaaggtcaaagactaaagttaacacagggaaaaactttggactggaaggtactcctaagcagccaaaatgttttgagattaaacaagttacaactttttacatcagaagtagaaagcaacataagaatgatgatgttaaaagagggcatatgaacaatcaaattctcataaacaaacaacatttgcctgcaacattctcaagtatcggaaatagtaaatagatcacaaaaaatgctctgacgcttttaaagttaatatgtaaagtacacggtaaacacttaaaataagtacagacaaagcaaatgaaggacatcacagaaaagaatatgggaggttactcacataatcagcaaatttctgaatgggggctttggacatctgagcagtttcaaccagagatatgatctgactcagaactgtctcggatcctactttgtttgcttgtatatgaaggacaccatgcaagttcattgtccctccgattactgcactagatacttctttgggaattggtgcagattcaccagttatcatactttcattgacatggcttgttccccacacaacaacaccatcagcaggaacctttgaaccaggaagcacttttaagatgtctccaggttggactaatagcgcatcaatttctctctcctcagtatattttccttctgcatttgaaaagaacaatgtgagtttgtgtaacttgatagtatgaaatgaaaaaaaaaacacaggcggttgcctaaaacaagtcagaaataacttctaaaactaatgtgatgagtgtggcactgtgacttaattgtatatgttttgaaggacaaaattttaccatatacctttgtctttcagaagcaaaagagcagtagcagggaccaattctacaagcttcttgatagcatcagaagttttcccttttgcaagcacctcaagatacttcccaaacaacacaaatgtaattatcattgcacttgtctcaaaatatatgggagggtgaaacccagtgaatgctccgtataggagtgcacaaacagagtatacatatgatgcagtggtgccaagaacaactaacacatccatatttgtagagccgtgtctcagggccctataagccgcaatgtagaaccgtttgccgacaacaaactgtacaatgcttaccaatatccacttcagcaaatctcccatatgaaatggtccacagtgcatcattagtattgaacgaatgaaaggtatatgagggcagaccatgcgtataaaaaatacaggaatctggtgcaaggacacagttggatagagttagtaagcaagcagaagagaagttcaaaagtattctgaaatataaagaagcaaaagaactacgtagctagggaacatatcatctaacactcccaaatgttcagtactgccaaatttaattcaagtatgaagtaaaatgtgcttgttatcttttatgaacagcccaaacccccaaacctagaattaaagcagcatgctttcctatggcaagtggatctcacatgtaagatagaagaaagtaaatagaaaaaatctaaactattatgtggttaggagaaaataactgattcaaatggcacagggacatgatgattgctgtttttccacataactaaaatgctccaacagaagtccagaagggtcctccaggtcacaaccatgtcaaggatattgtcacaaacattgatccaactaaaaatctttgtgcaaaaatgcataactatgctggtggtgaaaaagaagagcaaaggtcaaaacttacacttaagaataagctcgagcggagaagatgaagcattttggcggcctcatgtgcgtcatttgaagcccctcgtgcatatggattctgcacatgagctttcaatcttccattgcttcctgtctcaattgcatccacaattgatctcagaccaactgcttccggatcaaatataatttctacttctgagaccgtagcatttacatcaaactgtcgcaaaccaatcatcttcttgaggatatcatgtaacacattaacatcccgctctgtgtgcaatccagtcaggcctagcaaaatcttatcttgttcgctgctctgtaagaatgcagcttcaaaaccagcatcctcaatagcctcaacaatttcatccttgttaatgacagaaggatcatactcaacttcccctagtgaggttgctaaggcaacaacagctccttttacaccagatagccttttcaagatcccctcaactgagttcacacaattagcacatgtcattcctcctattctaaattgtgctgacagagtcttttgtgcctttggctgagagatagcagtatctgggataatttctgcgtcaaatccggcatcttctatagcttctattatatcctcaacctgtataaacaagtacccaaataaaaattgcaggtagctaattgacccatataatctaaaaatgtgtgtcaacaatgaatagtaggtggccattaaaaacaaactaaatgaatgcctattatgaacaggaggtagcagatagaacttgctggtaaatgtctacttaatagtcaggaaagccatccttaatagttccaacaaaagcaaaaggatgaaacacaacattccccgtctgcactacaataggctcatcaaaaagttgctagcgctacaactcaactaatattcacattaacagtcattaaaaccagaaactgtagagtacttcacaacataataaccataagcattaataaatttcaattgtgaagtacactgttattactatgataagactaaattttatcactgctgaaagtttatacacttgcatggtaattactgggcctagaataatgagattatatgcttgtcccaaaattagcatgtaacatcattttgcattcaattttgctcaaaggaaacttcaatgagtacttagaagccacataaattgggatccttaacttagcaccctttccccccgaaaacatgactcggctgctccctgcctcaccagccaatcaaacctatcgtagtacagcagttaccccatttctgccggtagcaacaaccaatcgcagcaaactgccagcctttttgagctcccaaatcccacaatccagagagtccagccacaatcacgagcttgcaacaaggttacagctcatccaaccgccaaagcaaaaggagcacaaaaactctggcctctgggcactgtgggctaaccacatttcacgaatcaactcatgaaaagtcgtcatcgcaaggtgaagtcaaaaagaaaaaaaaaatcatctccagctaaaacccaaaattgcaatatcatacacgattgactcggtctcacactcacacacatagtaattagtaaactcaacttattattagacaagagtaaattccgattcaccaacttctaaccgctcgagaaaaaccacgagcaagcagcgcgatccagcttcctagaatcctgttctaccgcaccaaccatcacctacgcaataattccagcgcaagaaaaaacttcaaaaaatttaccaccgcgtgagcgtcaacgagctcacgaatcccagtttgctcccggagacgcgcaaaactcggctcgacaaacgggctcagccacgcaaaaggatcacatcacaattgcaatcgcaatcgcgcggaaatcaccttgaggagcgccgggtcgaagacgacgtgggcgcggttctggagcagggacacggcgacgcgccgcacgccgcggcgggccgagacggcgccctcgacggcgctcgtgcacgccgagcacgtcattccggtgacccgcacgtgcgcctcctcctcctcccccgccgccgccgcggcggcgccgccccccatctcctcgtcgtacgagtccagcagccggacgtcctccatctcgtcccctcccccacccgccgccgccggccggccgccgccggcgaccgccgagagctgcaggtgggccatgcctgtcagagagagagagagtagccgcgcgaggtgggaatatttggtggaagagagagaggagacgaaacgatggagaatggggcgaggcggattatataaacggagagggaaaaaaaagttaaagcgcagggggcaaagtggaattattttgcattttttaggaggttatttgtaaattatggattagtcaaatgctcgaaattgttatctgtgcgtttagctgggagaggcaaatttcgccatatgaactttcccgtttttgacttcttctcagatggttcgaagaaaatctctctgaccgggttttcgaattctgaactttttggtagtactagtattactacctccgtcccaaattaagtacagccataagtttccgtgcccaactttaatcgtccgtcttatttaaaatttttttataattagcatttttgttgttataagatgataaaacctgaatagtactttactcgtgactaatttttttaattttttttaaaattttttaaataagacgaatgattaaagttgagcgcgaaaaactatggttgcagttattttaggacagagagagtacatgatatcaccgtgttggggaagccaatgttacggtctactatagcgtaactgctttcgtaattgtagtaagttaatgcttggttatatgtgagcttttgttgtgattattttgttctgacatttttggcttagaatatagtaggggctttgtttggttgaaattagcatgatttgggataagttgagctaaaccaacatgccctttacaaagtccaaaacattaggttagcgacatttttgtttcgctctgacagtgaagctttgttcttacgctgctgtcgctgtgtttgcggatgcaggcactccactccactgctaaaaccaacgcccattctgccaaaatgtaacccccatcataaatttcataaacccatcgcaaaatgcacccaaatcatatcgaaattcaaaatgcaatcgaagcaaaaaaaaaaaatcaaacaaattcagagcgaccgcgcgaggagagaaggagacgagcggtttcgccgcgggaatccgcgtgccggtggccaggttccggagcacgtgttccgcgcggctaatcacggagtagtatgttacgactttaatcgggtgattagcgccttactaatcctatcttactataaagttatcccccaccaactccttaaacttaacatgcatgcaaagatgccacatcatcatccactaatccattaattaacaagatgccacatcatcatctactaacaatcatcacatttaaacatcatacaaacatgctatatctttatagtttttataatttaagagcttttcaaatataaacatgttaaattatcatccaatataattcacataatgtttcaatgtatatttttattatgttttatgatatatcctatatatttatatagttcatcctcacttaattagtgcttaaatgattaatctatggtccaaattatctttctccttttttcctctcattaaggcatatcacatcaattgtttttagcctttagatgattaatctacggtccaaactatctccctacttttcttattctataaagtcataccaccttactttttacgtttgaatcatcattctacatactatttaaatttaaattatcataaaccacattaatttatttaatctgatattatttagctatcttacacgttatttttttattgttatcatactaaattcccgcagcaatgcgcgggatttcacctagtcacctaataatcaaagatccccgtgggggcccacctgctgatcgataacggtcgctgtgacggtgggcccggggtggcctgggtcgtgattgggtgaggccgtccgtcggaggggtaggtgtgtgtaggtaggcttggctctgagtgtggggcccatccgacgtggcgtggtgtgtaagccaagacgacacgcatgcacaaatccggttcgtcgaggttgacccatcgcgttagacacatacaagcgggggcggctaacaccccccatcctttctttctcctcatcttcttctcttcctactacaccataaatttttaaaaaataaaaaacataagcttgaaaaaaattatatatagaaatactatatataaaaaaattaaatttaaatttaaatttaaaacaggtatgtaaacttttgacttataaactttgggtctataaactaatatttgaatttaaattcaaattttaatcgggtatataaacttttgacataaactttgggtctataaactttagatgtacaaaatactatatataaaaaatatttgaattcaaattcaaatttgaattggatataattcaaattcaaatttgaattgggtatgtaaacttttgacttataaattttgggtctataaattttaggtgtataaactttagatgtatagaaatattatatataaaaaatatttgaattcaaattcaaatttgaatcagatgtataaactttaggtctctaaactttagatgtgtaaacttaaggtgtacaaactttaggtgcgtaaatttactaaaataagaaagtaatgtggtgccaaaaaatgaaaccatatggaggaaaggggagcgcccaggggcgatcgatcgccccttagcatttccgcatacaagctggtgtgtgttagagcaaggctaataatacaatcgatatgttgtttataagtttttttttagccttctctatagggtccacttgtctctcttatagaatttttttggttcttgtgtccaagccggttgtaagtttacagtccgcttcttttctctctctcatctcttctatcatttgcctcggcatttag

SEQ ID NO: 45928 - DNA, 1951 bp, Oryza sativa
aagtgttcttcttgctcaaataggtgttgttgggattaaaattgcaaaattgtttggttactcatatgttcatagttgaagattgtttgtcatgtataattgcattacctcccatgtgttaactgcagagtagtatttttgacccctgtcctttcaaagtttaggtttggcttatgctttttagggtgtgttttaatcttgagcaagggaagttctatccttgctaagttaggagaggcatttggtacaaacaaaaaatcctagattttgagggcaagttaggcaataactgcctcaaaatccttgcccaccagggagagccaaatcagctctcctccagcggcaagcaatgatcgttggtagttttgcttgagcagccatgaaaccaaatgaactctcttgttgccataggctatatagcctaacctgactactttggcattgcttggctaggcaaaatattccagaaatccaaacgtgcccttagtaaactacaatgcttaaaactcaagtgctagtgattgaaccaatcctgttcttctgtagaaagcctcgagtcaattgaccaatctggatctagtctgaaatatttcgcatcattctagcactacttatgttcaagtatgggatctgcatatgtagaaggcaaagttatgagatgggaatttttcactgaatatccgtaatactgttccatgaatcactgttaatcaagatggtgtccggttcagagcttcctacctttgtattctgatttcaaagactaatatgctacactgtttggttagttcactcaataactggaatactctattgagaacactcctatactttcagtacattgaaaggcaaaatgtgtttcactatgttaccaattttgattatggctgaaataattatctgaaccttatggccatgcttggacatgtttattgataggcacttccctgacctgtgttgcttttgcaggatggtgttggaagcaaactaagtgatctaaaaatattctctgtggtaagttgcattgtactatgactatagctcatgactgtgtgcctaaatttctgcgcagcttcctccagttatctagatctctttttctttgttgccaacatgttttgctcttgtagccaacattccatttctactaccaaggtcggaagacaggtgaggtggttggtgctaatgcgacaaaacttgaatcaaccatggaaagtcttcacaagtaagaaattcaatttatattattcccttgttatctctgttgttaaatagatggacataaagaaaacctgaccaattaaatttaatcctgtcactacaaaacaagcaaaaccttggttgtgatgataagatatgcatacgagttcatacacttgtgtccatcacttactaagtgcccctggtattatgcttttgttgcacaggcaactatagaagttttgtggaagaatatgaccgggaggtggccagatgtctccatgtgccttccatcaacgtgtttgacattgatatttctgaaccttctggttgttttttatcatgctgaattcagtacattgcacctcttgtttatttagcacaactttgtatagtctgcatgtctaatatcagaatcaacgcaaacattctgttgggatgcagcaacccactaattttgttgggatagacgtgaaggaattctgggcctgtcagtccatccattgtttttctgggcctttgtcatagttcaaccattccagtgttgggctacaagtcccccagaattttttctcgccatcggcacaagttaatcatgaacctacgatgtttggcgtctcgaaagtgaaaaaaaataaattaaatgcttgagtttcacctgaatttctgagcaatctggtgcgttgcaccgtatactgtgatcgtgctctacccactaggccactatccagactatccatactccaaaggt

SEQ ID NO: 45929 - DNA, 20730 bp, Oryza sativa
gtttttattagcatgttttttaaatatgtttcatatgaaaattttctatataaaaattactttaaaatgaaataaatttatttttaatgtaataattaaatcttaattaatcatacgtcaattgttttttttcgtttgtccaactttattctccatccaccataatactacctccgtatcatattaagttattttttactcctacttatctcaaaataagtttatttctaagtaattaaattattgcatcagagtttgagtttatgaaagtatggaataattacattggaagtagataaagtaaaaaataataacttccggatttgataaagtaagagcattctaatgtttatattggtatgtgggggatgaataaaaaaaacaagctttagggtccctttgaatcgcaggaatggaaaaacacaggattctaacaggaatagaaatgcaaaacagaggattacaaaacacaggaaaaacacaagaatgacggtttgattgaaccgtggaaaaaacgcaagagtcggatgagagagatagactcaaagaaaagtttccaagagatcgatttgggcttttactaaatttcctccaaaatctctataggattgtccattctatagaaatttgaaaggataggattcaaagggcttcataggaaattttcatatagaattataatcttccaaaattactatgtttttcctctaaatcaaagaggtcctttaacggataagggtgtgttcgctggttgtacttggttcccaaccgaacccttcacacggaaaacagagcaatccattagcgcgtgattaattaagtattagctatttttttaaaaaaagtggattaatttgatttttttaagcaactttcgtatagaaacattttgtaaaaaacatactgtttagcagtttgaaaagcgtgcgcgcggaaaacgaaggagagggcccttttcccaaccaaaattgtgtctagtttacaccaaaattggaatttggttgaaattagaacgatatgatggaaaagttgaaagtttatatgggtagaaaagttttgatgtgatgaaaaagttagaagttcgaataaatattttgaaactaaacatggcgtaagcaaagatgcaaagcatccaatggcgcctgacacgcacagcgccttgtggcgggaacgcaggtgtagtagtggccaggtgcagtgcaggctacggtgtagtactacagtacatgcatatgcatgcacgcacgcaccggctgtggagattatggatatcccatatctacaaggcgacaatatttgggctgaatataggataccgaatatagatagaatatcttacttgtatctcgggtttgtttcttaacttgtacatcaaggaaacaccttgagacttagtcggtcacgactgtatttgatctgtatctatgtattccgttagggatatcgattatcttttgtaacccggactccttcccatatataaggagggtctgggcgcctctaggggcggatgttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaatgggttccgtctccggcatcgacgacctcgtcttcccgcccgggcagacgtttcggttcggcagcctcgacttcgtcaccaacaacttcggcaagatttctctcctcgactcggaatcagaccagtcgggagagaaccggatttcggtcccgtttggattcccgaacgcggctgaaagctacttcaagaccatctcaaccgagtcggcttcaaaccactcggccgagatcgcatcttctccaacgacaccagatcaagatgacggggcttacccaccagtcctgatgaagctccccgacgatttagcggccgtcttcaccacgacagcgtcttcatcccgtaggcctaggcggaagtcggcttcaacaccgatttcgcctagcttcagggaagtcggcgtcatcctccaaccactcggcacggtttcgacggatcaactggatgactacaacagctctcccaccgtcgactcacgtcctactgacatcgtggagtacgacgaatttagttctcgctacaacgacttcgacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggcgtgagcagcaggaccgtgagcggatcgcgaaggaggctgaggatcgacgtcagcgagctttggaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcaatccgaccacgtcgtcaacatcttgaaccagacgaagaccatgattgcggcttcggtcccagttaactccgaaagcgtccacacgccgactggcagccgagtcccccacttccgatctcatgactaccgtcatccaagcctcagcatcaccggcgcaggatccaatcgcaggagcaggggtcacgacgagcggtccattcactcacctcccgaccaatatagggagcgccgagtggaacggcctcgctcaccacctcgtcgccgccccatcgatcttcgcgacacaatcatacaacgccgagcagctcgaggctatcatccttcaccggaccgccacaacgacgaccttgatggagtagcagccttcaccgacgacctgcgtcgagtggattggccggccggcttcaagccgactggaatagagaagtacgacggtaccactaacccagaatcatggcttaccgtctacggtctcgcaatccgcgcagcaggaggagacaacaaggccatggcgaactatttaccagtggctttagcggattccgcccgatcttggctccatggactgccccgtggtacaattggatcttgggccgaactacgcgaccacttcatcgccaacttccaaggcaccttcgagcgtcccggcacacaatatgatctctacaacgtcattcagaagtccggagaatcccttcgagattacatccggcgattttctgaacaacgtaacaagatctccgacatcaccgacgacgtcatcatcgccgcgttcaccaaaggaattcgccacgaagaactagtcggcaagtttgggcgtaagcctcccaggacagtcaagcttatgtttgaaaaggccaacgagtacgccaaagctgaagacgccgtcaccgcatcaaagcagtcgggtcccagttggaagcaaaacaagggtacgccgactacgggaggaggtggaagtaacaatcataagtaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactgcacggaagaactatgacgaagaacaaagcacatcgaggaagaaggacgacggcgacaccccggcaggttttcaagatcaccgcaaggagctcaaccatatcttcggcggccccctggcttatgagtctaaacggaagcagaagttgactgaacgggagatcaatgctgttcagcccgacacgccccagtatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggacgatatgcagattcctcgctccgagctaaaaccaagcaatgcgccttttcacggagtaattccaggattatccgcaactccactcggccagatcaccctcccagtcacttttggcactcgggaaaacttccgcacagagaacatcagctttgaagtcgctgatttcgaaacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaactcgcgagatggcgtctgcccgagaggatatccgactggctgcagccacggcgagcgaaggagaagtgcccgctaccaagatttcaaagagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaaatcctgccctaaagatccttttgggttgcctcgcattgaccaggtagtcgactcgactgccggctgtgagcttctcagttttttggattgctactcggggtatcatcagatccgactgaaggaatccgactgcttgaagacttcattcatcacgccttttggggcatactgctacgtcaccatgccgtttggactaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaacctttgtgagcatccgtgctttcaggatgaaattgaaccctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctaactggatgcatggcggcgctcagccgatttgtttcacgacttggcgagcgggggatgcccttctttaagctgctgaagaaaacagataacttccagtggggacctgaagcacagaaggccttcgaagatttcaagaaactcctcaccgagccaccagtcttagcctcaccacacccgcaagagccgttgttgctgtatgtatcagccacatcccaggttgtgagcacagtcttggtcgttgagcgcgaggaagaaggccatgtccaaaaagtccagcgaccgatctattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgacatactacacaaccgcgaagcaaacggacgtattgctaagtgggctttggagttgatgtctttggacatatcattcaagccccgaatttcaatcaagtcccaagcgttagctgattttgtcgccgagtggaccgagtgccaggaggatacccctacggagaagatggagcactggaccatgcattttgacggatcaaaacgactttcgggcactggagcaggagtggttttgatttccccaactggtgaaagattaagctatgtgctttggatacatttttcagcgtcccacaacgttgccgagtatgaggcgctccttcatggactacggattgcaatttccctagggataaagcgtctgattgttcgaggcgattcacagttggttgtcaaccaagttatgaaagagtggtcctgcattgacgacaatatgatggcatatcgacaagaggtgcgcaaattggaagacaagttcgagggactcgagctcagtcacgttcttcgacacaacaatgaagccgccgacagacttgccaattttggatccaagcgcgagacggcgccctcagatgttttcgtcgaacacctttatacaccgaccgtacctcataaagatactgctcaagatgcggacattcatgacgtagctatggttgaagccgactggcgagagcccttcatacgatttttaacttctcaagagctccctcaagataaagatgaagccgagcggatttcaaggcggagcaaactttatgttatgcatgaatctgagttatacaagaaaagcccttcaggaattctgcaacgctgcgtatctttagaggaagggagacaattgctgaacgacatacattctgggatatgcggaaaccatgctgctgcacgcaccattgtcggcaaagcttaccggcagggttttttctggcctactgcagtgtccgacgccgacaaaattgtgcgcacatgtgaaggttgccaatttttcgccagacaaattcatctaccagctcaagagttgcagactatcccgctgtcttggccgtttgcggtttgggggctcgacatggttggcccgtttaaaaaggcagttggcggttacacgcatctctttgtggccattgacaaattctccaagtggattgaagctaaaccggttgtcacaatcacagcggataatgctcgagacttcttcatcaacattgtgcatagatttggagtgcccaatcggatcattaccgataatggcacacaattcaccggtggagtttttaaagacttttgtgaagactttggaattaagatttgctatgcctcagtggcacaccccatgagcaatggacaggtggagcgagccaatggcatgatacttcaagggattaaagcgcgtgtttttgaccggctaaaaccttatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagaacgctacgaagaggaccgagtggatgatttgcaccgattcgaagaagcccgcgaagcagctttgattcggtcggctcgatatttacaagggttgcggcgctatcataatcgcaatgttcgatctcgtgcctttttagtcggtgacctggttttgcgcaaaattcaaactacacgagatcggcacaagttatctcctctatgggaagggccatttattatctctgaagtcacccggccaggttcttatcgactcaagcgcgaagacggtactcttgtcgacaactcttggaacattgaacatcttcgtcgtttctacgcttaagtttatcattgtacttccctatcttgactgtcaatatcaagttttcttgactgtcaacatcaagttttcttcttgaagttgtcagtcgggggctatcatcataataatggagtgtgatttttttaatttgcttacttggtctatcattgccttgtttgattttttctacttagtctgcgaggactgaaagtttttaatagcttctttgggttttaggctcaacaaagcttgataaagcttttaagaaatcaaagacttggctagaactatcaagcacagcataaatacaccagtattgtacaaattgagcctccatttgttacattcatactcagtcagagtcagtcctttcgtcatcagagttattattactcggctgaagatcgttgttgcggaattgctctacaacatcacttgcaatcttggcagccgcactttgagcattactgataagatcaagagcagcttcttcacttgtcccgtctgcaaagccatcaatggtatcaatttcaatcctcgggtacaaggatttggtcatcgccaatgccatactagctcccatacttccagctttcttgatatttttgaagtatacatccggtgcactctcagcttgtcaaagatttcggttgcgtcaagtgcactcggaccactgttattaaggaacatagcttggacaagtggtgtagcgacattggcgacttcgtctcttgctccttcaagcttcttgatcttaccaaccaggacatcaaactgagcttgagatttgattttacggtctacaaaacacatttataataagagtctgctgcattaaagagaggaaagttcaaattgtcagttggcagtaccttcaacctccttcaaggctgagtccctttgcgcagctagttctactttgtctcttttcaaggcttcaatctgtttctccatttgagccatcctggtagcttgcgctgtttgaaatccaaatgtttgaggatacagctatgacagcataaattaatgggacagatctagaagattaccttttgatgaaccacttagctcgaagtttgaatcctggagctgggcaattcggtcccttaactccttctctgtctttttggcgtactccttggcctcatgcagctggtccctaactgcttcaagagttcccaaatgaggaaccagcttttccaaagttgtagtcttggcctcattgcgaagatggattctctgcatgatggatcatggttcagttctgctaaagagagaacaaagttattaaaggcagtcacccggaagatttacattcacaatgcgagtggcttctccaagtgctttcttcagctggcacacttcctcatcttctttttgacgatttatgacgatgccggcaacttgcgaattctcgtcccaccatttgagtaagataggaggacgggaatcatcagccgcctttatgcgaggaattgtttcttcgtcgtcgcctagtgttcctgatgtatttccaagacattagacgagtaagctgaagttatttaaatcggcatcacttgagaagatgtgttacctgaggatgttcctggctgaacatgagggatttcttcatcgggacctacatccgactggtttccagtcgggggctcttgtgttgttgcggtttcagctgttgccgactggtctccagttggcggctggtcactcggatcggctttgtcatccgaagcatgggcgccagtcggctgactttcggcagtcggctggctttcggcagtcggctggttttcggcagacggctcagcgtctttggataaatttggctctgtcacagccggatcaggatcttttccagttggatctatgtcggatggtttcctgcaaagtgtcctttcgatattcagcgtaatttctatgagagaagcatatcaaagggagatggtaccgagaagtttatacctggaagatgttctaatctttggcatttgacggccagccagttttttcctgggcatggtatgctttgggagtttgttgggcgtgcccttgtccccagatttgttgctgtcatcgccctcgtcgtcattaagcaccagctttctcttgcgaggacctgtctgcccagccggtttggaggtctgaggttgtgggtctgacctgattgtcggccctccacttccctgaatggtgtgctggcgaggagatcggcgctgagcaattgggggatcagatttcatcaatacatattcctgaataagatgcctccatggttagttaactcaacatgaagacaagatactattttggtcataagttgaagatttcagatacatacctgcggaggcggattgaatgcattatatggtacaactggcagctgatgtgagtagctgacgacaatagcatttgagaagattttatacattctctccttcatgattttgaaatccagagagtctggttcttcgcgattaggatcatgcttgccgtcaaactcaaaagctgtacgggatctttctttaattggcgccagtcggcatttgatgaaatgccgagtgatctgctctccttgcaagcctcgttctttgagttttaacatgcgatccaacaattccaaggcttgggcagcttcatctccgattggaagagagttccaagtatcttggtacaccgggggaagacaagagtattcgggaagagcaggctcaggattctgaacataaaaccagttcgcatgccatcctttgtttgaagtcttgaagggcattgagaagtatttctggctcagagttcccctcagctgaaatccggcccctccgactacacatggcttactcttgtttggttgaggtttgagaaagaagattcggcggaacagagcgaagtggggtttaattcctaagaaggcttcacagacatggatgaaattggcaatgtggactatggaatttgggtttaggtgatgcaagctcattccatagaagcttaatatcccacggaaaaatttcgaggtcggaagggcgaagccgccatagaagaaatgagagaagaccacaatctcgtgtgtatcgggggtcggaaaaatctcaccgcacgctggccgccacccgatgatctccttggcagggagaacgccgtgcgccaccatctccttcaggttctcttccgttacgtcagacggcgcccactggccttcaaagctttctttctcttccgccatcgattttccccgaatgcgctgatttgattcgagggatggcttgggagaggtgaggaattgaggcggtggatcacgggaaggattttgatgcactttttcgaaggtggatttgagtggagtggtgaaccctagttcgccagcgcagttctgcactgtagcaaggagtggggaaaatggcgagagttccggcggggaagacgaagcgtcgcttggatctcgggatttcttgttaagggtatcggaggtgcaaatgggcctaggcctgaacagtacttcagcccaatacttttaacagcgtggcccattgtgttccttagggacttaggcatattttgctttggcaatattatgcgcacaatagtgttgcccaatgctgataaaatcctttttatgcggtcatataattctttggaattattgcaatgcaaataagaggtgcccgacagaaaggtgttatactgctttttgttagctttattaggctacaaaagctgtctgggttaatttggaatgacttgtttttatcatagtcacttccttggtatgttatatacctattttcattatggtaaatagtcatagcctaggctattagacttattcattaccataatttttataatacttggtgggtaatctttagagttttatattcggatgcctgtccagtgtgttcattcgtgaaccttttagagtgttaaccactcggatttcttttattatggctaaaaagcagtcggcaagaatgcctctttaggcgccgcgtatgctattgtcatatgatgcatgattatgctattattttgttctcaactatatgattagtttgttaactaatcacatagttgggggctacacctaattaggtgcatctattcgatgcaccatattctttatcttttcgccctttacagtcttcgtcttcgctactcggtaggccttggcatgaaaagtttgaagcactcggattattatctttgggaaggctacgatggttgactgcaaaggtctcgggggctactgtggagattatggatatcccatatctacaaggcgacaatatttgggctgaatataggataccgaatatagatagaatatcttacttgtatctcgggtttgtttcttaacttgtacatcaaggaaacaccttgagacttagtcggtcacgactgtatttgatctgtatctatgtattccgttagggatatagattatcttttgtaacccggactccttcccatatataaggagggtctgggcgcctctaggggcggatgttgattttctctaaatcatacaatcaataatacactcggcggattcatccccggacaggagtagggtattacttcttttataagaaggcctgaacctgtataaatcctttgtctccaaacccatacacttttccagcttgatagccaccccctatcttgactgtcaacatcaagtttgactgtcaacactaactttttctttaaacaaacatctaattttgactgccaaacccatacacttttattattgccgaaatctagtttcgacaccggccatccatccatcatccagatccatggcgcctgcgcctgcgcacaccagcagacaacagtcactcaccagatcgacgagacggctgtcccccggtgaggttggcaacgccggtgcgtgtctcccgcccatgtggcagcctgcctcgctgcctctcctctcctcgcagctcagctcgatcgcgcgccggtggcggtggcgggggccgcgcttcacatggccgccgatgccgatgccgatgccgatgccgatggatcgtggacggatgcggcgcggcgctgtgtgtcgcctgaaaagcggagcctttttttagaggaaaggattggtggaaagtttcagtgatgagatgatagctagctacagtgtgagtgtgtggtggcgacacgacggacgacggtcgtccagacactcgagtgtggccgactggccggtgagggtgacgagtactctctctgccttgttggcagaatggcagtcctcttcttttgccagtctctcctctctcatctcacatcgccgagttcaggcttcagaggttcgctgcggccaaagtggccgtggccggatgggcaattcgggtggatgacgaccccgcagttatcttatgcattagcccttgtttagttactaactttttctttaaactttcaactttttttatcatattaaaacttttctacacacatatcgttttaatttcaaacaaacatctaattttggcgtgaactaaacacacccttagtttggttgaatgttgggatggatcaggctgaatctattttttatcgaaattgctatacgtccgacctataagtccgacccatccatccgactagtgtatgtataagcatatatgctatttgtttgggcccacatggtagtaaacaagttcagtgattggttgtatgactcggtcggacacaaatcgtatggctcagtcgtacgtatagcaagatttatttttaatagcgtttgattcgagaataactggaataggatgatcctgagaggaaatatttcccttcagatggtctggtccctaaaaaattgacggacgaatccaagaaatggaaatgagtctaacccatcccacctcatccccaaaccaaatatagaggacatgtttaatgagttactacttctattctaaaatataacaggttttagagtggtagtaggtgaaattaaatgagaaatgactgtgattggttgaaaaagcaagatatgtggagaatttgatggtcgaagattatgattggttgagaactcaataaaagtgaagaaatcgttatattttgaaacgaattttaaatgctgctaattttgtcccggaatattattttttggacacgattattaagaaaatatatagaattaaatggaatgagattgtgattggttgagaaatggaggtagttgaaaaaattgaatggtagaggggttatggttggttggaaagagaatctatgtttttggaaaaaaattaaagcccataagttattatattttaggacggaggagtagaagttgtagtatattttaggctctcatcggatggcctaatcagccaaagaaaaagccaaattttaaattttcaaacttaatttggagattgattttgagatattttcagcgtagtttcttttttatattggcttttaagtcaccaagaacacatatataaaagttttacctacaaatttatttttattccctaataagccgttttggcttgttagggaaaaagccaaccgatgaagaccttagaatggagggagtacctatcttcacttcttatatctcatttatattactttcataattttaaatttatcttatattaacataataataaacacaaagtaataaagaactcactaaatgtaagtagtttagatgtaattaaaatgctaagtaagcacaaagtatataaagatacgttggtatcttatactaacaaggtagctcgcgatctaactcgttaagcttactagttaaaacttaaaagcctaatttggctcgaacttactatatcgctacgactttacctttaaaccaatccgagctgattcgagtcatgagctttgagctctccttttcccactccttctatctcgaaagacctcatcttttccaatcttgtgttgttttgagtgaagtggcagccattattatcttcatcctaaattataaaaacctatataacaaaatgagatgtatatttgtactatgaatcggcttagattcacagtaatagaatatgttgctttcattcctttatttttatattttaggactgcgtacgcatggatctctaatctatgtgagctgtagtatgtaaaggtgtcacatgccactatgtagtctcatctcatgctacttgtggcatcgtctcatcctacttgcctaacgagataattctgttttggcctttccggtgcgaagatacaacaatgacagtcgtacatgagcactgcaaaatttagcttatgaaaaattttaaactgtttttacaaaagtaactttagataactaaattttacactaaaattttaatgccacaagataattccgtcccaaaatataaaaacttagaaccggatgtcccatccaggatgtcccatccagttctaaattattatattttaggacggatggagcagtaaatattaacttttatattttgggatggatgctaatattttagcttatatgtttcggcacatctgaaatgcgagattagacctatcaaatacaccggcgcatgtcatataagctcgaatcaaatttgaaatttgcatgttgtagctcttaaaaaaaagttgtactaacagccaatagctacagtagcaccatacaatttcagccatagccgctacagcagcagcactgcacaaccactgtgggcctgtttagttaaaaaaaacttttcccaaaaacatcgcatcaaatctttagacacatatatggagcattaaatatagataaaaggaaaaactaattgtatagtttgcatataaatcgcgagacaaatcttttgagcctaattaggccatgattagccacaagtgctacaataacccacatgtgctaatgacggattaattaggctcaaaaaattcgtttcgcggttttcaggcgagttatgaaattagtttttcattcgtgtccgaaaacctcttccaacatcctaccaaacgtctgatatgatacccaaaactttttatttcaccaactaaacagccacagtaattgagctgccgaacacaccctaagctgtaacactgcacgtcacaatccatctcgatggtaagagtcggtggttccgtacgcaatacagccagtcaacaactttgactaggcacaacgccctgtcactgacaccgtgggccccacaaactgtcctaacatgcgggagcgacgtcctcctcttggacctcttccatgagaccatctgacggcccaggaacaactccaaagaggtcggccgggccgggccccacttggcatgttcccccacttcaggccacggtggggcccatcgtacggacgataagggggcacgcgtcacatcctggatcgtcgcacaggtgcagcgcccgcgcctcacatggcggccacacggtgtccactgctgccacacatgggattgtttcgtaggcatgcaagccggacgggcatgtaggttttttttagcccgcttatctcatttttaatttattttttcttttaaattttatattattgtgtgagaaataaactagcaagcgagtttttatacaggtagtgagactacccacttgcatctctattgtttcatgaaatggatttcaaaaacaccaaccacactgaaattcttatgggtaaatagctaatttagtccctcaagtttcagctaaggctcaatttggttcttcacgtttcattttgtccacataggtccttcaaatatttgttttgacttgaaatcatccttgggtgcacttaatatgccatatggctatttctatcaatatttctattagaaaatgtcctttttacccttaatttgtatatatctatatactagaaaagagaaaggcaacatgaataaacaacattacagatatacttcccattatttcaacatgtgcacataaaacttaagcaattgctatcgtatacacttgttagtacataattttttttcgttttacataatatactatgtattatctataaaaaaattgaagcatgcaatttttctcttatagatgtgaatgatgagggtataaatgtcatttatgaagagagttgttggttcaaggataagtttgaactaaaatgaaaacttgaaggactaatatagatagattgaaacatcaaggactaaaccgagcatcagatgaaacttgaaggaccattttggctattcacccaaattctcactagcacacgaagattttttagcccatgtaaaacgagttaagccattattatataattaagtgagtataaatttttatagactttaaaaataaatttatttaaaattttagggcaacttacaaatataaagttttcacataaacctagttggttgggaaaaaccacccccatggtatttcactaagaagagcttaatcggagcctgaccaagaaagatcccaaaagctagtctcctcgtatatggggatatcactctctatgatttaggctttgacccatactttgaggcccagcgtcttacatgaggtcccgcccaccataggtcgattcatacatgtcgactaagggaaccaacgggtgatatagggtgctactaagttttttttttaaaaaaaagctgtttattgatttgaaaaacatgctaatgaaaatcgagatagaatgtgcatcttaattgaacgattatgttaattatgtaacctatcttaatcagaaattcgttgtgtggtataacctactgcaatactgctctcacgtaggtgattccatggtggatggacgaagcctaggccccggcaactgttcattgcgtttttccaagctgaaagtgagcacgcaagcatcttagcaacacagccgacgatatgatacatgggccgttcttggcgtaatctcaagattaagaaggcctttacctgtgggcttcatcactggacacatatatatatgtcctttgctgcaaattaagtttgggcttcatcagcggtgcgaaaacgtgacatgcatgttaataaattaattaattaattttttgttgcaccctattttttttagtaaatagtagtagtagtaggacagagatcttgggttatgatagggtaacagtttcagtcaaatcttctattactaacaaaaaattggttatatgtgagccgtggatatatatgcctgtaggcgtgtattggaaacagtcccctaaatgcactttgggcccctctgtgatcctcatcaaaacttggctagggacaacgacaaaggcagcatgcaatgcaatgcatgctctttaatttctctcgatgcatttccttcttctaaatgcaacacatgcacacatgctatttcacccacctatactatatatcctgatttgacaagaacagagttattgctcttgtcatatgcatagacatcagttagctgcaatcctgctaaacctcatcaaagctgaatatttaaaaagaaagagagaagaagaagcataaaaatcaaattcataaagcaataactacagatttatttttttcaaaggtagtaataaccaactttgatttatttttttttaggatttataactacagattttaagaatttgaatgaaaaatatgaattgtttggagagagttggagattagaaataaagttagagttcacaaaaccgatctttttttttcgcaaaaccgttcatacatcttctgtaaaaacattaattgtctgtttgtgaaaaccgatccgttttagctggttttcgtacatcgcttaccgaaggtcaccagttttatgttttcagtaaaccaatacgaagcggtttttatttcaaaaacgaaaagataaaccctgcagctgctaaaagctaccttgaaccaagcggatagtccaaccgcgaacgcacgcacatggataaaattccatgccttcttcaaccaccaatcctatcatggcatgctcttagctttgttcaggtgagagagaaagaaaccgttcacatggcacagggtttccataatattgcttgcacacacacacacaaacacacttgatggataagataaaccgatcgaatggcagcagctagcacagagtcatatatatgcaatgcaatgcatgtacatgggccaggatcagctattgaattgaatttctctcctcctctcttgacttgcacaccctgaattcataatatgatcaggttactggagcaagagttaaaaggcacatgcgaggccggaaatggacacccctagggctcgtgtaggcgtgccgaaaacgggctcgacgacaagggccgtcgtcaagacggctaacccctcctctcgcacttattgcccctactttgatccatccatcacatgtagcaagtacatgcaggccggggtagcactagtacatgccactagtggtagtagctatccactacaacatgtgctgcatttgcatttgcatttgcaatttgttttattttcagataatgacattttgatcgagatgttgtattgttttagctaccaatgctactcttgcattgatcgagtttcaggttagagagcatatatatatatggcctgaacctgaaccggcctgtcgtctgtatattggtgatggttttggagtgtatatatatgcagcaggtgatttgttgcgtagaatttgctagctcatggctggctaattaaccatgcattgcacttaccattttgtcaccggcggtgaggtccaagggcttgtacggccggcaaaatcattgggtcggcgagattgtcgatccgacgtacggcggcgtaggttggaaaggtgatttaccgacgctgtttacagtagcgtactacttcttcctccgttttacaatgtaagtcattctagtatttctcatatttatattaatgctaataaatctagatagatatatatgtctagattcattagcaccaatataaatgtgagaaatgttagaatgatttacattataaaatggagggagtagtatatgccaagttgattaggctgttgatgtgttgtgtctaccgaaatttatatttagcgcaggtccgtccatatctagagacacgtgtgagctgtgcaaccgtatagggctttcactccgtatgtatctagctattattcaaggcaatatgttccgatataattagaatctgtttattctattttctcaaatctctgtttttctccactcaatcggctagaacaagctgtttttttttttaattccgacaagcttcgatatagtaaccatgcatggctacagctttattttttcttttagtaagaaaaagctgaattgtttcaacggttcttcttctacttggtcagatcgtcatacatatttaggtgggtaattaagctacttgacatagcgctagtaattattggttgcgaataatttctgttcgtttgatagcaggatataattagctaattaaataaaggagcattatattgatactagctttcctggcatggttggaaggccactaactgcaatttaattatattgtaaatataagatatagcctattctattattctattactcccttcatcaaaaaaaaatcctaatattgagtttgaatcctgacacatatcgttaaaaaaaaccaatcctaaatttgaacctgaaaaaaaaactaattctagatttgaatctggacacatatatatccatccagatttaaactcaggattatttttttttttggacggagggggtatgtaattagtattactaaagataagacttttaatttttatatttgacacatggctttcaaattattaggacggccctaaacgatttacgccgccaccagcgtgcacaattgcacaaggccgcacatgcgaaataataccggaataatataatatagatctcacactctagcttagctaggacatgctaaaaattgcttaaggt

SEQ ID NO: 45930 - DNA, 10313 bp, Oryza sativa
tgtcaaatattttaaaacggagggagtagctagcaatccaaattatagtggtagtactactactcaacaaccaatgaaccaaatatgctccctagagaagttcactagcatgccaagaaatatgaaatgggatacagctgtaaaatttgaagcaacacaacgtactcctacgtaggctgtgtttagatggtgtaaaagttgaaaagtgggagaaaattagtagtttggagaaaaagttagtagtttatgtgcgtaggaaagttttcgatgtgatgtgatgtgatgaaaagttgggaatttgggaggaactaaacactgccgtagtactactctctccatctcaaaaatataaaaacttaaaaccggatgctacatttctatagtacaatgtatttggatggactcgatgttttctagtataatatatctttattcaaatatattgcactagaaaacgtttcatctgattcaaggtttttatatttttgggtaggagatagcagatggtacagagtgtactgcgccattgagatgaaaaaaaagctagaagcgttcgctaccggccaagaaactgtgaaaaaattgtaaaaaggagctttgaaattgctgcgagggtaaaaaagaattcgggccacataaaacaagaaaccaaaaggcagcagtacgtaccactgtttgtactgggctaaccggaaaggcagagatgctgtgtgagcagcgacgaacaccagcaacagctcgaatttcttctctcgttaccaaacttgtactactccggtagcagcagtaagtgctcgatcaggttgtgaagaggcagggaagaataatgccagaagctgtgtatgtgttgaagggaaaaaaaattgaaattaaggcttgacaagaatggggatttcagattgtaacgagtggtattgcagtttttgttactccctccatcccaaaatataagcatttttagttatgaatctagacaactatgtgttcaaattaatagctaaaagttattatattttgagatgactggaattcagcaacctaggaggtttattttcttcttgtctgtgctgtactactgtgttcaagaacacattaaaaagttagtagcatagatcaggaccacgctaatgctatggtagctgatgaaaaagatttgtgtgcattcgatcaggcactaatcatatcagtcttcaggcagccgtgcggctgttgcatgtgggaatgcctgctcctgttttatgtggtcaaaggtggaagaacaaatggcagtttttggataattaagatggttatttatggcaccgatgtccatcaagattagcagcagatatgtgaaattatcagtatcttcgtcaattttatgatgacagaaaaaaaggggtcgtcctcaaaaaaaataaaataaaaggaggggtataatgctcatcacttcatcagtgcaaacaacagcttaagttcacttcattatcatttttaaccctgctatttttttatattaccaattttggtaggatagcaaaataaacacattcttaccatatctaccttattagaatttggaagttctagaaaatctctcacaaaaacatgaccaaaatttaaaaagtttcaaactaaacgacatatcaaaagacaccaaaatttagtagcgacaaatgtactgaattttgaaagtgccaaatatttggttaattttgataataaagtgaacaagtattaaattacccaaaacaaaatgatgagtaaatttcacaaaactataaatatttttgtcaagttattaaaaaacctatagatttaagatgatatatcataaaactacagatttaacactaaatttatcccagaactacatatttaagttggagtatcccaaaactacaggtttagtaacaaaattatcacgaaactacatgtttagtgtcaatttaatcactaaatttggatattcataactcaaatataacattagtggtaaggaactaaagcttaaaatatgtagttttgtgataattttattattaaatttatagttttgcaatacttagccttaaagttacgatagatttgccgttaaatttatagttttgtgatatatccctagttttgttaaaatttaattaaaatatttatagttttatgaaatttacttaaaaatgatttatattctctcacgagtcgtgacatgaatcgcaggtggcaataacctcctcccttggcaaagcgaaacaacccttcgcagaaagcaccccataacgctgttattctaatcctgcccgactgcacacaaagttgtgagggacaaaaacggtcacgaaaatttccgctcggcctagcattgtttccgtacaaacggcactacaaaattccattttcttattagtactttttaaattagcaaagaatcaatttgcagagaccgatcattttccatgggagcaaggataattcagaaacacccctcaagttggttggatattgtcgagaaggtccccgacacttggaccgtgacgcccaattggtcctttgaccgccgaaccccatggtgtccccttgacgccattgccccacaccacaccaagctcctcctccttctccttcaccttctcccgctctatatataccctgccatggcttcctccattgctatccaccactaatccctcccaattctcctctcctcgcctctccaaactcgcatcgatctttaatttctgttctcacctgtacatacatacatacgcacgcacgtacatacactcaatcagagagagattgttggtagctaggtagctgtggccaagaaagtgagagaattgggaggaggattggaggaagacgaaggggttgatggggatgaggcctggatgggtaggggggctcgtggaggagagcttcttcgttgggtgtcccgcccacgagagccgcaagaagaacgagaagaacatcttctgcctcggctgctgcgccagcatctgcccccactgcgccccctcccaccgccaccaccctctcctccaggtaatcaatccgccgtcttcgtcgccggcgccggcgccggcgacccaattgccatgccatgcatgtcctcgatacactgcatatatctctagctacatgcatcatatgatgcatgtctatcttcttcgttaattaattgcagtatcttaactgtattcagaatttcagattatgcatgtgatgtgagagtgtgttagtctgttgaaattcttcaattacaagtttatttatctgctttgaaatcgttgggggtgtgctacagtgtgctgaattgagtggatttgtgggggtgtgggctaggattttagcttttgcatgtatagcagctactagcttgtacttaacaaaaaagcactagctttggcctaattcactagcctttccgtcttggcttattccaagatttgcttctactagtaccagtagatgtgggcagctagaggatcttgttgattcttccatgtgccatgacatgctaattgtgtcattttcagaggaaagattgctaattgcctctcatcagcgaccatgctagtgtgccactaggagtactagtagcagtagtatttctagcataatttggttagatttggttgggcttaattgcggcggtgcttgggcttaagctgcatcgcatggggtgtctcacttaaccacttgcagctatagctctcgacccttttagaaccctgtgcccatctttcgtcttccccttgtcgttttccggccttcgttttgtgctccttgcaaagtgacccctcggttaatcaccctgattagtcacctaaatcacacattagtactttcacactgctaatcaccaccttaatttcttgcgtatttttctttgccaaacttaatttttcttcctgtccttggctgctgtttggtgggccatgagtagtagaaatgtggagtggttaaaattgggaagaagggtgaaaaatgagtctctctctggcaagaagttactgcgagcctcagtcccatacgcctgaaataaccatagtcttataattaagcctagtcccatcttacatcttccccattccggtgtgcaaagcatatgcaatgcattgctctctcttctcttctgttcacctcaccacctgcaaaagttacattttgcagcagcagcagcagcagcaaaggccagcacacacagtcatcacctctgatgaaaaaaggccatctctctttttgacagcggtaaacaaacaatagcccttgtgtcctgctctccattataattaaccagtaaaaacttctgatcaccacataaaatgaaccacttctttttgtcaaacttttataaaatttgtgtgtttccagagagagtctggtgcaactacaaaagctctaattcttaaatacatccaaactgcagcagtgagcaagattgatctattagcacaaaaatgggttgggttatccggattgtttagccatgaatagcaaagcatgccgatcttgatctctatccctgcaaagatagacggtgccggttggttgataaatggatgggcaatcctgtgtctatctagccatactagctacgatccatccatcgtctcagccaaagccagagctgttaagatcgcagctgcagtagtcacagtgacagaaactacaggctacagaccacagagaagccattggcgagatgcagtaaaaaaaaaagtgagcagtgtctctgtttttttttttaccatatgtgtgcttggtaaaagaccctgtcctcctaccaaacaaggccccaatactgttgctccggctctgtataatccaaggtcgccgtgacgatactgttcattcgttcaggcagtaacacacactctctatcttttttttacagtgtcatggggttaatttggaggtgtttttttttttacatttgtgacctcgggttgtgtgaccgagagaagtggaaggtgtaggggtggtatggtaaattagggtttgtttctccctcccacgatgtggatgacgacgagccgccggtcaaaggctcgcaattattaccgggggagtctatcctttccctgcctggctcagcgtccggatggaataatggaatttttttttacctcatcaacaattacaacttctagaagggtctcatctaaaatttgaatttggatggaataatggaataatggcctatgcttatcagctaaaatttaaatttttaaccttaaatttagagctgattttgagagttttttcatcgaagtttatttttcaaactttacttttatattgtctaaaacacgtatataaaagttatattcacaaattactttttgtttgcaaacgatgggtccgaagattcttttactagcactagaattaaacggtaccgtacgtataagtatactgtgcattgaagtgcttatacgtgtatataggttaggaggtatgtgtacaacgacgttgttcgcctggatgatctcgacaagctcatcgactgctcctttgttcaggtaaattgaacggcaataaaaactctgaaactaatctgttcagttttactattatgtagagctaattattaatgttggttctaatttgatttcagccatacacgatcaacagcgcaaaggtgatatttctgaagccaaggcctcagtcgaggccgttcaagggctctggcaacatctgcttgacatgtgacaggatcctgcaggagcccttccatttctgctgcctctcttgcaaggtacagtagtgtagtatagccactgtacacatcttccagaaaatttttttactgtcatggcgaattggcgatcgattgagaaatattaattaacgacacacaactctaatgataataaggttgggtttagatctaggatgactagttttagcgtgtcacatcgtagatgtacggacatgtatctgaagtatcaaacgtagactaataacaaaacaaattataaattgtgcatgtaaactgcgagacgaatttattaagcctaattaatttgttattagcaaatgtttattgtagtaccacattgttggatcatggagcaattagtattaaaagatttgtctcataattttcacgtaatctgtgtaattagtttttttttctatatttaatactctgtgtatgtatcaaacatttgagttcgatgtgacgggtgaaaaattttgtcacgagagatgtgagagtgagctactaactacaacgactgtgtgtcgttaattaatttgtgcatgcattggcatgcaggtggatcacgtgatgatgcagggcggcgacctctccaacatcctctacatgtccggcggctcctccggcgagcccgacctcgccgccggcttcccgcgcttcgagaacctccgcgtcgacggcggcggcggcggcggcggcggcctctccgacgacgacgacgaccaccaggtgaccacacccaactccatcctcgaagaccccctccaccaccaccaccaccagtactacggcggcggcggctccagcaacaacggccggagcacgtcgccggcgccaacgacggccgatgtcccgaggaagaagaagagcggcggcggcggcgggttcttcccccagatcgtgctgtcactgaacaacaggaggaagggcgccccacacaggtcgcctctcgcgtgatcatcatcagatcgtcacgtacgcgtaaaccgtgtttcgatcgctagtacagataatcatgaacacctccccctactattatataattagttgctctcattacctatcttaattgtaatccccttatgattattagtagcattgtagagagagaaagagagtgtgtgtgtggttgtggtgatggatgatggtgtggcctttggctggctagggtcaccatctttagggcaagcagtgttttgacgagatttgagagaggagagaaccagctaagcttgcaaactcctccctgttacaagactaggtaggcacggactttgtgggggcccctgtgcagggaccccaaaagattggctaccaattttgtacttgctgtaatgggggttaattaggtttgctcgctacctatgtgtacacttcccaaaaactatatatatatatatatatatatatatatatatatatcttcttatatatgtaagatagtgagaattcttcatgtgtttattagcctcatttccttgcttattcacatggttatccatactatttattaacaaacaaaataatttgttttgtttctcggtaaaacttttatatacgtgttctcagctattgaaaaacacatgttataaaacactaaactgtaattaacttttttccataaatcaacttcaaaatttatcttgtaaacttgaaatttagctttataaacagataaatttgaattttagttttataaacataaacgaagctacgaggctatatactccttctgggcagataatacttgtcgttttagacaaaaagtgaggtcaaactttagaatctttgattatgaatcatttttaaaatatttgtctttcaaatattgtgatgtcgaggagtgatcctctctagcgggtggtcgtgagacctccctttgtgagttcggccgggggagatggcgcgatgatcaagagcgtacttccgcttgggatctaactactggatcgttcacgagtttgtgtggaagacaagggattatacaggttcgggccgctgggaagcgtaacaccctactcctgtgtgtgggattatggttaggtcttacaagagatcttgagctcctagggaaacctagctgttattcctctagagctcaagcaatcgagagtcgtcccttttctcgatgggcgaggttctccttttatagttcaaggggataccacatgcaccgtctatacctacccctcccatgggagggggacccaccctgtctggatcagaccgccattcatgccttcaaccaaaagcaaggtggtcgtgcgtccttgggtggggcccagcaccgtcccccgcctgacacgggggacatccctgtcattcccctttaaatgtatggagactttggtggctcaccacgcgcggagggcgctcctggcagtgcatcgataggacggggcatacctgcccccactccgcctgacacagggtgggacgtggggacgctaccgcccgtccaatcacccgtgaccggtcataaaccggtcacgcccgattgacatgggtctatcgggcggcgccgcacgtccacccacaccgcattaaatgcagtgaggaacggttggagtgccgcgcattaaaggccctaagaggcgccctctgcctcgcccgctctccccgccacgtggtggctggtcgagggcctcggggtagagcgtcccgaaagcccgaggggtgtgatgtggcaccccgaggctccctggccaccttagcgctatccgtggggcgtggggagacgaggccgcgtggttatgcgactagatgggatcgatactttcctttactgtgcatattcccgggcccatatcaccgacaggtgactacatgcatagattagtattagaaagtactttaataaaatcatatatttattaacaattatatacatattataataaaaaataatgattaaagttgttttttttaaatcatgtctttatccgaaacaacgggtattacaacctggagggaggaactatattttgttgcgatcaaggacaattaactggataaatgatcattggaaatagtgtgaaacgatggtagcgagagagggtttgggcattgaattaatctgcaaatggccatggtacttgcacgcatgtagctgtcgcctgtcggtcccgggccatgcatccaccaatggcagcttgtgcatgtcctttgaccggcatggacagccgacgatcgagctcgccacttgtgtgttgtgtgtcgcgttggagaaaatgttgcccctaggctgcttggagttggatggagctggagctagcggcggccgtgctttgcttgcctgttgccagtggttgccttgcatgggccaccgtaccttagctcgtgcctgccgccatgatcgattgatacgatccatatcgacctcgacctacgccgtggttagtttcaaaatatttttttaaacttccaacttttatattatatcaaaactttcatacacacataaacttccaactttttcatcacatcgttccaatttcaacaaaaattccaatctcggtgtgaactaaatacagccctacccgtgttcaaactatgtaaagacctgtttagttcgtaaataaaaaaaatttcaccctgtcacatctaatgtttgacatatgtatagagtattaagtatagaaaaaaaactaattacacagattgtgtgtaaattacgagacaaatattttaagcctaattgctccatgatttgataatgtggtgctacagtaaagatttgctaatgacggattaattaggcttaataaattcatctcgcagtttacagacggaatctgtaaattgttctgttattagtctacgtttaatactttgaatgtgtgtttgtatatccgatctgactctttgaaacttttcgtctcgtgaactaaacggggcctaaaagtttttagggaagaaaagtccgctctttgtaccaagaactgttacttttgaaaaagtctgttttttttttcttttgaataagagggtagaaggacagtctcctttcattaacaaagaagaaggtttagttttgtgcaagtgttaaggggtgttacataggggactattctcacaacaacattagctctttaagcttttttttttttttttgccctcactaggcaccaagctctggcctcctcttttgtttatgctacaataattatggggaaaattgtaaccataccattatattttgcaaaatttaagatataccatcctaatccatatgtcattgactcatgtgggtcatatgtgtctttgagataccaatgacatatttcaaactttgaaaatttataatgacatggttccaaattacccataattatgatcggtgttgtggtgatgtgctggaagactcacgtatttctctctttccaaacttccgaggtgattaggaggatgagtgagcggagtctgcggtttaggtgctcctgttgcacgggctagtgttgtccacatgtttgaaccgtgtccatgatgtcccaatgctccaatgggacagttttatgtatggtcaatttttactacagaacatttgataattccgattgtctatgtcgtgatcttaacatttttgtgataattcagtagaaaaagaatt

SEQ ID NO: 45931 - DNA, 4041 bp, Oryza sativa
taggtagaacaacaactgtgaattaaaaaaaatgttcatcaaatggtttgtttgattttcggcgttagccctactaaaaatactcaatctaatactgaatataacatatgctaacagcctaacactatactatcaatatgaatagagagatatcgagattcaacatctatactagattagtttgtttacgagaaagtgaccctcgtttagtgtgcattcatatgaaatgtcgttttacacatatctctgccattttctgaacaaacatatactccatatatttcaaaatataagtatttttagctataaatatagataactatatgtccagattcataacaaaaaaattattatattttaggacagatgtattagtatacttctaccaacctacaacctcgtctgattatggataggcgtccatgatgactctcggttacgttggcaatcgtagtgtcatgtcttgtcgattttactcccttcattccattttaaatatagtaatgagtttttttacctttaactgttcatcttatttaaaatattttcatgatcaatatttttattgttatttgatgataaaatataaatattattttatatgtgacttttttaaaatatatttttataaatttttcaaataagatagatgattaaatattagacacaacctacaactgtatttaaaataggactggggtattattggagaagttgttacgtgctgctctctcccatgtcttgtcacgcttaaactggctttgtttccgtgctgtcttgtttagaactctgtgttagcacatggcctattctcatttatcaattaagtttggctatgcaagaacatggaaaaggacctataaaatagaaaccgtgctgaataaacagtggcctaatgaacatcttatcaacaggattgttagttcccatgattagtgaaaggggaccaaaacgtgatcttgcttgttaagaacgacgatgcatgggaccaaaagggacacaaggtccccgttttgtggcacgggaattttcagaccaggtggcatgttaagagcaagcctaagctgacctgttggctataagattctttgtagctttctctcagcctatccatataatagttagctctttataattaatacagggcccacttaactctctcacagagtttcttggttcttgtgtccaagctggctataattttatagcacgcttcttctctctcctctcttctctcctccacctcagcatttagccggcttatagtctactattatacttgctctaagggtcccgtatagaaacaagagaattattctaaattatcgtttgacttcagattactatttaaaatcgaaatagtttaagctagtgttggtttaattgaaactagtaccatgccttggagattccagcctactactacaacatttgtgttatgcaacaaattatttattggttgagctatgggttataaacctaaaaaagtaatgaagcaacaaaaaaaatgacggtaagacttttaacttcgacactttttttaacttctaattagttatccaaaaatcaaggctacaaaatatagagaaaaagctctgagtcaattctaaaatttaaatttttatgtggcttgttgtaaaatgaatgggtgaataaaacacttcatcaaattattgccatagattatttccagcatcacatgtttaaaaataagttttgttaacaaattttcttcggctgcattacttagaccacgtgctagaagttatttgttgaatctatttttaaaattatttttattattataatcaagtaaataattctaatcaataatttagttaatgatatttttttaagacatgtcttaacttaaatcatagctattaacatgaataagcattatccagattcgtacttaggatttaattctttttaggttaaagggtatgctatattgtatacctatctagattatcagaatatattgtttttttttacatgggaccaagggagtacttgaatggagggacgggagagcttctacgaccgtatcgtctattttaatgtgcaccgtacaccatatctgccattgttcttggtgttttgcgtggaacccatgtgccgtttgcagctactcctctgatgattagtggacaaagaaagacactcacgccgtccttgccacaagaaagcaagatcaatgcatgcatggcctatgaatctggcagggagaaatggaacagttcattctgaatcgctttggaattcacatgcatgtcctgaaaactgtcaacgaaacatttgtgctctccaaactctgaaatcatgctacaatcaatcagctgtgtttgccagaagaaaccagatctgcagaaattaagcctcatgagtactaattaatttgcatcgtcagatgctttcagcttcgacaaatcactttgctttagagagtgagagtacaaagaagaggccacaggccagccggtctcttggctcttgcagttgcaggctttgttggtagcggcaggcagagaggagtggcacaaacctgaagtcctgaacttggcatctagagactgttgctacggctcatccatgcttcctctcatctcgccgcaactctaacgaaactgacctgctgatcgtgacgagctatagctaagccctgcaactgtagatctcgctaccgtggcaagcagagctgacatgacacggcatgaaacgacgccctgtttactgctgctacagagctagccttgtctgacgatgatcagatcagtgatggaagagaagagccactctgaacccgatcgatcgcaggaaaaagagggcatcatttgtgcaaattactccagcaatcgtatacaagtacttcttgtttgctagggcacagggcacagggcacaggcagctgcatgcagttgtacaaaacgctgcatggaatggaactgcagggaaacgccaaaaacggggttatggggataactgaacagggccctccatatgctctttgtcatgctgctctgtccgaggaaagctgcaccatgcgatgctcctcctcctcctgtaggcggaaatgtattatggttttctagttgtcgttttggattttgttatggtctctactaaggttacctttttgtcttctttttggaatagtatgcaatattactatgccataatactaatcttagtagcaaactttttcttcaaactttcaacttctcaatcacaccaaaatttttctacacgtaaacttccaaattttatgtcacatcgttccaatttcaaccaaaccaattttcatatgaactaaacacagccaacataaagcaataaaaatctaggcccagtgagcttacattatataacttttggctgagtttatttctaaactttttctttaaacttctaactttttcatcacatcaaaactttcctacacacataaactttcaactttttcatcacatcttttcaatttcaactaaacttctaattttggtgtcaacacacactgtttgattcaattttggcagcagtggagcggattccttgtacggatatcaaataccagtatgaagataacggcgaccagagtgacggattgacgagacaacacattgcatggtgtttgaactggatcatcttcgcttcacacttagggccagtttagttctcaaaaattttccccttcacctatcacatcgaatctttggacatatgcatggagcattaaatgtggacaaaaagaaaaaccaattgcacagtttagctataaatcgcgagacgaatcttttgagactaattaggccatgattagccataagtgctacagtaacccacatgtgctaatgacggcttaagtaggctcaaaagattcgtctcgcggtttccaggcgagttctgaaattagttttttcattcgtgtccgaaaaccccttccgacatccggtcaaacgtctgatgtgacacccaaaaatttccttttccccaactaaacacagccttaacaccagcacaacgtatgtgatccatgtg

SEQ ID NO: 45932 - DNA, 2137 bp, Oryza sativa
ccacagctagctagcggcgctcgtacgtgaaaaccaccgtggtccccaatcaccaacccccgcaccggtgtagcacgcgcgcgccatctccccccatcgcggctgcatgcgcgtcgcgatccgggaggagaggaaaatttctaccgttttttcctgtgggagaagccgtttttggcacgaggccgcatgcagttgtgttggggttatccaaccaaaccgcgggggcggtgtggtggaccacggaagatggcgtgcgtacgtacgtacgtgcggcgcgggcgtacaggcgtacagggcgccgcgcgacgcatggatggatggatggatggatggatggatcgatggtcccgggcggcacaggcaggggctcccccgaccgggcaacccgtgaagaacttcgtcaacttgactgcaacggtgaccacacgcacgcacgcacgcacggccacatccgctccctgttgctctcagtgcagagtgcacagacagacttgtcagccgattatatttctgctgaaccatacggcgtacgtatctacttgcatagttgcattacatgaacaatattcgtacatgtgtatgcaagcttgattaatttggagttactgcccgtgatcatcgttctccatgcatggcccagcaacatgtactacgagctgctgatatatgtatggccactttaattaatttgcgcatgcgaacgatatataaatcgagcccacaatcaccttacgatcaacattgctccacgtttttgttctgttctctgatcggtcgtccgtcccgggtcattgggggctacattttgacggctttttacagcgcgcagttgcccgccatgtactgttgtttcgtccatggacggcacgtctggttaattattgctgcatgcggttcagttcactgtcacacgtgtgaatctatagggggtatttagtactccctccatgctcgtaaagaaagtcgtttagaacagcgacacggtctccaaaacacaactttgactttttgtttttataaaaatatttattgaaaagtgatatatgtatacttttatgaaagtatttttcaaaacaaatctatacatataacttttatattttcaaactcaacaacttgagagttattcatgacttatattcttaaggtttgacttaaacatttttataaatgacttcctttataagtacggagggagtacgtcgtgcacatggttgtcatatgttaatttgcaacgacaaattaaggcaccaacacgttatatatgctccaatgcaattactcctcatgttttatctcatttatactgagataattaaccaatataggcttaaggtagttaaggaataatattgacaacaaaagcgctgaaaattactgtattacactagaatctcactcaccgttcggtcatacgcgtgtagataaccaactgtacaacacattttcataggagtttttaaaataaaggtacatgaaaccaaaacctatatattccttgcatataattaggaacaatgaagtttttcttacttatagtatgccaaaagaaaaggagcatataataaagtacattgagaaggcatatgataaagtacattgggacttcctgtttgatgtactttagaggaaagacttctgtgaaaagtggattggctggatgaaagatgctacaactaagggtagggtggctatcaatataaatggagaagtggagaaatttttcaggactcacaaaggtgttcgacaaggggatcccctgtctcctttaatgtttaacttggtggcagatgctctttctgagatgctaaataaagctaaagagggtggtcacttacaagggttagtcccacatctggtcactggagggctgacacacctgcaatatgcagatgacactatacttttcatgacaaacatagaggagaacataataactgtcaaatttctcttatactgttatgaagctatgtcaggacttaagataaatttccaaaagagtgaagtaattgtgattggagcagaggaacaggaagcacagagagtgtggctgatctcttcaactgcaaaagaggggagttacctattttttacctaggccttcctgttagtgaggggagactgacagcaaaagatt

SEQ ID NO: 45933 - DNA, 2628 bp, Oryza sativa
ggaggttcctttaaaaatcatgttcccatacatttatagcatcagtgctgatccagggatgacggttaagcaagtgtataaagaaggcactgggaaattaatctacgaaggacccttaacccaagaggaggtggctgaatggacagatctgcaagcaaagcttgctactatccaattatcgacagaaagagatttgatgctttggaagctagaaaagtcaggaaagttcactacaaagtccttatatagagagatggtttttgggggcattaaagatgctcagcttcagattttgtggaagtcaccgatgcctataaaaataaaaaattttatgtggttaatgattaaggggagaatccaagttgctaaacaactgaaaaaaatgaagtggcctggcagccccttatgcaagctgtgtggagtagaggaagatgtggatcacttgatgttcagatgcccaccaactcagtttctctggtgttgttttagagatgcctttgggtgggatagaattcctactgacagaagtaaaatgctcgatatcattcaacatcagaggggggtagataacaaaactttgtgggtatatgttgctgctggaatctgggcaatttggctaattagaaatgactgggtgtttaataatcgtctaatgaaagatattatgactttgcctcacagagctctatcttttgcaattcagtggaggaagatggctccagcaaaactaaggggagaattggagacggcacaaagctcactgcttgccagtatcctcgcgctcggagacaacaacagatgatgatgatgtcaacatgaggtcttattggcttgtttggctgtgtcaatagcaagggctcatcgtttgttttgtttctatgttatttttgtaaagctggaaaccccagcattttgcatctgtgaaggatggctacaacaaagactatggggagtaaatggagacagcacaatttgatcagctaggcttaggcaaaaatagaagatttggcgtcctgatcttaaagctgcttcctctatggacttgttttctttgctttatctctggcttgtttggctgtgccagcagcattagtcctccttttattttgaactgtgttgcttcttgtaaagctggaaaccctagcattctgtactctctgttatgctttatgaaaagctgggcgtctgccttttctctaaaaagaaaaggagcatatgctaccaagctggtgaggcggcaaaccgaattgtcttgtgcaccatgaataatcgacaaaaaaatattgatcaataacctgagctcctcattgcctaagacccaataacgtacatagttagctccatcactgctacggctaatgagaactgatcgagccaacttttttttatgagtaaagtgtatttgcggttcttaaacttgtagggttttctcatataggtccctaaactctcaaaatatatatcccggtcccagaatttgtcaaagtgtatcatttagatcccaaatcgacacatcccctctagtatcctacgtggcgctgatgtgacatgccacatggatgtgacgtgccattttcttttttttttcttcttttctttttcttcgttttcttctcattctttcttttttcctttcttctgcttgggtcacagagaaaggagaagaaagggaaaaaaagagaagaaaaaaagaaaaaggaattttttttaacaggacctatttgtcagttaaaatgatgccacgttattccgtgtggcatgacacgtcaacgccacgtaggatcctgaaggggttgtgacgatttaggacttatatgacatactatgagaagttctgggacttggatattcattttaagagtttagggacctagatgacacattaattaatacaagtttaagtaccgcacgtacacttttttttttcattagctacaccccccccccaaattttctcaagagaatcggtaattacataagtctatcataggtcttgtaggagattctcacaaacttccgtacttcggcaagagctctctcaccaaggtctctctcttttcaaacctgtctacagtcccttccaattagttattacaactaacataccactattatatgaatgagagataacagctagataacagtgttggagccagctagtaggctcgtcaggatgattgtcaacataaacactgacacgcgttatgatgactgacagaaaaattgtagataacaagttataattcttcattgtctaggttctatcacaacgctagctttactaatactgctactcatgtagcggtgagatttccgaatgtaagaaaaaccatccggttgtgtcgtggtttttgccactcttggaggaacagatgtaacgagcaatgactgtaataacaaatcactacgtactaccaactcggagcaagaaaaaccgcttggttgcgtcgtggtttttgctactctcggaggggcagcggtaacgagcaatggcagtaacaatccaccgctactatactcgcagcatataaagcaccgctccctccttttctttccccaatgattgatgtgttgcaagagcaaaactcgctgcatatgcccttgtcctgaaacctgcggaatctatca

SEQ ID NO: 45934 - DNA, 3441 bp, Oryza sativa
ttcgtcttattcaaaaatttaagtaattatttattcttttcctatcatttgatttattgttaaatatacttttatgtacacatatagttttacacatttcacaaattttttgaataagacgaacggtcaaacatgtttaaaaaagtcaacggcgtcaaatattcaaggaaggaggtagtatatagtattaaatatagataaaaaactaattatacagtttgcatgtaaatcgggagacgtatcttttaaatctaattatccatgattagttataagtgctacagtacagtgaatggtgaatggtgaatggtgtggcctgtacggggaacaggacgcatcagttcggcgcaggtaaaaaactgcaagctgatcaatgtgacttgtgctccatctacctgcccttaattaccgcggctttgacagactcaagaacgaaagagacggctcaaattcttgtggtttttgcagtcgccaggccaccgtacgtgcatcatcttgctgtacacagatcgggaacaagaggtcaaacaaatacggagtatattttactgctcgaatcgatcgaatctgggacggatttttttagcaattgaacacaaacgcgacgaacgagtatacatgctgatgtagtcatgtttgacgatagtgatttcgatccggctgcgaataaagaggtcttaatctgtttgttagtactccttctttaatctgcaatttgtttatctgtttgtgtctgcctccctatcactcattcactcccttgaaaaaaaaaacaagttttgtttgctctaaatatctactaactatacgtatacgacagtgttgtcaacatcaaatcgttcatagtaactggacatcagataatatcaactggggctcattatgttgtcatgaagaagcttcagtgctaagcctagagttgttggttaggctgcttgaccaagtctgtgagtcaatagctttcaaaatctcccaactaaaggattagacttcagaggttctctcttatcttaaacttttagtcgtactttattatatacaaatccgaactaacaattgcatgctgatggtaattataaattggtttctctgagaggtcattaatggtaaaatactccggtgggaggcgaccaagtgtgtcggtttcagacagaaaccatgttctattagtcactgtagtctgtccaggaggcatacagaagcagcttcagcttccggcttgtcaattggtcaagaccatgcaccaaattaagctgaaacttcgagtctatcgagggtgtgttttgttcatgctaaaattagaagtttgattgaaattagaacgatatgacagaaaagttgaaaaatttatgtgtgtagaaaatttttgatgtgatagaaaagttgaaagtttgaagaaaaattttgtaactaaactcggcctgatcccagtaaggtagcaaatcctgatttttcatttgctacgtacgacggcgatactgttctgaggacagtagacaaagccctatttcatatgacaaaacaataataaaccaaattaagcattcacatttactttttttttatataaataaggcaattttcactaccggcttggcactgttcgcttcacctggaaggctgagctgatcggtgaaaaaaacacaacgtttcattagcgaatgaataattaaatacggagtattagctattataaaaaagaaaaatgggtttatttgattttttaaatacatttatatacgcaaagttttttttttaaaaaaacatcgttgcagttcgagaaatatgcttatcataaagttcacccaataacctaaatcagatgcgtcttagaagaacagtaatgataggggacgggagtcgaatgggatgggcccaactcctaacaacacgagagcaaggtgggccccttcaccgggtgtcctgcttctgtataaaaaaaaccatcaatagctcaacactatatatgctcgtgtagtttgttgatgaaatccgtttcacttctgcgaaggacatgagaatcggtcatggatgctagtgacaagctccaaagctatgttggtggactccaccgttgatgatggccggcgtcttcacaagaaggccatccaggatagaggatactatggcggccatccaggatagaggatactatggccgtgtttagttgttttggcaaaaacaaatttaatgtatacgggcacacatttaaattattaaacgtaaactaataacaaaacaaattacagactccgcctgtaaactacgagacaaatcgaagcctaattagtccgttattagcaaatgtttactgtagcactacattatcaaatcatggcgtaattaggctcaaaagattcgtctcgcaatttacattcaaactgtgcagttggttttttcgtccacatttaatgctccatgcatgtgtccaaacatttgatgtgactgttgatgcgaaaaacacacactggcctaggagatctgcttaactccagtgcaggtccaaaggttactgagatgtaggcgtgccagtcagtttgaccctacaactgacaagatatgcaaatagtagatcaataagccgatcggctgacaagccgatgttgtagttccagccgatgccgataccagccgatagccgatgctagccgatagcgatagggttctgagctatcggctttatgtccaatgtatagtctgacacttgtctttaataatgatatacaggcaatcgactgatgataatatagtataacaataatataatccagtataaaccaatcggctagcaatacaatatgatagaataagcattgatccgaaggttaaagcataaatcagctaaaggtccgatgtcataaaatccaaacaattagataaatcaatgaaacctttattgtcatcgactaaatccaacttatatgtatatgcaaatccttataagccgatgcaacgtccagataatttatcagctagcaccccgataaaacactagcatgaacctatcggcttaacaagattcatattatcaataacaatctagtaggttgaacctaaccgatgcagcacgagattgtatatgataatctaatactcgatgagccgatagatctatctaatgtgatggatatgacaaatctatttagaacaacattgtgattgtagagatatatcggctaagacagaagatcggacctaaccgagacagttccaactaaaccgatgcgtctctaaacacaatgtaattagagatagaattgagatatcaggtaggcaaatatatcaaccaaaccagagcgatccaagagatcgaagcgatgcagccttgaacaacaccaatgtagccaacaaattcactagggccagtggaacgtaggacttacccctttgccggagatcgaaagccgatgcagccccgcgttaggtgccaagttccgtcgg

SEQ ID NO: 45935 - DNA, 10711 bp, Oryza sativa
  unsure (1)..(10711): unsure at all n locations
ttcttttttctccaccacgacagcccctcccctcatgccgcatgtcaccgccgagaaaaaagaaggaagaaagagaaaaaagaaggaagaaaaaataaaaaaaatccatgtcatcgtccatgtggcgtgccacataggtaagaccacggtcaaatgcggctttggaccaggatgatacaataaaccaagtttagagagctcgatgtgcgttttgcaagttcgtgtacctaagtgaaatctcctgacaagtttaaggaccgctggtgcatatatctgacgctgttgactttttgaacatgtttaacgtcttattaaaaaataaataattattaattattttcctatcatttgatttattgttaaatatacttttatgtatacatatagttttacatatttcacaaaaaatttttgaataagacgaacagtcaaacatgtgctaaaaagtcaacggtatttaatatttagaaacgaaggaagtactatcatacggtcaaactagaactagtcttatacatgtaaacataatacacccctagtagtagtaaatactagaagtaggaagttgaaacctcatgctcactagtagtagttcacagcaataataacatgaaaaagaagaaggaaaacaaaatcagaaagagtcaatagcttgactgactcgagttatatacgtgtcaccccacacatcacggacccgtctgcgttctaggatgtgggccccacacaacgcctctccaggtacaaatgtggacgaatcagcgggggtgcatcaaatttgcaagaaacacccatgtgtcaaaatacagtgaacccagctaggcacgaattaattctagctcctaatacgcactagtagctaggataatctagttaggccctatgaagaattaccaccacttcacatatttttttgaaatgccgcagcgcgcttcaccaccgccgccgccggtgctccaaccgacggtgcccacgcttctccgccggtcgcaggtttgggcgcccatttccgccgtctcttggccgcagtccgcccctcccctgagccgcagcatgggctccccctcccctagtaagttctggcaggccacgccaccacccccgccgccctccatggtcgccggatagtgtcacccacgtctccgcgactccagctcgctccacctggtcaccgaccagcgtcacccttgcctttgcaactccaactcgcccacgctcgtttgctgaggtcgtcctctcccccgccagagtcaacgcaagctcgcctcccgcccaaccaccgccgcgggcaaaattgaagtctacatttactatgccgtcgcctcgacgcgatgcctaccgccgcgcctatgagatggaagaaagaaggagctcccctcctaggtatacgacactgcacagagcattcacaccccctgagccgggatggacagtggtgagatcctgtcgcaggcggagagggggagaacattcaagtcccgaccaccggcccgattcatggcgacaaggccgcggtactggcaggagagtggctctctcgctggaggaattcaaggcaagaaccaggggtcgcagctttgtgtgcctcgctcgcgaccaccgtgcctcggtgtgccaagacccgcctcgttgcttcgtgtgcaaccgctctagccatagagcgcgctactgcaattttcgccccccggtctgcccctcccccaaaccaactcgcccaccgcccagcaagaacagagcccggtcgcccttgcctcctctcctccgccatcctcctccaaccacacttcgccgccgatgctctccaccaacaccccgtgattccaccccttcttcgcctccgctgcctctgcttcaccggcgtcaagtaccagagatccttctgccgccgccgccttcgggcatcatggcgcagctgggtgaccccgagacaaggcctttagaagacatcgtcttcatcccgacgtcccacgccatcgacgcggagctgcgggaataggagagcacggcggccatcacctgggcgatgcgcgccccgccgtctgtcaccgccaaggatgtggagcgtgtcctcgctgatgagttcggcctgcgttctggggagattgcgatgtcactgcatttccgggaggccttcctcctcaagttcaaacatcaccggcactgtgaagaagctgtgaagaaaggttttgctaagggccaagggatagaagtccatttcatccaatggcgaagcctgaagaacgccgctggttctgccctcatgtacagagtgaagctctgtctcgatggcgtgccaatgcacctgtgggcgccggacatcgccgagcgcatcatcagcaggacctgcactctggagtcagtggagacggacctcgtccaccctgtggacgctggcgacacgagggtgatctccctatgggcttggatgccaaacccgagccgcatcgacaagcgcgtgtgggtgacaatcacgcgtcaaacccgtgaccccctacttgagtcagtcaccatctcggagacgccaccggagcactggcagcaaggcgtcaagcacccggtgttgttccatattgaagagattcacgactacacggcggcggcggtggacctccgcaatccgaagtcatgcaggctagcgacacgtacgctccctccgtggcatctgggcgttcttgatggacaacgggctccgccgtgcctcttcgagaacttccctcaccaccccccaacgccgacgacctatgctttccgccaggggcgggcggagggcgtagaggacaatgccggtctcgcgagggagccacacgaccaaggaagcaggacggcaagggaagctgccgccagggatggcggatggcgtcagcacgacggggatcgtgataggcgtcgagaggaccatgatggacgccgtgatgaccgggatgtgcggcgcaacgctgacagacgccgggaacgcaggggaagatacaacaatgaccaccccggcgccggtcacggccctgggtggcggcgagatgatgatgacgatgaggagcgcggccatggccgtgacgttgcgcaaggacgcggcgggctgcgggagcctgatgttcacttccgacgggagcgcacgcgttcgccaagagctcgtgaccgtggcggcaatgatcggcgtgatgggcgccgtagacaggacgacatctgcgaggagcctggcgatctcgggggtggcgaccgcgacaacgacatctctcctggccttgccatggcgggggaattccagccaccaagatcgctctcccctctgcctctgctccgtgggttcgggaatgaagcccggtccgctggttggggagctacaatcccgcggcgagggtcttctcgcgcatacaagaggccatctcagtggcctctgcggaaggggccctatgccagctcgtcctggcggctgggttgcgattgccattgacaagctgtcagcgccagcaaccattgttgcgccagggggtgtcgtcactccttttgctgctgccagccccgtggcgccgacggacaccctcgctcttgatgatcctgcaaatgccgagcaagctgaaccagcgcgacaggctgctgcaaatgacccggtcgacgatctgcaagcaacactggggcccactgtgcaacctgaggcggcgatacacacgccgatgctctctacctcggcagtcgacttccctcaggtacctccggcgatgccatgtgtcctcttcaaatctccacacccctcaatccttccctcgccaccgttgcagtgtgccgacgtgaacctgcagacgccgcctccacccatgccacgacaggacaggcacaggagttcaagactagcccagcaaccaacggtcggcctgccgtcggggttgaaggcacagctgaacctgtgccgccgaatggggttgacgccggaggaaggaactctcaccgacaaagtagtggctgacttcaaagccatgttcaacgcaccactgccgcaagacaccatcgatgccctcgagcagctgttcggtctgaatagggaggatgcaaaggcggcggacgcggtgctcgcgaagtacctggggccgacggacgcctgctatagggaggaactggcggcggcgacatgatctgggagctgcgctccatgtccaggagattgatatctccatgtatctttcatatttgctagctttgtagtggcgtgacgaatggacacgcgtgaatgtcctgagcgacggcacttcgattcggggaaacatccctattccgcagcaattccgtggctctacccccactagcgattcttcggtgccgcatttccgcaccttcttcgtgccctcttcccactcgtgcgacaaagctgattctctgatgtgctgccgaagaacggttgcctgcggcgctgatgcggcgccggctcctgcgactttgcgaagaagatcgcctctggtgcgacgaggccgaacgggctcaacttggccaaacaggcccaactggtctgcctcgccatcccaagcaggccaagctctccccgctagcccgtgtacgctgcaccagcccaggtctccgcgcgatgccggcctgccccctcgccactttagtttaaatcagccggaggcccacaaaaccaatccatacgctttgagattgctaggccgtcataccggcccaatccaggattggcgtagaccaagtcaaaacctcatactacttggggctcaatcttttagggtattctgctttaataatagagttcttgctaattatgtcatacccctatagttgacatcatgacatggaatgttcatgggttaaatagaccgggtagaagagcaacggttagagaaacgctgcaaacggcgaagccccacatcgcctacctgcaagagacaaaaatgagtaatattgatgtagctattgttggatctctcggtgggagctacctacggtcttacaattataagccagctacaaggccttttggaacacgtggaggtatactggtactctggaatgaagacaccgtcgacctctctaacttcgtcctaggcaccttctccctcactgccactgttctcctaaaagagtgtcaaaccactttcctccttaccgtggtatacgggcccacaagagatagagcgaaacaagcctttttacaagaattgcgagacaccaagcctagaaacgactccaagtggctcctagtgggggacttcaatataatttacaaggcctcagataaaaacaatgccaaccttaacctgcgacaattgagaatatttaaagaaaccctcaacgcttgcgagctcaaggagatcacactacaaaatcgtcgatatacctggagcaatgagcaagataacccgactctggtcaaacttgatcgtttcttttgtagcccaaattaggataccgcctttgagaagcacctcctccatgtgctctcgacttcgctctcagatcactgccccctcttattatcgggacaaggagacgcgccgcgcgctagaaccttccgttttcagaactactggattcaccttccaggtttccaggagatcgttgctcaagcatgggctgtgagccctccatatcatgaagttcatcacagactctaccacaagctgggcgcaacagctggtagactgaaagcttggagcagaaatctcatctcccaaggaaagatgcacctccacatggccctcgaggtcatccttcagttagatatagcacaagagtcaagacaactcagtcaagctgagctcaacctaagacggggcctcaaggacagagtcatgggactgtctataattgaaagagctcgcaaaaggcaagcttcaaggatcaccaatctcaaagaaggcgatgcaaacacgaaatatttccaccttaaaatgaatgcgcgaaggagaaaaaaatttattcaacggctccgcgtggggaatatttggaaattcaagcatgaggaaaaagcggccatcattaaagatcacttcgaagcttttctagcgcgcccgccaccatgcctggtagacttcgattgggatgccctgcagttgccacctgtagacttggcaatgattaacgggcccatcaccgaagaggaggtgcttgctgccttaaaacaattgcctggggataaagcacctgggccggatgatttcacaggagccttctataaagcttgatggggcacgatcaaagaggacatcatgttagtaattcactccttcgaccaattgcgaagcaacaaccttcagattctgaactcggctaatgtggtgcttgtcccaaaaaaggaaggagctgaaggcataggcgacttcaggccaatcagcctcattcatggcatcggaaagctaatctcaaaagttcttgctcttcgcctccaaccccacatgggctccttgataagccaggctcagagtgctttcattaaaaaaaggagcattcacgataactttatgtacgttcggaatctggcaagaaaattccaccaaacaagaacaccagcgttgctgctcaaattagacatctccaaggcttttgattcggttagatgggactacctcattgaccttcttcaacgaagaggattcacaaccagatggacaaactggatcacaaatctgctaatctcctcaacgtcaagggctcttcttaatggttgcccaggaattccaataaagcatggtagaggactcagacaaggagatcctctgtcgcccttgctctttattctggccattgaccctttccatcacctactggagaaagcaacaaaccttgggctactttctactttgcgcggcagagcaccaagattcagaacctccctttatgctgatgatgcggcatctttgtaaaccctagtgtacaagatatgacgaatctaacagaaatattgcgagctttcggaggagtttcaggtcttcgaacaaacatgagcaaaagccagattgcccccattcgttgtgggaacattgaccttactgatgtcacgagcatcttcccggcagctttgacaagcttcccaatgaaatacctcgggctacccctagtggtaggtagattgaaaaaggtccacattcagcgctgatagacaagtgccagtccagactagccccctggcaagggaggctaatgtcatctgctgctaggatctgcttaacgaagtcagtcctcacggcacaaccaatctaccacttaacatctctgaaactacccgatgataccctcaaggacattgacaaaatcaggaggaagttcctctgggctgggggtgaaagtatttccgacggcaaatgcaaagtcaactggaaaagggtatgtcggccaaaagatctaggtggcctgggagtaatggatctacagcgtttcacgtccgccttacgcctaagatggctttggaacgaatgggtagcccctgacaaaccgtgggtggggatgtcagttccttgtagccttcaagataaagaactcttctcggcggcaacaaccataacagttggcaacggcaaaacggcgcgattctgggattcgagatggctggaaaatcagatgccccagaaaattgcacccaacattttcttagcctctaaacggaagaatagaacggtgcatgacgccatatagaataataattggatccaagatatcgacatcctccgcattacagaagcggagcacttacgccagtttgtccatctatggtccatggttagaagaatgccccgttgaatgaagaacaagatagcattcgttggaatctaacggcgaatgggaaatactcaacaagatcggcatataggctgcaattcatgggagcggcaagatctgctttctaccaatcaatctggaaagcatgggcgccgccaaaatgcaaattcttctcttggcttgctacccagaacagactttggacggcggatagattggggaaaagaggctggcaaaatcaaaagatctaccccctgtgctgtgtaacggatgagtcagccctgcacctactggccaaatgtagagtcactaagagaatctgggccgaaatccaacaatggacacaaactgacctccaattgagtaaatggaatgactgcccctccgtcaaactttggtggaaccttattgctgaatcccctaatactccacgagcccctctgcgaactctgctgatgcttgtgtcctggagatttggggggagcgtaatgcaagaatctttcggagcacagcctccacccctgcctcagttatagcaaaaataaaagaggaagggagagcctgggttaaagccagagcaacaaagctacaggagtttggaattttgggagacaactttttccgtttgcgggttggcttttggctgaccctgtacatattttctcttgttttcctgctcctctattaatatacgaggcaaagcttttgccctcctttcaaaaaaaaatctagttaggccctgtttagttccaaaacaaaaattttcacgctgtcacatcgaatgtttggacacatgtatggagtattaaatgtagtcattaaaacttattgcacagattgcatgtaaattgcgagatgaatcttttaagcctaattgcgacatgattcgacaatgtagtgcgacagtaaatatttactaatgacagattaattaggcttaataaattcgtctcgcagttttctggcggaatctgaatttattttgttattaaactacgtttaatatttcaaatatgtgtctgtatattcgatgtgactaccaaacccaaaaatttcccccaactaagagcagatacaatagtagactataagccagcaataaacttatatattaaaaaaataaaagaagagagagaagagcagcatgctacagatgtgtagccagctgcagcacggactctaagacgtaatgtgtatatgacaggtgggaccaaatattaatagtatagtaggtaattattgtatgaattgactattacattagttatagatgattcggagctagtagttggctattctattaaacatgctctaaacaaggccttgatattgttcttacttcgtggggaacagattaacataatggatagccgtagatgaacgtgtccactcgctagcgcgaccaggtccatcctataatcttctgatcacattcagatcacagaatcatagtgttaatatatggttttataaggaaatcaccaatatttactacctattttatgaataagggtaagctctatgtcaataggtattagttattgttgtaatcataatagttagtgaaagaataaaagtggacggtaagctagaccccacagtcactagccatgagaaaagatgagagaaattatttatttattccttataactaggtaataagcatattacctagtacttgttacttacttaccattttcactgtgtatactaactagtactccctccgttttacaatgtaagtcattctagcatttcccacattcatattggtgttaatgaatcttgtctagattcattaacatcaatatgaatatggaaaatgctagaatgacttacattgtgaaacggaggaagtagtattttattccttgctgcccactttagatgcacattgtgataccctaaatgcaagttcgattgctaaattcggttacaaaaaaattaatttagaagtttggacagaataaatccaaaacaaacgtgtcttcgctcatcttaattattgcttatcgagatgtgattagtgattacctcccatcattcaagtaaacatgcatcgctcatggaaaaaaaaactactaataaagaaacagatacgatttgtctatagaaattatttttttatggagagagtaatgtgaggataaatgatgattttttttctcattcgctctacagcggtcgaaatatatgctccctccgccctaaaaaatataaggggcacgttttagacagatagaacacttactaatactacgaatctagatagggtatctggattcgtatagtgtatcccttccatccaaaatcttgcggtcttgttcgatagccagttttgctgcagccaacaattgaaaatcgctgcaacttgcagccgttttgaactaccataggcgtatctgctaccaaaaaatctctttcaaacacactatttatattttgggatggagtaagtaagattagaagttctacgtacagtggtctggacacttggttaagtgagaaaccatgtgcataatatgtgaacacgctgagtatttcctcgaacgatcgacatttgaacattttagttaactgaacgagctaatctaactttgctatatatacccaatttggtaagcgtatattaatcgatgtttggcttgcggtgcaagtaaaaaatgggcgccctgatcgactactgtgcatgccgtacgttgaatcactctacggtcttgatcagaaaattaactaagagctaaacataacattgtagttaccactaattcatcaggtccattagtgcttgacttgtagtgttggccatgcttacgagctaggagacgtgctcgtggaagcaatcacgcaaatgaaggtgaaagtgtaacatataatgtgcaacctttacaagatcgtgctttaatttgtcacagcttcagcttaaaacctaagctaattttgaagctcttgttannnnnnnnnnnnnnnnnnnnnnnnnnnnnnnnnnnnnnnn

SEQ ID NO: 45936 - DNA, 882 bp, Oryza sativa
gaaaaagaaaaagaaaagaaaacccgattatctcgagtccagtaaccacttgaggagaagtggtgagtacctgaggaggagggggtggtggagaagaggcgggagagagagggaaacggcggcggggaggagaggggaggaggaggcgcggggctaggttttccggggaggtagggtttggaggcggcggcggcggcggcgagggggaggaggcgaggaagacggcagagtcggtgagccagagccatactgtgccacgtcgccgtgaaagattttgcctcttttgtgcgtaaaagctcggagacgccaagcccacgacgaaaccgcatgggcctgaaagtttctcacacagtaggatgggcttccggcccagtgtatttcaggcccatttattctttacaagtctgtttatctttttatttgattgattgaataataaatactctctctagtttttaactgatgacgttgttagattttgaatatacaatttgactattggtcttacttaaaaataaattttacaatatgcaaaaatatcgattatccttattttttaataagacgaacaatcaaacatatgtctaaaagtcaaaagtgtgatctactgaaaaccggatggagtactaaagtagcaaaccgatttttaacaaaaatttaaaatgagttttttctttaggaaaaccacctaagctcagacagtgagcgacagttgcaaagctttgtttgagaccttataaagaatatctttatctttagaccacaagtagagattactaaagaatgggatagtggagcattattgcgcattatcggtgactgcaaaatccatcataaggcttggttataaaactcttcactaacattcactagttgggccac

SEQ ID NO: 45937 - DNA, 2110 bp, Oryza sativa
  unsure (1)..(2110): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacagaagtaattaagttgcatgggctatatgttctcaatatcaatcctttgttttcttttttgcagcttgaatatgtatatgctctcctaagacttgaagaatataccaattgaataacttgaatttggaaaaaaaatgcaagagaatgattgcccactaactaaacatacctggcctatagatgttacgttctgggtgactgtgcagcatcagagccatctgctgatgaactatctgtgtctgtatctgcatatgcttctcacggtaaatttcatatgttatgcagatgtatatgaaaatatcctttatagagttaattgcaaacagaaatgctgctaatataaatttctgcaaaggatgagagcatttaccactagacgaagagcctgaatcgctactagaacttccagaactacttgatctacccgcattctcccccttctgatcttccaaatgaacaggtgatgatgagcctacatacctctcattatcatctgtaattgaacaaacttagctgttatccttaaactggtaatagagctaggtcacaaacacaattttacatttagattaataataacaattataaaacatgctccaaaaacacagtcgcctacctgctgtgttttctttaggtggttcgatatcaattgattctggctcaggattatgtaactgcagggaaataataagtaccatattgttaatatcacagtataattaattcacaacaattacatcatccctaagaagcataccgtctcttgtactggaggcatctgatcctgctctacttcatccaaccttgcatgctctgtcttctctagctctatatcatgattcatctcatcctgccctgccacgggattctcagccttccgcttgttcttgcttatactttttttgtagtttgtaacaaacctatcgagctcccataatgtctcaacatcaaagctatctatatcaacctcaatctcatcatcatgctggctgagtgacaagtttctcttctttataatctgcacaacattgtcaagtttctctggtggcaactcctggagattattactaagccgctgcttctcccagaaggtcatctccctcttattaggctcccttgccttgggcttctttaaaactgggggccgaccagtgttctgctttggagtggcctccatccccgcagcatgtactgttgagtccgacctctctaacaccttagaattatctatctccttcggcttcctgggtgcagccgatgatggcgttggcggctgtggtgacagctgtgctacctcggcctcaatttctggccacttctcctcaaacatgttcaacagctgctccgccatgaagtgcacatcctgccctttggggttgtacctcatggcattctgaaaggtaaggcgcacgtcaccggcgaactcccgcggcgacttgtagtgcccagcggccagccgcgatttgacagtgccgaggtccatgggcttggtgatgatggtgtggtagtcgtggaggccaagcgcgctggcgtcgacgggcgtgttgaacacccagctgtgcttgtgcttcatcagcctagcgagcagcgcgccgcagctcttgaacacgggcgcgtagagcttccgccgcgcctccgcggagaggcccgggttggaggaggggttccccttcttcgacttgtgcttggagaccggcgggtgcgggggcagcggggtggaagggtcggtggcggagagcgcggaggaaggcgcgggggccgggagggagctgaggcgcttgcaagtggcgcgcacctgcgcgagctcggcggtgagccggcggcggagctccctgcgggcggccggcgaggacgacagcgagaaggtgacggtgcggacgtgcgtcccgttgtgagcatcgaaggccgccgngacacccccgccgccccgcccgccgccgcc

SEQ ID NO: 45938 - DNA, 2774 bp, Oryza sativa
ggtgggaggtggtggggcagggcaggcagctgctactgttcgttttttttttttttttgccttttccttgtctgaaacgtcttctttaccatcctttttccctgtgctctttccattgatggtaaaaacttctgttcatctactgtttcggtttgcactgcgttcttggagctttgagcagtttgggtcaggggtggaccggggaagacaatgtgcttttctaggagtactttggagtgggagttacttgccaattgttgaaatgcaaggtcaacactcaatagtaagggaaaattggaaccatgccattataattttacaaaatttaagatatgccatcctgacccacatgtcattgagataccgatggcatatatcaaactttgtaaaattataatggtattacatttttttacccatagtttaaacctttagtttataagcataggtgaaattctgaatttttaaaaagtcccctgaaattgagttttgggtttcaaaacatttaaaaatttgaatttggaaaaaaaaagttgatttggggtattcatcttagtttattttctagtatttatttttaaatcactacaaacaagtatataaaaatttacccatcaattgatttttaattgctaatatccgctcaatttagaataagtataagcgaaattgtgtgacatgttgaattgatgtatggttgttttaaatgtaataaccactgtcgttttaggttttaattttttttattccacgaaaagacacacgtacacacaccactgcaatgtatgtaacacatttgttcttaaaaaaaagtgacgcattcacatatgtaaatgccctcttaacaaacatttaaagagataaaaagaaaagtcaatatactaagttcactgagttcccattaaaaaaagtgtaatatttgttggcattagaattcaagtctcggtagaatggtagatatatatgtcatgcatctgcaattttatcaccatcgtaaaatagtgctttcgtgggttatgtattatgtactagtattgcagaattaatgtcctatattgtgttttgcttatgaccaatcgttatttaattttgtcaccacagtatgaagggattaagggacatgacaaatatccttactcaagtctatagttacaaaaaaatatccttggtttttggcaattaatagaagaattttgtaaaatacacatgattcgatagggtaaaacacgggtaagaaatattttgaaatgggaacagtattttttattttaaaaattaagaaataacattttcaaatcatataatagttcaattaatagaacaaaaggagttgtttttctattttaaatcattgcaatttgaactgaaattatcaaactcgccacctcttgaggtgtatctatatggcttcataacctagaaatactttcactatcaatgacatttgaaatcattagaaagatgaaaatgatacacatgaccttgtcttgagaagtggacactttcgtattctcagaaacttgttacttccttaggacataaacttatgttctccgactacttgttcttttcgacgtgtaacattgatcaaatattttattagaataaggtcataaataagaagtctaagatatcgtgaaaatattttacaggagaaatctacaaatatcaattttatgttatgaagttaagtgtttaaaaaaattattgatggccaaaatttgatagaatctattccgaagcgtccaatgtttatgaccggagtggatagattttacgaatttattctaatatgaatttatggttgaatacttaacttaaaatccaaggaacctaaaaaaaactagaagaaactagtactaacaaaaaaaacactctcaattataggaaaactaattactgactactttctccatccaaaaaactcaatctagtctagcatattatggaacaatgaatctagataaaaccttacctagattcgtcggtttggattttttttatggaaggagtccatcagggaaatgattttcttaagacggaggggggatttggagattgcttgatccccatccgtgtgattcaaaccgatcccaatcaccaaactgcgccgccggccgccggaatatgcttgtcactgtataacagctcaccgctcgtcactgacaacggcatcttggactccttggaggcacgacaaatttacaagtcagttgctgccactgttttctataaaatcaaaacttgcacggaagtgaagtgaagcgagatgggatcttgaagttgaagacaaggcagttgttcagtctcctctagcacagcactagcgagtgactgccccaggcggatattctgaatccaaggaggaaagatgaggccgcggctggtgctcttcggcgactccatcaccgagctctccttcgccgacggcggctggggcgccgccctcgccgaccacttcgcccgcaaggtacgccacccttccctcctcctcgcgatccggccgctgtcccatccccgcgacacgcgtacgtcaccgtttctttggataggccgacgtggtgctgcgcgggttcagcggctacaacacgcggtgggcgctgcgggtgctggcgagggcgatggagggcgcggccgccgccgcggacccggcggccgtcacggtgttcttcggcgccaacgacgcgtcgctgccggaacggaagcaggtgcaccagcacgtgccgctcgacgagtaccagagcaacctccgctccatctgcgcctacatcaag

SEQ ID NO: 45939 - DNA, 14465 bp, Oryza sativa
  unsure (1)..(14465): unsure at all n locations
catatttggtttatcgggtatatatccagtcaccacttggtggcccttagcttgatctgaagatccttttttcaagttacaaataaaacagtgtgctttttttttgtaaagaggatttgcaaactgtacttattgtccctgtctttccttgcagggacatgtatggagaagatgacccttcaaaactacctgaaagaaccaatgaagctgctggcacttatgcacaggcatgcctgacagttgctaaagaattgaaccatccagtcatagacatctggacaaagatgcagcaatttcctgactggcaaacatctgcattatggtatggatctatttcaagtgaccttatacctaaacttgatgtatggatgggcttaataactgttaagggcttccatttatgctaccagtagcctactttgcagattgcataaacaatctgatcaaacataatggttctgtacttctattgagagtataaaagttctataaaaaatgtagattcatggtaaactgttctgcctaaagattcttgctgcttactaagatagggaatcaccttcctgttatcactctgtctaaagactctatagttaagatatttaactgaacaagacgaacctgacactctccataacagtcattcagttttcttgcttctgaattgtgcttagatcaaaagattctgtactctgtagtgaaaattgttggaacaaacttacgaagtgcgttttgcttagttttcatcttctcttctgatctgtatatagtaaaatggtactccatgctatgtggaccagaacatagtagtattttgttttgaacttgggtatatatctgtgtacatgtatttcttgctgaggaaatgcgttatgccgtgatgtagctgtgaataaacaattgtagagtttactgcttagaatgttttttttcctgatgacaatcgctatacaactttcttttatatcatgcagtgatggactgcacttcaccccattgggaaacaaaattttgtttgactgtgtgctggagacactggaaagcattggtttcagccaagggagtcttcaaccagatcttcctctcttccatgatatcgacccaaaggaccctttgaaagcctttgaaatctgaagaaggtcccggccggcatggtttgttcaggcacggatactcgttgtaacagggacaccttatgccatcgtgttgtgccagctgtatgtgcttgaattttccattataagatggttgaatttccatgtagaacataataaatggtttgtatttccatgtagaacataataaatagtcatacaattccatggttcacatttaaaaagaaagggaaatttattttggatctgcaaatatagaagctaaaagaatttcccagaaaagaaaaggaacatattaaagtttttttcttctttttaaacaaatacgcacacaccagccatgttcatgcatccctgaactttttcaactttctgcaaacgattgttgattattctgcagaatatatatgctgcgataatgcgtgcgtaacattttctacaagaaaccagacatttgcaaaaagacgaagtagggaaatgcatcgacttgggcctatgagtggaggcccattacgcatgactgatgaccctaccttagaaaaagtccattttgactgcctcgtctattagacgacatctaatttgcatcatcagttacaaaggctctcgtaactttgaaaaccaacataatttgactcccctggtgattttgatagtgattttgaccaacgtggcttattgacttggtccgtccatgccaatatggcgattgtgtgacagtttttatctctactatcataaaaattgaagttgttttcgtcaataccttggcatgccgttcatatttgagtcggtttttaagtctgttcgctttggaaatatataaggagtcatataagaaatccttttaaaaaactcgcatgctaacttgggacgaaagtcagactcctaattgtttcagaattcttgccaggccatgctattataaaaattgaatatttatttgagtccttttttaaaagttcgctcgcttttcgaaatacataaggagtcgtataagaaatctttttttttaaaaaaaaacttgcatgctaacttgggataagagtcgaactgttaattacttcagaattattgcttggtcataagaaagcaacgtacataatatggctatcatcctaataaaagtttcgaattagatatcaatactatcgaaataaaaatcccatatactttttagacggctaggcttcgtatctctccagttcaacggtgagaggtggaggagaggatagacaaggaagaagtgatcactgacttctgggtcccatgaatatttttctttagttttttatgattgtaatgccatgtagacgtcacatcagatgaaggctagttcaatgcgacaagtaggtgacatgttagccaaaaccattgtcaatactgtcgagggaactattttacaccgattttattagttggaggggattatgtacccggttttgcagtcgaggggtgggaatcagattaggccgattgtggagggtgtcaaattggactttgatgctttgcacccctcttcagccaattatagatgttgtggccttcccattcagtacaaaagatggggaataagttcactttaggtccctctatttgtcggtcagtctgattttcgtgtcttgatggcaaaaccgggtaagacctgtctcccaacttatgaaaaccgggcaaacgagatcccttggcggtatggaaggtagttttgggcgacgtggcgcctacatggatcctttgactaggtcttcgtcccacgtagcattgacgtggcgcttacatgacaattttatctgaaaaataataaaaatcgtgggacctatatggcagctatacaaaaaaataattaaaaaaggtggggcccatgtggtcccacctattggcctctcttctctctatccaaccctcactctcccctacaagggtggagtggcgggactgagcgaggcgggcggtggagggcgcggagcggctgagcgtggcgggcgacggccgacctcaccctcttacctcttccggtggtcatagcggcagcggcagcgggtggacgcggcgcgacttcattcctgggcccacctcatcgtgatcctctgggtccgcgaaggagctcttcatcccggcgaggggttgtcgccgttgccgctgctgcctggcgcgcgtcggtcgaggcggcagccatggacgcatgcagcgggtgatggaatcaggcgctgacgtcggcgatgggttttcccaaatccacatccgtcgtcctccattgatgagctcgggcagcgactcgccgccgcattctcttttccctccttctgacgcgcggacgaggagtcgctgcaggagaggagtcgtggtggcggccagagcgagaggagtggcgcacggcggcgggagagaggagcggcgcgcggtggcgggagagagaggtggcagtggaggagaagaggagcacgtcgtggccagcgggaggaaggagcggcgcgcggtggccggctggccagagtagcgtcgtgtggaggctggcgggcgagaggagcgacacgcaccgacgggcgagaggagcgccggcggccggcctccctgcctctcccagtctccgtctgtcatccgtatgtggtggaaaaggtgggacccactaacatgtgggtcccactttttattttttgtttgactgattggtgggtcccgcatattttgtattattttttttattttgcttctttacttttttttctgaatcaaaactccacgtaagcgccacgtcaatgccacgtgggacgaagatctagtcaaaggagccacgtagacactacatagaagccacgtcagccaaaaccgggatcaatactgccgagggacctcgtttgcattgttttataagttgagagatgtattgtatcttgttttctggaccgaggatgaaattagactgagcgataaattgagggacctagagtgaacttattctaaaagatggtgtaccctgaatttccattggagctccactcccctagaagcccagttgcctagttgggttgcaaagtatatgctgtccatcagtaagcagaaatcttactactagtagtatagtattagtactaatctactactactcctgtagtactcctatccaaatcaccagctcatcacctgggagtccacaatatcttccctggctttaacgagaaacaagatttcaggaccccaagaagaggatctagcttgtgcaggagtacaggtggtgagatgggcacgatcacgcgtatgcccagagagctgtacaatgccgttgtcactttcccaactctcaccttacaaaagacagaaagtctcacagacacacacagaggcggttttagcagagagggccattcccgttcatgctcagcaactgtcactcactctgtcagcctcgctggggtgcgaacaaatggatccatcatccatggcatgcgcctactactgctacagcgaaaaaacaaaacaaaagcctgggacaaccctactgttatgggttactgatccctacggcctaggttgattaacttaacttataaacccaagctgatcaaatcctaacgataaaacaagatagggtttagccttaggcagcgttaaaacaacctgcctatgtgtacggcaaagatcgcctcgtgaagcgtggatctcttttactattcctaccagctcagcctataccgctccacttcgctcactgacatgtggggccctggctgccagtaatatgttcagctgtaaagatccctgctgcaatctcctgctcttgcctgcttaattaattaactggcctgtgaagcatcatgatcagtagtaaatcagtggagtaattactttggattcagctcgcagcgtggttaaattcgggcgctagctgctctgcctccttttgcctgtgcgtgcgtgtcgtggaaagcggggactttttatcgccggcatctgatttgctgcacatctggggagaagcatgcatgcgactgtactagagcaattatttatctctctacacaattcgcatatctactgtttttttattagggattgctcgattttcggtcactggaaaatttcacagattttaggtctggtttagttcacaactttttcttcaaacttttaacttttccatcacatcaaaacttttctacacacaaacttctaacttttccatcacatcgttccaatttcaatcaaactttcaattttagcgtgaactaaacacaccctagtcgaatttctcttgtctgacgatgcttggcggccggccgggaacatgtgaggctcaaggattggaatgggaggaggggttatagatagtggaaaggggcagtgaagatgatggatacaggcgagtggtaaggcgatgttgtctaaggctgtcaatgagtcgagcgtcaacgagtcaagctcgtatgtcgtttgagcttgacacatgcttaagccaaacttattccgtcttcgagcttttaagcaggctcagttcgagctcgatcaagcttgagcttgactatgagtagtatggagtatagcactagatctaattacgcacaaaccggagggtttttttctaaaatttcaccccttgcactatagctatctgacgtggcattgtctagcgtccgcgccatcggccacccttaatattctcctaatgtattttaatgatacttttagataaaaataactattttctagtaaatcacactaacaatagaggagataacacatgttaattcattgtgtagatacgtactaatatatattttatttattagtttaattataaaaaataaataaacaataaaatccatatacagtcaagctcgttaaaagtttgagcttgacttaacaaagctcgagagctttagattgggatagggttagcttggcttgtttcttgaaccaaggtcgaattaagtctaagataaatcgtgctcgagtggcttgtgaacctcgagctgttataacaactctaacgggggctctatatcgaagccgctgggaagaaagaggttggtggactaggatggacgggtggtgacagcaatgagttcatcatgcaaagctatgaaaggagatgcatggtgttgaggtcccattggcgttcatctcaggaagaaagcgtggaggcggtctcgctggcgccgttgagacagaggtagagtagtgaatatagccatggtgtagcattcggtggaggaagtaaaagagataattgagagattactgtagtgcataaatcttggcgcaatccatgccatctaagggcgtgtttggcgcccctagctcccaacaccaacactgtgcacagaaaacagagcggtccattagcgcgtgattaattaagtattagctttttttaataaaggattaatttgattttttaagcaactttcatataaaaactttttataaataacacaccgtttagcagtttaaaaaacgtgcgtgcggaaaacgataaagaggggttggaaactaggggtgccgaaacacaccctaaagtgagagtagcaaaatttgagtctaaagttttttttttgaaaggaaaatttgagtctaaagtggagtatggtgaaatttgtgagtacgacgcttctcttcacctcgctgtgttccgttccaggtagtagtgctcataccaaagatgggtactagcgctgctgctactgcaatatttttgctgggttttcgccatgcatgctgcagctagctgcatgccgtactgcagatgaacctttttagggccagcgagctacattgccgtagcctgaagaaagataagaataggacatgacagttcgttcatcattggccactggctactctagtactaccatcccctcatttactggcacagttgcacccatgcatactcccaaatgacagttgctgggaaaagaaaattaatttattttaatagtttaatcctaaatgacagtttctgggaaaagaaaattaattgattagtaattgtttaatcctagtactgcatgagcaccggtagtgtgatctcactgccaccactgactggatcctctgtttaggcatccaatgaaatgaccatctatctccatagtacaacatcgcataaaatataggcacaaataataatctgagaagtttcaacccaaaaaaaaaagaacgcaaaagcatgcggatgcacgaggggaaaagaaaaaccaaaaaacggtctgcatgcgcgagtgcccccagctacagttgtttcacacacctccagaaatccgtactacgagtgtattcaattcgatgcaagcatgcaaaagaagaaacgcagctaggagtaggagtagcatgtatagcagctagtatactgtactaggagtagctgtacgtggccatcgccgtggttggggcgtcgcgaatcatttggacagatcgatgcacgcacgctgcacgcgacgccacccctcctcctcatcaggcatatcgcgcgcgcgcccacgcccggacggcgccggccggccggccggccggtggtcgccatgtgtacagcgacgtcgtgcttgcccaatctgccaatcattcctacggcgatcgatcgatcgagctagctagccgattccccgcgcactatactagctttaatttagccaggatgctttgccaagatgtgtgtcgtccagacttcaagcacacacaggcctgcgccgtgtatacaaatcaactcctgattacgaatctgcatatatccaatgttaagttttgtagatagaaatttaactttatggaatgaaggaagtatgttttgctacgtcactactagaaaaataatttattgccacgaaaaaaatcgtagcatcaatgctaaaattgttgcaatagatacatgttgccacaatctaaaaatcgttgctagccgtagtaataaatagtgtggtaataggttattgcaacgatttttatttagttgtaataaattttgttattgccataaaatgtatgtggcaaaaaatatatattgcaacacttcacatcgttgcaataaataactattgccaccactccatatgtggcattagttctacgtaccaaattaaatgtttcaatattaatttatcatcctaactattttcttttgatatcttgtcatggctaggattcgaacccaagatctctccctcacgcgcgctcttcatgaccaactcacctacgcatcaattttgtttaaaaatgcatataattccatttgagactgcttaactgagatttgaatcataaatttgagtatttaaaagatttcaaatgaaaaatttaagttgtagatctcatcgagaggtataaattttatataaaatttgtcctaatccgtgtccatatgaaaagaataagttgaattatgagatgataaattttttttgttgtaacgaatttgttgatcatggcaaatagaaaatagtgaaagtaccatgtactatgcaaattgccataaaaatttaatttatggcgatagaacatgttttttttgcaataataatatttttgtggcgatagcccatttcctattgcaacaaaaatactgaataaaacaacgattgtaaatcattgcaacaaattatagttatttgtcacagaaaaattatcattacgatagtataatatattgccacgaattatttttcattgcaataaattgatggcgatatctcaattatcttgtagtgcgtgtaacgtgtgtggcgctagggtcacgggnnnnnnnnnnnnnnnnnnnnnnnnnntgactgaaatcgatcgatcgatcatatacgtgttccgacggcgaccggccggccggtgcaggagcagccgagggggacaccgaccgtgcaatctgcaatgcacgcacgccaccacgcgccgcgtggccggccacggcgagcaaaagcgtactagtacgttcgtggcgtacgttggagcgtcgccgtcgtcacctctcactcacctaggaaccgtccagtttggtacaccaccaccactcccagttagtagtacgcaatgcactgtggtcgaattgaactcgatcgaaacatttgtggggacgtacgtacgtacgtacggtgtctgtcacgcacgatgaaggacgacgacggtgatggcggctaaggatctgtttaggagaacttaagattctgagaatcaattgctgagaagctagctggtgagaatatggagaagctggtgacccagcttctggcttctagtttatttttccaaattctacaaagagaaactgcagctgctagaaacttacctaaacaggctataagatcgatagataacccgcgctgattattggtgtggactgtaccggaatcgatcatcgattagtactactggacatgcaagcatccatgcatgcacgcgatcgccaataatcagtgtggcaggcgcttgtaaaaagccatgggactttacgagatggtagctagctagtgcgcgcgcggcgcggagggctggacgacggatggcatgcactactcacgcgcgcgcgcgcgcgcggccgccggcgcagataattgttgggggggaggtagctagggcccaaactgtaaagagcacggaaagctggcatgcatgcaggccggcctgcacacacatgtactgtacacacaagcgggggggcggcggcaggcatgggggcatgcagatgcaagcggacacggccggccgggcgccgcgccctgtgctactgctctgctgcgaaggcacagcatcagtactggggacggggagttggtttgtgcgccacatgtgttgatccggcctactgctagctacagccaactgctcacagtcagagactcagaggtcctatttaatttgaagaaactgattttagtatgctcgcttctgataatttagagaagatgatttttctagcttctgaagtactagtagttattttctagatcatatagttacagattctcgtaaatatgatcaaaattcgtattgtttaggagaattagagcttttaaaagaagttgcaactgctaaaagtctacaaaacaggaccagaggcttaaatgtataacttcttattagttactactcccttcatcatccataagtagtacaagtgattttaaacttctccgtagtttcatttcgcaaatataatgaaacttgaaggcattgtttttctaatctatccaatcactgtaatagttacatcgcacaacatgattttcttttctaacgaagtcgtcaaagaaatttcacattaaccttaaactctcctaaacaatctacaatcccctttatatactttaccttaaacgttgctaaaaatctataatcccctttatatactttatggaatggacagtaactagctagtgagtgcgcagtcagatggtcagagagatcatcggtgatgaggactatagctagtagatcatggcatcgctttctcagcatgcagtggccaggcctgtgtccggccgaacgggctaacatgcctaggcttctgtggcatcattctcttgctgcaggctctacatactcctatatgcctagcatacggagtattcctatgtgaatcgtacaacgggatggccatgagccatgagcccatgatctcgtgaccatcctctccatctggttgcatgcatgcatcttgatttttttttaacagaaatgggtacacggatactggaatactatatactccctccgtattttaatgtatgacgccgttaactttttgaccaacatttgaccactcgtcttattcaaaaagtttatgtaattatcatttattttattttgacttgatttatcatcgaatgttctttaggcctgacataaatatttttatatttacacaaaaattttgaataagacgaacagtcaaacgttgataaaaagtcaacagcgtcatacattaaaatacggagggagtatatgtcatgcatgcatatttcttcctatacaaaatctttgcaatgtatacataaagaaacaatgtttctaagtgctgaatacaagtagccaagggttgtataacatcaaccaataactaataattagcccataaaacagtcagctgtaggcaattttgttgatggggatgtgagagggggtaaggagagagaaacatatatttggggtagtgatcagctatgcatgatatatattgctctacagcgttgcatataatagctatggcatagctgtgccagcacaaaacagtagcgccactatacagtggctgcagatttgctctatatagtgaagccgacatgtatgcccattgactctcgaagtacaagatatgatgcgctacgcaagacacaacttgggaaaaaaaaccaaacctagtggcggatccagaaaaaaataacagtgaggtctaaacaaactagatagagttacagtccctcctcccatctacatttggtaaaaaaatttagtgggatcttcgtgggggctctcatagtcttcacgctagtagtgggggctcgagaccccgccaccctcatgctagatccgctacatatgtgaggtgatatggactaattggtagaacttactagatgtccgtacagcacatttgtgggagtagtctctggttgattaatgtggacttatatataagatgaacaagccctaacaaaaaaaaaaacaaaaaggtggcttcttggctcctgatcaaacaaatttaaataccatcttcctaaaatactaacatatataaaaaaacaaataaaaaattatacctacaaatcaattaactttgttataatttagattgagcatgttggaggccctctaggttggagctagcgagcgtttgtggggctaagttctggagctacacatatagtatatgggttgatacatcatacatgcatggaacagaaaagttttgtcctagaggccggaggggagaaaggggactttgtcacaaaccctcccgtgaataccaagcaatgtcagcagcgaactgtaccgtcgtcacatagtgcatcatatcaagatatgtgcttttttttacttcaacggcctgcataagtgtgttcagccctgtacagttttctgcttcctatggtacgtgatctgttgcctccacattcatcagtgtccatatagtagtagtaatctacttactcctatttgatttatcgtaaaaatagtcaccggttcatatatattggtatatatatatatatatacacacacacacacacacacactcaatttcatttccaaacctttcatgtagaccccaactaactcttcaccataataattcggaccgcacatcacaatcgtcgacaatgcatatatatatcttctttttctcctttaacgtgatactagctttctattccatttatccattttgaatacaagtatttctaggttgtttagcaaaaattaaaattgaggagaatttttcggtgcgctttattaaatgagagatggttgagggtaaaaaaaaagaaatttaaatgtgaggtaattaatgggataaatagtactctaaatagttcttgaagcactaatactttggtacaaatttaaaatgttagaaatacttatatttttgtaattgcgggaattttaatagacccaggaattaatgaatgcagtatagctagtttcaggcttctgttaatttggtggccctggcatgacatgacatggcatggcaagtgagccacaaacattttttaaataatggaaatggaatactgtcgacggtgtgtacccgtagaccggatatagagggtattgaggtgtacgaggatctacttagtacgacatcaaggaaacaagagacaaatattatactcgttcaggccccctaataggtaatagccctaatccagttgatatgggattatatggtgagaaccacagattacaaagggaataaaagaactcgacgataccgacgagatcgtagtcgagttggttcgactagaccacccggcgacttggctcctgtagacttcggcttcgtaggttgtggtcgttgtattggctatgagattcgatgccttaggtcctcccggggggtcccttttatatcgcaggtcaggtggtatccaagtaggactcggagacatcggaccctgcacgatacagtgacgacccagtcctatacgagtaggaatcttttcattggtggactccgtgatgaatttccttagcgtatacagagaacgtctgtacacgcgcagatgtaccatattgccgtatagcgtacatccaagggtagagggtataccttattcgtaaccctaacaaatacatctccggtctctgcccatgggtacacaaccaacaaatcttagaaatattggtcgcagtccaaattaaacatgagaataatagtaatatggagcattttaaatataccctcagaaatggaacagatgtcttaagttggcactaaaatatgaataaaattttgttacacaaaaacattaatatgcatgtgagatattccaatccaattaatcaggtcttacacaacaattttgaggaaatgaaattttcatttttatcaatgaaaattcagtactatataactaaattagcatttcttctgtgtaaccaaagaactattagtgtaccattgcgcacaaagttcactatatgtatttgtccgcaaaatagatccggagccaggagcctcgcgagtcacgagtcacggcctacttctgaattctgatcaaaccacaaaagaaatgaacgcacgatcaataattaacaaccgtttctccatgcaaggatcgatgcaaatggatctacacataattaaactaaggttttcggtcaacctcaaatctcacgctgcataagaaaatcccaaatagctagctagcgaccacggttagcggagagtacattcatcttgctagcaggttcagtcgatgactaaattaagctagcatgctactgttcatgtggccaatttgcatggagctgaaagctgcctttgtttaatgtgacatccacatgtaaaatattacactccttttcgaatgtcggcatccactcgttttttatggtcccagttagttcttttctgcaacgagcacacaacgaatgccatctcggacgtgtgtgtgcacaagatatataaaccaatgtatgtacgtataaagtggtagccagaagttttaataaagaaaaaaaatcgatgttattgtcatagtgtaacttgaggtatatatgtaatctacgtcaaccatatatatataggccatactaggctcgtctttccgtctaggtggactataaagtggtggggaatggtggagaggatatggaaagaaataataatatataaatagcgtaaatcaaatatctgcgaatcaatta

SEQ ID NO: 45940 - DNA, 5241 bp, Oryza sativa
atgtgtccagatttaggaagcgtatcctatgcacacaggccctcgcgtgtacacaccgtgtacatcaactaaaaattatcacaaaaaattctaggaaaattcatacatgtactttcaacagtattacatctacgtgcaaagtcacatcttcaaattcattctacatagagaataacaaaaaagataaaattctgacaaaattataaccttaaaactgtcagatttttttgttttttttgttacggctaaaatataatgaatttgacgttaatattttaaccctaggtgtaatacaattgaaagtatgtgtatgattttttctatattttttggtgacattttttagttggtgtgcacgtgtgtacacgtgagggcctgtgtgcataggatatgttgccccagatttatagctaaaagttgttatatttttggacgggtagtgagaactcatgtgaataagcacatcagttttttttctgttgtacatcttatcgaagtacctaaatgctcaattctctaatggtcgatataggtggtggggttttgttggcttaatacttacaaaagtggtcatttattatttgtcactataacctttccactacaatcaaaaaagacacctggatatattattgtaccaataaattttgcgcctgattttttttctatgtatgtcattttcactgatcgagtccacacatgcaacgaaattggcaagtgcaccgtgcaatgcgcaggtgttgccgagacatgaaaggaggaaaaaaagagagggagaaggtgacaagagagggaaaaggaggcgcctgccagcgttgcggctgtactggccggattctgttgggtgcgccaccgaccggtgcagaatccggacgcaagtatagtccagtccaacccatcaaatcaaacaaaatcgactaatcaaatcgatttgacatgacgcatccttaagaaaagctacttcagctaaaggcccttatcacaactgggagtaacagtagcaagtactcgtactctgccttttcctttccttgatgaaagaaagaattgattgcctctgtaattaggtgtaattaacaccttctctacgtcgttagtgcacggtttggttgatttgactgggcactaaggactggacttatttttatcatctttccgacagaaattctttggcaatgaattgtcctttgcaaaaatgtcactccagtgtttgtactactaccactacttttcccataaaactgtacaagtaaataagcttgtccatgtacgagccgagtacgagccatcttgactgaaacccggttttgcagacctgtgctgagtatcacccggttttgcaaaaaaaatcagggtttagttcccttcaaacttttaaaaatttcgtcatatcaaatatttggacacatgcattgagtattaaatgtggacgaaaaaaagcaattgcatagtttgcatgtaaattgtgagatgaatcttttaagcctaattacaccatgatttgacaatgtgatgctaccgtaaacatttgctaatgacggattaattaggcttaataaatttgtctcgcagtttacaggcggaatctgtaatttgttttattattagtctacgtttaatacttcacatgtgtgtttatatactttaaaaaaaaattggcacacgaagtaaacacgccgtagatactcgttgcagatcaacttggatgtataatatagtagtagtagtagggagtatatcactgtgaataaaaaaaaattactactcctatgtgagttttctggacagccagcgatcacgtgagccactgagccagccggacccgtacacattcagagacagagggcccaatgcagcagccagccagcagcagcagtagggggagtactacgtagcaataaccatctcgatcatgtggcaaggacagggtgttggggattttaatgctgagtttttcattccactggaatgtcccttgtctggccggagaggagagagagagaaacaacaacaccacatgatgatacagaagggggaaacaaacacccaaccatagcagcgtagtagcatgcatgcatgctgcagcagcggcaaagcgagatcctgatcgagttgtttattaatctcctcgtttaattagctgtagagctacacgcattaatgccacctatgccatcgaggagcaaactgatgagcaagtgcatctctctgttccagtgatcgatcggccatatgcatgtgtgtgtgggatgaaaaggccacgtctctttcggcaaagcaattaaaggctgcccccggaggaggccaaaagttgtaagagatcacaccacagggacagcactgcacacatgcattggcaggcaaggcagggagggagggagagtgtgtgcgcgcgcgagagagatttattggtcgtgtgtgcacagagttggtgtgttccacggatctcgcgcggcgggacgggacggcaacggaacggagaagggggctctcgctagctcttgcttgttggcttcttatgcacagccaaaattttaaaaaaaatttgcgggaaaacaaataattttacaattaaagcttgattttatatttgattttgggttctgtcatcgtagtctatttttaagacttgttattaatttaaacggtaaacaatactcactccgtcccataacattctcttagctaagactataacttataggttgtttttttggatggatggagtacatacataacattcttacctataaattatattttttttatcttgtttattttttttcacgccttatcagatgcatctcaattgatccgaacaaacaaagctagagaactaatcgctttatttttttttctatacttctggtcatgaaaacatgttatgcggtactgatagtgtacataattttttttaaaaaaatactaagtacttgtggctgagaaaaatctgtggtgaaagaagtttttttttctttattcctttagggtgtacagtagaagtgagtcaagtgacatccattttgtaactttgatggagtgtgtattactctctgaaatggatgaagtggtacatttcgcatgcattacatgtcctttcaatataattgcctctttaactatgacaaatcaatctatcttcagttaagacatccaactatgtactccatactgtacatgtcatttccaaactctgttcatgtctagcaggttcaaaacttcaccacatgtgtgggctcggcatgattgggtagctggttaattgctcttagctatagttatgatcatgtctcaccaccagacttcttgaaccatcgtacaacattataaattggccttttcattctcatatagggctgaattatgtttttagcattcttccctttgagatgtactacggcttacccatagcagccatgaaattgagcactccaactaagcagaagaactagggaaatctctctctctctctctctctctctctctctctcaaaaaaaaaagaataagaagaataaaaactagggaaatactccctccgtttcagtttataaaacaactttggtcaaagtcaaactgtttcaagtttaaataagtttatagacaaatatagtaatgtttataatactaaattagtttcatcaaatcaataattgaatatatttttagaataaatttgtctttggttcaaaatgttactacctttttctataaatttggtcaaacttaaaacagtttgactttgactaaagttaaaacgtcttataacctgaaacggaggaagtacaagtttacactatcctgtatgtagatgtgccaatgaggggtgtttccttctatcttttttgaacaaatctatgggcaccatctcggtccctcgacccgttatgtttttggcatcaaatgaactaaaaatagcttgatcttatttccatgcaatggatcaaacttggggcaagtttggacaatgacgccacataaaaccctcttttagcaaggtggggctacaaataaaacacaccatcaatctataaacaagtatctcaggggaaaggtctcacatttgaaactaatattgcaactctcgactttccaaaaaggaaaatcattaaccattggcatatacccttgaaaaagctccagttgccatcttacttgcctatgcaactgcccaactacaagaattatagtacaagcactctctaagaataccacaagttagcttctgaagagcatagatattcatgtcatgacaaacatgtctactgtacaacaaaaaagaaaaatcggctaagtagatcactccacaattgtgcgagtagatactagcggttacatatacacgaacgtatatataaacatagttaaaattgctatatattaccataaagctatcgagatgcgcttaattccttatccatggagactagggtgtgtgcctccggtttttattttttttcccaaaggcacgtacacgtgtgtgtgttcgagtttcatcgcgattcgatcgttgtctactgttttttaataatacaacagatgtcctaatcatccacgcatgcataacccacaatcccccagcatcatccatcccttcccaattcccaaatcaccacctctcttcatcacttgggctccagcctcctgcagccccagccaagctaaggtaagctccatctgcttctgatacacacactcacacacaaagcagcagccagcatcagcagcagcagtgtgaagcaaaaatctctatctctctctctcctcactaaagcacaaatcctactcttatcatcctgtcttcttgcctcccttctgcctcctgctcaccaagcttcccacacaaacccaacaagagagtgagagaggagcaaaagctttggctggccgtcccccctgttaaaatgtgatgtccaatccatgggattgcgtctagtttagtcccccactcctctcctgggtcagtccctccctggccaccacctcttcttcttgcagcctcctcctcctccggggccttcttcttgttgattcttttgatggtttttgtgtttcttgtcgacctagttatgggatccggcgaggtggatggacgcgcattggagcagcaacagtagcggcggggaagaaggcggcgggggatctggatccgaggcaccaccaccaccgggtcacccacggcggcgacggcggcggcgtaggaggaggaggaagcggggacaggaggaggcagatgagcagca

SEQ ID NO: 45941 - DNA, 3595 bp, Oryza sativa
tgggctacgaccgcccgagcaaggcggggactggctcatcaagaacgccaaggacgccatcgacaagctcgacgtgctgccggcgtggcagcccactgccggcggcgcaggcgcgggcaatgccgccgcgccgccgtcctcctcgacccaccccgactccgccgagaactccgacgaccaggcgcaggccatcaccgtcgcgcacaccgccttcgacttcgccggcgggggcagcggcgggaccagcttcctcccgccgtcgctcgactcggacgccatagccgacacgatcaagtccttcttccccatgggtggcaccgcaggcggggaggcatcgtcgtccaccacggcggcgcagtcgtcggccatgggtttccagagctacacgcctgacctcctgtcccgcaccggcagccagagccaggagctccggctgtcgctgcagtccttaccagaccccatgttccaccaccagcaacatcgccatggcggcggcggcggcggcggcaatggcaccacgcagcaggcgctcttctccggcgccgccaattactcgttcggcggcggagccatgtgggccaccgagcagcaggcgcagaaccagcgcatgctgccgtggaacgtgcccgaccccggcggcggcggcggcgccgcctacctgttcaacgtgtcgcagcaagcggcgcatatgcaggcggcggctgcggcgctgggtggccaccagagccagttcttcttccagaggggaccccttcagtccagtaaccagccctccgagcgaggatggccggagaccgtcgaagccgacaaccagatgagccaccaccaaggagggctgagcccctccgtgtcggcggccatcggttttgccgctcccggcatcggcttctccggcttccgcctccccgcgaggatacagggcgacgaggagcacaacggcggcggcggcgtcaatgacaacatgccgacatcgccgtcgtctgtctcctcggcttctcaccactgaccgcagcagtggcgagcagatgacttcaccaccaccaatccaccatgagcaaacaccacaccatgtaccagactatcagctagctcctccacttccatcacggtgagaaaaaaaaaccgagaattctcatggctaacctgcattagttcagaatttttctcgtgttagttagctgatcaatcttgtgctgctggttttggtgttcttgacatgcaggaattgtcgattgcattcgggaggagcaaagtttggaggtagcacaagtgcactactactgatgctactacatatcggttggttggttggttggttttccatcgatctcttctgctgctgcgcatgtcattggtttttgtttcaagaattcactcggagcttcttagaattaggcttgtgagaatgcagcaacacgatggcaagctttagcttagcttagcaagcctctgtgtctgttggctgttgcgttgcgctaggtgtagttgatcgatgtaggttcgagcttgctttgctttgttttgatttttactcttttgttgctgatgcatggacatgcttttgcttcctcctgtgggttcaggagcagttgctactagaccgatgttgttctcaaaactgataagtgggatggtgatggattgggagaggagcctatctttcatcttttccaaaacttgtggcctcttttctttatactgtagtgtaggctggaaacagatggtgcatgcatgcctgtgcaacaaatctcccccgccctaagtgtttttctttatgcaatccaagtatctccagccatccttattatatcttgggctttcttcttttttcaaagccttgtttggaactgagaaaaagagccgcatgacaatgcttgctggccctcatatataccttcctcaaaacaaccaaaaggtttggatttaatgcatgctttaagctttgaaaagaattgcctcactcacctccccccatggccgcacacaccctcacacacacacaactgcaatttcccctctcccctatatccatgtgattggttgggtctctttccctgcttctgcatcagcagcagcaggcagccacagctttcctttgcaccgtgccatgctgccatctatcccacctatcatcactgggcatggcaagaatgccacaaggaaaaggttttatgtgtgtgtgacattagtatcctgtctgtcttacatgctcttgcattgccaccagcggcacagtacaagccttttttaaccattttacctcaggctcttcaggccttggcctgctgcctgcactcactgatgcagcactctgtgacagatgccagagaagagagagagagagagagagagagagagagagagagagagagagagagagatgaggggtcggccatgattgctcacttctgctctcttctctgattggcttccacatggacactaccttagcttgtgtactgtaagtctgtaactttaaggctgggtaattagttgtggccttgtgggggaggggaagatgagcttaggcatgcatataccatgatttgagcagctagctaaccctctctcctatatatccctcttctatggggtcgccattaatgactgctttgcttgtaagatggaaatcatggaatgaggcaatgagcaatgataggactaacactgtgtacacccactatactcctaccataggagtacgttgtacaagtggttatcacaagcatgcatgctgccatactttacaggctttaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttatctcgtgaattagcttttatttatgtaattagttttataagtagtctatatttaatactctaaattaatgtctaaagacagggactaaagttaagtccctggatctaaacaccaccttagtctggcctcctttatttgctactccctacttgtcatgactcatgccatgcatgtggaagatatttttggtgtggatatcagaattactacatgcaaatttaacaacacgtagtagtattaagcacttaatgtgttcttttagctgaaagtgtggaagaacatatataatactaggatttgtagtagcagtatggtaaaggcaaggcttaactttttttagtttgggattgttaaggtttatatctagaagagtgtatacttggagagctcttctaaagcatgtcaatatcttgctttattcttgtgctagatttattaaccatggtttttcatttttatttgaaacttcaattttttgcaagtactctaaactttgaattccaatatgtggtgcaacaatgggattgttggttatttatgaaaattggtgtcgttataattgttgccaggaaaaaaaacgaaagtatatatatggagagttttttttaagacttatataga

SEQ ID NO: 45942 - DNA, 6019 bp, Oryza sativa
aaatcagttttcactctaaaattctcctagctccctccttgaataatcatgatatagtatgttatatgaacggtatttatattttttacttaattcagcgtgaaaagtagccataaaaatttacctcgaccatgagaggtgcataattcatcattgtagaatcactaacccattgtaatatttgatgatgaatatatggtattgatctttttggaatttactatatcaaaacaaataaacaattattttaatggtttccaaggctggttggtaaaggaatatgtattatattaatagtacatatgattcatccaaattcttacaatgaggaaagcattgtaggttgtagttatactaggattctaatggtgagagacaaatgcacaaaattgaaagacatcattgcaagaaagcacatgtagtgagtttgatcatcacactgccatgacatcaaacttcaatttcatatatattcttagatgtgcatagagcttggggttagtgttactttttgtgaaagcataacattaatttagttaagattcaagtaaaattcaaatgatgtgtttccatgattacacaatattcaagtacaatgttctatcacctggcttttgcacataaattgtggcttaaactgtacaaataggacactctacaatgaattctttttactcaaaagtctctctacagctagcatatcctgaactaggagtacctatctaaatctccttttaggcaacaattttgcataacctcaatcagtattcatagcaccaatttaacaagctagataaagcaaacatatcaaaaatcggttcaaataagtaaaacattaatacgattagtgtactctaacttatgaagaactaatttaggattatatatggtttccaaaaacggaaaatgaacttaagtaaaacagaaattttgtagtaacaagtatagatacaacagcagggacaaccattggtcgtgtgctatctattactatatattatccaaagatctactctctagaagtttataagttttgtgggcctaaaaattgccactttaatcaaagatgtaaaatagagaaagttatttgcctttaatcatggtcaatctagattataactatagattgactgatggttgtatagagaacatgtcgtcggttggatatctatctttcgtacatggcccaccaaagtttagatttctaaatttgaagtagtttttcaacaatataatttagtaatcttagcaatatatactatacgagatcttctttaatgcttgaaattaattaggacccttgatcagcaatgatctaatggatagagagagaaggtacatggaaaaaggtattaaaagggtatgccaggtatggaaggtggaagggtaaaatggtaattgtttttcattaaattatttttcggtaaagggcaaaagcgagagaagctacaaacgtttcagcaggaggaagaaaaaaacgagaggaagaataagaacgcgtgcaagaggaacctacatgaactacctgctgatcgtcgctgccgtaaaagcccgccgctcgcccaggccgcacacgcctgccgctcgagccggataccgctgtcgcacgcgcccgtaacgcccgccggtcgcagctgaggtacgcagcagcatgtcgccgtcaccgccgccgcacgaatcctcgggctgctatctactctgctagttccttgctcgttctttgtcgtcatgccttcatgcagccagcagttgtattccaggttctgaagatcgattttgccagcaaaaacaaatcaacaatgccctgtgctgcgcatccgatcccctgctggtttctgcgcctaatttggctatttgatcactacgtacatattctgaatatcgattgaggtgagccactcgccacctgcatgacatcgtggatggccgatttgttaggcactcgacggggtgggaattaagcaattactaagctatccatgttaataaaaatttttgttcctaaattagcctttaaagattaacggtggataacaattcgttaaggaggtacctggagtaccttccaagcacagtaaaagatctctacagcgtccaggcgagcgcggtttgccgttagcaagcatcaaaccgactatagcgctgccgtccggcgactgtagctgaagtgaacagctcctcagatccgggagcagctagctcccttcaaatctttttttcctctcatcacatataaaaggacgtacggtacgggccctcgagacatatgcagccagcctcgccaaccaggcttaactttcccaatccacagacagcgatcgacgatgccgctgccgccacatctcacagcatgcagctccgctagctcgccacccacctccgacacaatgatggccgccgcccatgcacgagaggcggctcgatcagcccatgttcccatcgatcgatcgatctcgccggccgcgcgcgcgcgtccgcggcatcggcagatcgggacgtggcgaggcacatgaggctataaatgcgcctccccctgcctgcctgcctgccgggcccgccctcgtacgctgcccacccgcgattttcgtacgacgaaccactggaagaaacgcgataaatgcgatgtttgctgccgtcgttcacccacccgtcgccctcgccggctgccggcagattgatctgcatgcccgggcgacgaacgcggctgccggccgcatatcgtgagcaagtactacttggacccctgcaacgccggcagcggtacgtacggccgcgcgcgaggtgcccaaacgcgccggcgcggcgtcgctgtcgatcgtgccggtggatacatgagctagcacctactagcagtgtggtaatccatcgatggatggcgacgggacgggacattggtattagcggacgaggctactgccgcaccggcgttagctacaggggactactgcatataccgatctcgcggacaggtagctagcatgcagggtcaggtcagtgctgtcttactccaagtcctcgtatgtgtgtgcagctagtagctactccatcggtcccaaaatataagtatttttagactctgacacgatctctgagatactgctttgaccaataatatctataaaagtaaaatgttttaaataaaaagagttacatattatgatagtttgtttaataataaatctagtaatataaattttacatgattgatcttttttatttttttactattaataggtaacgttaaaaatatttgacttgtcattatgctaaaaatgttacgcttgacatgatggtagtcctgtagggattcaggctgctgacagctgccatctcacaagtcacatgcgtcgacatgacatacatatatgcatatgcatgctgacaccacgactccgcaacaagcaaagcttgtctcatgttattcggttccacttgtagtactgtaccactgagcagtggcactgggggtatgtgtctagtaggtcaccaaggaaacaagagtcttaaaatgtgtatagtatctttccatcattatgtttgagtagttcaatttaagggactgtatataatggcagctttgctgaagaaaatgtgaattaaatccacggttgtagcagtgacagatggataaagctgtaaagaaacatagctcgaggcttacgagaagctcaaactcggatcatcctaggctcagttcaacctcggatcgagttttgaatgagctgaccccgaacctaactctaaggctccagggttgcgggctttgtcggatgagctcgaatatcttgcgagcccattgttgtgtgcaatttttattatttatgtgatgaatcagtacatcaagtataaattatattcctgctatgtagtacatattggcatcacatatttatctttgtacttcttctttgttagtgagattagttagaaatttatttttcataaaaatatattttttaaatgtgtgttgtaatatttgcatgccgagctcaagtccacaataaagttgagcctacttataagctgggaagtggactaggtttagctcgaggggctcaagcttgtattgagcttaaggctagacaactagggtcgctcgagcttagcttgtttactgcccttattaaggaggcactagatgagccatatctcatacccctcaagtaaaaacacgcctaaaggtggactcaacactagaataatgcttaggacaaccaactaattttggcccacatcatatttaatatggtaaattttaatataagtcaaacaccttacgacgacgcaggttctgcactcactgcgtccctccccacccactcctagctacctcccccatgaatcccatcgacatatgccactacccctaccctcaaagaaacaaacgagtcttgtcgcccgatgagccctcttgcacaaatctacccacttccctagcaacgtaaccatcaatcaccttctaattatcgtcgctacttatggttgcccctatccgcaggtacatatgtgccctagacatccttctaaaatccacataaacatttgtcttcccctcttttatactaaaccctaacctgatgatctcactagagttgaaaagatgtcatccaagagtttggagcacacaaaccgccaacacacatgtggtaaatttgattgattttttttgtaaaaaaatagtcgatggtctttttaactcacgctgcaataatcgacttgttgacagatcatgctaggcgctgggtagagcagaaaggtgccatatcttggggggaaaaatagtacacgttagttctttaatttgcttctgcttccacaccacgatcacctgtgcaaaaagaagttggatgccattctttcgctttaagatgttatcgacctacctacatatatgttcactttatcacacaaattgtgtccaactttttctccgagaggacatacgtacataactaacaaagctaacaaagtgcagctccacttaatccgaagaatcctgcaaaaagaaatgggctgaaatgtgctccctgtccccttaaagaagcgagccggaatctaccatttgacactttggtaaaaaccccctcatttcatcagatctacaggcaaagctcaacctgtagggttacatagggcaatggggtccaagctttttttggcatctatgcttccatgcatccgactggtagatggtcccccgtagtacgttctctccgtcgatcgccgtagtgccaaatcatatcaatcatgcgcggcttcatctcaacaagaacatggttccctcctagtagctagcagctgcttgcattgcatgcaggtaggtacagtttagcacggctttcagttgacagcaagatgcatattttcgtgtagccgggggacctctcgaatcgctgtcatgcatgtcacaggggagcaacgggacgacgacgccttaactctcgcgacgacgaaagtatcacgataccagcacagtttacagggccggccggggggcgtcgtcgcagctggctggtggctgcgcatcaacggacaacgggatcagagtaaaagacgtgcagagcgcagttgaaagggagagagaagctataggtgggaaaactcgattcgtcccttaaggatatccctcattttttcatgtcacttaaaaagttactaaaaaattgaaaaaaaattagtagcatagatcagtatatgatatgtcacttcacaaacatacaaattcaaattcaacttatacacgtagaaataaaaataacaaatttaactatgaatataacgcataattcacggtcaaatttattttttttgaattgtattagtcgaattttaactcgcatgtttgcaaaaatatatattatatattgatcaatcttgacaaatatttttgaattttttgataactttttaaatgacatgtataaaacgagtggatgtcctctcgaggggacaaaaatccacttccctataggtgagtgagagtgagagtgagaagtcgatcgggggaagtatcgggtgc

SEQ ID NO: 45943 - DNA, 1789 bp, Oryza sativa
ttccccaagtcgatcgtactagctagctatagcctgcagctgcagtgtgattaaaaaggtggactggagagatggggaaagtttggacgggtgaaaattggccaaaccggagttcagttcctagtgtacggtaaacgtctcaccattcacgtcacttttaattatggtcggacttttcatctgcctttagttcttggtcattcaattaaaaaaatgtatagtagtagtacataattttaccatgcatggacccaaattagagtgatttggacgatgcaacatttagagcatcaccaacctcctattccatccctaaaaccaatttgaagggattttagttaaaaaaaaaccacttcaagaaatcccctactccttcccttcccgaaatcttctcactgttgatatgcgggagagcgcgcccccttgcccactcccaatctcaccgctcccagtccctcctctctttcccgcacgtcagatggaggatctcgtgcccaattccacgcgttagatggatgaaaacaagagaattttgttggtagtttaacagaagatagtttgtcacgtttaagatttgataaaatttaatcaacttgttaggtgtttggttataatcatagttgtgtcaagattctgttccaacaaattggatctcatgtgttaataacttataaaagtgtgaaaaaaatactttaggcttagtaagttatggctaagaatttgatatcatattttaatgacttaaaaagatgtggtaagattcctttagtcttagtaattaagttgcggctaagaatttgatcgtctcaccttagatgaagtgtggtaactgacggtaaagtgtggctgagaaccaaacagaccctatgtaacgtacctgaattctaggattaaggaatttccatcaaaactagttgaaagggaagttcttcaattttgtaaaccaaaaatttctattttaaacctaggtggagttgatccaactcttgcaagaataaaatttgagaaaaaattaaaaactttttcacctttaacctaggacttggatgcaacccaagtgaaagcatgcatacttgcataaatcatattttgacttgagtccttcatatgcatttggattttcgatttgcatttcataataggtctcatgaatataattgcaatctagacaaacaactaaaccattagggcctagtgctaactaatggaaaataatacacagaaaccatacaccttaaaaaaaatcaacatggctaatgtcaagcctcacaaaactaatttggacatccatctgaagacatgtcatgaacatgaaagtgaacaaataaattatatcatatagggtatattctattttaatcatctctataagcattctcttaatttaatactaaagtaaacttatgcataaatagggaaggagcttatgacatgtgtaaggtaaactgtaattctaacatatcaacatcacctcatgttaatgagagtccaaatataacttttataaacattttcatgcatttaggaaagggaaacacatataagacataagtcctgcgaattatctaaaataattcatgcaagataaaatcatgggaaaattcatgtaggctctactcaacacatacaactcactgtaattttggtataatttaataactaaatttggtacctcaaataaattagtcaaactaataaaaactagattaactgtagttcttaatcggctcaaaccatactttgtctaaaaggcatttaactgcataaaagtgtataagtaaaataattt

SEQ ID NO: 45944 - DNA, 7744 bp, Oryza sativa
tcctgcagcccttaaaatcattcaaaccttttgttcacccacgtttctgcccaaccctctcaccctagcttagtttgccatgacctgtacccacttggcagccactctggctcgtcctcaccctgtgcaaatcttccagccggaccaaagacagccgagagagagagattggcgccggctgtgtacgacgcgtggcctcgacgtggcagcgccgaaccgaggcttcacctccacccagctgcgtcgccattcttcacccaccatcccagtgccgatccaaccgagggaggaagctccagctctccctctccacctctctttcgtcgccggccgccaagaagagggacatcgccaaccgttatcgagccctcttcatctctaactcatactcgttccattctcatctcaccatgacgaacaactttggttttgatcccattccatttcatcttctacagcagcgggaacaccgccatgtcatggtcgctctagagcgcgctctgtgcaccgccgcagcgacatcatcgccgttcccgcttatctggaccaagccgggccaagctgtcgcgccagcttcttcgcctcgacctcctctccatttcccctcaagaatctcgaaggatggtgctacgagtgtggagatcgtccaccgtcttctccacctccggtcaccgtcgccgttgccgaatccaccccctccggtgagtaccaacccaattccatgcatcagtagcatctctggggcctctctaacctcatggacacacatgcatgatagttcttggagctgattgagccatcgccgttcacccggaggttcttgccgccgccgagccgttacacgagccaccgtcataaacctagctaccccagccatgtctaccatctcggtgagcacccttccgcctatagaacatacatgcatgcacccaattaaccaatacatgattgtagaagcacatgcatcaccacccgaaaacatcctcctttcggactcgccgccggcgttactccgatgtccactgaccgagaaaagtagaggaatggaatcgcaataacatgatcttcattttgtattttggttgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgaggctaggtcggcgggttgattcttagaaacctcagggatctttttgtatattgatctttcactgacagtggaccccttggaaacaaaaatctgaaattataaaaggaaagtacctaaaacttgtaaaatccatataaaattaaatatagctcattttaagatgatacaaatttctgtcaactcaccaaattgtgaactatagtgttatggaataaaaacttgcactcacagtacaaatttagcctctaaaatttatccaagttaaatcacacataaagcatgcacaaatttataaaatgcatacaaaattcatttcaactcattttggagcaaactcagtttctacagatccaccaacttatgttctcctataaagcaaaatgaaatagtatacatactatacatcgaatgcctctaaaactattacctttaaaatgactagttttacataagctgaactttagaagtttatataaaattcatcttagatcctttttgagtaaacccaaattcagtagaatcatagggttgtgcacttcaatgttataaaataaaaagacatacttacagtataatgaaaacccctaagtatttaagtaaggaataagcaacatggagcataccttaaattgtaacatttgtagaaaattcatctatagtctaaatgaagtgaaccaaattttctatagaaccagcaagtaatatacttcaacctagtagagtgaattatagcaccctcttacagaccatggctctgaaccttaatttggtagaataggtactaaacacatagtaatggttaaacaatacatatgaaaaagtatatatatgcttggtagctccaaataaatccaaataaaacttgttgaaccagtgaaggcatagatccatccccttccaccaaaacttagtatccttaacttatataataatctccagattaatatgttaagtttctaacatagaacatcccctagcttataaaatgtgaagtaaagtaatttgaacactaaaattttataaactaagattagattagttaactaaaatactcattttatacaacactagcaagttagagcaagttctggatctaaatctccaaagccatgtacacatagggaatatatgcctagaacacgttaaaacttgtaaaatacataaataattcatattaactctaaaaattatgaaaccaaatgtgttagtcttagaaaacaaatatcttcaccccagcaaacataaacttaataagaatcaccttacaacagcatttcacaatagtaactaagtaaatcctacactataccgacgaaacttctaaaattcataactcccaaataaaatgagataaaatagaaattctttcacctaaattaattttagaccagtacctattcactgtgcacaaatcatccattttagagcattttggatttttcgcatatttcggtgtttaattgcataacgtgtactttgtatagatgattgcttaatcggtgaagaagtgatttaggtgctgacattttccagttgcaaggcaagtcccacctccctctctttgatcactttgaacctatctttggaggttattgaaaatgtttgcaaatcttgcatgtcgattgtacactaataaattaaaattttgttaaacttgttagataaactcctattatttgcattatcaccttaactccacatatatccatattcctcattcctaaccttaggaacaatatggctataccactttatatatgagttttggtgacactaggttactataaagcatagccatgcttagaatggtcttccttgtcattatgggctcatttcaaacatgaaaattgatttttaattaatctggacagaactttaatacttgtgattttgataaataaaatggtggaaagcatggattttaggtttgggcctcaagtggtgcacatatggtgattagttgtgtaccgatagggggagagtgcgcccaaaccgacctaaggacttcactcaatgtcagttcatttcgtatacagtacaaccacatgtgctagtatgggatagtccaagcttagtaaattatttatggtttagccttacattctggtaggccggtgtgtatgagttcggataactcagaggaacttcctatttaccacgacgtggtagtttaggtgactaagtctgtccaatacaatggtattatgccacgtgggtgggttcccgttgtgtccgccaccacggcgttaagttcaaggcgtgggcccgccacttaacggttctaggtcatatttccagtatgactaggatggaggaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctgcagagttaaaactaatcgattagccgtgctcgcggtcatgagcggcgtgtggatatgtattgagtatagacttgtgtttattctcctaaatgctgaaatttaccttcaaattgtgatgagatttgagaatgatctccttgctgccatggatggcaatgaggtgaatatttatacatgattaatgcctactttgatgcccatatgctaagtactagcttgctgaaattttatttgaaagcaaatccgttttgaatgtgttttatgcaaataaaacttgctttatgctaaaaagaaccatactatgccttccttgattatataccttgcaagtagggtgttaggcttgtcttggtgcttgccagtacattatttctaataatgtactgactcttgctgttgaattaacttttgcttgcaggatttagacttagtctttgagtgatgcgggttatcgactgcttcttctaggacttgaacataatgggtaaacccctagtcggtgtgcttgtggattgggtagacaagtttccgctgttctattatttatttggccggtcggccaatgtaactaaagtagatgtagtttataatcgctttcatcttatttgtgtttgctatgtataatcatgcttgagatgaaagtgtgaatctagtgcacatcctgggaactagattcacatgagtatgagttaggaatatttgagatgttgtagaactttagccatttttgtcaagtctcctgaatgtgtaacacatctggtcgccgccttcgagtggtttgacgggcacgtctcaggctgaagttgactggcaggctaaaggcctagcaatatctccaatattcctctctcgaggcgtcggatatttcattatgcttgtttgatgacttgaattattcacttcatctctcaattataatggaaggtccggagagcctacgacaccctaaatacatgaataacagtgatgccactataccgataaaaaaaacaacaatgaaataaaataaacagtaaaacaacatgtcatccatacctccggctgtttaccctatcattcccttctttctctcctatacgatgacaatccaatccatggtaagaaatcacatgttgtgtgatgatagaccgtggtgaaggtaggatttaagatttgaggggagccaacttaagctaaatatagtaatccaaaatgcttaagtgttgaaagcttaaatggttacaccaaaatgcttaaactaatcgtgtaatgtagttagagaattattaacaagttctaatataaacagaactagttggatggcccgcgcaattgcgcggctagtatcaatttaaaactatccttttttacacatgattttatttaaaattatcgttcccgtgattataataattttatagttttaaaagccacgtcagtcgctacctcttactcctttatcacatttttatgtgcttactcaatctgccactacttctattcatgctttttagaactttaaaaattaggtcttatcgtttttagagttcattgtcttgttgggtttcgttttatattttagaagtatcgtcaaacatcgacaatttactattctacggcccatccgctgccacctctctttattgtcactaggattttaaaaattgaacacaaccattgtgtgtgttttttactttctataagtctcgtcaaattgttagttgcatcgtcactatactcctgtataacccgcccgctgcctcccctccttattatcattgagattttaaaaatcgattatgataatcactggagtttatttttactctccataagtcccgccaaccgtcgtgaccatgctgcttaatggcatgcccattgtcactcctcttaatcgaattctatttggggtttccttatagtttttagataccccataaaccgccagcactctcctcatttacaggcctattgcttctcccctctttattgtcatttgtcattgttgtgttctagatagacttttttttttaaaattatacatttttcactctgataacttttattcataaattatattcttacttgaactattataattatttttatatttttaaaatttattttatttgttatttagaactttaattattttcgtcatgtgttctagattgtctcttatttcaacagtctttgttttttttactacaaattagttatttataattgtattctagttgagctcttatttttatttttctaatttctgaatttattttatttttatttcgaattttaatcaatctcatattatgttctatatagactattaatttaatatttctttttttatttccaatttcaattgtttcaaaattgtattcctacttgaactctctttctaatattttataatatatgattttattttaatttttattttgaattttaattaatatcgtgctagtttcttatatggacttttctttcaatattgcttatttttaatttcgaattttagtcattttcaaattttattcctacgtgaattcttcctttatttttttttctgatttcggatttattttatttttattttaaattttaattaatcttgagttggattcttatatgaactcttctttcaatattgcttatttttaattccaaattttaattatctttaaattgtattcctacatggtctcttctctttttttttttaatttcagattttattttatttttattctaaattttgattaatctcgtattgggttcttatatggactcttttttaatattgtttttttaattctaaatttcagctatttttaaatgatatttctacttggactcttcttttctttttcttcaattaatgtgagaatttctagccccccaacgaacgtggtgtctcctttcaaagctgttttaataatataatagatagatagattgatagatatgcatcattgggggaggccaggcctccctccgcccctccctaactttggcccttatgatagtcatggaaaaactagacctattagaattgaaattgtggtatccacaaatactatgcatacacatatattactaagttggggtagagagtgggggtgtctatgtgcagtggtgacaggtgagtgtgcaaaaatccaacccacaataccatgcccaaccgatatgtgcatgatttagggtgcgtttggttgacggtcaaggttggatgggatatggtggccagattttgatcgatatggcgatctattttttgtttcgttgagtggatatgcgaatcagttttttgtttggttctagggatgaaggtggatttggtgatctatttttttgtttggttagagagctaggaaggatgaatggttacaatcaccccttcattagaggcggtgagtataccccttcatattcataaaagccacaaaattattataaatctaatacaaataaacaaatctaaagagaaataaaaaaatcacgaagaaataaaaagaggaaaaggagaaaaacaagaaaaaggaaaaaaaagtcatcctccatcttctcgccggccgctggcttgctcttctcgccagccaccggcgcatctccttgctcgccggccgccgcctaattcgctccatcgtttcgctcgcttgcgtggtgaggggtgacgcgatccacctcggttggtcgtccagctcgcctgggcactctggcggctgcgtccaggcaaatcggccggatccctccatccggcatctgggaggaatattcccctccgggtcgtcctatcccacctccacccaccaaccaaacacccaaaaaaagggaccgtcatgtcttatccacccaaaacccaccatccaaacacaccattagagtttatacctgtggtatgtccgacttgaatcccaagtacaaccgagagttttgtgttgtatagtaatcagtatcatgtccatgttaaatgcttgggttgcatttttgatgatattattccgcaaaggtctttatatgtacaaagtttttttttcctaagtttattcatacaccg

SEQ ID NO: 45945 - DNA, 1140 bp, Oryza sativa
tatttttaattccttattttaattatttttaaattatattcctacttcgactcttcttttattttctaatttcggattttattttatttttattttgaattttagttaatctcgtattgggttcttatatggacacttctttcaatattacttatttttaatttcaaatttcagctaattttagattgtatttctacttggactcttcttttgattaatgtggaaatttctagcccccacaacgaacgtggtgccttctttcaagactgttttaataatataatagatagtatataagacttttttcatatataagttggcattgtgtggttcttatgggtgaggatcctctaccataatctcactatcattatagtcactagtgtgggtctcacccttctattgccacacctgacagtgtttataataataatgttataatggtaggggatgtgaacccgtttcttgtgttggacggggattataggggagattacttacaactaactccatgaaacgtcgatcttccgtacgtataggcattgatatgcaccttctagcagaggtccttaagtaaattaaatcctgcagaagccaacaaagagatcaccgaacgcgaagcagttgaaattaacctagaaaaaacacggagggaattaaaggatagaaaaccaaccaatccccaccggggatggctgatcggcgatcagtcgcgcgcggcgcgcgacgcgtggtcagtacatacatacatacatacatacatacatacatacatacatacatacatacatacatacatacatacatacatacatacatacatacatacatacatacatacatacatacatacatacatacatacatacatacatacatatatatatatatatatatatatatatatatatatatatatatatatatatatatatatatatatatatatatatatatatatatatatatatatatatatatattgtatatttatattttttgtgtatatgtataaaaagtatatacacaaatataaaatttgtatacgatgtatacaaatacaaagtttgtattcgttgtatataaagtttatatatgtatgtatataaaatataccaactttatatatatgtatataca

SEQ ID NO: 45946 - DNA, 26736 bp, Oryza sativa
tgtatacgtgtatacaaactttgtatacgtacatatacaaactttctctccgtatcttttttttatacgtgtatacaaactttgcctacatgtatacaaactttttacacatacatatgaaaaaaccgaaaaaactggaaaaaaaatatggatagaaaaaaacggtgcaaaaaaaaacgcggaaaaaacagaacaaacaaaaaaaaaaaaggaacgtgcgggaaaaaaggaaaccgaaaaagaaaagaaaccgttcgaaaaaaaacacggaaaaaaacagaacaaacaaaaaaaaaaggaatgtgcggaaaaaaaggaaaccgaaaaaaaaaaaaaaaccgtgccaccgcctgtgccactctccacgcgcgacacgtgtccagtcgcgcgagagaggacgcgcgcgactgatcgcgtattagcgttctcgatcccgacccgttcagtctgggtgaaacactgaaacctccaaacgccagtcaccggcggcactccgaaaaggcaagtcccaacccgttccagcccaacccagcctccgcagaagagcccaatagattcaccctcatgggtcgccccgccggcccactttgcacgcgagtattgcctgcgcagcccaacactcggaccgtacagcccacagaaaccttattgtcggccaaggcccaaaggcatctcaaaacactcgaattccggtccgcggttgcacaccacaagacagtcggcagaagagttttttgactcctcaatccattgaaccttcctgtccccttccttgatgcaggttggtaattacaccgaacagcgacgtctcatccaagtacgcttaaatatctcgttcatttcaacattaactgctcctgttcgtcgaatgcaaaatcggcagacagagaccggacgaccattctcgaggctaaaaacgtctaacgttgaacaaagcaaagcaagtaattgccatgtacagatgtactcgttggtgatgacagtgacggaatccccatgttgacctgctcgtctactaacccaaggttagcttatccggtgttgattaaaccggcggcgaggtagtagtagtagtagggctttgctctggtcttgcaagttaggttagtgattagtagcagcagaaagagtggaagatttagaggataagggatagtttggtcatgtcggatacagccttgtcgggcgcgccgccggcggcgaggtcggaggattcgtggagtcagcagcagagctacaacttcagcgggcgcgtgctgctcacggccgtcgtgatcctgttcgtgatcgccgtcgtcttcgccgtcacccgcgtcttgctgtactacctcgtggtgcggtccggcggtggcggcggaggccgtcgtcgtggcggcctggcaggggggatcttgcggtcgttgaactcgctcggcgtgagcggcgccgcgggctggacgcgtccgcgctcgccgcgctgccggtcaccgcgtaccggaagaacggcggcgggggcggtggtggggagggctccaaccgcggcgggcctggcgccaccgccgccgactgcgccgtgtgtctgtcggagctcgccgacggcgagaaggtgcgggagctgcccaactgccggcacgtcttccacgtggagtgcgtcgacgcgtggctgcgctccaggaccacgtgcccgctctgccgggccgaggcggaagtacccaaggcgagggcttcggcggcggcgacggcgacggcgcagtcgtcgtcgtcgctcggtgacggaggaattaccgtggtcgtgaccatacacggcggctctgacgaagccggtggcaggtcaacggcgttgactggtcaaccgggatcctcgaactctcctagctgcgaggctgcaaggaattgaggatcgacgatgacgacgaacttcagagttgtgatgtgattctttattttgctataggagctctatcaagtgtagattgtgaaacgcatttgtgatgtgattctttatttctttcccatatatagctaagaaccaactgcataatacattccccgcaaaagaaaaaaaagcaaaagtaaagtgcttctgtggtaattgttacgagttttggtccattgaatatagtcaagacgattgcatagctttgacatttgtgcaatacccaattatctaacacctcatctcctccctcctcactcctaccctgccgccatgactcaattgagagtccacttgatgccgccgcttcctctgtcgtcgtctagccttattggccggtcagaatgcgccaatggtgccagcaaggccccacaaccggcctcatcccctttcctagctttccttgtagttggccaaatgggccgcccggcccggtccgagcacgacaaggcacggcccgatcgatacgtcgggcagtgttgtgcccgcccatgggctgcaccaacagctcaggcacggttcagtaagaagggtcatgctgggctgggccgaaggcacaacaggccggcccatcgttctccttggaataagtctatttttcctccctcatctcttgggttgtgtcttatatgggtataaataagtctattttgaatccctcatatctttgggccatgccttatatggctagaataagtctatttttccttcctaatctatttggcctccctaatcatttgacctggtcgtgctaaggaagaggcccaggcatggcccagctttcgggccatgccgtgggctgggccgtcgggccccgacccttttggccatcaatagctctcatcctcctcaagctgatggcggcgaggtggccttacccagccatcgttcacgtctctagcagctcccatggctagattagccaacaccaaccacatcctcctcttaggcacaagcttcagtttgcccttgccgccaacaccgacccactaccttcctccatccccacggcttcatcatcggcaccggctcctcgcctcctgcccatgtcgatcgcccaacgcttggctgcctttttccatggtcatcactcttaagccaaacgatgttctccctctttcccctccccatttcctctctcaccccaactcaataccctaaagcgcaactcgcagggacatcgccggatagaagagaagtgttggggtcgctggaacatgaattgtgaagaaaatcctaaggttagaaattttcaaagttttggtctcaattttctaccaacaaccatttagcaattctgactatagaagggctttagggattgatttccatataagttatatctcttcacttttgttggtcaaatttgtcttctcatcattatttgttagatactttcatgtttggctttttatcaaaaacaatgtgattagtagttgtagcttctgttgaaacaaaggttggattttatatagagtaaatttcactttaggccatcattttattaccgatgtttcactttggaccactcttttatctattatcttaaaaatacatttgtcagatgtaaacaatgcatttgtaaagtaaaaacaatataagttgcatgtgactacaacataatttctatgtgactttcacataattttgaactattagatttgctttgagatacatgaaagaagggaaggaaaaaatcaccgtgtgcaaatgggtgaggagatttgatgatgcaacctccacttcacaagagtagcttgttactatggtatttttgaaagtttcgtataagttatactgtagttacatgcaagttacatactacaatataaatgcattacggttgcactacacttatatctgacaatttttttagagaaaatttatcgatagatattataaatagtctcagatgctcccacctctccttcaccagttaccacctttcaccgcctacattgatgattagccaccacgcaaacctacaccaccatagctaccggcttgagctaaacttttgcttccatgctgtttctctctttctccctctcttttcttattacatcctcagattgtcagataccaaacgaatgaaactatcctgagaaaaagtaagattaatcaaccatatcagttcatatctaagaacaaacatatttgagaatggacaatagtaaaattagggatgtacttcagaagctgtcggaaggaaggtaggaccttcctcttccaccaatacaactgagacctccacgcggttctaccgtcgccaccacaaatgagtgcacatgtatgagtgcacaaattggggcgaattggactggttttgtctggtgtcttgttctactcaagctcaacttgacccattggcattcttacacctttaactaaaacccaatgaaccggcttgacccacttacagtggtttggtttggattgggttgacaggttaattggtttaattttcaaaaaccatgaacaaccatacatacatgggcaaagtctttctgcataggctaacggaataccatgaagaaagaggaccagggtggcatttctttgataaagtaggtgaaatcccgcgtgttgttgcgtttctttgaaaaactaggtgaaaccccgcgtgttgctgtgggagtttagtatgataacagtaagtaaaaataatgtgtaaaatagctagacaacataacattacgtaagttaatgtggtctatgataatttaaatttaaatagtatatagaatgatgatttaaatgtaaaagtaaggtgatatgactttatgaaagaagaaaagtattgagatagtttggaccgtagattaatcatctaaaggataaaaacagttgaggtgatatggcttaattaatgagagaagaaaaggtgagagataatttagaccatagattaatcatttaagcactaaaaacaattgatgtgatatgacttaatgagagaagagagaaataacattgacgaagtgaggatgaactatataggtacatagcatattataaaaaaaataaagatataaattgaaatattatgtgaattatgtgggatgatgatttagcatgctttcattttaaaagctctaaaatttaataattataaaataatagataatatagcttgttcgcattatgttcaaatttgatgattgttagtggatgatgatgtggcatttttgcatattaagatttaggagttagtgggttataactttatagtaagagatgattcgattgtatgatagtatttatttttgtagaacttgtacttgttgatgatagaacatagattctaaaacttatcgatggcaaaacctagatttcctctgaatttttattttattctgattttcatttagtcgtatatagtatttggctcgaatttttcagtttttttctatttttaatacggaattagatatttttaaatcgatttttcaacagggatttactacatatgtttcaaaaggcgtattttattttgttaagacaataatttaatcaacagttgctctattagaatattatttgtgtaataaagaaaatattagaatatcataagcaattagtttttttatattaataaattaattttgtgtgataaaattatatcgtagagtaatcattggttaaagtcttgacctaacgaaacaaaacacacctatattttaagatgaaagtaataatattcttcgtctaatctaaaccatcatatataattgtctcccatgctaatataagtgatatatattttttatttggtttatttgctaaatctaagctttttagggcgaacgtgaacacataattttatatttccttaagtaagataacaacttgacaaattctcatagagagagtgtacaaggttttcatccttgttaacctcaagggtaaacggctcaaggacattatctgatgaacttcaaccacttgcatggataagactaattatggagtctcttgaaacttttcattattgcagtttcctctgtaaaatctttcattttttcttaaaaataaagtatgataattaatgcatgcggtttgtcagttacttgtgccaaagcattccaaaaatagcaaagatccaacactccacaattaaaggtatcatataaaaggtatttaagtattgctatagatacttaggtaggaagggtaaaaggataattttcttaagagatgaaaaatgacataattgtcgtaatattagttggaggtacattgataccgcatcggtagttcatgaccatcggatgctctaattctccattgcattatttgcgtactttttttgtgatttacatattgtttctaagaacacggtcgattaaaatatcaacaaattattgtgtggtttcacgaactttgtggttggttaaaatatccaatctgagatattcacgaactttgtgtcgtattttgaataagacgaatagtcaaatgttagtcaaaaagtcaacgacgttatacattaaaatacggaggaagtagtttactgtgagcagttttcaatgaagagcatcatcatgtggaccccacctttctaacccctcccactaaaaggaattctagaggcgagacaagtttagttcacacgtgccctatacagggtatatctacgtgcatgtaacatgcatgcgtagtggtacgtgcgtgcgtgctcattcttattgtaaaaaaaaaaagagagaaaaaagttagttatcaggcacacattttacgagcctaaaattcatcaaaatcaataaaaccacatatattattcgcattgcctcaacaaacaaatattattttgccacgagtctaaaatttatagttggccataaggcccgaggcccgaaggcccggcccacggcacgcctttttggcccggcccaagcacggcacggcccgacttgggtcgggcccgtgctggcccggcccgaccgtcgggccgtgcctgggcctccccaccggcacgctgggctggcccggcacggtcgggccggcccggcacgatgggccggcaggccaggcccggtacataaagtatggggactaaaaatagacatataaatgtaactgtctaaagaatagggaccttaaatagacttattttagctatttatataccccagcccaaagaagagggaggtaaaatagactttttgtagctgtacatatgtcacagccaataggagggaggaaatttagacttattctgaggaaaagcacgacggcccatcgtgccttcgggccggcccggcacggcccgaggcgtgttgggccgtgcctgggccgtgagtgcggcacgtgggctggcacggcacggcccggtgcgtcggtcgggccgtgccggcccgacaagcctcggcccaggcacggccgggcctgggccgtgccgtgccgggcggcccacatggccaactatactaaaattcatcaacatcaataaaacacatatattattctcattgcctcgacaaacaaatattattttgcctccaagaggcctaactaaataagctcaattatcgagacacatcagcattttccaaaatgctatctaagaagagacagacagacagacagacagacagacagtcggttcctagttcctcagaaccatgcaccagcatcaccagtaatgttgtttccccaaccggacgaagacgcatgctcgacttccggcaaagcagcttcaggaacaccaccaaaatcaccagcaggaggaacgcccatgttatcaaccccggagccgaagtagatctgtccatcatagagaggagaggcaaccaactgttggtagccgaacgggttgtcgtcgttgcctatagctgcaaagcctgcgtcgccggcgccagcggccaccggctgtgcctgtgagagccccacgttctcaaacatgtagtcatagttttcatactcttggggttgctgctgcacggccagatcttggttatactcttgtgctgcaggtggcaggtgagcttccaaaggcatctgcaatggaggtggaggaagagcatgcacagatttctgatcagccattataagtgattcttggaacaatggagcctcgagtgggaagtgatcagctcccactggcatcagcaatggcgttggtggaggagcatggaccggtgcttgatcaggcatgagaaatggttcttggatccatggagcctccagtggcatgtgagcttccactggcatctgcaatggcgtcggcggaggagcaagcactggtgcctgatcagaaaacagaaatggttcttgcatgaacggagcctgcacttgcagtggcaggtgagtttcagccacaggcatctgcaatggcgatggcagaggagcaagcgtcggtgcatgatcagagaatagaaatggctcctgcagcaatggagcctgcagtggcaagtgagtttctgccacaggcatctgcaatggcgccggcagaggagcaagtactggtgcttgatcagcaaacagaaatggctcctgcagcaatggagcttcctcccgtatcagaggtagtggtgctagctgtgtgctgacctgtgccggaggcggagcttgctgtgattcaagaaaggatggctccatcccggcaaaccgtggtggtcgcagcggaagcagaccagcccatggcgacccctccaccggaggtggaggcagctcagggatccagagagaccctcctgctgctggcggtggaggtggaggtggctgatcagcgacaaatggcggcggcgccacaggaagcaactggttatgaggaccggacagattcggccattgcggcagctgcagctgttgctccggctgcggcggtggtggcggcggcggcggtggaggtggcacgctagagccctggattggccgcttgccaccgcgacgacgtagcgggggtagccgcacgttgagttccttcttgatctcaagcatctcagctaacagttcattcatctcgtctgagctgagcttgtcggccttggagaagaagagcttcttcttcttcgtgtcaccctcctcttcgttctcctccttcttctgggccatcttgaaccgagctttggatgctttcgtcgtctcatccttctcggcagcttcacccttcagccaagccagctccctctccagcggcgcgatcctctccatcagctgctcgtcggcgaccggccgcgcctcagccgccgcctcctccacgtcgcttgagagggcggcgtcgacgacggcctgcaccgtcggcgtcccgaccgcgtggaacttgctgcggttctggtcctcgatgaccacggcgacgctagcgccggtgaggatggagaggtcgctggcgcacttgaacagcccgttccgccgcttgaagaaggtgatgtcgcgctccctctcgtcgtcgacgtacgccgcgccggtcctcctcgccctcctcggcatgatcggcgatgaggggatcgatggaggtttataccaaaaagagattttgtgagagaggcgaaccctaaaatggaaatttaataaaagattagtttatagtgatagacatataagctagatctaaaaaatataaacatagctagatctggaaaaaaaattatagctagatctacactcttgtttctggatttaattgcttttaatgttaagtggttccaaatagctagtatatacataattatatagatgcatctaccatttttgttaaaaaataaactatggacatatggctaagcatacatatgattcatgttaaagaagagcatcattatcaaaattaaggaagatgtggctacttgggtaagctggagctgcgaagctccgtgagtttccttcgttaggagataactcctgattttttttaatcattttacgggcatgatacttgatggcggatggcctgtgtatatatatatattttaccgcaatcgttcactgctctattaatacaaacacggtaaaacttttgtcgcctctttaaaaaaatgttagtgaacatctaaaattaactacgtccatatagctccactactctatcaatacaaacacggtaaatcttttgtcgcctttttaaaaaatgggttaatgaagacctgcatctaaaattaaatacgttcatatagctatgcatagatatgaatcatgtcgaagaaaacatgcatctcctctaatggagaacaggatgtttaccttagctagggagattacagagatctctggtggagaaggaaaccattaagcgagagctacaaacatcttgccaccttgttggagaccagtcatggtgagacaggcatccgaaaggagatggaagaaactactaaatgatttcttaagaggtatatgtggctatagcaagaatgagctcgatgaagaacaaagagggggaggccgccttcttatatagggaaatgaggggtgtcataataagaagattttatccaatgtgtttttgataaacatgcaaactatagaaatcctaccaattgtcactgacaggatggtcatccttttacatgggtatggtgggtccatttgtcagtgaaaattggttctaacgaatagtagcattatgtataagttcaataagaaaacattacaatgtttcaccctatgagcacactaaaccactcaaaattcatcacagtatggatcaaccaagtgtgctaagaaaactctattttctatgaagaaatcaacgtaaaattgtagctccccgcttaaaccctaagttcacctagcagcattaggtcgggccgggtttcccgggcaaagacataatactatttgaatgatgtgggtgcaactaattattaagaatagtccgttatgtctaaagccaacggtttcgtataatgattagttgaactataactatggtcccacgttaatataatgtggcgcttcaacatcgtaaagacatggtacatagtaaagttattccatttaagttgccacaatactaaaagttattctttttttttctaataatagttctcttccaagcaacctaaggctattttcggcaccccttttctgaacgactcttcctcgttttccgcttgcacgcttttcaaactgcttaatgttgcttttttgcaaaaaatttctatacgaaaattgcttaaaaaatcaaattaattcatttttttaaaaaaaattagctaatacttaattaatcacgcgctaatggaccgcttcgttttctgcacgaactgttccggttaggaacgtggactagcgaacacagcctaaatcctaccagtgtccccattcaatacacaaaattttcatagaagattattttccacaagcaatacttccagcgtgttgtacaaaataggaggccacatttcgttctgcctgtgtgattccaacgtgtcatatgcatttcagacgaattttagccggcacaaactagctcatttttatcttccagtaagccgtttcaatcttgcaacgccaagtcaacatttttgtagcagttactagataattgcgtacaatagaagcgtctgcattgtaccgtaattcccctccgtctttaaccccctcttttttgaggataaccgcgtacgttttcttctgcctttttatagggtatataataatataatcttgtacgtatacagttttagatacagagcttggatgaggacgaaaacgcccgttaccaatcacagccagacgcggtaaaaaaaaagacgcgtaaaatcaatagcaagcaaataaattcacctcattccatatctgtatttactaactatagcaaacatttattcgctttcacaccagtaataaaggtaccgaaaaactgtcaacggaacggaaaatactgtaacggagctgaccgctatcatcatcataggaaaaggtaaaactgggaaatgggctaactgaaacctgtgggacgggcccatgcgaacgcaggccggaccgtactgctaggcgggccgccaacttgggccaaacaaacaagggcctagctggtccaaaccaagcgacaacgtggcaatccaagcgccagctcagcacacacgtcgtcttctcgtttaaacagaaaagaaacgaaggtcaacattatatacggttcgttactaagttcacggtctcacaagtcacaaaagtcccttccttccaccaccaccaccatgtcgtcgtcaaatggcacgacgacatacttgccgggaggagaggcggccggcggcggcggcggcggcaactccggatgctgcagcaccacgacgttgttcggcgcgttggccgcgtcgttcgccctgagcttcttcctcatcaccatcttcatctgccttcgagcactccgcgttgctcgtcgccggcgtgatcgtcccctggtcatggagcaggagcagcggcggccgacgccgcctaggttcggcctagacgccgccgccatcgcgcgcctcccgtcgttcccgtacgtgcgagcccgtgacgacggcgaggtctcggactcggcgtcgtcgtcgtcggtggagtgcgcggtgtgcctcagcgccgtcgacgagggggagacggtgaggcagctcccggcgtgcgggcacgtgttccaccgggagtgcatcgacatgtggctctcgtcccgcgcctcgtgcccggtgtgccgcgggaaggccgcgccggccgacgagctcgccgacgccatagtcgcgcgcatagcggtgacgcccgacctcgtcgggccacgcgtgtctatgtccgtcgtcgtgccggttgagatgctgaagggtgaaatggtgggcgcgtcgtcaacgtcgcgtgccgcgtcggcgccgccagagcagctcgatgcgcgagcgcctggcccggaaacggacttggagagtaaatagcagtcgttttccggtgagccttgtaaactctgctttgtttttggatttacaaaatttgaggagcgtgaaatgttgtatatatgttttgaaatttacattagtcgcttcttgttcatatttacttattattcttctctagtttttagcatcgttgcggaagtgcatgcagctgatcgattgaattatatcatccaccagatattcagattgagattcgatccagtaggactctagctaggaggtgatcgacacggcagcacgtatgtacatttacacacaaaaaaaagaaagaaagaaaaagcatcctaacgtgcggttaaaatgttgctttagtcccttttagggacattgttttttgtaaagatgttttcagacatagttgaccatgcaaacatgaaattaaccagttaacttgaaaccacgacatgtacacgctgttttatccccctttgaaattttctccaataattccagtaaataaatggtgtctgtaatctgttgtattgttagaccaagtcatgcaactttctttatggcaccactcgcaaaattttattgatccacagctatcatattcatgtcgcacctccctgatcaggcattagaagctgcaaaatgtgaattggcaaaatgaatttgttaactcatctgtgggtatgatcatccaaagtatttgaatccattttacatagtacaacatataactttcaaaagaaaaaaaagatatcgttgttttggtggagacagatttcgctcaatatataataggaaaatacaggaaatgctaaagaaaatctgacagtaagcaaaacaatatgttttttaaaaaggaatttagaattcagctgtcgttgtcataattctcaacccttcaatcatttcaaaattaatcaaagcaagatcttgaagtagtattaaatctattcacttacccttttgatacatatggtagcgaaatggtagagcccatcgatcaggctgtgtagtttttttttttttttgaaaattcaccggatcaggctatgtagtcttcctaccctctccacttcccttgcttcatcgtatttaaggtcatcgagtattttttttaagataatagaataaaacatcatgatatttactcaatcagctacaaccaattattataacctaacactcaaaatgagtgtagtttaaataaatataaagacaccaataatgaagaggaaacaaatcaaaaactaccaacccaatataagtagtacacaattatttaattctatttgtgaatcttcatctgaaattggcaaacagtactcaagataaggtcattgagtatgcgtattgcattcataaaacccatggcaccctccacatcaacaaagttactctttcaattgctaaagaggtatccctccactcctcaaataccacacaaatagtcgtgaattttttttaaaaaaatatccataaaaatcattacaatgtgcacctgtggattcgaacctgatccagacacactagaggatcagccgcttgtggatatggttcacaagatatcggcagccgtcatggaaggggaagctcatggcctaggctggcaggccggctagttttcgtgcaatccgttctttcttctatcccggtgcacccatccatgacgattggattgtcttgtctcctgaggtgatcgacaagagacggcgtgaattcctttggaatggttcagatcataccgagtccatggcagccattgccttgtcgcctggcccaaagttttccaccccaaggacttcgggggtttgggcgggcgtcacggacctccaagtttatatgggctgggtgctgtggattcgatggctgtggttgcaacggacgaacgatcctgcctagaggccgatttgaaggcagtccatctccacaaagcagcagaaataatatagcagtggcacaatgaaagcgaagtgaaagcacgattcacacgttcctatttactcgtagccatcagagtagtatcactcacaaacaagctaattctgtcaagggtcaacatgtaccacaacactgttcccctcccccctcattcccgccgcaggttgctccctcccatcaccacaaacatgcataaaaccccagaaaaagacacccaacctattaatttatcccttatcccacactcgatcgatctccccccgcccaaacgtctgcatgcatgcgcgccatgggcgccaatgacggccacctcgacgccaccagcaacaacaggggcggcctgcacgagcagaccaccaccggctgcctccccgtcgaccagtcctgcttcgcgctctcccggctgtcgtaccgccgcagcagcagcagcaacccgcgcgcgtgctgctccaccacctcctacctcgaggtcctcgccatctccttggcctcgctgctcgtcatcgtgctcgtgctctgcgccatacggtgctaccgcatgcggcgcgcggtgaaccgggtcacggtggcagccgcgtcggcggcggcggcggcggcggcggccgggaacgtcaccaacaagaagcggccggcgccgggcctcggcgaggacgccatcgccgcgctgcccaagttcgagtaccgcggcacgggcgacgagtgcgaccggtgggagtgctcgatatgcctctgcgcggtggccgacggcgaggtggccaggcagctgcccaggtgcatgcacctcttccaccggggctgcgtcgacatgtggctcgtcgcgcacaccacctgccccgtgtgccgggcggaggtggtggtcaacaaaccgccggacgaggacgacggcaggtgcgcggagacgccggaggatgaggccgcgccgccggcgtcggcgctggagccggcgagattggagaatggcgagagggacttggaggcgcaatagcagcgtgacagagtacatgaccgcgcgtttgcgttttcattctcaatcttttccttttcctttgggtagacatgtgtagtttttgcgccccattacggaggtgatcatttttttaacaccgtttgattttacgcaagcggtcattagaaaataagaaaatgatagattgattctcattagaatttgcatgtaaaaaagaagaagaaacatagtgtataatttgaagtcttgaacgaatcaatgatgaaatgtaattgctccgttcggcatcagctgctgtggatgcatttagctacgcagcacaaccggtttgaaaaaatgtgtgttggctttcctgtaccaattggcagccatcgcttctgatttctgaacattcccattgtttgtatgtcagggacttgatgaaagtaggctgtaggccccgttattttctgatgttcgggctaatagcactcctttgaattattgtgggtacatttttcaaaccactaaatgttttagataatgtaaaacattttcattatttaaaaatatacaagttttttaaaaatatataataaatgtatttttcaaataaatataattatattaaaaacttgattaattttgctcttaataatccaccttgtttcgtgtgcggttagtaagctcagcttatcatctaaaatgaaatggggccttaagcttacgtgcttacggcccaaagccgagaaaagcctggccctcagatcgattgtagcccaaaatgaagtggtttagcccctactttttcgaagactaatttggcaccgatcgattcgaatgttgtacatgtatagatcttcaaaattcaaatggtacaggaaatttcaagcatacaagtaatacctatactaatattaaactttcctcttatttttgttaataaagatattccagctacggttatatgccaaaaatgacttttcttttgcggaattaattgcggggaataagatgtattactaactaacttcactgtatatgaaccccagtttgttgctccaagcttaccagttcccagtagtccgaaatcaaaataaaccaaaccagctggaaaaagattcctgtcatgtgtccaattaaggctttgttcatcgtgatgattgaggagacaccctctttatcttatcagcttgtgatatgtaatagtactaaccttggcttatggggcccagttctctaatggagtaggcgagtagcagtaatggaccatttagccgaatgccaacgccgaactacaacacgtatcgttgtgctttgggctaatcagggttcctgaacctgatttttcttttttcatttccccctcaccctggcaaaggcccacgcagcgctaaccaatgtactagtacgctggcacgacccatactgaagtagtactaccactaggattgtacacactgtcatgtcctgtgcactcttcatgcgaccattactcgcccgttgtccgatagcgcggcgccaccgtactcccccctcaatccaaccgtcgtcgcgccgcacaccggccacccaccctcctcgcgccgtcgcacgctggcgcgcgcgcgcccactatgtagcattgcgcgtgacggcagcaatggcttgacttcccaacctcgcgaacggcccaacacttgcacgtcaacgttgccatgccttgccgttgcttaacgccagaactcaagtagtagtagtattttattggacctattttagtcggcgtggccgcgtggttgcctcgaagatagagtccgaaaccgctgcggcggcgccgcccgatctgcgagccaagtatcaaaaaaaacagcagcgcgcgcccgcccaattcgtgtgcggcgaccgttgatatttctcgtctctcatctcaccaccggtaggcgcgctccaagaatctcccagtagctcactgcctctctcggtttctcggttctctctcccccccagctgcagacaccacggtggcgtgccggggcgagacgtgtttgtcgtaatggcgacggtgggcgccgtggacggcgttgaagttgtgagcgcactgatcggccagtactacgacgggctggcgctggagctcgtggtgttctccctcgccatcgtcgtcctgcggtacgccgcggtgctctacgcgaaccacctggtcgacagcctgagcgagctccaggcggcggtcggcgccgggatcggcggctcgtcgtcgggaggcggcctcgactccgccgccattgcgcggctgccctgcttcgtgctccctccccgccgcggaggtagtgcggcggcggcggcggcggagtgcgcggtgtgcctgggcgccgtggaggaaggggagacggtgcgcgcgctcccctgctgcccgcacgccttccacgcccgctgcgtcgacgcctggctgcgcctgcggccgacgtgccccctgtgccgcgccgacgtgccggtgccggcgaggccgacagctccacgacgcaggcacgtgcctcgtggcacagtggagtgacgtttgctcgcaaattgatcccacgcgaattcacgcgagagcgggtgagaaatctcacctcgacgatctctattgttcattctaattctagttcgatttttctttctctttctcattcgtagtacgtacagaaagcgttttctcgctggtgtaattttatcggtcaacagaaagagagtcgcaactcattcagccattgtttgttaatttcatttcatttatcttggactgttgggcctgttccgttaaaaaaatagaactagttgtgttttacactcaaggcccaaaaggctctaacaaacaagcccatatgtgactactagtctatttcttgagggaataagttcatctaaggtcccttaattttacaccgaatccaattttcgtccgtaaaccccaaaaccagatacaaacggtcctgaactgttaaaaccggggtaaacgagatccctcggtggtttggaaggtggttttgactgacgtgacgcctacgtggatgaattgactaggtctctgtttcatgtggcattgacatggcgctgacgcgacgtagacgtggcaattatatctcataaaaataataaaatccgtgggcccacatgtcatcctcacaccccctttcttccctctcccttttcttcatcttcttcctgtaggcgagcgaggctgcgaggcggcgacctcggcaacctcaccgccgccgccgcctcagctaccaggctcctccctcgccggaccaccgcctccatcctcctccccctgcgctgcctctgcgccgacgcagcagccagcacgaggcggcagagctcgttgcgacggcgctccgcacggaattccggccgccgctcgtggctcgtggcgaagaggcggagcacggcgtcgggaggggagagcacggcgtaggcggcgagaaggcgggtcgccgcgaaggcgtcgtcggcgaggcggccggagacgagcatggcggcgtggacgacggcgagctcacgcggggtcgtgcaacggtcggccaggagggacaggttcggccggcgccggacgccgctgcgggggaggcgggcgttgacgactccgctcgcccgccgccgcgcccctctgctccatgtcccggagctgccgctgtccccgcgcctcactccccccggggcacgcgcgtataggaaaggggaagaggaacgaaggagctaaagccgtggcgagccacgagctcgtgttgtctagtcgcttcaccaaagccggcgtcgtcgcttccccatcaccgacggcctcccagagccgagagcggagggcgacgccgaggtggaggacaacgccggaggggacaccagaacccgattgttctgcaccacgaccaaaatcatgcagcaaccaagcaagagaaacaaattaatcagcatatggtgaacatttgaaaaaaataaaataaaattcatgtcgcgggtgcactgcaccagagcgtacaccatcgtgcgcggtagcgttcagcagcaccgcgacgtgctcccggaacctgccggcgacgaaggcgtccaccacattggtgttgttcagcggctactccggcttgttgccgtacccggagacgaagtccacgtcggagaacaggagctggaagcggcctgttcgtcctgttcatggcggcgtcgaacacgtccctgatgtagccggcgcagaggaagaaaagagaggggagaggaagaagggagaagtgaggatgacatgtggggggcctacgtgggccccaccattttgtagttattttttttgtgtgtagctgacatgtgggcccaccgttttttattttttccaagatataattgccacgtcagcgccacgtgggatgaagacctagtcaaaccagccacgtaggcgtcacgtcagccaaaaccgccttccaaaccaccgagagacattgtttgcaccggttttgacagtttaggacaagttgtatctggttttgaggttaaaggatgaaaatcggattcggtgtaaaattaagggacgttagatgaacttattcccttcctgagcaataggctcactgtacccactactacccagggccatttcaacttgtgccgtcaacattcagcggcagcatgtcatgccatgccacgccatgccactttgatagggcataaaccgggccagcttgtgcgcaaatcctccaacgaatcccggcggtaccttcgtcacattcacaacggcggaaccagaaactgagggcggaaaggtagggtgggacgtgagtgcacgatccattgcttctctttgagaaaaagaagcgattttgaccgacaaaaggtaaacattttggggacatgttcagaagaggggagggtcttaaccctcacctttcgtgtcgaatcattgcagcttgaagaagatagtgagatcttttcctactactgtagtagtacatgggcttaccggcctctgtttggctaattttgctggaagagaatttagtacagatcttatcttcctgtgggcagagatgctagtgcagcatctgaatctacgagaaccaagcatagcgcatattgcaatagtgtccggagtcgctaaattctccttgtgaggaccttcaggtcatcaggtcatttccattcttttttccgtgtttgtggttaaactgcgtgctagtttattctcttctttttctagtaacagaggcatcttgctgaattgattagaaccacaggaatcctgaactcaacaaatacagtacatgtacacccgacatcagcatgcttaccatactaacgtctgaaaaggacactagtaaacgcgtgatactgatgcgttcatcactgtaccattcttaatcacttaaaagcagaagcaggaaatgcatcatggacctgtcatgaacccaaagaaagaataaccatccgaacgctagccgtcagttttgctcgtctgcattccataacctgtcaattgtcaagtctgcgtgagctccttggcctcttgcccgtgtcgatgaaaactcaaagactacctgggtgcacttttccgaacccttttgacacacggatgattaagtgtcgtcagtggtgccattccagggcaatcaggtgctgcacctaacagccagcctctgaatcaatcactgtccattttgcagtcaccagctgacacatgaccatcaagaatttgacgcttcggcagtactggaaacagggtgaaaaatgctacactgcaatactgctctactatttcgatgttgagattagtgctcctttttgttaacacgattgagaattttagtacttcaaatcgacttgtgattcctaaatcgatctcgcgatggccgctcgctaattctgtgtgctaaaaaggctaaaaagcccaaaaggcgtacgtgagaccacactggaatattgatttgcagccgagcagcctccactactgggttagtgatgcaatcaatgaacctttcttatcatgaaacaaataatgcagcttgttaaattatgaccactaaagtgctaattttctacttcctccgttttacaatatcagactttatagtattatccatattcatatatatgctaatatgattaatgttagaaagtctcaaaccgaggaagcaacgaggaacgccaaacttatcgacagcttcttgacggcatcacgagttcacaacggcttgttgacacggagatcatattattcatgctggcgtgcataaacgtgcaaacctcgctgatcagcgctagttaacaaaaaggacaaagctatggaaaagtattagtggtgtaatggtaaagtcatgggtgtattagtaaggttagggattaaattatcgttattctctgtttatttaaacgttatttaaagagtgtatttacatacagttgtgtgagtgtactatgcgtgcgtacgtgtcttatgcgcaatagagaaaatgaccaagcaaagcatcatgagtcatgacaagccgctaacccaagcaaaggatattcagtgataaaaaaaaaacaaagtaattcaaggttagccaagtgcgcatcaagaagccaaaggggttgaacaccaaacgccacgtcaactcaactactggcataaagtttccttccgttcaattttagcacctcacatttatcttaaaacaaatttattttcaaatatagttattgcattgagagtttatgaaagtagaaaataattatattggtaataaataaagtgagaaatagttgtatttggatttgataaagtaggagtatttagttttctttatatatatagagtatattggtatgtgtgggataaatgagaaatgaatttattttgagacgaaggaaatacatatataaatttgctgagtttttagattaaaattatacaataatgtttacgtgcatggactacttcgagagtatacgaaggctctctttaaagaacttaattttgagaaacaattggttggtaattagtttttagaagtttaagaatctgagatattgagaaatccaactcctaacttttagttcattttctagattctataactataatttttcaaaatatgaattgaaagctataccttttaggaaaacttttgattctaagggcctgtttggttcgcgaaaagaaaattcgggtttcacattgaatgtttgaccaggtgtcggaagagattttcggacacaaatgaaaaaactaatttcataactcgccgaaaatcgcgagacaaatctttttagcctaattaatccgtcattagtacaagtgggttactgtagcatttatagctaatcatgaactaattaggctcaaaagattcatctcgcgtttttccctctaactgtgcaattagttttttttaattaatatttaatgctccatacatgtgtccaaagatttgatgtgatatttttgataaaattttttagggactaaaccagacctaagagaagttatcaaaagctgtcaaacatgctcatattaaccgtcaacaagttaaacccttctgtcacgccccgaactagtaccgaccggaactagctcgtgacgctccaaattaacctgttgatcgataccagtcccaggaaacagtgctggtatcacagggagacagaatatcacagcaacagcggtctcttcattatagagtagggatacagtcatgttgggctacggacagatcccgagctcacaactgcattacaaaagggaaacggaagcaggacttggaccaaacaacacaggcgcgacttgggaactaggccgaaaccctaaaactcatcgtagccggcttgctcctgaaagaactcctcatcagcaggatccgcttcatcttcttcagcaactggggggggggaattatttatatagagcaagggtaagtacgggagtactcagcaagccaagggaaaatagatgtttaatgcaggcttcaaggaaaggctgttgtttttgcagttgattttatttgaactctttttctaaaaacaactaagtgagtgcttctcaaacgacacggttgagacggtgcgtctcgtccggtcggagtatgtgcaatgtatcagtctttaaaatttaaaacaaggttggcacccggccaacagcttttcaaacggccacccgggccaacaactttcaaacggccacccgggcctagctgatcccatcagctgcagatttttcaaacagcgaacccctttccacaacagcaatttcacaaccagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaaccgtacacccggtacgttccccggtccgcggttttagaaaatccatttagttcgcaagcaccgacccaggtgtcgggttttccaagtcttttgtaaaactcaagttttacccaagaagttgctcagattttaaatttgaaggcgcccttcggtactcgcacagattgcacgatttcagaggcgcaactgggaggttacaagggaacatggtataacaattaacaaaggaaggatcaaatgcaacaaactaggtagatccgccaatctgccttacagacgggacaacagattaagtgcgatcctatcaatgcataatattttgcaagcaacataattaaatttcaaatataggctcaagatgttcaaaggtggcttgccttgctcgaggtctggagcttgatcctcgaaatcctcgcgttgcgggtctttgggctccgaaactacatgcgaaacgggacaactcaacaaacggcgaaaatgaagccctaataatgacctctaagcgtgccattagatagatctcgagatttgaggaattttggaagttgaacggagtcaaacggatctacggttgggaagatattgaatttctaagattattggatttttggtctaaaggaaaaggatttaattaaatcctttttggaaaagaaaaagaaaataaaaggaaaagagggagggattatagacttctcctcgggcggctagggcgcggcccaagggaaaaaggagcggaccggccgagctaaatgggccggccgacccaaggcggcccaagtgcgcgcgcgcgggaggggaggagagagagggccggtggaccgggctcaccgtgcgcggtcccgggtgggacccgcttgtcagcggctcggctcaccgtgcggagggagcacgcggcgcacgcgcgcgggcgggggagggacgcggtgcacgcgcgcggtctgcggaggaacggatgcggcaggcccacgcgcagcctcacggctcgcggtggaacgcgcgcatgggaggggctgaccggggtcggcccgtcccgacctcggctgagctggcgccgacgtggcgcctacgtggctgccacgcgggccggcgggaggtagacgacgacgccggccggaacggacggcgggcaacagcggcgagcggcggagcgaaccacggcgataccggcgaaagcgagcacaccgggtggttgcacgagacgaggggagacgagccaatggctcggattcgccggaggaagcttgacggcggcgaatcacggcggcggcaaccggcggggagggaagagggaaacggcgacgaggtcacgaggggccgattcccggcggtgagagcatctacgcggccacgggaatccgatgctagcgtcggattgggtggagctacgccgagcgaggctggcgacgagcgggtgctacggagctcgagcggcgacggcggcgagcacacggcgggcgacggcaacggtcggggcggcgccggctagctacggggaggctactcgtgctaccaccgaaaactaaggggggagatggagcgaggagaaagaacggagggaggcatcaccgaggtgaggaggggcgctgtgacgagaggccgacggctcgggagtaatctctccggcctcaggccggggaagaggaagaagagggcgcgcccggagtccccttccgcgtcctagtgcgcaccggctcctccggcacacacgcgacgacgaacggtgacggcgaacaggggcgacagtggcggcgagagacgaaaacgagggagattggagggggagggcttgggtttaaatgggcggcaatgtcggtttgggagaggggaaccgacattggacagtcaaggcgcgagctggcgctcggcgcttgcggccaaaacggcgacagggcggagggaggatgacgccggcgggaaggggaaaagaaaaagagggagagaaaagggggcttgcccccatgcttctttggggaaaagaatgaggggagcgggagcgacgcggcagagggagaggggctctgcctccgccccttggaggctagcgcgcggagtggcggggccgaggcgatgacgacggcgatgacggcgggcggtgtggagcggagcggcgacacgagcgacaggcgcggcaggcgctgacgacggcggcgaccaggcggtcggccaccacggcacgcgcgcgcgagaagcaacgggcggcgaccgcgcgggcgcgcgcacgcgaacacggcgcgcgggaagcggcagcgagggagcggagagggaggactcggctcggcgcgggcggctcacgcgcgcgggcagagcggagggggagggagcgctcggcgcggctctcgcgcacgcgcgcgcggcgcgcgggcggagcggagggggagggggggaaagagagagagagagagagcggacgccgggagggagggggagatgg

SEQ ID NO: 45947 - DNA, 8586 bp, Oryza sativa
agatgggccgagagggattcggcccatcgaccccgggggaggcaaaatagacttttgcggagggatttgatttggaaggatttggattcggaattggactcgacgatagatcggggattgagatccgggatggcacggacactagacaacaagcaaggaaacaaatttcgcaattagggttttttaagagataattttcccgctatgcgccacgacggaacgggcgctacaccttcgaggctagcctgtttgaaaagatattttttatggtgcttgttaagaatactacacacgtgacgtagtaaaccaatggaaaataataggggcaattataaaattttcactggtttattcaattttataaggatgtcactcgaatgataattctactgacattttataattttgtttccagtgacagtcttgtaataatgatttaaaccagtggtaaatttatgattgtcccaaagtaatgttatctttaagatttttatttttgtactctttgttaaaaatataaaacgagttgaagtgatcgaaacgatggaaaaagctatgtatctactttgctcggaattcatctttccactataaactacaaaattggttatttttcacaatatttgttagataaatgttttttgatagcacaagctaaataatgtaggtaactttcatgggtgtggacctaaataagtagcatttgaatcaaacaaaatttactcaataaggtataaatagaaaatcgacctcatttcaaactaaaccactacaaaaaaaattaactgcagaattataagtcacggccccaaacaagcagggctccgactgcaagatcgactgcggagcacacatgctacaggcacagcccccattctctcgatttgccttagagcacaatagcagattattagccagctataaatatattttagaaagataaagatgatagagaagagcatcgggctatatatctgtagctagctgcagtacggattccaaacgcaatgtgtatatgacaggtgagaccagatattaatattatagtaagcaactattgtattaattggttattaaatattggttatagatgatttatagcagctagttgactctactattggacttgctctgatagaaaattgcaatcttcccacaggccagggcagcgcgcaagcagccagccacaccgagacggcgtcgcataaatatctcgcgcgcgctcacttgctcacggccccgccgacctcacgtcaccttttgttgcgagttgcgcaccgtgcagctgaagctgccaccaccagctagcactgacccgcctcctcctttatatattgccccggcgcccccctttgccccagcaaacgcgaaccaaaacacaaagcaaacgtccatctccgcagcttgctccggccgccaattacaagcgccccacacccagctgcttcgccttcacgtccacttcaccggagttgccatttccaatcccaaaccaaaggacttcattggattgcgaggggagtggagttgctgtgctgctgctgccgctgccgtcttcgacggtgagaagccaagaaagaggcggaccatgaacacgcccaactcgtggctgttcgcagacaactccaagtacagcacgcgggcgcggctgctgttcatggggctctccttctccatcggcatcctctccttcctcgtctacctcgccatctggtacacctgcacccgccgccgccggagccgtcagctccgcggcggcggctcggcgtccgcggatcaggaggcgcccgaggcgaacagccacggcatgagcgccgccgcgatcgccgcgctcccgacgttcgggtacgaggcctcggcggcggcggcggcggcgctggattgcgccgtgtgcctcgggcaggtggacgccggcgagaaggtgcggcagctgcccaagtgcgggcacctgttccacgccgagtgcgtcgacgcctggctgcgcgcgcactccacgtgccccatgtgccgcgccgccgtcgaaggccccgccacggccgccatcgccaagaaggccagctccggcggcggcgccaccgacacgccccccgtcgtggcaccagccccaccggcggcggcagaggcactgccactgccacctgtctagcttgctgcctaccagtcgccgccgtacgtgcctccggatggaccgccgcgcccgcctcgggaagcgtcagcgcatgattgaggaagtagctaaagctacatgctacagtgacgagactagagtgaaacctagctaggatcgacgtcgtagatcgagaggcagcctaatcaaccaagattttattcgttcgtgctcaagtagctttgtacgtagtacgtgtacataccgttttccttattatagtgatgggtactactatatgaccgaaaatttccgtctcttcccacacaaccaccttgctgatgagtagtgctgatgaaaacgtcgcaggcaccagcaatcgtgtgctcgcgcgcaacggcgcgagcgtcctgacacctttttgtcccgtggcggctacttccgcggtcgcgaacgaacgtttccgttgcacggttccgcctcccccagcgaccagctagcgtcagccgtcagctatacctctcggtctccgggcgccaattcgcttcgcggagccgatcaactcggcattgattccgatggtgcgtgccagtgcaagcgatcgaaaaccgcgtccgccgcagcctcccccgatcctttccttcaccgccccgagaggcaaagcgaaaacggattcgatcggctagaaacgttggtggagtagtcgtcttccgtgggaaaaaaaaaagaaaaaggaaaaattctgtacgtacaaatattttttacaaaatacttacaaactctgatgtgacaagccgtgagtaaatctaaatttcttataatttttattagttaaatcaaaacggttgagaaatatgtgttagtaaaagttttgtaataaaattatagtacgtctatcagtgttaaaaaaagaagatgtgtccaccgctccgagagatcaatttttactgcctgcgagtgcggttcgggtgctggtaggcgagttttatgagcggttgggaacctggaagaaacatagggggtcgtctctcttctctctctcgctgaccccatttgcggctttcgcaaaagtggcggagcctttccttgtcctttctatctctgatctctccacctccatcggtttcgttttgtttcctcgcccgtggctttagcatctccagctagcttgcctctgcatgttgcgtattgctctctctgtgcgctgtgtagttatgatctctgccggtttatctccagctgtggtcactcgcctcctcctcatctcatcatcaattggttcactagttgggtgcgtaaaacacgtactactagtacttcacgctcgatggatgggaagactagtgggtacggtgtacgtagtttgtgccaattaacgagtaggttggagttagcacacgattcaatgagccacacacaccgtaccgactcgttcgatcgcctcttttctcatgctttatatggtgcgaacataccacgatgctgcacgcacctttgcactcgtcgttgcacatgcgagacgcatctgaatctgaccgaaccaaccagagccgcctgtactgtctcctgcaattcgttaatttggtccgccaggaaggatgagcgcgagaacgcaataactgcaagcggtgacgacatgggggctaaagctttagcttacggttgcggcgggcggccggaaaggcggaaacctgtgtgtggctcccgaccgtcgaatggtttgggcggcaacggctgcgtgcccgcgtgagctaagctaagcagccggccgcggccacgagctgagcgcgcggacaactggaaccgagctggtgtgtggcctgtggcctggttgatgatgcgagacgagacgatgagctaaaggtcgtagctagagctgcgtgcgtgtgtgcgtgcttgctttgcttctgttggacaaaaaggaggggggaattcaatgcctcgatatactactcctctccttggcttgttcggtttctctaggttaattggagggagtgcattgatcgtctgatcaatctcggcagctggccagcctacgcaacattgcaggcaatgcgtgttgggtgttagcgcggggacctggcctagctactgctaccgtggcctttctgtttgggccttgaggtgcaaaggggtggagatggcaaagcagtctcgctttgcaacttgggccagaggcggtatggccacggattcgtatcatctgtagtctgtgcagctagttccgagttccgacagtccatgccgtcaatgcgccaggacaaaatttggcatggagaaagaaaaaacggggaaagaagaaaatcgaaaaagaatggaaatcacaaccaattgatttggttcaccaagtagcatgcaataggtcctcttttccggaagttggttctggttcataaccaaatagcgcacgtgcaggtgtgcacgaagcgcattactgtccttcatggtctaaacttaaaactagtgagatgcgcggttatgcgttgagtgagtactcgcgttgctgcagagatttttatgaaataaaataagaaattttattgtccttaaaaaagtatatgaagataccaaatttgatttacactagaaaaatatgataactcccggtattttttaagaatggtaaaattacccataaaataaacaattaagaaaatgctagtagacgagaatgaaagaaaatagtaaatcaaatcttcttgatgcctatatagcgcaattcaacggaaggatgagctcagctgcatcaaaactaatctggaagcaatgggcaccctccaaatgcaaacactgtgcctggctattgctacaaaatagaatttggacagcggattggctacagatcaggcaatggccaaacaactatttctgtcaactgtgctacaggaatctagaaacaactcaacatctcttcaaggattgcccttttatgcgatatatttgggagagggtcctaggtaggctgaactgcaataaaattgactagacacatgatgaaaatgtgccactgctggactggtggatcagaaggacatctcgaggtggaaaagacagagccaaagaaaaaacaatcagtcgacatactggtagcatggaaaatatggtgtgagcggaacagacgagtatttcaaaatcaggataaatccgcagctgctagacaagatacaggataaaatcaagctatgaaagatatgtggagcaacaaatatcgcgagattatccgcctaggatgttttcattgtttagtagcttcttctttcctctctctttctctctttcacccgttttgcgatcttgtaaatacttttttttctcccctacttaatatatataacaccagctttgctggcttcgttttttttttaaaaaaaatcttcttgatgatgtggcctgacacatttttcttataggagtaattgcagatgctgaattgtagtaattaactgtatagaatctacatagaggatgcacgtacttccatttttttttgcaggacagatgaaattttgttaagagcttggagagagttacaagaaatttttacagcaaacatattgcatacggacttgtgtttatattattcgacatagttttcaagcgtgtgaaaaagcatgtactctcatgtactcatatatcatatatgtaggtaccaacattagtagtgtactatgcataacgcgtattgagtgtgactgtgactaattgtagttcatcgaaaaaaacaaataaacatctgtaaatcgttctgtatttttcactattcgttagcttcctttacatcggcctaaacattaaaaaaatattgtagcgtggaatgccccaagagtactattatatattctttagtagttaggaccataatattaaggtaacatgtgatttatgtcgcttttcgtgaaagtattcgcttggaatatttgttgatgtcacaagaccctttgaactaaaacccctctattattgcacctcacagactttccatcgaatatgacttcgagtgttaatttgagttctcgaattatgctgaaatgctcagagtcctcttaagtgtctttgaatatcttaaccctcaaagcctccttgattctctagcattctacaacatctttggaccacggttctctgaagcgtcttcgaaccttgcttgtatgatgaagatggctccatatcctgcatgttagaaataggaacatggccttggatccttgggaggatggccggggtcttgctcttacgtacaaaaccctctcttttatttttacatatataaatagtgagaaaaaaaacatatattcgtgggagcggtcacaattattcacttagaatattcgtttatgtcacaagaccctagcttgaaactaaaccccctattattgcacatcacagactccccttcaaatatgtcctagagtgttcgatcgagttctctaatcatcctcaaatttactcattgtttatacatgcctaaagctctgtttttttctaatttactcaaccccagattactggatctggaaccacattcactctgattaattaacctccgaaatgcagtgtctaaagtctagctaaacccatctacatttgtcgtgtcaccacatttgtcgtgtcgtactagctgttgggatgatcccatatttagcttgtatcgtacaatgccatcatgattatgcatggagatgattttctaggatcttggaaacaacacaatactttatgttggaattaatgaatgggccttagcccactcgaagattaattctttggaaaatcacaaaagcccaccttatgggatggcatgcatgtggagtttagtaccaccttgcttattctaggagagggggacctccttaaaagggaggatgccctcctagccacttgaagcatgtgtgatggagagaagaggggaaacacacgcgcgcgctggctcgcctcgcctggccgggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcggacgccctgatcaagcgacccttctctatataaaccgacttgccgtcttcacgcaacacttgcgaaatcaatctagggtttgtctcctactctgtactgcgccgtcgctcgtagactactccatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcaactggtctttccgtcacctcggtacgtgttcaatatgttgcgcatatttgatctgttcatgttgtactgtgtagtttacatgtatagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctataaaatgcttctgggtgagtactggcaaacctgaaggagttcttactgctgaacagcagaagcaattctaggaagccactactctctttgtgggatgcattcttagcgttcttggcgatcgtctggtcgaggtgtatatgcatatgaccgacgctaaggagttgtgggatgcactaaatactaaattcggtgctactgatggtagcaatgatctgtatatcatggagcagtttcatgactacaaaatggctgacaaccgttctgtagtcgaacaggctcatgagatacaaaccatggctaaggaactcgaactccttaagtgtgtcttacccgataaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgctaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgt

SEQ ID NO: 45948 - DNA, 31013 bp, Oryza sativa
ttatcaggtcgcacggggttccaccgtcctaatggggaatgggtcacatgcttctgttcatggtgttggcacggtagatctgaagtttacttcgggaaagatcgtgcaactgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgtggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgagattacactcttgcagtcccattatgtggagaagatcttgaatcgctttggctacattgatagtaagccttctccaacaccttatgatcctagcttgttgcttcgcaagaacaagagaattgctaggaatcatctggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcttgcggtactggagggttatagtgattctaactggatctctgatgtggatgagatcaaagccactagtggatatgttttcacactgggtggtggtgctgtttcatggaggttttgcaaacagacaattttgacgaggtcaaccatggaagcagagctaacggcactggatactgctactgttgaggcagaaaggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgttaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcaaatatattgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccacattgcttattctagagagggggacctccttaaaagggaggatgccctcctagccacttgaagcatgtgtggtggagagaagaggggaaacacacgcgcgcgctcgctcgcctcgcctcgccgggccgggccggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacttgccgtcttcacgcaacacttgcgaaatcaatctagggtttgtctcctactctgtactgcgccgtcgctagtagactactccatcccgctcgccgggtgcaccggcgatcgggagagcaggtctccggaacctctgccttcgacgttctgcaccgggagaaggcggcaataaagtttttggaagcgcttcgcgcgactgctccctgttcgttcgcgacggctcgccttcctcttcgctcgcgtgtttcgtgccttcgtagacacctgcgaaaagtttcgaccaagcaactggtctttccgtcacctcggtacgtgttcaatatgttgcgcatatttgatctgttcatgttgtactgtgtagtttacatgtatagatctaatgatgcgttcatgctagtttttatctgtaatgtcatgatttatttatggaatagattaaatcattatatgtctataatctcaacactttaacggacagtaggattgagatcctatatatatattcaatcattcataaatcctacgcaagcgagaggttatttagtttttgctgtctcttgtagtaggatcataggacggcagtacagtggtaataataaacactcttctagcgcccatacgcatcctacgtatgcatacacacatggcacatagaagtccatatcagttatttttctgaggctgggcacagcaaaaggttcagaaaagaaaaccaacaataaggcagcttttttttaattgttttgcttttattctacggccttgcatgtcaaacacattccttcagcgtggcctgtaccatgccaccgtgagcagttgagcactttatagctggcgggggcactggcacatcactctcatgcgtgcacaaccatgcttccatccatattttacggtgtttggaactgagctgtttaaaattaaaaattaatatttttcaagcacagtaataaaagaaagagacttggagggagagacgtccctccaaatatatttttaagaagaaataataagcatgttgggattgaacacagacctcagggttgaaatcatatactccttgccactacactaaagtgcatctctttcaagcgcagtagaatatctcgtctctccgacctaccttttttttcataaatatttaatgtatttatgaaacaatttgattatcactacttagaaaaaacaattttgcagctctagtcttttcttttcacagactgctcagaaggaaaatcgtatgtaacagatagccgaggtcatgttactatgttagggtcatgactgccttagaaaaacacctatgaaaacaagtctatttctgcgagtcccttttctaaggagctgtttgtgaaaattctgatttttagaggtggtttttaaagaaaattatttccaataaaatgtgaagtgtgatggttcttggcagttcccttaatgaaaaggcaagtaaaagtcgatttttatagatggttctcttgaaaaaaaactgcccatgaaaataagagcaatactatttcatgaaaaattacaactcttttatggtgaaaaatcttatatagaaattgtttgttgactatatctatataaaaaacaaatttatgggtattttaaaaacctctaatggagacattctctatatcaaaattctagagttcagaaaatctaaaattttatcgttgaaactttttacatttgagatcatttcagtgcctaaatattcgctacaggttttagagagaagtaaaaaattagcatccatcacacagtcatgaagtgtgagatggtaaagaggctatacgtgtagggagaagaattggattaggatcctacataccacacgtgtaatcgtgtatagatgtgtgtgtgtgtgtgtgtgtatatatatatatatatgcgtcccaaagtataagaatttttaggctagacgtgagtattaagtaagtaggtggaattaatgtgcttgggttgatattttgagatgaggaaataagtggagaatttgaacggtgaaatgttattattggttgagaacaaaaatgtaggtgaaaaaattattgtactttaggggagtacaaattacttttttgggttttgggacgcggtggaggaagggggaaggggggggggggtttgcacttaaaaaaatcaaaaaaagtattttcacgaatggtttcttaagagagtcgtgtgcaccatgatcgtgcatatttcatgatgtttagaattgagatatttataatatcttcccgttaccgtaagacatatctctgtccatgatccctctttgtatatattttgttttctttcttttatcttatgtatagaaccatgctgccattattaaccacttgttatatgccgtcaagtcgcagtctctgcttctcccgatttgtgatctttctcttagtatatatatttttgttctttttctagttgagacataagaagagagtggcccatatgcatctaaaatggtctataactagtggtctggtgcatacaaatcctcacatagccatgctagggccaacatagcacactctgtcacctgttgtaaaggaaaaagaaatagataagatagggataagatagaagaggatgacatgagagatcataaaaataacatatatgtaacttttttcctcaataaaatactctccactttttaatttatgacattgttaacttttgaacatacgtttgatcattcattttattaaaaagattatacaatattttgttgggatttgttttatcatatgtattttaagcgtgacttatatttttttcatatctatataaaattttgaataagatgataactcaagcatatgtagaaaagtcaacagtacctatactcatttaaaagaagggagtaatggtgacactaatctgccaccccactatccattgtaaattttgcatattacccctaaactttttaatattacaaataataaaaaaataaatgaataacacagataaaatcaaattaagccctgcagcaaaaaggtgagtaacgcattttttgaaaaatatatttttatttattttaaatgctattataatatgtttttttcacttttattcaaagcaaaaacacgggcattgagttcgttatacatgaaaaatcttaatcggagggactagcacgtagggcccgatcaactaacgagtacattactcctttggattttgcaaagatccaatcactagagctcacgcccgacaattaaatttacaggtgagctcgttcctaagtacttctttatttgctcttgaggatagattgctacctaatgatttaattatgattaggaattatggagaggaccatggagcacttggagagaggctaggagatggaaaaggtcattatggatgttcaagttaagatggagatccaacttatatcaagttcgagtccacttcgggctccaagagcagtctacactaaattcgttgctcaggtttcatccggactccgatttcgacgttccacacatgcatggaaagctaacgaaatcacctttccaatggatttggtcccacatcaaaaatccttccaagtcaacaggaatcttcgaaacaagaaggcattcaaaatctatccgggtgctgagtcaccgtctttgggcccgttgggccatgtatcgagtcaaagtctaatagggtcgcgtccatgggtctaaggtcgacactaaaacctatatattcagtagccgtcattgtgttagggttgggttttgcttagattatttctgccttcacagtttcgccgctagatcggtttgtgaaacctcaacttcgagtccttgataatcattcatctgcaattgagttgttgtttttcttgtttttgattgtgttcttcgattcatacgtagggattagccttctcggcgaggtcaatcgggtttcggcatggttgataaccagaggagacgtacgtggtgctgcgattgaaaggtttggatcgtgttgatcggaagccgaatcgtgtgtgtcaagtttccaccaaattgatagatatcttcacctgacagaagatcgggcatcccgttgccatcatcaactttgtactactaattacaaacggcatatagaagttcctcggtgaagttcatttacttgaggtcatacaatgcaagacaggaaaagtgcaaaagttggatcaaccaatcgatctaccggtgcaaatggcaaaaaaaaaaaacaataataaggaaaagggacaatacgaaatataaactctcatcaaccaaaaggcatatataagttcgaatactgcgcttttttcccgaaagttttaactagctactagtcgagcataaaaatggataggtatgacttgaagtacgcagatcgaatattcgatccttccaacaacagggacacgaagaaatggaggatacgcttttgtagtaaaattgagagattgtttcctttgaggtggtggtcgcagcttgtgctcacaaactccaaagtgttcttcttcgcttttgcgttgcttgctacagtggaaaagtccacctgccagttccatgttcgttggtgtgttgcaggtctctccccttttagttttcaacatggataagtaactggttcttttccattacttcttcctcgaagagatgagagttcttttgggtcatctatatctgggtgcattttcttttattagaggggcactgttccatatttacattcatctcatattctcgtaatctgcaaacacaagcacacaacctggtgcctccatttgtcttcactgcaggatttcttaaaccaccgggaccagggttaccgtgttccgaaggtaagcacggttaccacgcggtaaccgtgaaaaaccgtacgaaaccatgcaaaatttattaaaattcaaattatttttaaaatttatttgaatttaaggaggttaccgtggtttttctattaccgtaccctcgcggtaaggccggtaaccacggtaaccgcgtggttaccgacggtaatgtaaaccctgcttcagagtacacatcgcataatgcttatattttctgtgatgagactcatcaattacccatattctctaacaattatatattttgttcgtatcgaataaaaagccaacgttaaaaagaaattatgttaaaaataatttagagtcatctccaaaatcaaatttaaaaatttaaattttagtttttttcattggctcgtgccaatcgatggatctcgaaatatgattactatggttgttatgcagaattagaaaagctagctaggaccgacatgctattaacgaaaaccgtagcgaaataaaccgtgcgtcacactgagagagagagagagagagagagagagagagagagagagagagagagagagagagagagagagagagagagagagagagagagagagagagagagagagagcgcattttatgaaaaataaattaaagtccctggcagggaggataaggaggaggcgtctatagcctgtaggtccagcaagatattttctttagcctatccagtttagtgaggatcgcaatatcgaattatagcataaaatcgctataaccaacagtaaattgagtttgcttaagtggtgcaaacaattcagtgactgattttaatgtgcactgaagaaaagcaccaatataacaaattactgtagtgatctgatcgaagtcggttcgatctggatctatctaacagtgcaatggggtagcaaatgcacacaacctgttcgcctccgttgtagcaagttgatctcagtcgagtcgttgatcgatgtcttgtccgttgtcacgaaccaaactgatcggtttgcaaaggcaaagaaaagaattccattgccattaaaatggtcgacacaccggcgatgtttatcctagcacgttgtatcgatcgatcgggacctcgcattttccaagacggccagggcaaacgtatctactcctactccagtactagtaggagacatctcgtgcacggttgcgtaatcggacagtgctttgacgtgcaaaacgtcctgtgctggtgtacgatgtgtcgagcactcgatcgagccagtggccaccaccgcggcgatcctgaactttaccggccaccacccgcactgtcttggcattggctcgcagagtcgcagctcgcttcaccgcggcggcggcagcagcagcttgggccgctgctttcgcagtccctcggctgggccgcacggcgcggcggctgctcattgcgcggcccgcgtgggtgcaccgtctcggcgaggtgcgttgccgtggtagatcagtctctagccctcagagcagtaaggagaggcctcaaattaaatgggcttcctcctcttctgagagagagagagagagagagagagagagagagagtagttcttgggcttttttttttctcatccgttgagctacttccgatcaaggctggcagtcgggccaaacgagatttaaaggccagtggtctaatcgaaacacagaattacaacatccaaggctccttttcaagttgttggattattagtacggtgcatccaaggtttatttttcccttatcgggaaagcatcggcgatgtcgcagtggagatttttgttgcataatttcactttttgacaagcacaaattaactttaagtttttaatacgtttttagtcctcgtgaccagagtttttctcactactagaaaaacagacgattaaaattgctatgtgcacacaagcgttcctccaggcaaaaacctacgaaagttaattttaggggtacatttgttgttgtgtttagtggtacgtgcacgtgtatacctttttcaatagtagaaaaaaagagaaattgttttcttatcttcgcattgttgagatgaattatattacttcaattacaacatgtatacatatgtgtcctagagagggattgtttgcatatcattcaaatattttaaaaaattgaaaaattatcaagatatattaatatgtgatagtgactccatataaacatgaaaaaaaaaatcaaatttagcttttacatgttacaacgtaaaaaacaaatttgattgttaatatacgttaactaattatattttaattggtttttttaacttgtagaagttgaattttaacttgtatatttgtggaatgatatataacataataatccatcttcttagtttttttagaactatttagataacatgcaaacaacgatagaatgtccccttaagagtttaaatccactcccctaaacagcttctaggtgtacttaaagttataatagcactcccttcttccatataaggtctgtaatttcacacggcttctaactttaaccattagtttattgcataacatattatcaacaactatgaaattggtattacatgaaagtattttttttaatacgagtctaatgatatactccctccgtcccacaatataagggattttgaatttttgtttgcaacgtttgaccactcgtcttattcaaaattttttgaaattattatttattttatttgtgacttactttattatctacaatactttaagcacaacttttcgttttttatatttgcaaaaaaaaattggataagatgagtagttaaacgttgcaagcaaaaactcaaaatcccttatactgtgggacagagggagtaattaaactcagttgtatattgttagtttaattattgttcaaaattttcaaatattaatttctcttaaattaaggtcgccttataatttatgacggatggagtacgtacatacatatacatatagtattgttgtcaaacttcataacctagaccccatctataaataatgaggggccagtagatgtaaaagcatggtgaagaccatggaatgcaagagccaagagcacaagaggagaataacatttgggtcatggactctcgtggagcaccgttcttaaaaagaccatatttctaggggagtagggacggagggagtagttaagagatctgaaatcctttttatcctcgaaagatactagacagatacaaatagttttaacatgtaaaagtattgcacgtcaacatattagaagaagaaaacatagtttagttacacaggggaacaaacggttagaagaccgttgctaggggataaagaaaaaagaaccgaaaacaagaacaaacaaaaggtagctactaagaggaaaaaactcctatcgtgagggaggggcgggtgggggaaaaccactaaactcccaaaaggcccctacagcagcagagccaacaatggaccacaaacgaccttcttagaagatggactccagcactaccgaaaccgaagagagagagagagagagagagagagagtagtcgaaaaccctggagttctgctccttccacagttgctaggataccagaagaacaagggagtcgaaacccttgcgaagatgctctggcaggcaagcccgagcagtcagccaccagacctgaagtgagcagccatgggaagtggcgaggtccggccagctaggaggagaaagaacattgcacgagacctggcaagtgaatacacagtcaagaaagatgtggttcaccgtcttaagctcttgggtgtagaaaggatagtccgagtgtctgtcaatgccacgcttttgtaggaggtcagccttccagcaacgctgttggagcgcaagctaaaggaaaagcttgcacttagcaggacctttgaccgaccaaagcaaatcagcgcaagcgaaggagtgatggccgagaagaaagcctggtagaccaagcgggccgagtaacgctgatctctcgtccagcgcgagacaagttcgtcttcagtgctcggagagagttggacaggaagcaccatgtcccgaaagcaccaggaactgggggatggacgagacaggtagtgggccatggatgtcccacagccaagagttgccggtgagggcaaaagcgcaaccgtacacgaagccctgagatgtggtggccaccgagcgaccgtcgatccattgattagtctagaaaagagctgacgtaccatcccctagcacgaagaaggtggatgccgcaaatatgtaggagacgcttagctcgacggaggccttcagacccatccagtaggagtggccagagcgctgaagccagagtcagtgaagacgtagagcgaaacccgttgtactcaagtccgcaatgcccagaccgctgacagcttagttttagtagagatatttacactttatgatttacgctaaaaatttctcggtagatgacatagaaaaatctcctagagatccatagttcggcaatttagaacgtggtgacgaaataccgacagctgacaactggaccatgcaccaccggaggtctctatcagcttcctagatggcacaaacagcgatagtatggttgcaagctacgcagcgttctgaactaaaagaagctgagatcttcacaaggcaggcgaggaccacacgaaaggaagctctgggcagctgggctagctagcaagccagccagccagcaactcaactcctgcctgcctcctctgccagaaactacccggaattactacacaagcgtgcgttgcctgctacagtacagtgggattaataactggcacagtcgacacagctgctgcccacgtcttacaacaatgctcctttctcaactactacacggccatggtatcgatcggccgatgaactgcatggttcaagagttcaactcatccgtgcatgcactgccggccgcgatgccgttgcgtaatcagtgagtaggcggtgtggtgcgtatagcaaaattaacgtaccacgtaatgtgggcaccgtatctgtgtggcaacgacgcgagatccacggaggatcgatctgtgtggggggtgcgagtctgttggagcttgaaagcggaaggattcggtggggcgcccgccggacggggggaagggtgtgacgcgcgacaccccgcgaaaggcgtccccgtgcacgcgcgcgcggcatacgtgcgtcggtccacggccacacccacgcatgtgtgcggtgcctgtgggagcgcgtgatgcgtgcgaggcgatcgctcgcgagggcgcgcgcaggaaccaggaggcaggaaggcaggttgccgtgaattgtttccgagtaatattcctcatctatatcgacaagatcaaaggagtaactaggcaagtatacaatataatagttataattaagcatgatagacactacacaacttatagtaattgagactaaaagctctctctctctacacacacacaaaaatgcccgtgcgttgcaacggatgaaaaattataatgataatatacgttttttcatgcataaccatgttaatgcaaatgtttgtatggatcatttgttgataagacaatcagaaaattagaacatcttcaatgtaatgacccaacctcaacgatggcaaccttaccgatgcttatttacctaaataattagattattcatatgacaacatcaaatcaaatcaaatcctacactgcatcgcatggtcaaatctacacaaaacagagtcactgtgcactcttctctaaatactaacaattaaaaatatgtttattttttaataatattttcatatcatatgttatcaagaatagtagctatacttaacaaaaatagtctgataattgcatatagagacgtgcaaggtctacaatacaggagaatacatgatgaaacaaaagtcgtgtaggagatggaaaaaaatcgatggatcctatccaacccaagcgtccatcaattttatctcgcgttaagttggacggttttccagagcggttcttattataaacggtattttttttctcatattgagtcggattggttctctctagcctttttttagaaaaggtggtttttctcttgcgttgagtcggacggttttctcgaaccatttgtagaaacaacaattttttctcgcattgaatccgattgttttttagatttggctttgttataaacggtgtttttttctaatagttttttcagagtggcttgattttttatgaacggtgttttttttgcgcaattttctcaaaccattttcacaaatgttgcatttctttctgaaatttctttcctagcacgttttttttctttttttacagacgatgaaaaccgtatttttctcgcttttttttgctttcttttctcgcgcgttcttttgcctgttttttctgacatttttttcttgcgcatttttcttgcttgttttttctcgagtgttttttttttgcttttttccaatataggagcataaatgacgaaacaaagtcgtgtaggagatggaaaaaaaattgaaggctcctatctgatccaagcgtccatcaatttagtattttttttctgacagtttttttcagagcagcttggtttttttataaacattgttttttttcctgcacagttttttcttacagttttttcctcgcatgcattttttaattttttacggatgatgaaaatatttttcctcacgtgttttgttatttttttaggacgacggaaacctttctttgcgcttttttctgacttattttctcgcgcgttttttgcttttttttctcacactttttaaaaccgtttttattttatcgcatatttttttatttttagttgtacgatgaaaacttttatatagttagattagatttgattagagatagagaaaatatatatacagtcttgcgagtttttttattttttacgaaccgttttttcgcctcccttttaatgttttacccgatttttttttattttttcggactttttttttgttttttttttgcctttcataggaatcatttttttttgttcttcccgtttgtttttaaggggaatcggatctatgattatttttcgccttttataggggaatcggatctacgattttcttcgcctttttttgtctgattttttggttttttcaccttttatcgggggaatcggattttttttagatttttctcctttttttgttttccccgtttttaaggtgaatcggatccttgtttttgttttcgctacttctcctgcgaatcggacttctactttctttttttttatttttttgccacttcttctcggaatcggattttttaaaggtgtatttttttaattttttgccacatcttctgggaatcggacttagtttaggttgtttttttcgctatttattttattttgacttacgaaggaaacatttcgtattttgaatcggatctacggatttattttggttttttcaccttttatagggggaatcggattttttttagatttttcgctatttttctctgattttttttgttttccttttttaaggggaattacgtttttttttcgctactcctgggaatcggacttctacggttttattttattttttgccacatcttctgggaatcagacttttaagtttagattttttttcgctatttattttattttgacggacgaaggaaacgtttcgtattttttaagtagtatatatatatatatatatatatatatatatatatatatatatatatatatataagagacaattctaaaagttcctctctccaccattatatagcaaaatttccttttatcttgaactaaaactagatgcaatgtttcatagatgctttactttccttatcttctctcttctcctcacactactacagaaagggtttttctgtatgaggctcccggaaagttccaggcaggccataagtgccacgcctagaaaaaacgctcccctcggggcctgatgatggacaacacgcgaagatgcattatcgcgtgtggtcctcttaacaaaccgcacgtgataatgcgtccacatcgcgtgcggtccacttaagcgaccgcacgggatgatgcatcttcccgttcggtcgcgttaagtcgactgcacgggataatgtatcttcacgtgcggttgggccgaccacatgcgaaaatatgattatcacaaactttcttgggtgtgtgggccggccttttgcataggaagatgccttttggcccgcacgcaaaaaccctttctgtagtagtgtcatgaagtgattggtctaggtcacattttatttttttttattatacataaaacacatacacatatactactacataatacgttaaatatgatttcctatcaataatagttaaaaaagagtagcattgatggggtttctcgtccaccctacccaaccttgtgtgcgctctgtactagcaaaaactagcattgtatcagaattataatagattataaaatgtgaaaaactattagttccgtaatttaaatgaatcgatgtaaataatctaagccgagccaaaccgagagcctgcaaaagaactttttagccccatcgtctcccccctcactctctctgtctctcattctctcacttctcttcgatccccctctacccggcgagcgctccctactctcgttggcatggtggctccctccccctctttctaaatcatgtcgtctagggctcaggagctactggatttattcgccacaagctcaaaaaccgccagatgcgaggttgtccgagtttagagtgctagctcaacggtggcagatgtaggttgctgcagatatattaggatgggcggacttctccaccacagtgagcagtagcgataagggttatctcggcctccgacaccctttctctgtgtaatttagtttccgttcttccaatatgattaatgttttgacttgttaaagattgattatgtggctaattttttgttggtttttttattcgtttttgttggttggaatcatccacgtcgacgctgatgttcattaagacgacacttatgagatgtcttgggatagtggaacgacactaaacacacaccacactcatgtacccgcaagtgtgacctctaacattctcaaagagatgaagaccgacgacaaatctttagccccaatggatctaatataattgaaagcacatatgcataatatatatgggcaccaagattgaaactttaatgaatggattcatgcaaccacacgactgctagtgtacgttttcctgatgagagttcagtttagttgaagcattttttttctttttatcttgggccagctattagttgatataattgatgttgtacacgtccaagactagtcgtctaggtgctaattaactagctagaagggaagagatattctatacgtgcacgagaaagatctggttgttagatatacggtgacatggggagatcgagatgccatgtccacaatatggaggtagctagctactctttcccttgatgaatgttgcttgcagttgcatcgtactaaagctgatcgatcgaggtagggattgggttgcgtagatagctttggtcccccataagttttttgccaccttattggttatgatagagcctggccatgctttttttcctcttctactttgaagctccttgacaaaatcccagacaaaattagtgcaggatgtgtgctaatctcagcgatctgtagactgtagtagcgagatgaagcgtcttcgtaaagacttcgaacgtactagtatctactgtgatgctgaaagatttgcataaaatctgacaagatctttactgaatggtacctgtgaaaagaaaacacttaaagctcgtccttcttggtcctagttttgaacttacggtaactacacatgttaatattttactctataaagctcatgttttgaactataaactgatgtggtttcacctgagtgattccagaatttggccggtggagcatacatatatatatgtacacacgtttagctttccaatagaaattggatggtccattaaagcgaaatctacgtacaaaactgaacatgtctatctaatccacttgatccaaacaacccacaattgatttacatatgcatcatgcaattctgtgggacaggttgctgctgtggatttggaccagcagcagcaggcatgtacaaccctacccaaaacaaatcctgatgctagttgcacggaacaatatgtatattccaacacgccagtacatctgtacatatatgcatccatgttcggaacatgtacgtacgatcactgcaccacgctagacaattagctttgcaccactaaattcagagaactggtcatgaaattaactagctagccagccagaaaaactaacatggcaaaccacacattactaactcgcttgctcatgtgtcataggctcctttttaaaaccaaacattgccacgcttaattaatggataagtatttgttagccacattttgatcacacctttgacaaagttaggttgtggcaaaaaggcccatgatgtacagggaaataaacgaaagaagctagctagcatatatatgccatgcacacgcacacacatcgatccacatacatgtctcttgttctcagagcatcacacacaccaccaccccagccgatccagcatgcgtgatcgatcaatctaggctaattaggtcgcccacatgcacctcgtgcagtgaacgacacgatctcggtaggactccgactcgatcctccgaaccgatctctgcaatttgcaggtggctctgcagaaacgggaaacgtaggggaggcccggaggccggagcccggaggcgagactcgagagagggataagaaaggaggcgagcgcgttgccgagccgagcgggatgcccgaaacgagacggtgaaagcgtcgggagatcacgatgagatcgcctccaaatcgcaggagatttgcagggagggagaggcagcgaaaggctgaaagctctcctttcttgtggtgtggtggtgggggccggctcagctagctatagctgggcagagctggctgcccctcttgtcttggctccattgaaatgcttctgcgtggcccccgtctcactggccaggacccaggattagggaggttaggccatttggggtctatcattgtggtctctctatggaaaccttgtcaggctcaggtccactagatagggttcctccctttgatggaagtacatgatgtgcactacagcttatggttccatttgttttttaaaaaaggacacgttatataaacgtaggtgttcacacgcacatcctatcacaataaatatgttcgaaatactggaccgacatatcttgagtggtttgtttttaatccctcaatgatttgggttgttaattggattttgggcgaaaatacttctaggcgatctaaatgttaagacagtttatatggttaatggaacaaaggaaatatgctactcccttcgtcccaaaataagtgcagttttagcactgtttatgtctaacgtttgaccgttcgtcttatttgaaaaaaaattataattagtatttttattgttattacatgataaaacattgatagtactttatgtatgactaatttttttttaattttttcataattttttcaaataagacgaacggtcaaaatgctaaacacggatatctatggttgcacttattttgggacggaggtagtaagagataagaccgtgcttcatgctgaagactctgattttttagctccagttcatacagaagaatgaattatttagtgctctttcaactaaaattaacaattaacataactaattaacaatttgttcgaaattacttctgaaagttctcaaaccatacctgaataggttcaataagaacttcacttgctcaaaatagaggaaatcggcaatagtactacatatttacatgtgagttttgaagtttcatgggaccacgactactcactggaatccttttacaaaaaacagtacactggcaagttgtacgtgccatcaatagaaagctctaaaagtaagtggccaagatcccagcggaatctgaattcaattgttcttttatatttttaatttgctttaaagtaaagctttgttacttatttttaaaaacaaatgttttagtcataccacccaaggttgggtatgctatagcaagttgcagtagcacaaaatattcatgccatggcaacaaaaaccaagatactttatgccacggtcatatgttggtgacaccagctttgtacgtagggttattctttagaagtctggtttattgggattaatggggaataaccctatacctaaggtgtactattgagaaataaccccatacctaagttgtttataaactaatgtaataaacaactattatgcccccatagcaatgccaatcccataagaaagccccaagggcaacacaataatttttcgttacatatgaataaataggaccctcaaggggcaagtgggaggagggtctcccattgaactgccatcatcactctcttcctctcgtcttccctcctacgagtctaaacttgagctcccttcgagagaggggcgtccttgttatgcatgttagattttgtttcaatattgatgcaatggttgcagtgtattatagttggagatggtggtgaaagtgtttttttttacgcaaggtcctcggtatcgatatattcttagaattgatggccattaattctcatgtaatccactatgttttatctttgggtgcgtgtgagttggttgtatgcattcttatctatacccagtggttattgtcagtaaatcatttaccccttaaacttcttaatattaaaaaaataaaatctaaataaatagtcatgtacaaaattatattaagataaatattttctatattaaaaagatgggtaacacattaatgcatcttattttatatgtagcaaatcacgggcaagtaattatgcaaaggttggtagtgttcttaagacaaccgtatcatctatatgtaatttactatgttcaataaagtttttcaattatacgtgcaaatgtaggcaaccccaaaacaaaatcaatattgaaacgatatttagtcaattttttttaaaaaataaaataaaatatacaaaactgcaaatattttaatcaaactatttcaaaattacagatttaaaataatatataataaagatatggatttattatcaaaattattattaaactacgggttcaaggcaggctatcataagactagagatttagtaataaagttatcacaaaactatatagagttattgctagcactattaccctgtgatattataagtgttgtagtttggtgataatactgccactaaacctacagttttgcaatattattacccttatttgatcatagacttaatgtttaatttaattttgtatacactattttaatcttataaatttctagtagtacaatagtttggttaagaaattaaattttttacaaatttacttacaaaatacattgggatataaatttttttcttaaattatatgttttacatttataagtaattgattatatgaaatgcaattgatagatatgagttcaactaaatcatcacacttttgtttttcttcccttttattatcgtagttagaactttgccaaccccttataaaaattatattttaccctacatatatggctttccttttatcatcgtagttagaactttgctatccccgtataaaaattttataagtaatttttcccctacataaatgaagaagtattcactatgttatattacacttttaagggtaacatgatatgttgcttggttttaacggaagtccattgacgacaatgacaaaaaaaaaatgcttgtgggatgctatttcatagaagtaatatttattgatggcaatttgtaaaaccaatcacttgtcaaaatgtaaaatttctcaatatattatattggaaataagttatcttaaaacattttctttaataaaaagttctaaatacttaaccagaaaagtcaaatctaaaattacagatactttacctaaattattacaaaactaaatattatttaaaagttaagtaaattttataaaactaaatatactttgatcaaattatcacaaaactacatatttaagatgatataactacatatttaacaataaatttatcacaaacatagggtttaaggctaagtatcgcaaaactacaaatttaatgataaaactatcacaaaactaaagattttggggtttaaatccttaacgctaatgctgtgtttgagctatagatatcaaagttttgtgatttaatttattttaacactatagttttgtgacatttcaccttaaacacatagttttgtgataaatttagtgttgaatatgtagttttgtgatacattgttttaaacctatagttttgtgataatttagccaaagcatatgtagttttgtgaaatttattcttaaaagtttgtgtaggagaactatacactgatttcggttaagtaagttataagatgttttgcgttccatcctcacatgtataattagtgaacgagttaatacttctacagatttgcaataacctgataataaaataggcaattgtaagtaagttaatgttttgagctccatcctcacatgcacaattagtgaacgagttggtactcctacatacctgcaataacctgataataatatagacaattgcatgtaagttaatgttaatatttgagctccatcctcacatgcacaattactgaacgagttgtacatgagttggtacttctacatacctacaataacctgataataatataggcaattgcatgcaagttaatgttttgagctccatcctcacatgcacaattactgaacgagttgtactcctacatacttgcaataacctcataataatatagacaattgcaagtaagttacaagttgttttgtggttcatcctcacatgtacaattactaaacgagttgttgcaagtaagttacaagatgttttgagctctatcctcacatgcacaattactaaacgagttggtactcttacagaattgtaataacctgataataaaatagacaattgcttaaaaaagatgccacaagtttttcttctataaacttttaaatgtaactacttgtagtctaactataatgtaatttgtactatagtgtaattaaactgtataactatattattatctctatataacttagtataaagtttcatactttttaattttctttggagaaacacagtacaaacagtacaaacgcagacgctcataacgcgcgcacgctcacccctatgaacatacatcctacccttacgagtgcctccgaaaaattgagacggcatatcatgagattaaattttaatacttatagttaattgtagtataattacggtaaaattatattacaatttaaaatttttccataaaaaaacttacggtatttttttaagatagtcccataaaatatttacaaaactttgtgaaatttacctttttaaaaaatccccaaaccgcaaactgacagtttcccaaaaaaaaaaactgagtccaattatcacgggggcttaggtggcttcactctgaactctctcacagcctcggtgtgagatcggatgagagggagccttgcccctgacatttcggccccattttctcctacaaccttggacaagagaggagagggagagaagggaggcgcgtgattcgatcgagagaatagggagcaaagtggagcgagggtttgggcggcaaatcagccgggcggaaggaacaagattccttcgacgacgacgatctctctatctatctggatctcctcctgctccccgagtctcccgctcctgccaccactcaccgctcgctcccacactcttcgccctatatatataccccctcctccatcgattcggtagcctgccacatccgtgcttgcatgcggctcaactcctcttgtgttcctccgagaaccacgcctccatcgatcgatcgtctgcgatccttgtcacggcttgaactgtgatcaagaaacgcctttctgatcgatgcgcggttgattgatcttggtgcggacggagggagagagagagatggtgcaggagcacggcgggagtaaccacctgcagcagcagcatcagcaccagctggcgaagtacggcggcggtgtggctggcaccggcgtggcgcgggcgtcgaggaagaacaagcccaagaaggtgccccagcgcggcctcggcgtggcgcagctggagaagctccggatcgaggagcagaagaagatggagggtggcgccgcgttgtcctcccacggcgcgctcggcggcggtgatggcgtcctcggccacctccctcctccgccgccgccgtcgctcgcgttgagcgccctgcagtcgaggtccgccgcggacggtggcttcccggcggcgctctggagcccagtggatcccatcaaacacccgtacaagaggagcctgtgcccacagcctccatccccgatggtacgtgtctttctcaaacctctccgtgtcgcggcgcggcgcgcacccgccggcgtggtctggtctcaaacccgctcaaatctctttggctgatcaggtgagcacgggcctgtcgctgacggcgtcggcgcgccacccaacggagcccccttcaaaccaaatgtacagcagcagcggcagcaggagcagcgccgcggcggcggaggaggagagggtacgtctcaagcctcgccgcgtgccgagtgattgcgtctttgatggtcgctaaatgtgagcttggttagaggttttgcaggagacgggcggcgtggacaggtcatggcctttcatgttcaagggcatggccgccttcaggacgacgacgagcagagctcctcctctggtggcgcctttctcggcgaggacgacgaccaccggcgagctggcagggttggccgatgttggtcctgacctgagcagatacgagttcagagcaacaaattatttcaggtagatttgcaatgctaattaacttgttgattgattctgtgctttgtatcttcgaaacaaagattctgtttttctttcagaagtacaatcattcattaaaaaaagtgaatctttactcggttttctcttgctctgctggagctgaactagttatttcatttgcatcactgcaaagtatttcaccgtttttgttaaatcttactaggttttctctgcctttttttttctgaacatgagttttctgtgtcccaacaacatagtagcaaaaggcaaagaccaaacgaatgaacttgaataccttgttttccttgaaaaaaagagtagcacattcgggtgcattcttttctcttttcgaattggattctcacggataatttgattttacttttgatctgtgatatgcagtgccaatgcaaattattcagactggacatctgactttgctcactgcaaaagcagcaaggagaacggccgtgccagagaccctgccttcctcaccttgagctcacagcctccacacctcctcaagcagcctcatgtggtgccatcatacaacgacttcagtgccatggcatctcaggcaagtgaatgatatgctctaccatattctgaaaccagtaatgtgtgacttggctgtgaaattgtggtggactaactgatgatgaatgtgaacttcagggaagcaacatttcatcatcgtcgtcgcagccattctacagcttccttccagtcggtccggttcgttgcgaaaggaccttgagcgagtgcaagaccgatgtgtctgaaggcgtcgacttagaactgaagctaggaaattgctgaactgaacttgtcctgttgctttctgaaaaaaaaaaactgcaatgaggtttacccaattaccctgttgtgtgaaaaaaagtagaaacttgtttagtcagtaagaccagatgtataatcagttgcttctagaagatgctttccctcccaataatcatctgctgatggtttactctgtccccagttcatttctagcaaagcaaaagagtgtgcataatggaaacatgaagcatttatattacacacatgggtccagataagatcgcgccaaatgtagtagaaactcaacagaaaagggtgtcagatgaatacatcatgtggtgttgatgcagcaacagtttcaacaaggaaatgagagagcatgtgctggatgggcaatacagctaatctgtggggtctgttttttcacagatctagcacaaggcacagtagaaaactgaacattttcagacatagatgatgtgtgtgccaattagaaattcaaaagggtttgtgtagatgtaagatgtaatctacggttgcattgcaagttgatttttgttcacataaagggtaaagtcttagcagaattctaaaactgtcaaggacgccaattccagaaataagcttgcttggttactttcaggcaactctcaatttatatattatgctcatctctgttcaagatcaggataaactagaacaaatgggaaccttaggataggcacaagttacaatgcacagcgtgaagtgcagacagataaattacagggagataaatttacaagatcaaaccgaagaaaaagtaaccgtcaaaagcaggagttcagatgcattagcttatgaagcagaagttcagaagcatttgcttatgaccagccaaagacgaagtcgaggatgtagacgacaacgagcgaaagcgggtaaagcatgtacgccaccagacaggtccagagcgggaatgtggttctgaagcttgtgaagagtcccatgatgacacagacgagcagtatgatgagcacctccgatgagaagtcccatgtcaggttcctgatgtagatgagcgccaagaacacgcccaagcacagcgtgttgttcatggtcacaccaccatatacctgcaaacaaagaatcaaacgcttagaatcagtaacatttttgtgtagatttagaaactagaaacggtttaggaagaataactgcttctataatgtacctcagagaaagtaagggaactggtccgtagcttcttcctgctagcgaagatgatggcagacacagcctcgctggagttggtcgccagcgggagggcgatgaacgaaatgaagaaggatgggatgtgcgaggcgttggagaagttgtggacagcatcaacaagcgggtctgcgaatgcagcagcaatggcactgccgagaagcaggagtcccacggctttggtgatgcaccagccagggttctcaacgctctcaactgtctcgtcagatctgtccaccagaaggtcgtgttcctgccttgttctctgcagaattcagacattttttcagcacttaaatctctagacgtctgagtcacattcctatatctgaatcttttcgtgtatcgcctgtctaagttatgctacttgatatagattttcagaaactaaagcactagaggaaggaaaatatataccgcatggtaatcagtgatgaacttattggaataggcaccactggtagggacgctgcgcttggcctcattaagccatctcttcatccccgagacaaactctgcctcctcgacgatatcattgcctgacgtgtcaaagtcatccatgatcttgtcaacagcgtcattcttgtcaaagtcaacctcctcaaagttgataccaatgataagtgcatgaagctcagcacgggacagggtttggctctcatccatgtcaatcttgtggaacaacctgcgtgtgaggatatacaaggttcatgtcaagttcacgagctttctgttggcatatcaagagaatcaaaatgtctaagcacccacttttttatgacatcttcattgggtgtgccatcctcattaagcagccgcccgagcgcttccatttgggcatgcctgaggattccggagatcacatgcttgtgttttgcgtatgcaagcttcctcttctgaatccatggctggaaaacctgatgcaaaacgcagaacctaacagtcaaaatctagagacaagagtttccaatctatgccatcgtttcaggaggctcaagtgtccttaaacataattgtgcttacctgataaaggcaataggcaagcacaagcgagaatgatacgataagtgccagcaagacagctaggcgctgtccgtggtgggtcttcaacattttggggaattgagcaatgataaagggaataacagaaatccccatgatccgagctgcatagctggtttggacatcagttgaaataccagtgcctgcaaaagaaaatttgtgcatcttacattcaatatatacagaaccagtaggtcaaagcagtgtaaaggtaaggttaacatagtggcttgtggtttttaacatgttaaccagaacctccaaattgaatgcatccttacaaagaagcagacaaagatcagtgtttgtaatttaaactccattctactttaggatttagatgtaacaggatcaacaattatcagaaagactacattaataacaatgttaaatacaagaaggcaatttaccagtcaagctgaagcccttgttgttctgtaaatcaactgcaacgccatttggaccaatgtcacacttgccaacaacaacacaggttccccacagaagggtgagaagaaagacggtcgaaccagcaagcaaccccattccaatcaggacctgactttgtgcggtctctctactcccggacagaccagacactgttaatgtgacagaacaaagagatcagaactctaattggatatagttggatattcagagcagtaaaaggtgagtagcttcatgattgtagcatatgtaccaggagaaatctgttttgagcaatatggatatgcaaaatgtcaaaatctgcatcataccataatacaagatcggtggtcaaaatcagagaactggtttttataggagtaaatattctttttattaatggcacagaagaacattgatgtttagacttaagagtggcagagccagaaacgctaaaaaaaatggttgaagagggccaacagtgctagttttttcaaagtatgccaaagctacagtaaatttagtgtgaaattagaatccatgggggaggacacacgcctgtctccgccctaggtaagactggtaaggtggaaaacaaatactaatagagcaaaatttctagaataatgagttgatcaaatgtagcattatcatataaaaaaggtgtaccagcatccacatttaagtctataggcaagtcctacatcggtagaatacatatttcatttcagatctcattgcgatcaatgaaccatgtgcagccatgctatcatagtaaagtgtagccaaatcagtattgtgttctttttaatgaatgagtacctgaaaatgagcagatagctacaaatttcactaatattagagcaatattgcctattatctatggagaattagaatctttatggcacacgaaaggatttaacgaagagggtttcctcttataaaagtttatgaatcttagagagtagttaaaaaaaacgttaatcactatttcctatgtcgcaaaataagtttatttttcactcatcccacatgtaccaacacaaaataaaaaagactaggatactcccactatatcaaatcccaacataattattacttgtactattttatttttttgctcgctctggtctgcattgcacggtttttcttttctcaaatcaaattccggcagagctcctgccgtcagtttcctcaaaaaaaaaacataattattacctactttatctacttacatttatttcctatttttacaaactccgatgcaatgatttcttaaagataaatttatattgggatagacgggaggagccaaaaatgaacttattgtacaacggaaggagtacttcagtactactacgtcacaaatgtttaccgtgatagttcaagcatgtgattagtatgatctgctattttcacgtgacaagatcggcaacggtcttgaaagaaagacggaaccgaaaaagcataatttctggaaagctaaactccaacggtccaaccactctatccagttgcacaacatgttgcctttcaatgtgttcagttaaactacaataatttggttgcatacaattttacaaatatataatttggaactttggatgtaaaattctatgagtaaaatatcaaatctatgccctattaatttcctctgaggacaaaccatcgtatttgctacgtacaagaatagtacaagataatgcaacacagtaaaagtgcatatcaaagcaagtcgatcacttgatcacatccactaatcagataggtgcaacgcacaaagaaatattccatacaaaaagggtcaattatgcaagaacgtaataatgaaaagtaaacagaaaaggggaaaggtcaaaatgacaggacaagcactggtggaactttatcatgctagcttatctgacacatttcagagaaaaagcagagctcagtagaactaattcctcgaataagcaggaggttaatcaaaaggcatatatactttgctagagcttatactctgtttttcttttcttttgaaatagtagaacatactctggttcagtcacaagactaacagaaactttagatctgaagcaaaccaagaacagacaaatctctaaatttacggatatgagttacttttttacccttcataaacacgcaagattttaccagtgctaattccaagaaaaactttgcatcctcgaatgttaaaaattcaaaagtttcactataaaatccaaaagtcttactgctaga

SEQ ID NO: 45949 - DNA, 5561 bp, Oryza sativa
cccgtacgactgctcgcacttctcctccggggcggcggccggcggcgaggaggcggaggcggagttggaggtggtgaggcgtatcacggctgacacggggttggagaggagggaggtggcggacgccgaggccggcgagccgtcggagatgaggcgtccgtacgcggcggcggccaggaggaagaggaggagcgggacgagcgggaaggagcggcggcgagtcgccattgcgggaggcggccggaggcgaggggcttctcgggtagggatgggtttggtgcgcgtagctttatatagtgcgatctgtgcgatatttgatttatgtatttctttccttaattaatttagtaggagtactactagtttataatatagtaatatttttttgtgtgtgtgtggatcaacggcaaggagaggctgtctggctgaagagccggatccaatgatcatatgtacgccttggttaaagtggttcgttatacattccttacctagcgatctgtacgctttaacctttccaactagagtaaattccctttgtactcctgaaaactcacttaattccttttatatctctgaaatttacccgatcccttctatacccctgaaattttaatttgattccttgtatgccctcaccgttacattttccatcatttcactgttacgtttggttgcaaatgtcatttttacccttgatgctttaggtttaaatataagcttcaaaaacaattgaaaattttatttgagtgcacagtatgtgtattttataaaactaatgggactaaataattagtgcagaaaattttgacataaattttgaaaataaaataaatgtaataaattaaattttttatttgaaattttaataggacaatggatttttttatcaggagcattcataaaaaaaatgttgtgaacatgggtagtcctatctttatatgaatgcccctcatttttatgacttcttttaaaaaaataaatacgtatttttctatttcattatctaaaaatattttttgggataaataatacatcgcacaacaaactcataactataatagtctcatgcgagaagcttttatatttttaataatgtaattcatgaatttctttcttcatccaagggtataatagtcatttttatagaaaatacacggtcaactgacgggaagggtatgcaagggatcaaaatcaaattttaggggtacacaaggaagtaagcaaaattcaagggtatagaagggattaggtaaaatttcaggggtatataagggattttctcttccaagtaaccacactcaaacaatcaaactatgacatgttatacatacgcgtataaaaactatggaaggtgcgaaaccatattttggcctattgtgtgcagaaattaccatgagcttaaacattgaaaaattgtgaacaaggcaaatctataatttgaggtttcacaaaagaaaaaaaactagaattttaaaataatgctttggtgcgagcacctgatactacgagagaggaatgtgtggatctttttctctttcgccctcaatctcatcaatccctttctgcatggacgactaggaattcgtgggtggctagtagcttggagttgtggtaggggagagcacctatgcccctattgtagagttatggcgaccaatcacgtataacggtgattagctcgacgttaattcttttcttaagctagtatctgagagtcaccagtttcgtggtggcgggttttttctttttttcctgattgtagcatttcagggttgtaattttatttttttaatgctacattaaaatgaaatctcacacctatcttgtgtggttcgtttcaaagagaaaaaaaaatacacgcatcatgtcagccatttctccgctatcttttctctctcttcacctctgatcccttctctcttctctctccagtcttcatccctattctggcaaggttgctcatgcggctacaacacataactataacgacggtggcaataactactagtgacgagcttgaggtggctattgcagctatgatgacgagcttctcacaaagtagtgcctatgacaatgatgagcaatggcggcagtcgcaagttggggcatgcggatgccccgatctggtacttgtgaagcttggggctaccggattcgatggtagtatcacttagggatgctcgatccgacatcagtgaaactcttgagacgctagactagtggtgatggagcttgggaggttcctcctttgtaatacgtgcctagcaataattccctgcaggctgaatggataaaaaaaaagccattcattatccaagcaatataaggcaatcaaacacacccttaatacttttatgatgagcacaggaacttagaatatatgttcaagaaatttgttcctcagctctccggaggatagatcctgaatttcgttttaagagtccatttggctcaataatgtgcataaacgatgcaaaaattatggctcggccgcatacgtggccataactggcaaagagattagctttctaaatcaaactgtgggacccgctgatttattttgatgtttgtttgagatctttggatggaccgtggaggatccagagttcacactgctgccacatataattttttagaatcagatcctaatttctcattcccaaataaaccgaaagttcagctctttgagctcagaaattgatatatcgtcttgctcttctcttttcttgcgaggatagctttggcatttggtcatttaagtcctactatccttagcttcgttgctatataaaagcacagtggtacatgatcgtgactcggtgatgccaacaggcaacaagttatacgacaataacatggcgattttcaatgctttttttttctttctgaagaccgtgtcaccgtgtgtaaagcctgaccccgctggatgtttgacaaaacaagtgcttatagatctgcttatgcactgcattagcaactggatgcagactgcttgtataagctacgaattgcttttataaaaaataaaaaactaggatggtcatgcaacccaccaacaattggtcgagatggacaaataaaaaacaaaggcaaatcgctcttgcaagtgcaaatttttaaacggaggcaactaaaatctactcctatatttcaattaagactctgttcttccctcttctttctcaactcatatctctctcttttctttttttttgttacgtacgcttttcaaactgataaacaatacgatttttttgcaaagttttctatagaaaagttgcttccgaaaatcatattaatctatttttcaagtttttaggctacacttaattaatcacgtgttaataagcaacaccgttttctatgggagtacttttcaggtcactcatgttccagctgattggcgctgcatgtgtccgcacagtaggcaccttgtttctataattaataatttggagtgatctgatcctgaggaatagatctaccactctcatccaacagatcagcaggttcatcagttattttattattattattattaaacttattttttagatcttaacttgtgccgttagtccaggacaatccagtgctccatccatccatccatgtgctatttcaaatctatttacaaataggcgagttatgtatgccatcttagcaaaacacaagtaaattcccaatcccgttggttattcttttcaaaaaatggattgttgttttttttcattatattttttttgaacaattaaaataaaactccctctaaaacatatgttgtttaaaacagttgaattgacctgcgcttagtagaatttgtgtgccaaaaacgacaattaatattcaccggaggaagtaactcgtctatgtaccaactaaagatattcacaaccatatttatgaaaatcaagctttaaatcccaataggtagacttaaggctttgttcgctactcttggttcccaactctcctatctcgttttccgtgcgcacgtttttcaaaccgttaaatggtgcgttttttaaaaaaattatatatgaaagttgtttaaaaaaatcatattgatctattttttaaaaaaaaatagctaatacttaattaatcacgcgctaatggaccactccatttttcgtgcgcattgtttgggttgggaaacagacctaacgaacgcagccacctacaaccccctaccacactttcggcatttccccggattaaaagagaagggcgaagcttagtaccaggatccaataaccctggtgtcctctatatgaaaccccttattacaagaaaagataaaatcatgagaattcacaagtagtgtatggtgagcacggttcaattcctcgtctacgcccccaaagagtttgttagtgcaaaagggttttctaaggctggcatttggttgctaaagttcgtcgtgcactctaaaatcttagtctaatgtaccatctgttctatacacacaattagctaaatcacagtttagcaaacattttctgggcacacaactgttgtatggcactctttgccaaaaagacaaaaaaaaagaggttaattggatccatgccactgcaaatatgccaattcgaaaaaatatcactactatttacaatatcggctacgtgccactggaatttgggaaaattggaatcatgccactcccatccagttttctgtcaacctccatcatctctctccctcttccttctttgcttcttcgccatggatgccggtaagccctccacctcggactcgctggtccttgccactgcagctagcaagcagtcccctccatctctcgttgctcctccgccggcagcagccatgacccgtccattcctcatcgtccccaccggcggacgcgacaccctcgccgttgtcgttaagggaatcaacggccggggcgcttctccgccatggaggccggcgagcccaggaggacaacggctaaggggaacgagcgaccggggagccgagggtgaagctcagcgggacgagcggcacgggggaaggaggtcggtggtggcagcgacaagggttgaggacggtgacgcggcggtggctgggtggcaaccggcacaggggcggtggccggggaccttgccgggggagcagacgatgacactgtaggcgcagcctggcctgccggctccgagacgaggggctcgacgacgacgacgcaagcgcagtctggcctgccggctctgagacgaggcactcgacgacgacgacgacggcgcagcccagctcgccggcttcgagacgaggggctcaacgatgatgacgacgcagtgcagctcgacccgccggctctgagacgaggcgctcgacgatgacgacgacacagcgcagccccactggctggctcagagacgaggcgctcaacgacgacgacgcaagcacaacccggcccgacctccatctctaagatgacaacggcgacgacacctgccgcgtcaatggtggtggcgagagaggaaggggaaatagaagagaggggagggaggtggggcccacgtgcaatagggggtaacggggatttttgacggaaaata

SEQ ID NO: 45950 - DNA, 918 bp, Oryza sativa
cccccccccccccccccccaaaaaaaaaaaaaagccaacatctggataaacacaatttggagcaccatattggcaaattgctattccaaccctgcaaggttgaaggcaccgggtcgccttcgacgatgtgtaccatatcatcttttccatataaactattccgtacactaattttcttttatcattgacaaaattttattggcacagcagacagatggtcctctgggacccacatgtcagtggctgacagcactacagctacggcgggggacgggatcctcggactgcagaaaaggcaagctttcgaacaagggtaactagtctgtcactcgcagctttatgaaagataagctatacgctggcaatccaaaagaaactactcggattattgatcgctacaataagtagcgttggatccgcggaatacacgcgtaacacgaataagaatcccgtgttattatcctgtcttgtgcaattgttactattattgaaagttgtttatgacagtcggcaccagctgctggccagtagccagttcgtccattgtgacttttgcaccattataaatatcaactgtaaaacatagtggtcagtcatcactacgatgatgagatttagtttggttggttttgctgaaacattctctatgcgatcaccgtaaaaagactactccgtattaatctatatccgcagtcatggtctcatggaccatgaagtccactttaatagcgagttggtttgcagcggacatcaattctactaatcagtttccctaaaaaaaaatctactaatgagtttgctttatctgatatgcttacgtttgtcctatttttgtactaaccaccccttaaaattccgaatacgacaacataacaagcaagatcagcccccacaggttattacaataaaatacttttt

SEQ ID NO: 45951 - DNA, 1164 bp, Oryza sativa
agattatctatactatcctaaagaagctaatggtggtggtggttctatcaccccccccccccccatctatctgacaagtgggggccaccatctatcttgtgggctcatcattactgaccaacaatgtactagagtgagaagctatatttgcttcatatatagtgtacaacacattgtttatcctgtcattgttaatcacagagtgataatttagtttcaattagagctcgctgcaatgcaccggtattttgctagtttagataaaacatgctggctggtcattctaggtttgagggcttactaaatctagctgttctttaccttgtgctcaagacatctcacaatcactgagatgttctccacttgtcgaaaaaggtgaaagcaggttctaaaaacagcaaccccaagtcccaaactccgtttcttatagagatattatacacttcgaggcttcttttcatatgtccttgacttcatgcatagttcattctaaagtagtcaaaagatcagtcggttcattatcctatcgttgagagaacacacacctgctagcatctatttgcacggagctctgggagaagctggtagcaacaggagccaagtggcaagcaaacaacatgttgctctcagggaataagaatcaggggcggatgaacatatcctataccatctaccacaaacaagacaatgctaagcaaatggattgctcttattggcagctagatacttgacttgctttgaaataatgctagagaatctaggtccatgatcatttattttgaactgaagtaagagtacaatgcaaattagaatgatgctacttgattggcaagtagataaagctctaacaatagtaaatatttttggtcttttactctttagtccaataaattctatcgcatcagactatccccacaaaaatgatgaaaacaatatacccatgagttgcatataccatgacgcagggtaacagtgattgtcattaacagaaataattcctctctgacaatgccacgacaacattcatattgccacacagataattcaacgcagtacactgcagcaatataggaataggaaggatataaagctatggcagctactttccgctgacatagtagaactatcagtctacacggcacgtactcctttgcctcccaatgt

SEQ ID NO: 45952 - DNA, 16957 bp, Oryza sativa
  unsure (1)..(16957): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagccttttgttgcatcacaaaaaaggtctatactgtacacgactacacacacacacatgcttacatacatggctgttgcatgttctcaagttcctgtggcttggcagctgaggttaccatggccaagaactagctccctctctcctgcatcgtacaggcactcatatgtgatctactgatcttctatttatttgcattgtaaatctaccaagaaacctcacaaatgaagcataggagctacctagtccattcctgtttgttgattctttcgtacataaaaccagtattctcttgcccaacgatacactaagccatacgtgatttgatccaagttttcaaacaacaatgaaggaaatggtttcttcctctacatttagagctcccggtggattaggattcttggggccttccaaaataggtttgattcctttgagaaatagaagtggtgtgagatcaagggtaaagtatatcgcaccaaagtgcgcggtctcctctgctaggccagcatcacaacctaggttcatacaacacaagaaggaagcattctggttcataggttcctttccattgtgtatgaccatgtcataaacccggggcattggaccgaggacatgagggatgatgcattggagcctgctgaactctaccaccatgggctcaaggttgtcgatgttggtggtggcactgggttcaccacattggggattgtcaagcatgtggacaatgagaatgtcacactgctagaccagtctccacaccagcttgagaaggccaggcagaaggtggcactgaatggggtgaacatcattgagggtgacgctgaggacctcccctacccgactgacacatttgatcgctatgtctctgctgggaggtgattctctaatgtcctctttgcattgcagtttacggtattttctcaattgtgtttcccatgagcaacccatgaaggtttattctgtcgtgtttaataggacatatagcaacacagaatcattcttataatttggctataagaagatgcaggatttattaaaataaatataaaacattttatgtgctgtcttgtatagatatgtgttcaggattgtgaagttaattcattcttggttgtgtttactaggataaaccaatatacggtatgtgtgggcacaacttaagtttggtcaagaattttctctttgctaatgtgaatgtgttacacttcacatgtgaactgtacaataacattttttttcatctatcatcaactaatgccattattttgtcattgcatatccttgaattgatattgatgtatagatttctgtatcaatgaaagaaaatacctgttaaattctatgtgatctagcgttgacaccatgacaaaaccatctgtttggatatatttgcagtagtgtggtttctagtaaatggttaatgttatcagtgattcaagtgtccatgatgagatgtttatatatttgttggatcagatttctgttaatatgataatactggctcttatgattgttttgacttatattgtccatgtgaagatgttaagtatcactcctatccaatgaatctattacctgaaatgtgaaagcaatatgcatgtggtcatcagtgacctgtgtttcatttacttttaagcttagtcatatgtggtcattgatcagttttgatgccatacttaccaatggtgttgttttgtcagcattgagtactggcctgatccacaacgaggaatcagggaagcctacagggtcctgaagctaggtggagttgcctgtttgattggcccggttcacccaaccttttggctgtcacgcttcttcgccgacatgtggatgctcttccccaaggaagaagagtacatagaatggttccagaaggcagggttccaggatgtcaagatcaagagaattgggcccaaatggtaccgcggtgttcgacgccatggcctgatcatggggtgctctgtgacaggcgtgaagcgatcgtctggcgattcccctttgcaggtattctttgcatctcaatgtgttctagcttcatattaactcagaattgctttcttgttacaaacatcaaatgttaagagcacctaaatttgttaacagtgagtctaacacacctgagttctgtgtcatgctagctcacactgatgtgctttgttatctggtttttcaccttttgttcttgttgcagcttggtccaaaggctgaagatgttgagaaaccagtgaatcctttcaccttcatcttccgcttcgtcatggggacgatttgcgcttcttattatgtgctggtacctatctacatgtggatgaaagatcagattgtccccaaggaccaaccaatttaactgtttcctgatgccaagcaatgccaacaaaacgaaatgatctgtgcttcttacttgtgctggtacctgtctccatgtggatcaaagaacagattgtcccaaaggaccaagcccatttaactgttacctgatgccaagttgccaagcaatgtcagacaaaatgacagggaaagttgtgttgtgttaagcttctgttacatgttaggcactgaacactccaatggtctaatgttcgtgttcatgttgtgttgtgggtgctgatggcatgctttgttctctagcttgcttcatttgttcccttgttggttttatgaaccgtcaaaaataaaaatgaggcaatatttaagggatctgaaaaacaaacatggactcgactggaatgcaggaatatgaatataacagttaacagattcacagctcatttttttcttgtcaacagaggaaaaactcgtgttgaaaacaagaaacgtgccaatacaaatatctaaacaaagttaccaacagactttaataggacaagagactatctaaacaaagttaccgacaggctttaataggacaagagactacaaacttccaatcataaaaagacgacaaagggtagatttacctataaattatgcttaggttatgatgcgaagcattttagaacttagaagtctaaatatcatatccaaatagaagatgcataaaaacaacaatctctgaatgagaaacgttacaaaagaagagtacattaagccattaactacatcatcattcttaaagggtagtactcaataccaagctaccatggaacatagggttttcaactcctgatatcacctcaacttctgatatcacatctcagtatgaaaccaagcctttacttccagcagggctactggatcttgaactgctgctgcgcctgcggttatattttgagctcccctttttggcaggagcatctggtgatctggacttcgagggatcacggctcttcgacctggatcttgaccttcctctattgacaggagggctgctattacggtgatcagggccaccaccatcccgacctgatcgaagcctgtttcttacatctcgcctctggtgctccgctgggctgcggctgcggctgtgccttggactggggcggcgatatcctccacgctcacggtacctcaatggactgcgtgacctgctcctgctacggtctctccttgggtatctgggcaatggttcagagtttcttaaaaaaatgtatagctcattgctaaagtaacatggccttgcaatggtaaaaaagggaagcggataaaaaggaaatgtttggtgaatttgaatcacgcaagaaagctgattgatctaagcaaaatatactgtatctatgttaacatgtaacccagtttgaggtttgtccatgcatagcctctgctatctacctaagagaagaattggcatgaaatataaggcaatgaaagcaagttatgaacttgggtaatattcagattaactaaactcttgaaggcatcataatatagttatgagtaaattttataaagtttttataaaaccccactattatggtccaagttgaacaaaatcagatgtttcggcacgttgcacataaccccgggtattatggtactaaataataacaaactacactgttaaccccaaagaaggcatgaactcatgaagagtacacaactatattcaaaatagttcatccactctacccaatcaattggtactgaccactaggagattccaaggataatcagaagaataccaacctggacggactactggctcttggggaaccacgatatcttcttactggtgagcgtgcaccgtagggaccatttcttccatacctgcacatgatggcatccaaacattaaattaatcatcatttttttttaaaaaaatgtggtaaataatctaactgcagtacctattaaaatgattccacctatcatttcttccatcattgtagcgagaccgaacaggggaacgctctggagatggtgtcctgtatcgacgtgcaaatgcatattgttgagtaaaaccacgccccttcctgacacgttgaggctgtccgttgtctgtagagcccattgctaaatctttaccattggttggcacaggttcagctctagatataccagcctctgcagtatcagcaccattgttgccatccacttttgttaaacttgcatcagccctaataggactgctcctagctctcgcaccaggatcatccctgcaaatacaaacaaacatctcaattgggtactcaaaggataaggttatctcaatgttgaacaggacatttttatccctgctaaataccctccagtcacaaaaaagtgacgttttgcacaatgacacagtcatcaagacaattattttattaggaattactggtataatattttgatactatttttaagacaaatataatcataacatttttaaaagttgaattcaaaatattcaaagcaatattgatggtcaaagtttaaacatgttgactgcacggtgcacgcattccaaaagtcacatatttgtgactggagggagtagtactgaaaggaacctgacagtaagtaatttgttttaagtaatcaaaccttaatttactagctttatcttctgagttctgattttcgtacctgataccagccccatttccatctgtgtttgagggtttgcttccttcatttgatatgttgtcaagggtagctgtttgtttgcctttatctgcatcttccaaagtactatctttctccaaacttatagttttggtgttatctggatctgctatgaacaaagctgcttattagttcaaaattgtgtagacaatctcagtacattcaaacaattaaatgcaacacattccatgaaacatacgtcataaccaaacacagcaggcaaaacttcaaggtcaaagatggtaacttctgtcataaattagaaagatgttaccttgttagcaatttaaaaaatataaatgatgaaactctacatttaccatattcagaatcagttcaaagtattctagaatgattttgtaattaaggtcggcaagaaatgataataaacaaaaggttggccaagagtatcgtcaattatgtggatgcttaaagaatttgagtggtaaacagaatcaaaaaaatagttgcagacataagttgttctgtgtatcagaatagaatagatagtttagttgcagaaaaaaagtagatatggacaggtcgcaagcagggattagcaagtgcagtggacaaagtcagccttttgaaccacaaaacagaaaatttaacaggcagagaaaatttaaagtaacacggacaatcacagcgagtccaaagtattaacaagcagaacagaaatctgtgcagttcaatcaaagcagcatattttagactactcaggattttcatagcaaatgaatgtgaattgactcttctattgtcctacctttcttcgaggaatgcttggtacgagtcgtacgacggccttcactttcactgtcagaactgctgccgcctgtctttgagctatctgaatcatcacttgagctcctgtagcttctgtaaaaagctccagacaggggatctttcagcaaatacatcattataagctaataacactaccaagatcatacaggtcatcaacgtaccgtttggatttcctttttgttcctctactctttctcttagtcttcttgtgtttgcttttcccctttgcagacctgtgtttatccttcttcgaactttttcttctcttgtgtctgtggtcgctggatgagctagtatccaatgatgacgaagagtatgattctgattccgagccactatctgaggactgtgtgtcagaataatctgagctataggaatcagaagaataatgctttctctttttcttttgtttatcatgagtaggtggtttttgggttttgacccttttttcagcagcagaattgtcttctgttcttctgagcttcttttctgcaaaagaacaagtagtgagaaagctaaccagacaacacatggactgtttggtattatctgtttatgttgctttttacctttctctccctttagctgattctgggaatcagagacttcaccacagtccacgattttcacttcacaagtaggctttccggtatcagaacctaccgcttcaagcttcttcagcaagggcattccagtgaccaccttcccaaagaccacatgtttgctacacgattataattttaagtcatttgaagttgatagattttggagccattggtaaaaggaagttatatgacttcttatccacaggaaaacaccatagaaattaggaaattgattacttctgtgggcaacatacactgtgttggagccaccacatactctcaaccattacctgacacaacttgtagacacatttaagaaaggagtagggcttaatgatgtgttctacacacacacccactccagagagttttctatggttgtatatacatagacataaatgtgctgtttataagatattatttaacaaatggcaacttttatgtgtgtatgcatgaggctaattgatctttcatggttgtacagaatttttagattcaaggttttttaatagactaaatctctctagaatgttaaattttggtattggtagatatcaagtactatatctttgtgcagtaaggaaagaaagaaaggcataacttaatatgcacaaggaactagaagagagattaacagagaaaattgccaactgactaacagaaagaagcaatacccatcaagatgtggtgttggcatgaatgttataaaaaactgggatccattactgtctggtccagcatttgccatggaaagaacaccaggttggtcatgctttaacttgaagttttcatctgtagaacaccagaaagtacatacaaaaactttagcgaaagcatactaatgcatttgacactaattggattaaaaaaattctatggcagccacaaatttcattagtcattaacctttaaattttgcaccatatatgctctctccaccacgtcctggaaacagcatgtaacgttgagcttataaagtgtacaacagcaagaagtcagttgaaagaagatgcctgggataatgaatcaataccatctcctcttgaaaaatcaccaccctgcagttgaaaattttgataagatgagtatagttagggaaaaaatggatgctagaatgcaatctagagtagatatatcctgcaaatggaacaaaaaaaaatctgggattatgctgtataactagcaagccattcatatctacattctagaattatgtagagttcagcatttgaaatcccataaaagaacaaaaacatactgtgagttgatacaaagaaatatgcagtggccagaggacttggatcatttggtttaattttcagtacctgagccataaaacctttcagaatgcgatgcatgtttgttcccttaaaataaagtggcttttgtgtagatactccaaggcctctctcacctacatatcaaccaaaaagtgagcatgtggatataaaaggtcacacaggttgcaaatcagtgctaatacatcatttaaatacaaactatcatagtactgaaatgataagcctatgacttacaagaaacctgaccaaactaaatgccaattgctcattgaaagaataatgtatctttataacagaacaaatcatgccagaaccattgaaaggaacatagtgagacttttttcccactattctactttagataacaatattaattaccatacacgagcatgcagataataaaactgagtatgacttgttagcattgtaatatactacattcagaactggcatgtgcctcatcactcatgtaaattcacccaacagagctgcggagcagaaaagctcacgcgcatccttatcataaaacattgttcatcacctaaggtttattacaagtcgcatagcgcaaataaatttcctagcgacaactgatccgctacacgcaacttatatcccatcaaacgagtaaaaatttacccgtgcagagagcccggaaattctccgtggtcttcggaacgacatccgcaaacagctgcaaatcgaaggcaaagaaagttagcccaggcagcaacgattactcaaacaataacaccaggtaggcaactagccatgctggaacaaactagctcctcaaccaaccaaccaacctcaaatgtgatcctctcagcggcgcgtccgccgatcgctatgtcaaagaagacatgagggttcttcttcgccttgggcatggcgtcctcgaccaccacctgcgggcgcgcgagtgggcgtgctaacgcagcaccattagcaacacatctcgataaaaaaaaactgccatccaagaagatatagatagtatagatagatggataccaaccgaggcctcgcggcggtggtggcggcaggcccggcggcggaggagagggtgcggggcgcgcggcgacggctggcctagcgctaggggggttcgccggcggcgcggcgcggcgaggggatggggaggggagcgcgcggcggcggcggctagggctaaggtcggggagtggtggtattcgcgcatgtatcgaggtgaggccgtgagggaggtggagtgggccgggccagatgggatgggcctaggtaggatgtgataattttgtttgagtaaatttcacgaaatttcagtcaaattaatgaattatcgcaaaatataccacctccatattttaatattttaatgtacgacgccgttgactttttgacaaacgtttgaccttttgttttattcaaaaaatttatgtaattataatttattttattgtgacttgatttatcatcaaatgttctttaagcatgacataagtatttttatatttacataaaaattttgaataagacgagtggtcaaacgttgattaaaaagtcaacggcgtcatacattaaaatatggaaggattatatatttaagatggtgtattataaaactacggatttaacaataaattaaaactacatgtttaatgctaagtatcgcaaaactacatggctggcaataagattaccacaaaagtacatatttagggggtttaaaaccttatcactaacgctatgttcgagttataaaccaattaaattaatggagtagtactctttttgagaaattcatatagttttatgctccctcggtctcaaaattgtatttaacatgaaatagctacaaaatgcaaaacagaaacagctacgtacattttagtacggatagagtggcatgacatcttaattattaatcacatgtttttcttatttccgtatttgataaccatgcgtgtcgaaggagcccttaaaaatttgcttgccaagtactaataaacacacatgcatatggccacaaatacttgtagtgttatgttttgtgctgttattttgctcttaaattcactccctccaacccaaaatataagacacaaccacttttctctcatttctcataatataaggtgtgcatgcatgcatacattaactatcatcctttagtcctataaaattattttgttttaaatcttatatcatcaaaccttccaatcatattgcttacatgtatcaaggtgttccaaccaagaaagtgattaaatattttcttagtctttgtattatgggtgattatgacttatattttggaatgagtactaaagtttagccatgcaacctttaattggccgtcgatgtgacaatacttccatgcacagtagtgatagtgtagctaggatactactcgtacatgcatagccatctagcctactccatccataaaaaaaaaacttaacctaaaaaggaacgtgactccctcctaagacaataagatgtgacccctagaacaacaaaaggttcgttgtcctataaggggtcatatcccttcctagattaagctttttttttttttggacggagggtgtacatgcatagccctctagcctgtgcttccaccgattgagccaaataatttgtaccacaagcatatcaagagtttaaaatttattgacaaaaatataaacactccgaaatactaccgcatccatcttaaaatataactaagttcaaattttaccccatatatagctaattatagaatatataaaatgtgatttttaccccattacttcacatgctacctggcgcgctcatcatcccagcaaccgttgagacctgccctccacccataatatttataatttccatcaccccaccatctagtaatgagaataatttcaccacaatccttaattacctcaaaatactcctaggagctttattctgggatggagtgaatgcttatcttattaatcaccttgcacttaattgtaaatattttgcatcttatccccgatcacactcacactatacttatcccttctttattaagtttattaaggagcatcaaaatgttttctcctaaccctttattgttactacctccgtcccataataaatttatttttagctccatctatttattccaaaataagttcttttaagtaataattgtatcagagtttgtaaaagtatgaaacaattatattgggaatagataaagtagtgaatagttatatttggagtagataaagtgatgaatagttatattagggtattctattattttttgtttttgcattgatatgtatgagaagagtgaaaaatgaacttagggtgtgtttagttcacgttaaacttagaattttggttgaaatttagaacgatgtgacggaaaagttggaagtttgtgtgtagaaaagctttgatatgataaaaaagttaaaaaatttttaaaaaaagtttagaactaaactcgaccttactccattttagtattgaggaagtaaacaacataaacatatttatagttggggagggaaggaggaagcgcaatcatactccaatgaacactattgcgatgcacaccaatgcgatgcagggaatgcacaccattgaccggacaaaaggaagaagctacggcagcagatagtcgacgagacaagtgatactagactgttgtacctacctaatgctactcctgcatatctagcgaaattaacagtaaaagagtactgatccttttagctagctgtcaaatgtttcagctagctgtgctcccaatgcaatccaagtatctcatcgatgatcgatacggagtacggagtagctgttgatctgacttgggaggatcgatagctgttgatctgacttgagaggcctttgtttcgagtctcaagatcttgtcatttctaggagtacagtatgttctgtcaggatttcatctgaacctcttgtcggccagggtcaatttgaccatgcatcgatctaccgatccgtgccaaatcatcgttccttgatgcagtaattaacaaccaattaaacctcacatgaagatacgagtatgaaattacagccaccatccagttcatcagtgaagaaaagtcctgcttaatttgtggccaataggccaatatgcacaaataaaggctaccacaagctactagtatacaaactcaaaattgaatttacatttggtaattaggtcatattttaattcatcattgccaggttcaaccaaagccaaattagcatcatctcactttccaccaactagaagaataatttggcaccataaaagatatgtgtagtcgacatatatatttttgtcgtaaccacgttcaaattaaagtgctgaaatggacgaatagatgatagtttatctgattttgtgatgactagcattgcccatgcgttgcaataagatttagttaaaagaggaaaaaaatcattaattaataattatcatcattttttatatatcatctcttaatttctacatatatatttgttactaaaatatgagtcctcaggtttgaacctatattatccttttctttctcatcacaaaagtaggaagttgacgatgggggacggtaacatgtggttcatttggtcgtataatatcatttccatagaaaaaaaaatactggagagttggtgatatgatggtatgagagtcaaattaagcatacacgatcactgttcctttttaaaggaatatagatatccgagaatagaaatgtatgaatgaactattataaagttaattaatagctatttaaaaaatagtttttacgaaacttgtaccgtttagaattttaacaaacataccccccatatttttcatccattcatgagattacaaccggatggaatttggttcccaacatgcaaactattactatacgtacgcggccagctccatcgcgtaggcaagcatatatggtggcaatagctatcataaaatcacaatggaaaatatttccatgttttgtgttaaagttaaaagaaattattgtaatctaaagtataacaataatgtaacattccaaatgtatcctaaaatgtactactaccaaacttttcgacatcactactacaaaatatcaaataggtgtcgccactataggcttttttccacctccgcggattgaaatcacaaaaaaaaattgacatctttaaacaattataagtgtcggttctaaataaaaaccggcacctattaggtgccggtttttataaaaaactgacacctttaatatgtcaaaaaccagcacctattctaggtgacggtgggaggcaagtggcccatgccccctcagctgcgggaggcggcatgagacggttggatggaggtagcctgcgcccctcagcggtgggaggcaggcggcccgcgcccctcagctgcgggaggtggtcggacggtggcggcggcaggaggtgcgacggcgtcggtggatccatctctccccctccctctctctttgtgatttgtgatttgttcttattagagttcatttgttgctcatgtgagatgatgttcttgaaattgatgtgccgatgtgagttcatctgagatttattaatgagaattgatgtgttgttcttattcatcatgtggattcatgtggagttcatcggatcgaagtatcggctcctgcgtcggctcgaggagccgtttttttttggctcattgattttatattggtgccggtttttaagattgacattggtgtcggcggactaatcattgccgctttcaatgtcccaaccggcaccgatatgtggttctgtagtagtgcatgcttttgtcatctcaactaaacaaccatctattgttaaatgttcacataatagttttctcatattaactaatcataattattatattatcgatcaatttaagcttctttaaaactctaaacacttatattttgagatgtagtagtatcttcaacagctcaacacatatccacagcctttcactcttgtggtgcagcagcctatgcttgctgtctagacatagctatagctagctaggcatctagggttagctagctatactacggatcccttctattgctagtcttcttcattggcagtttctccctatctagatagacctacctcaggttaatgaattgaagatgctgcatactctctcttccatattaattattttgaacaaagttaaggtcaaacttttataactttgactatcaataactttaaaaatatttagtttaaaggaactaaaataacatatatagatttgtcttttaaagcactataataaaaataaacatgtatttatttattatatatattataatagaaaaacaaagtcacagatatatcttgtaaaccatgtcattgtctaaaacgtcaattaaaatgaaaccggagtgagtactctcatgtaggagcactatgtttatatcagacttgtttagtttgttgctaccatactaaaatattagcaataccaaaacataagtaaattttggtagtgttaatttttttagcaacttatgtatcttattggtatatttgggtaacaaactaaacactaactaaactactattcaaaatgacaacaatctggtagggtaattttggcatcaaaccaaaatgacccctcatcatactgagtgcaggtagatccttctttattttgttccttttcctttcttaacattgttcttggaatctttcttccttgtacttttgttctatgtaatctctctcctgccctcatttctttcagttttgcttaattatcgaccttttcttttaaccagatcgaagtcgcccaggttaacctttcagtgctaaattaattaaactatatatcaccttagaaataatttggcattaattcataggagctagctagctagtcaccagtgtctttcttagagatcccatgcatgaatggtcccagatgctagctggttagcagtgagaagagaacatgtgattccctagtacttgtgtatatactgtataattaatctattaatcttgtgatacaatcttggaactgcccaaaggaatgggtgaagctgccctgccgccagcattgatatgatctacaccatccgtcctataatataagggattttgagcttttgtttgcaacgtttaaccactcgtcttattcaaattcttttgcaaatataaaaaacaaaaagttgtgcttaaagtactgtaaataataaagtaagtcacaaataaaataaataataatttttaaaaaaatgaataagatgagtggttaaacgttacaagcaaaaactcaaaatcccttatattatgggacggagggagtactagctagctatgaaatgatcaccaagaaaaaagaattttatggtcatgtggcctcttttggggatcatatgcattgcatgccttgttgctaggtcatgctggctgcagctaacctatttaattcgtgtgtaaatacacatgaaagacaggcacagattgtgcttgctagctgcatgcattcttcttccaatggtggggtatgtgcatatacttccaaaatataaacagagggaaaatattttctttcagtcactttggacaattattaagttttggattacttagattaattcttcccttcccaagcatcttactgactgaaaatgtatatgttttcatgcattgaaattaatcaacaccccacaagtgtacacatttgaatctagaaatgattatattttggaatagatgaagtacatgttacctcactttgttgcactgtatatatttcaatacttgcaaagctgcagtatatttattctttttacctcactttgttgtagtgtgtactcttgatccacacatgcagccaagggattacttgtcctctttgttctcagtcagcatagacttatgcttaattatttgttgtgtagtagaatttgagccatatacatatttgtctgcatgtatatatgcatgtaaaagatatagtagtttgatcaaagttaagaatagcttgaacagcttcggattagtttatcatttgcattaagattgattatatttgttgaatatatgctagtgtacatacatacatacttaattaatactcactccactccaaaatatatgacgttactactaacataaagagttaaaagaccaagaaataattattatcaccccaataaatatagaggacttttacggtacaatatactgctagtatatatgatctaacagtgtagattgattggattttttagttaattagatagcagtataaagtttgaaagggtaattttatcttttcttcgttattctatcatcaaatcgtgctatcgtcacgtgcttcatcatcaaatggcgctcaagatgctcctcccctagtgcacgataagatccaggaccggctactcccaattaaattcaatctgaaccaaaaattactaaagtgttattttattttctatcaaattcttaacatgcccttctatatactgccagtatatactggtagtatgttgtaccgtaaaagttctctaaatataatgcatgtcctataatgcatgtccccactgggattagagatcaagagcatagagaatttttaaagaaatgaatttagaggagaaatactaattaattgtatgcatggatgcatatcttatattactattgaagaaatatagctacaccctatatttagaatggatggagtataacctgtagatggtgaattaacgggagtattttgtcgatgttaattaatgggagtatttttcgtactcctagctagctagatcgagagacaactcattcacacaagcacatgctatgagaattgaggtgccaaatttggtgccattatatagtacattagtacaacataacaactgttaatatacgtatagtacatcctacatacagtataattttaaagagtgatccaatcaactactccactaattaatcaattattaaatcatgcatgcatctccaataatttataccttttagttaagataaaaactgtagctgcaagccttg

SEQ ID NO: 45953 - DNA, 8173 bp, Oryza sativa
tagaattaattttattttttttatcacttttgtgatccaattctctggcttttgagaccattatgagtagaagtatagaagtcttacctgacaattatttttattgctttggttatgtgtctttggcttttataacccatggccccaaaaataccttacaaaaggaatatttataaaatcatgtattcttagtatataactaaggaaaaaaaatactaatgtggtttacggatacatgggttgacctatttacatcgctgaacatgggtcgacggataatgtggtttagggttaaggccgtatgattttttccccaaccttataaatagaactcatccttgaaattcatgtgttctatctacaaatttcagtttatttctcacaggaatcaagattgctttttttttttgcatttttaatttatgcacaaggagtgttgaatatacaaacagtatgtacagcagcatgggctggcacaatttaaagctagctagctatatactccgtccaaaaaaaaaactcaacctaaaagcctgtctagattcgttatgctagattttatctcatccaagttttaagttgggtttttctttttaaaggacggagggactacatactagaaaaaactgacaaaaaggctagctagctggtcaagctaaccatttcgagctttctcgtgagctagtatagcactcatggagttattgtacaagtacatatttataactctactgaatgcgtacatgtgtcctgtcagaaaaataagtagaaatacggtgaaacgtacgtacatccatggacgattaaagtgtatacagctcaccagccatgccgtttgtttagggctcctttggaacaaaggaaaaatagaggatttttgtaggattagaaacccctggaaaattttcctttgtgctcctttggaagggtatttgagaatcctacaaaattcatatggagtggcttgattcattggaattttgaaggatttctaaaataaggttggacctcatcgggaactttgttatgtcaacctctctcctaaaatcctatacttttcctatggacccaaacagcaaattttaacaatccctatagattacaattccaaaggattcaattaacatgtcacctcgattcccacattttttttctattcatgtgtttttgtattcctacgttccaaaggaacccttagctgcatttgtagttaacgttgatatcttgtcaatctgcagtaaaatagtgtattgtcatcgactcttttttttttcttgggagaatagcatgtcccagctcaggttaatttagtcgctagccttttatattatccaaatgaaccgataaatttatcatgacacataatataaccctttgcgccatcgaaatcaccacggttatatcacattatcatctcccatacaaaatctatatatgatgggtccaatttacttcatttcatcatcatttttcgcatgggaggatatatggtacgcgcaagtggtcatttatgtgggcctaaggacgatattaggtcatatgataaatattaaacacttgtatggataatataaaaacgctaaggactagactaaccttggaatggaacttcaaggacaatattggccatttcccctcatttcttcattgcatgaaagacaaatacatatgcacacactctaccacgcacacaagcaaaagtggctcctttttaacatacactcaatatactaaggaaactaataaaatcgagaaattcttattgagaatgcatcgatgtcgcatttctaccaattttcagaagcataaaacttcagcttactatggatcacccactagaatgatgtgtttgtgaggttttgatcccattttcctataggaaatgagctgatatatgcaattccccccaaaatttccatggagttcctgtgttccaaatatagcctcgatgagaaaaatgaaactacgaggagagaaaatgcactggggtctacatatctatttaaggtcagttcatctcatccacctgaacctaaagtactttcttcgtcacctgtcagtcaccgctcctataattctgaaaggtgctccaaaacacatcaacataaatcacaacatttcaaagttccaaccataaaggcctacacaaacataaaaagaagaaaaaaaatgcagaagaaaacaaatgcatagatagcccctaaatttatccaacactacaaaacaaagtccatgcatgcatcaacgatcaatgcagccacttacacatcaggacgccccatgctggaaaataattggtgacaatcaagaggaatgtacacagacatccacagcaacccgtcggcgtcaggatgcattaacggttatacctaacgccatatgccaacagttatgcccatgtctggcatgcgcctgattgcccctcttggcttcaggaaatatatagtcggcgaattgaaatgaaatcacactgcaaagaacaagacaagacacatgttttttttttcatatctaaattattgtgtgccccggcaaacaagtttctgttccaacaatgacatcttaattgcagtgcaaagcagacaagcaacaagaaagcataatttataattatatcacagcgatggctaaatagcactatgattggcctatctattggtttcttattaggcagttattgatcgacttggaataggattgcaaaaacacaagacatgcgcatctacgggttgaatacatatcattgatgacgagacgcaatgtaatgctgactcctacaatttatctcttgaagtaagaaaaaagaaaaggaaagaaagaaagaaaaactacatattcagaagagggaagatcatgtcatgaatttattaagactagtaatatgctcgtgctaacgctatgacaacaatatatgataatatagattatacaatttaaaatacatcacgcacgtgttttttaagcttcatattagataccaaaatttaaagaatggcataaaataaatatcatttcttgttttccttcacaataccgaagttttagtcctaaaaagtgtgataatttacagacagaaatttatggatggtggcaccctcggcttccactgcccctacccgggattctcaaatctcaaagcttgggagcggaggctgggcgagacccggttgccgctgctcgggacttctaactgcctaaataatcagaaatttcggactgtagtctctaacaacaaatgaaggacactcagtggcaacacaaaaaaggagcttattgacctaatgaaaggactactgaataaaaggacaattttaggtacctgaaataaggtgtaccatcagaacagtaagaacaaacttgcatagattcaaaacctcaagctgcttttcatcatctggcaaaatagttggaatattcataaatggacagtaataaactgaatttcatgatcttagaggacataactaatgcatgtgtaaagtatttcagttaaaaatatattatgccgaaaggttaaagattttttttccggagcatctcacagcaacgcattcttataagacatggcaactcagagcaaatggtttcctattagtttatatggtttaaactgtaatagtggccttaaataaagtatctagaaatcatctgcttctaacgcattatactgattttgactgcaatttaagcctacttcatgcactaatcagtcatttaaggcatcccatggagaatgcgcttggttccaattttaaactgctactgattcagttttaaactgctactacagactatgttacattaatcatgaaagatgtggatcagcaacaattcatcaaagcaagaattattgaagcatgagtaccaaatgaaaatgataagcaccaaatctggatcggcatgagtaccaaatggaattgataatcaaagtaccactgtaacatagaaggtgaagtacagttccatgaccgaaatgaactattctagtctaatgatctctcgctagagcacattttgtgacgcatgattgatggggtgaggccgtgagggaggtgggagcgacctggggcatcggatctgtgggagacgatcctgaccgatcaatgaggaatgatgaatgtaacactgtgttggtgaactatagggtagatgacagaataacggagtactgctgaaaagattaactataagaattaatgctagtttacctctgtatcaagccatcaaccttccaggctgcaccagatggatctcacttgtacgaccagttggctggattggctttttcacctcatctaaggaagctagttctccaggggtggttgtgaagaagaaacctgatcaagttactgaggtttaacatggtaataaggagcagatacctaattataacaatacttgcagatcctattgcacgattggtagtgtgtaccttaaaggaatgtagagaggaagcgatccagattccacaccctttaaagattcaacagtgtcatgtcactgataagaatcagctccccagtaaaatgaaacgctatcattaccgtcctgaaagaagttgggactgatatactacttcatttgagtaccacttgcccatatatagggaccgagtcagttttttttttttggtgtgcgtgtttctttaacttgctaatggtacaacatatgtagtaggatacagggatgaaggcacattaccatttaccatacatgcataaaatattgagacatgataaaacaaaacgatgaaaattgctttaattatctctgctatgtcaaaatacagtactgctattagcaattacacaaaagattggcaatcttgaatttaaaagtaaaatgaaataatacttagctacaagcaagggtgtgcatggatttatgtaaccattaaccaagtgactggccaactggggacataggtgtcagtgttgtgtgtttgcataaatggtccagtcgaatcctaaatactaaaacggaggacatatcatggaagagttgactcacaaaattagtccattagttcaggctctcaacaccagctcgtaaattgaagataaataaacaatgaatgttaaacggcaggaaaccatgcactctgtttttattaagcatcgggacttgatatgggagggcaagaaccaagctgcttgaggttagctaatcagtactcaaatcatattttctcagcttgcaactcacatctttctaagttctaacatgcctcagaccaagttggcctgctcaaactacaaactcagaaggaactggttgtatacactgcttgttcctccaaattgtgtaaacaaaaaacacctatgctgtaaggctcattcatctgtagtgccgtcgttgctcattagagaacttgtatacttctacctttacctactttctctgcataatgtcaccaataatgtaaagtgatcaggcccattcgttagtgtgactgtgtgagtctgtgagaaccatcattggttactcaatatctcctatatgcccacaacattatgcaggcatgaatttacacaacattatgcaggcatgaattttccaaataactgtctgtcaagtaacatacatacttatgttctacatactacagtatcattaaattttctcatgataaatctatggagggataagcacaacaagggttcccaaactcatccacgtccactcccacatgttgacttttttggtggaataccagatttgtgttttcttaaaaaaaatacttgagaaaaatgatcaggatcagtatgaagtatgaattatccataatttggtacaaaccagaggcccatggatatcaactctagctaaacataccatggaataaccaggttatgagatccctagaagtgtttaggactatttattacataatgcaatgttcaactcacaagaggtaacacataatacaatatctaaatagcacaaatcacaagtgaagtgaagcaggttgtacctagtatgtagcaactgtacaaagatttctcaatcatctctgcttctccattttaatttagattcaagatccaaaaatttcaatccagatatcaccaaatctgcagtgacattcttcaaatgctcattcaacatatcctcataaacaatataattggcttctgaaataatattgcgatctctcatggtagatagtacttttcttgcctcagttgaacttgcatacttgcagaaaccataaataatagcagaatatataatttcttctatggaataacctaactcaatcatttcgtccaccactttgatgaccttctctgggctttttgattggcaagcttcaagaatagtcaaggtgtacttgaattccattggcccattttccacattcccaagacaatccttaacaagtgaaatagctgcatttatctctccttttttgcacaaccctttcacaagagcacaataggctgaaatgcttggtatccaaactgccttcatcatcaagttgtagcacgagcaagcctcttcaatatttccttcgtccacaaaacatgggatcatatggctatatgtacatgagtccggcttgcagtcatctgaactttgcatttcctcgaacaacacaagtgctttcttcctctccttgatcttcagcagattctcaatgagaatgttataaatgccaacactataatgcccccttcttctgaaagcattaaaaacttccacagccttcaattcattgccactcttgcatgcaaagagcttcaggaagtccactaaaatttcaactataggcaagcttagctccactagtttatcaaccaatccaaaaaacttaaccatctcgcccttatcggcataacgagccagcaatggtgaaacagtctcggagcttggtattagatcctcctgaacgacaatctgaaacatcttgtgtgctttatcctcccgctctatctcacatagcccgccaatcagtgtgttatagatccccaggtctgcacggtaaccagcatccaccatctctttcaacactctacaaccatcgctgacccttcctgtggagacatacccatcaatgagagacgcatacaccatcctgtccaccagcaaacccttcctcctcatctccccaaacaattcttctgccttctccaccattcccgcattgcatagcccagctatcattgtggtgtaagccattgtatctggatccacatgatcccttcttatctcctcccaaaccctgatgcaaccctccatatgcccccagcgaaccatcgtcttcaccagtgcggtgtacacaaacacatccggtctgcacacctcagcccgcatcctcccaatcatctccaggagtttatccgtcatccccgcccgcgccagcgcacgcaccatgatcgcgaatgtcaccggcataggccgcacactgcagtgcgacatttcgtcgaacagcttgagggtatcatcaacatgcccagccgcagccagcgctcccagcacgcggttgcaggcgtggacctcaggctgcacggagaactcgtggcggaagcggcggagggcgtggagcgcgcggagcgggcgacgcgcgccggtgtggagcctgacgaggaggttgagctgggaatgcgagaccggcttgccatgggctcgcatgaggtcgggaagctggtcggccgcggcggggagcccagcggcggagaggagcgaggcgagcgcgtggaacgccgggaagcagtggcggaagcccttctgccgtcccgcccacaggaagaacgggagcgcgagcggcgggggcggcggcgggcgagcgctgaggacctcggcgacgagctcgggggccacgcggcggagcttggtgagttccgcgacgacgggcgggccccagcgctggtggcggtggagcgcgtcgaggaggaaccgcgcgagcggggagaggcggcgggcggccgcggtggcggaaggagaaggcgtggaggaggaggaggaggaggggtcccagtcggcgaggcggaatggggcggaggaggaggaggaggagggaggcctcggttgggaggaggcggcggtggtggcgcggaggtcggagaatacgccgcctcggacggtggggcggtgcggagacggtcggcggtggccgtggtacaccgtcgtcctgcgccggcgagcctccgccgccggcgcccgctccggc

SEQ ID NO: 45954 - DNA, 16482 bp, Oryza sativa
tccctctcgacgccggtggctcgctcgcagtcgcagctcaccagccgccgcccaggtcgccgccgcgccgccgctcgctcgtagctccgcacgtgcgtcgctgcgccaccggccggccaccgtcgttgcggtgggggagagggagggaggcggagagacaggaagcggcggcggcggcggcggcggcgatgaggatcgaggaggtgcagtcgacgacgaagaagcagaggatcgcgacgcacacccacataaagggcctcggcctcgacgtgcgtccccgcgcttctcctgctcctccgctctctcccccaccttgctgctgctgctgctgctgctgcagtggggaaaggtttttctcctagggttttagagaaaattttctcatggcttggcttggtttggtggtctcgagcaggcgaatggggcggcgatagggttggcggcggggttcgtggggcagggggcggcgagggaggctgccgggctggtggtcgacatgattcgccagaagaagatggccgggcgcgcgctgcttctcgccggcccgcccgccaccggcaagacggctctcgctctcggcatctcccaggagctcggtagtaaggttggttggtgcctccactccctcattctcctctcgaacaccctttgagcactgctctagatgatttgtacactctgctgtaaataaatttggaggttagattttaggcttcataatgaacaagccatgttattagcaacatatgctcaccgtaagcttgtacaaagtgttttgccttttggggatttttgctcttccgctcgtcaagaggtcgatgcgatggccctcagcgtggtgaaatggtggccgcacaaggttgtgaataccttggttttaagcctcatttcaacaacatattatacatgtgtgtgttcaagcctcacttctacatagaggggttatgtttcctgcctttcataccatagacttagtttaagaggtcttacttctatttcatagttctctttactgaagattgaatggagttaaagcatgtggccaataaaaactgatgaatcgtgtttaagtgcaataagggcaccgtggacaattgttcataataagccatttctttgtaagtttgaatcctttttgttcattagctagtgtaaacaagtaattctacatttataagggctcatctagctccagaaaggcattcatattgagcttctggtatttgagaacctatgccttattattttttagttcaactgttgggaggatggttggattaaatttcagattcacctaactaaattgctattctaaagaaatggtcgacttagcatgtttttttctatgtttttggctttcaacatttcttttaggcttggattctgttgcttgctggttcaatatatttgtttcccttccttgaaaataattctgctaatggtggatcactggaatttgatgtcaatttattagatacctgtacatttttttactttatacctcacaatctatatgagaaattctttgtgttaactataagatttttcgttcaatgtcttacatctgcttcatttttggtaaaacttccaatgtttcattcatgttgatggagaatatcttatgtgttatcttattattttactatacaggtccctttctgtcctatggtaggatcagaagtgtattcctcagaggtcaagaaaactgaggtgctaatggagaatttccgtagagctataggtttgcgtataaaagaaaataaagaggtctacgaaggagaggtaagcacaccatatatgctaatttttaagtttgcactaagatattgttcttgaatttgtgcattatttcattttctcttgatattagcacatttataactgatatgatattctcactgtctgtttctaaaataatatatatttgtgcttcattgccttttaggttactgaactttccccagaagaggctgagagtacaacaggtggatatggaaaaagcattagccatgtaatcataggtctgaagactgtaaaagggactaagcaactgaagctagatcctacaatttatgatgctttaataaaggaaaaggtatcctgctcctcgccctcctatcttgtgctggatattttagaatacactaagtgcattttttgaaattttagtaatagttggatgattgttcatttcttattcagaagaatgtcttgttgtgaatatttaatctataaagtaaactttggagaatgttaattgtaaaaaaaaaattgcatgattggaaattcataacttgtcatcgtgaagctgattagatgccttgatactgagattcacttctgttacttccattttttgcactagttgtttcattacatcagtgatacatgggatgcaggtgtcagtgggtgatgttatatacattgaagctaatagtggtgcggtcaaaagagttggtagatgtgatgcttttgctacagaatacgatcttgaagctgaggagtatgttccaatccccaaaggggaggtccataagaagaaggaaatagtgcaggtaatttggtgaattttagcctaaaagatttttgcacaggcaagtcttttttgcattgtactatctatgaatttatgttggtgataattaaagaaatgaatggatcgtgttttacaaatttgaagtatagtgtcaaatattcatgccttgaagattgaaagtagagctgtcagctatgggacattttgttaccatcacaccttgtctgaatagatatggattaccagattagaaccaactctttcaggcctgtaggtgatattgaactaaccgccctaccaaagccaaaaggattggtcttaatcccttttctatccacatttgtaaatacacctcccttgataaatggtttatacagttcacaaatcaaacactactaaataataaattcatgaccatcagtctacattattataacccttggagttcattatgtttgattaattaggtcccactggaagatttgtcctttttatcttctattttatccctcaactgttatattcctgtctaccggcataaaaaaatgggttcccttatacagcattagtgtgttatatacaggctctctgtttatgattctcaagttatatggatgttagttaaagagctgaaacttcagttatcaattttgtacaggatgttacgcttcatgaccttgatgctgcaaatgctcaaccacaaggaggccaagatattttgtcccttatgggacagatgatgaagccacggaaaactgaaatcactgagaagctacgacaagaaatcaataaggtattcaaatttcccatgtagcagcactgctgcttttaaaagtggaccacatttaataaacatgtcaggattggcatatgatctttaacatctatactgtatgttgctaggtggttaacagatatattgatgaaggaattgctgagcttgtacctggtgttctgttcattgacgaggtatcttattatttcatccttacgaattatgattggaaattttctcagtggctcattttggagtcagaaggtataaatacaaatgagggtgtgtttgtctgttgtcaaacatacagtgggttgtccttgtggggcagtgccatactgccatgctatttctctactatatggtataaatcttgatgtggtttgatttagttacttgtgaggaactttaatcgcaggtccacatgttagacattgaatgcttctcttatcttaatcgtgctttggagagcccattatcaccaattgtgatacttgctacgaacagaggaatatgtaacgtaaggtaaacagtttgatttaccagtcgaagcactctgcgctacattataataccagactaatcatgtgtttgtcagtttgtttattaccatatgctccttaaagtttacaaagtcttgttatgcttgtgtccagaggaactgatatgacaagtccacatggtataccagttgatcttctagacagattggtgattattcgaacagaaacatatggtcccactgagatgatccaggtttgattttggatcttatatcacttaggctttcctgtttagaaatgtgtttgatctttgctcattgtcctctacagatacttgctattagagcgcaggtggaagagattgacattgatgaagaaagtctcgcatttttaggagagattggacaacagacatctttgaggtacgattcttggttgttacaccgacaggtttgagaaagagagttaagatggaaattatgcagtagggagttatgttaagtggactgatcttatttcccactttcggtgttctataagcattttaaattttgtagttttagttttataaccaccaagctcatcttactgaggcagctagcgaagatgaacgattgtaacacatgttgaatctcatgtaggcatgctattcagttgctatcacccgccagtgtagttgcaaaggctaatgggagagagaagatcagcaaggtatgtgttgaaattccagcaggatattgtaacgtcctcttgttgtcttttttgccgtatgggctatggctggctgctacattcacttgttagcctgatattgttcttgcaagttttatgtatgctgaacccatgaccttgtttttaatcaggccgatcttgaggaagtcagtgctctgtatttggacgctaaatcatcggctcgtctccttcaggagcagcaaggaagatacattacttaaatttctcttgcagtatgacgataaactcgagaatttgtccctattcatgctgtacacaggtgcgaagactctttcaggagcacacttgattgatttttgcagaaatgtagaaactgaacaatgtacccctgcactgtaggcagcctctagagaatagcagcattttcgaagtattgcttgttcaaactactgtttgctgagtagatctcctatggaattatcgtgtttcttaattgtccatgctaaccagtagtttgatactgttttatctaatgagcattttcatgtcggttcttgatcattcagttcatatagagggaaatgctctcaaacttgaattgtgaggagacgctgcatatttatcaaatatcaatacccagaatagcgtcatgccctctggtactacctatcttgatcacggctagctacacagtggtttcacttattcatgacattttctaagtaatatgattatgtagcatcagagttgtatcacaagatttataatagagtggagtctactaatgttttgtatttaagccaataatggtcgttgtttctaaacagaaataacgatcgaaattcaaattattgttttgtgcaaattattggtcgtggtggtaatacgattttaccgagctatcgttgatagaacaaatgaacaatcaactatcgtacgtggtgtccagcgacgtggagtgaggctgggtcagtcacgccgcatcgggctattttattttttttgccagttcttgtacttcatagactagtcatttcgattggaatgactatgaagttgggggcaaatctacctaaaagtttgcttaagatttgacacaactattcttttttaaaaaaaaattgttcaaactgaccatataaacgtacacactataattaacatctatcactaaatacaagtatatgtgctaagtttagaacttaaactaaattagagtggatagatttaaaaaaaaagaacatagcccattgagctacgctcgcttcgcgacacaaccaaaattatgacgtgctttaaaccaaaatgagtttgaagatctcatttctatccatcatctttaaagaaacaaaattatgacaagcttcaaaccaaaactgcccatagagcctagcttgggtgattggggtcattgctcattggatactcaacgtggacatcgaggccaccgtgaagaggtcaggcagccccccggcgtggctagttagcagcctccatctccatggccaacaaagtggcagcattttcagcatgcaagaacgacaattcgagatgagacgggaaaacagcaatgttagtgaccgtttggcgttttgttccatcatttttttctttagctgccctgttcgtttcttctagaagcataggataaaattttagatactcgtggcacgtttttcaaactactaaacggtgtatttcgtctgaaaactttctatataaaagtttctctgaaatatcagattattccatttttcaagtttataataattaaaactcaattaatcacacgttattaccacctcattttacgtgaaacatttaatatttatctttatattcatcttcaggagattcaaataccagccgtgcatgctactaacttgattatgataacctaagctactagggtgtaaaactggggtctctttataacgatggaatgttatatatgagatcttttactgtttttcaatttaagtgtctaaaactcttgtaaaagtttttttgttgctcctttcacccaaaagtcttaaagcttatttattttctgaaaagaaaatgagatatgcatatttgtagtctccatatgcatataagatttgaatgaagtgctaaattagcatcttaacactggttgcatgaatgcatattttttttctttgttatatatagaatgagttaattttttatttggtcttggtgaaacaagaaatatgctataaacttttggttggagggagtataaacaagtcatcttatttatacttctataaagttacaacccactaactgtaaagcttaacatacaaccatgctatatcatcacccactagcaataattatatattcaacctcgtgaaaacatgcaacatcatttataatctatttaattctacaaatcaacatgcaaacatatccaataatcacacatcacatcattttcacaatatttttacaaatctatctaccattttataatatttaacataaacttatcaatatgttacacattaaagtgtgggtttcatttgtctgtttcatgataaatactgataagccctgatatttcatttgttttctttttgcccctagcttgattgtaacgaaaaaatatatattaaaaattacttagtaattcccacagcaaagcgtggggaatcaccttgtatataattagactaattaatcacagggctttgctgcattacacatagttatatatatacaaccagccggatatatatatatatatatatatatatatatatatatatatatatatatatatatatatatatatatatatatatatgttacacattaaagtgtgggtttcatttgtctgtttcatgataaatattgataagccctgatatttcatttgttttctttttgcccctagcttgattgtaacgaaaaaatatatattaaaaattacttagtaattcccacagcaaagcgtggggaatcaccttgtatataattagactaattaatcgcagggctttgctgctttacacatagtgtaaaccaaccggatatatatatgcagcctttttaaatcaggaacttagcctattaagcaggaaacttagccttcaaataacccaatctataacccaatctgaaattcgctcctatggagctttgaactcaggatcttatggtgctactcaggtcactgcaaccactagactatatgccctttcatgagcgtaacatcttataactgactaactacagtctaccttctttatttccattttttcatgaaacttatagcgtttagataaaaattaatttcttggagccatagaaggtttgaatttttttttaaagaaaaaggtccatggaagtattgtgctctagaagaaaacgaaggcaaagatgcaagcctaagtagtgtcatttgaaatttgtttatcttagctgttagtttgcagaaaaaaaatttgaaaatatactgttcatcgttttctttttcaaaaatataccggatggcgaatcatttgcacaaatataccatcggtattgcaggatggaagagcgataccgaggttcgcaacgggaaagtgcgatagcgccacgatatcgctctatcaatcagcgagggtgcatttgagttggcggtatcgtgtgtgggaaaagcgagatcgttgcggtatcgctctttcgtagagcgagagcgccacgtggaaaaactgacccgttctggcgatttgggagggtagtatggcgggtgggcccaacggtctcatagtttcgcagcgcgagaccgagagagttttgggatccacgttgtcgcattaccgggacacagagggaggtgggtgggcctgcggtatcacacgcgtagagcgcgataccgtatcagtgttgcactcccgatgcgcgagaccgaggagcacggagattggagagtgggcccgcggtatcgcacactcaaagtgcgaaaacatcgttggtatcactctttcaaagcacgttaccggctttagttgtgggtcttgcgaattttttttgttggtgctaaggatggctacggtatcgctatttggaagtgcgagaccgacgccaccaacacctccactcatgctcttatatctcgaggacaacaccggcctcacctgaaccatgcaatcacacctttttttttgagtaacatgaccactctttccctctactatttccatctctttctttttgcacagggtgaaatacctctgtgcactcttttatcattttcgttagtgccgtcatttcatgtcggccaccattactcagctcgtaataaccactctcttcatacaaatccaatgttgccgttttataaaaggaaaggagaggagatggtcctcactaacaatactgagtagtagagaaagagaaagaacggagtgcattgaggaggagaggaagccgcataagagaggaggcagtggagagaagaaaataattgcacgtaagcagtcagacgcgccgaaagtgtcctcgtctctttctaaatatgcatattttctctgaacaacccattaataattgagatggtgcgcacttctctctctctatatatatatatccactagagttcaaatcatagtgtccatagatatggttaccactgcatgtggttccccctatgtgatatggatctgtgctgaacatccaaatttctcaccaatttttgtaagagttctaaaattttaatcccttctcaaattccaaggtagtacaccaagcactataagcttgctacttgctacaatgtatacacacacaaacacaaccctagctagctacccagtatatacatactgtacttgtacacagcttaattaatttaattgaattgattaattagacgttgacgaagggcgagccggtgaggaactcggtgaaggcgagggcgacgaggccgagcatggcgaagcggccgttccagagctcggcgtcggcgctcatcacgccgccgctcctcgcctccgcgctctcgccgcggagcagcggcaccagcgacgccgcggagagcacggtggcggtggcggcgaaccacgcgagcccgtccccgctgccggcctgctccaggagcccgccgccccgcgacgcctccacggcgagcgccgacacgaaccccaccatcgccagccgcccgttgatccgctccggcgccggcccgctgaacgccagcacgtcccacagccccgtgctcgccgccggcttcgccctgggcgccgccgccgcggggctcggagtcggtgacgacgacgtagccgtctcctccttcgtcggctccacctccggctgcagatcgaacgacgacgtcgccccaagttagcacgcgaagcaaatcaccagagaacacgcacagtgaaaccaatcaagaacgctcagctcacctcggcctgggccctgacgacgagcgcaacacgccggcgaggcgggaagcgtaccgcggcgcgccatggcgcgccaccagcggcggctgcgacggcggcgaaggagctgctcagcgccatggtagcggccgccattgctaacaactcaaactgtcaaacaccgctagtgaggacaagcaaagaactcaggcgagcaaagctagaatgctagatcactctttctgctgctgatgatgatgcgggtgacgagacgagtataaataggcgggggatcatcgaggaggacggcgaggtggggagtggcggcggcggcggccacgtcggcgggggagggggaggcggcgacgtggagggcgagggggtcagaggttgcgcgtggctgtcgacgtggacgtccagggcaccgtgcgtcgtcggggtggggttcccgccaaaaaagggctcaggaagaatccagatggcgtgcgccagtagtcgcgggaatcagtatttttttttctgatttgctaaccgcctgtcgatagaaattgtatcctcaaatcttgcagattttggacaaccagatgagctttgagattcgtgctccaggtcttctccaactccggcgaccttctcttcttctccggcactagtgacaccctacgggttagggtcccggagtggggtgggggtgggagggggagggaaggggaggagttcgccggcttagagggatggccaggggaggcggtagcctggcggtgggtggcgggtcgggcgggcggcgaggcgtcggagccacggggagaggaagccacagaagataggaggcagtggataaaagaaataaattacacgtaagttgattagtaaaaatttgtagggtgaaggatttagaaaatattagttcatgtggtttatattagtgatagtaaatatttgttattaattatgtcggagaaaattagaggtatatattagtttttacattatatttttatacgtcgcatgcaaaaatagtaacataggaagttaataaatataaaatatttataatgtagtatattattattaagtaggataatggtaatggaggtagtttgtgtgctatgacttagagtcgatttaggtttaaaaaatagatagacataattaatttatatggtaaaaaatttaattaatgttataattaatttgtagtgattttaagttgcaatttattagttgttcatgcgatgttttatttttatatagatggccaatattatatctaacaaatgaaaaaaaaggctgaaataatggtagttttatttgtagtacacatacataagatttcatatagtaacggtgaaatatggtgtggttaaacatatgcttaccaacatatgtagttacgaacatatgtagttacgaaggaacaagcatgaatggagtgtactgaggaggaggacagagactagcaagagtggaggctacagaagagaggaggcagtggagagaagaaaacaattgcatgtaagcagtcagaactgtcgaaagtgtacttatctctttctaattatgcatattttctctgtacaaacctattaataattgagacgatgtacacttctttttatatatccaccggagtttaaattatagtgtccataaatatggttgtggttccctctatgtgatatggatctgcgtcgaacatccaaatttctcaagaatttttgcaagagttccaaattttgaatcccttctcaaattccaaggtagtacaccaagcactatcaagcttgctacttgctacagtgtatacacacacacaacccggcctagctagctacccagtacatacgcaagtacatgaatgtattgtacgtacacgtgtacagtgcagcttaattaatttaatttaatttaattgattaattagacgttgacgagcggcgagccggtgaggaactcggtgaaggcgagcgcgacgaggccgagcatggcgaagcggccgttccagagctcagcgtcggcgctcatcacgccgccgctcctcgcctccgcgctctcgccgcggagcagcggcaccagcgacgccgcggagagcacggcggcggtggcggcgaaccacgcgagcccgcccccgctgccggcctgctccaggagcccgccgccgcgcgacgcctccacggcgagcgccgacacgaaccccaccatcgccagccgcccgttgatccgctccggcgccggcccgctgaacgccagcacgtcccacagccccgtgctcgccgccggcttcgccctgggcgccgccgccgcggggctcggagtcggagtcggtgacgacgacgtcgccgcctcctccttcgtcggctccacctccggctgcagatcgccccaagttagcacacgaagcaaatcaccagaacacacacagtgaaaccaatcaagaacgctcagctcacctcggcctgggccctgacgacgagcgcggcagcacgacggcgaggcgggaagccaaccgcggcgcggccggcggcgacgacaccacgccatggcgcgctaccagcggcggcggcggcgaaggaggagctcagcgccatggtagcaaccgccattgttgctaataataactcaaattacacagcagatgaacgcggagacgcgcgcgaaacgatcgatctggagaagcaaagaactcaggcgagctagctagatcactctttctgctgctgctgttgctgctgctgctgatgatgatggtgcgggtggcgagacgagtataataggcggggggatcatcgaggaggaggtcacgggggcgcgcggcgaggcggggagtggtggtggcggcggcagcggccacgtcggcggggggagtgggaggcggcgacgtggagggcgagggggtcagaggttgcgggtggcggtcgacgtggacgtccagggcaccgtgcatcgtcggggtgtggggtgggcttcccgccaaaaagggctgaggaagaatccagaaggcgcgcgccagtagtcgcgggaaagggtggcggtttgtgggcccacgtgtcagtgattggtgatatgtggttgtgaacttgtgatcaaatttgtgctgattgtaaaatttatatttctttcgtctcagaggataatgagacttctagggcttttttatggaggttaaggttctattaattggcacaactccaaatcccatatacatattacatttaaattttttatgttgaattatattgttataaaattttatatttcatctaaaataggaacaaaacaatccatttaaatgttatcaacaaattcgcatatccaaattcatggattttgtagctaggaatactcagctttacaaaatctagcatccggagtcgtggcaaacatggcctaggaagagatatataattgaactactgaagtttgtgattgtttgacatgagggagtagatgccaaagttattgtgtttgggaacaaatattgaactgttatattttggagcggaagcaatacaatttctttaaaaatatgaatattttatagtgacaattttgaactgttatggattcactttgaaatatgaatgtattggtatagtctttaagttcgaaatctctttttagtttgactaattgccgatcaaaatctgaaaagtttaaacctatttaaatcaaagttcagtaccatatatatgcacctcatggaaactatactctcttttctcatgcaattcaaagcacttctgcaatcagattaagatcagatgtcattacgagaagtacagattaatattagatatcattacaacattgcacacactaagcacgactacaaatacaggcagaccatctgacaacacggaacagaacatttgtggatcatcaacacctttactcattttacatgactggcaggctatatggcctaacaacgaacaaatcactacggtcagtaacacagggagggaggcatgccagtagcaagcagaaattcaactaaaattcagttaaattcacatggcgaaagctgacagcaatgtggtataatttgaatgaaattagctattccccagccgttgggccatttgagttgaggtaacccatcttctccgacaacacattcatgtcgtcctcgacgaccgggttgtcgttctcctcaccaacaagcccttcgttcagcagctcctcccagaaattgtcgttcaactccccctggggcccgatctgctgctgttcggaggcgccgacatcgaaatcctgtggctccaccagacctccagcatccatagctgagttttcaagatcggagggaatcccatcgatgaggaattccaccgactcctggggatcaaacaaggccggtgactcttgctctatgctactgctagtgccgacgtcgtcaacttcaggtccctgatctatgcgacgccttcttttctttgaaatggcatcttggagctcctttctcatctcattctgggacataagttgttttaagaactcaggatttttcatgacacgcgccaagaatgccatcatctgctgttgcctctgctcggttccttgcagcctatcctccatggctttcagatttgcctttgtattctgctgctcctgccttagcttcaccacctcagccatcaataattgcttgtctctcttcagccggtctatctcagcatcatatccaaagtggcccacctcaaggtatggcccaagggattgctggtttgaagcagtatgggaaggtggttttctacgcttgatgttcttgagaagatgtctctgtccccgcagaaaattctcatttgcaaattcccaccgatcaggatccacctttctgaaaccctgaaaacaaacaaacaattcttcagggaaatgttagttgcaagagacatcttagacaagtatgcaacaggatgctacttctttcttggtagggggagaattacacactaatacttctctctcacttttttttttttgcttttttgttaagatcacaagttgcagcagtaccaacaaagatgaagctacaagaagtatcttttgtgtacctttctggaatgcgtttcagttcaatttgcaaggtttcagtttgtgcagttttcagttctttctgcactaaattcatcaagtttctccttcaatcttcatcgatttcataagttggggcaaattacaaattcagtcatctgttgccccattccagagggcacaagttaactatcaactctagcataagaattgaggatatttattaaaaaacataaacatattgatcttatttacactatttaaaaatagcccaacgtgatgcttatatgaagttcaagtagttgacggtgacgcatagcataaaagatgttggtacacaaccgtaacatgcccaaaaaaaaggttcaaaggatggggacaccaggcacagcatgaaaatggatctccattactttgggaaatggagtccagatatgaagacctgaaatacagtactacagcacatgcaggtagggcaatgctgcatccatccaaacaaacatcgaatcatttcccctgagcgacttttgtttctgttaacagcctttttcttacaattatgacagtggcccaacaaaaatgagaaaagtccaaattttcagatctaggacaactgccattcaactatcatttgtccatacgttgcttgttattccacagaagtatgtcaaatctaggatttctttgtgcttttaaaaacaaaaactctaaatagatgtttatatgcgcttgtgtaagttagttcgcttctctgatgaaatatcatgagacatagtaagtgtttcccagagattaaatatccttatcaccaaaaaagatctgagatccctactattcaaccataacaactgaaaagaacccggcaaccttaaatgcctaactaatttcctctgttaaactttgaatgaccacaaatgacaattcaatttggatggttacaccaacttattactccacaacatatagtttatactgcaattgtgggggttgttccaacaaccaagaacaagaacaatttcagctacattcatcggcgctagcggcgaaacatcaagaactgaaccaggttgcaaacaagtgcattgcaggacaaaatatagagggagggggagggagctgtggctatgggcttacataggtgttgagctgcctgacgaagctggagaagttgttgtgcttgaagaacctggggagcaagacggtggcgaaggcgtggggatcccacaccacgaagctgttgctcgtcgcgctccacgacacggcggcgtcggtgccggcgtcgtccaccatgtcgtacgtcttggtcaggaacggcggcggcccggcgtcgtgcagcccctccatcggcctcggcgccacccccgccgccaccgccgccgccccatcctctcccgccaccacctccaaccctcctccgtcccgtggctctcctcctccttcaccgcattcagcattggatcatccatagctcagaaggcccaaaaccccggtacagtacactgaacctccttgtccggctccgacgccggcaatggcgacggcgaggcaccctggggctgcagg

SEQ ID NO: 45955 - DNA, 2168 bp, Oryza sativa
tagggtagggtagggtaggggtggctatttcgggaaaggaaggttctggaaggtgggggagcggcggaggcggcggaggggggagggcggagaaggtgaatgctactgccggtcggtgagggtgggggagggacacgtgtcggaagggtgggcctagttgggccgcacatgggccttgtgtgggtgacaagtgtcggcgtgtcggtagctggaggaatccgaatcgatcaggagggggatatgctggcacaggaaatggatgggttgtgcaccgtccgatccaaaaccaacgctcaaacagtagctcgttttttttttcttctttttgggggtggtgcctacggggagtgccattcggcttaggagctgttcacttttatgttaaaaaaaattactaaattttggacaatgctaaaattttggtatagttgtcaaaattttgacaacttatcaaaattttggcaggattttttatatagttaccaaaatttagtagcaaactaaatgtagccacttttttttttgttttgacaactttaccaaaatttggtaaggttaaaaatagcatcaaagtgaacaggccattagctttattgacatgaaaaaaaaatatagttacatcggatgatgatacaaagcacttatatgtatttgtagatgtgttgcaaacatgtctgccttttgttctacatttccaggataaaatgaaagctgaaaggagaaaaacaaaatgctctagtatagcaaatcaaaggcgggaaaaaaaagagaagcacttaaaacatcagtatctctgctttagaaccaaattctaagtcttaatcgtttctaacagcaatcagcgggtgacacacgcgcggcggctgggctgcacctggcacttggccgacgtaatctcgctccggcgacacggccgccggaggctgcaattgtgttgcgtggcgccatggcccgccgtagtagcagccgccgccgccaacgcaccttgcgggcggactgtagctgtcttgcaatggcgaatgtgtaatgattggaaatttggggctaaccttgcgtgtttctttttgcgcggacgtattatacttcttgtctgtttcttcaggaaaaaaaagaatgatgttaaaggagcataaaaaaaaggaaataataacttcaggtgttcatgcacactacatataacattggtattcacaggccagtcaaattaatacagtatatacttactaaagcctcactccgatgctttctacttgtagtagaaaaaaaatctgaactgttgatcttatttgatcgaagggttcagatctatttttattaccacctcacttagtggtagtagaattgtggagagtacttttatctatataaaattatttacggagggatataatcgtcactttcactttataacaatagctaccctatcttctttcgttctggaactgacgcctgcatctggagcccatgccgagagaacctccctcgcgactcctcccttccgccgcctcagccgacctcgcctgctccgccaccctcgccctcgtctgccgcctcccgacgcactcgcctccgccgcctccaacgtttatctagctctctgagagaaatgcaccagcacatttgcccgcagctgctccattgctcgatgtcgtcaaaaatcttgtcgacaatctactgaattgagcattttgctttgcatcttttctgacacatacgaagttggttgcgtataccattgaacagaccaagggagagcttgctgaagaagcatgatagcagcaaaacctgacaaactattctttgatcaaccctaattaactttctgtccagagtttatggttgatagcatatcactgtcaatgcattttgcgaccatcgaacaagtctacagtaaaacggttttgctatataagagtacataggagtgggatttcaattaaatatataagaatgacaacttagcagcttgggatttcacttaaatatactccctcaatttctaaatatttaacaccgttgactttttttaatatgtttgaccgtttgtcttatttaaaaaatttaagtaattattaattcttttcctatcatttgattcattgttaaatatacttatatgtatacatatagttttacatatttcacaaaagtttttcaataagacgaac

SEQ ID NO: 45956 - DNA, 11941 bp, Oryza sativa
aagaattcaacacattgtgacatactagggtattaaatccacatccatatctgaaacgaattgcttcatatccagaagaattcagatacatgcagggagtagggtcaattaaccaaacagacagagacaaacagaaggatcagttactgttgaaaactaaaccaaacaattgatgatcagttggtcttcagtactaacatggattagtccatatatctatgaaacgaactgcagcatttcagataaatttccaactaacgttttcccttctctgttcagttcacaccagaattcaggcaaaacgcaacccatacaaaatcatgaacaggaaaacatcccacagcagaagctcctgcgcgcaggccggtggggaagcggctagacgccagcagagaaggggaacggaaggagaggggcgccggagagttccgccgttggcggaagggaacgcgatgcacaagcgccgccggtagaaggagtcgaggcaccggcggaaggagtcacgctctccacctccgctcgattgcgatagatgaggattccgagcgacgctaaccatgagacccacatggagaaataaattaagtgtcaaatctaccccaaatctgtcttagcaccaatctacctaaaaaaataaacggttcagattagttctactggtagtatcatctctctacttcctaagcaatgaccttattagagtttatgcaggccaccacctccttccggtgatccattcctcaccagagccgagggcatccagctcctggccgctctcggcagcgggcatgcagatggtgctcgccgccgccgtctcttccatgggcgccggcgacgaccagctggacctcgagctgcatctctagatcgacgaccgtacacctctagtacgtacttctgctcttcaatttcctgaatataaataatttgctttgcacgtaatatactttgtgttgtttgtaaggtataggatttgggtgatctcagtcgtgtttcttttatcttttatggtataccttttcttttcctggttacgacctttccgggttgtaaccttgtaatttttctcctgctatatcaatagaactttacaccgacttatgcgagtcgttcgaaaaaataatttgctttgcacgttgatgtaatatgaaccgtgtttttggcctccccagttgcaacaaagctctggttagtgatcatggggattaatttccaacatgtattattaattattaatttgtgctaccatgggaattaattatctattatctatctatctatctatctatctattatcttctattatctattatatactaaaagtccattaatcttcctataaacactcctaagccaccatgtggcgctcctacaaacgctcctagatcgccacgtggcattttataatcttaccgtcgattttcatttaaattggtgtacccgttattttagaccattagattagattagatctatttgctttgctttctgtcctgtgcataatgccatttataccgggaaaaaaattaccgtcggtatgtacttggaaaaaaaaataaaggtacgtttagttgatgttcctttaaaaaaaacgaacgtactttgtagttacgtacgataaaaaactataaaacagaaaaaaaaagaaactgttcacttgaaaaaatataaatatatatatatagacaaaaaaaaagaaaagagcctttgaatattttttaaatatgtttattgatgttttcctattaataatattttcatttattatcacatatttatgtacataggtagaaaaaaatagacattgatctttttaaaataaggattttccgtacaataaaaataaaatttattccatagatatgatcatgtggcgatcttacaagtacccttaccgccacatggtatgccaattttcatttaaaatgatggacccattttatagattattagattagtccgcttactcttagtttcatgtgtatacgagagattgtttacggatgttcgattgaaacaaaacaaagaaagaaatatatgtgcatacgataataaatctataacgcccaaaaaatacatgtataagagtacgtaagtacgataaaaaaaccatcaaacaaaaaaactttagatattgttcacttaaaaaaaggtacgtacttatgtaggagtgaaaagaaaagcaataaaatcttaaaaatatatgtacgtcagtagaaagaaaaatagacggtctttttaaaataggattttctatactataaaaataaaatttattactccacaaatatgatcatgtggtgtttctacaagcactcttagaccgccacgtggcagtctataattctgctgtcaactttcatttgaaataatggacccattattttagatcattagataattagcccgcttcctcttaatgtcatgtgtatatgagagaaactatgtaccggatattcgattgaaaaaaaaaacaaagaaacatatgtacatacgataatgaagccataaagccctaaaaaaatacatatataagttggtagaaccttaaaaaaatatagatgttcttcagaataggattttctatactataaaataaaattcattactccaaagataaatatgcaggttaaactattttaatataaaaacaaactaaatgtgtttaatcactcattttcttaaaattatttttaattatatagtcaacttataataaggtgtaatcaaatgttgatgacttatcatagttatattatagtgctaaatacattacaacacatggagccgacataataatttaatataaaaatactttttcaaataatttgtgtgacatataataattaatgttatgataatctttgaaataatttcatattatattttatggtcaaatatcacttgataattatataacactaactgaaatctacgtgcatgaaaatgaaacaacgttatgttttgtcaattatatctgactttattttaatttttgtgagattaagattcttaattgtttattgtatttttcagagttatttgataggtatgcctaggcaatgatgttgctacaatacaactccttaatccatcacaaaaattatggtcatttacatttgttattttgtgaaataggtttggtaacaaatgaacaatcttataacatgtacataaacctactcatgatatattttcttacaattgagaaattataatatgttgggcataagtgataattgataaatgtacgtcaaacatcccactgatgtaactataactgcacttcaacaaattagttattataaataatttgaaaaaaataaatacatttagaattagtaaaggtgtctcttgcaattatgaacaataggtgagaaaaacaaaccagatgctaaaatatagatctttgtcaaaatacaaactctgaagattgtcacagtcacatgtttgcttagctatatatatgtttaatgatcaacctcacttatttctaaagattacattgatctgtaccataaaaaattaagaagtattgcttaacaccataaacaaatcgtgcctacataaaacataaagaaactatttttttatgggaagaaatgaagaactattttcatcacatccatattgactttgtttccttgaaggataccgagcatgaataacagagcttgctatgctaccacaagtatagcagggggcacatatggttgagttgaagaaagcccagaggaggccaccattgataatagtgctcaattttctacttacttactgatgcaatcttcttcgagggtgccgatagcgaactaggattagttaaaattgtgctccacactaattgtgagagtcacgactatgtcaactcatgcttgaaggcagcggataaataaagcctcgatggttccacccattagagggggcattcatgtctatttcttaatggcgctatcctattaaccaataggttaatacaagcggtagttttagaatatttattcatagatttagaaataagtgttgagataaacatttaggtatgtagtggaaatgaatgtcttatgtattaatggcgtattaagtttattttggtggtacaaatgaagttccatttattaaaaggatatctaccttttaagaaaaatgataataaataatggtgataataggcaagtttacaagtaacctggataaaagtgatttttttaaatctaagagacattcttatcatttatatattaaagtttacgatctatttcaccatatagaattttgttattatgagacaaaatctataatttcttaaatctatttgatgagatatgacttaattctaatagcattatttctataaacaataaataagatgcccgcgcatctgcgcgggcttcctttctagtttaattaaacttcgttatgccatatctaattgggtgatgatggaacaacggcttggccttcatcttctcggtcacccggggaagagaaaggggatagaaagagagagataacggagagggagggagaagctggatttttcacattttggtttttttgaaaaacttattttgtaaatagaccaaaaaaaacttatctcaaaaatggtcctttttgaggcgccagagtcactgacgctgtcgtccaacgcgacggcgccagctcctactgctgacgtgggtggcgggggagcgcgccagccagacaaccatattgccctcccccctccccgccgccatttttcctctcttctcctctatagtgtagaggagagagatgtgcaacatttttattttcattttatttttttcacacttatgagcacataagaaccaaccatgggaaaaatatactcaaatgaacgaaatacgtgacctgtagaatttttctaaatctataccgaaaataggcatcatttgggtgtcatttcttaaaataggcgcaactttcaaaattaaaacctccaaattctgcttgcaagattgtgttttcgaggtgagaagcttttcggtagagctttagaaaattccacaggtcacatatttcatccatttgaatttattttttctatgataggttcttgtgtgatcctaagcgtgaaatattatcaaaaaataaaataaaaataaaaaaagttgcacgtctctgtcctctatactagagaggagaggagaggaaaaattctacaagtcacatatttcgtccatttaagtttattttttttatggttggttcttatgtgctcctaagcgtgaaaaaatatcaaaaaaaataaaaataataaaaatttcagagggggagggtgggcgccagccacactagcgcgctccaactgccacctcagcaccgtcccaccacgtccgagagaggctggcgccgtcccgttggacgatggcgccagtgactttggcgcccccaacaagaccatttttggataagtttttttaggggtctattgtgaaataaatttttcaaaatgattaaattgtgaaaaatccacgagggagaaggaagaaggaaagtagggagagagaatgatatgtggacccatatgttagtgggtcccctcttttaataataaatgggtctcatattttataaaaaaaattctaatgccacgttagagtcacgtgggatgaaaaccagctcaacactatcacatacgcgtcagcgaaaccatcctccaaaattgctgagggagttaaattaagaaaatgctaattcacacgcgcgcattgccgacacccacttccggcccacaaggcccacgtgcgcgtgcgattctttcttttttttcgcgacgccatttctttctttctttatttctttctttttttgctttttcttctttttttcgcagctgtcgttgtttccttttttttttctttttgccgtttactaccgcacgcgtgtaggagtaggactcaagaatttaaactttcaactcaagatttttttttgaaattttcaactcagatttgaaaactttcaaatcaacatttaaaaacttacaactcgaacttgaaaactttcaactgggatttgaaaactttcaacttagattttaaaactttcaactcagatttgaaaactttcaattcaaacttgaaaaccttcaactcggatttgaaaactttcaactcggacttgaaaactttcaactcagacttgaaaactttcaactcggattcgaaaactttcaaatgaagatttgaaactttcaattcaaatttaaaaaacttcaagtcaagatttgaaaatttaactctggtttgaaaattttgaactcaaatttaaaaatctgagttgaaaattttttaaattaagttaaaagtattcaaatcttgacttgaaaattttaaatctgagttcaaatctggaattgaaagtttgtttcaatcaacttaaaaaaaaagaagaaagacgtgtgatgaatttttatccaaaaaaaatcgaaaaaaagttagcactaagcgctcttagcatcaaaaaacgcgcacggcatttacctcctagcgcgtacgcgcacgttaggagcccccgttaaattacaccaattttaatagttgggagtcgaaatatccgtattgtgattcagggcaagaattagattcgacctgcttaagagagtcaaaacagacttattcctagtttatccgacagtaaatacctgaccaaatcgaatgcggcctggttcaacacctacgtcgataaacccgtagactgtagtgggctgtggttttggagtgagccgtgcagtgggaagaagctggtatttggaataaattcactttaggtcacacaatttgtcactgagttcgaaaattagtcctgggtcgcaaaaccggatacaacgcatgactaacttacaaaaccattgcaaacgaggtctctcgataatattgtccctgtttctggttgatgtatcacctacttggctcatttgactagatctttgtcccacatgacattgacatggtgtttatgtggtattttaatctggaaaaatgtcacgcccagaaatttccgaataaaattccaagcagaatgtgcattaaaatccccgtccaggaccggccggggtacacaaacgacaacgttgacattcagatccacgtcttacaaacatcataaaagtcttacataaatgcaacggaaaaacgaaagataacaggagctaagccttgacttgaactgcagcgggaaaaccactccacaggcatcctcgacggcacggacgaagcctactcctcaaagaaactaccatccgacacatactcatactctggggttggggaaaatagagcaagactgagtactatacactgtactcagcaagtcataccggaataggggtatgatgcagggagttatcaaaggagagctagagtggttcatttgcataaagcgagcatttataaacagaagttgaaagaattaaacagttgtaataattaatcaatattaatcatccactgtccaacgctataccacgttgcgacaggcccaaccatccacctaaactatccaatttcaacagactaaactagggtgaaactaatcacggtgaatctggttgaccgcccataaccgcgggcacgactatttgaatagttttactctgatcagaggtgtacaactgtacccacaagacacagccccacgacacgttaccgtgcgctgacatgccaccacgacataccagaaagaggccgtgacaagacccttcgcataaccccctctaaccaagcacaccacacctcaggtttcacccccactcctcgcaaggcagcgggcagtcccctctcgtgcctaggtgaatccagaaacgacggaggccgtcgcagggcccgccccgctccatcacgcccacccttgcctagatgcgtcagctagaggaaagctacactacaagcccagccgttgcccacgctggcttgtggtaagcacgataaattcttccagggtttcccgcgaactggtccttaactgccatggggtgcgaccaacaaaaccatgcacccacagcccaccatgtgattcattttaattaaccaacaccgaagcggtgtcactaatctaacagtaccattagaaccaacagtctaaacattaataggattttccccattgtgtactagttgaactaagcatggctaagcaatccctagtccaaagtctattcatgttataacccaagctaacaaaggaacatggtaccaaaataacatggccgtaacaataggtaaacatctcatagtaacattataaaccgatgcagtatttgaagaaaaacaatagagcatttgcaatataggatcaacatgttcaagtgacaagcatgacttgccttgctctgctgctggaggaacctcggcgactatttcgaagtacaccggagcgtcggaagaaccggaatctaagcgacatacaaagcaaacaatacaaataggctataagactactaaaacagagaacaaaaccatttttaatggattctacacatttttcttgatttactgagacttgaatgggcttaaacggagcacggatgaattagttatgaattttagaagattcactgtgtttattactatgacaaaaagtccttaaataatttattgcgcaattaattcccagggctgacgtcatcaagggggcggcgccgacgggcggggcccgcatgtcagcggctcaaggggagagaggggcgccggcaagtagggcccccgggtcagcggcccaaggctgccgatccaccgtggaccgggaccacgcgggtggtccaccgccggtccacgggaccgacggcccagatcgccccaggaccgatcggacgggcggcggcgacccggctcagctcggctcaaggctggccgactggccacggtgatggcgacggcgcacgcgcgcgcacgcgttgccggcgatggcaaccggcggcggaggctgcggcgcgaaggcggcggcgctaagcggcggctaggaaggagagggaggggaatagaggggagagggatgcctcaccgagagtggccggcgcggaggaggacgacgacgaacggcgacggcgaccacgggcaaacggcggcgacgggcggacgaggtccagaatgccctaagggaggaaaagagagaggttagagggagggagacgaaccacggcggccggcatccatggccgaaggcggcggtaggggtagagctcaccagagcgcgaggggatgcgggttccggcgacgaatctcgacggaggaagggcggacggggtggagttcgtccttgcgaacccgacggtggcgacggcgcggtgcggcagtgagcctagcggcggctagcggcggccggagtagcgggagcggcggcggcgggtggttgcacggcgcgggagcgatggggagcacgagggagttcggcgaaatagggaaaaagagagagggggcgacggcggagcttaaataggggaggggaatcccggacgtggccggtaggggcgggattccgccggccaacgcggggagtgggggaggagagagaaaatcgaatcccggccatctcgtgtgcgggcgcgggcgggagagagaggggagtgggcgcgggaggtgcggcgcatgcgcgggcgtggccgacgtggcccggaggaggtggagacgtgggcgcggcggcggttgcgggcgcagcggcgcggcgcgaggtgggagacgggtccgacaggtgggccccacctgtcggtgacccgggtgagaggaggtgggcggccagctcgcgcggcctagctgggccttggccttcggccggcccagcgggaggggaggaaggaaggagaatgggccggcggccattcaaagaaaaagagaaaggaaaagaaagaaaaagaaaaagaattttcccagggatttaaatattgcttatgctcaattttaattggttaaaattatttctagagctctgaaaattccactaaaaatcttgttagcgtatttcgacatgtagaactcaagaaaaattccacatgccaattccgattattatttgcattaatttatcaaggtttactcttgctttacacaggtattttcttgagaccatttataacttcaatttaggcttgggaaagaaattcggggtgtgacaaaaaaaatactgggttccatgttgagcccacaaaataataaaaaataatggagcccatgtggtgcccacatatcaatgagacataaaaataaagaaatggaaaaacaaaatggacctactcgtcatcccctatccatttctctccatccccatctctggcgacatcgctagccagtgagcttgccattttgtccacgagaaggcggtgattgtgttaacagtgaaatttggtaagctagagaattatcacatcaccaatagtcggattcctgctatattcggttaagtaaattaatctattaaaggaaacttatccagaagtgaccgaattcaaggaggatgcgacatggaaagttatctatcaattagaaatagtttgttggtttccttttatctttagaaaagtgtgtttagcggtaagcaaagaatagaatcaactggcattttgtcattgatgtacaatagtatatccttaaagtgcaggaagttccatggtattctatcagtggctcagtgcagaatgagtactccacaggaaatttggaatagttctcttttttttttgttacatgtaatgcattaaggaagcaacgtgagatgcttagaggaagcaacaacttgacaagatagagttccatctcctatcatgaaaaacagtacgacttaacacgattactgcaacaaaaattatgctaatggtcgaaacagcattggaacacaccaaatagaactttttaggaaaaaataacctaccatagaacagaagtcattgttggttctccagaaaaccttaggggtggttctccagaaaaccttaggggaggaatccaaaagaaaggaaatgataagaataaaagaaaaaaaatacagaacaatatttaattatcaacaaacaggcagataggatatgaaactcatgtaccaaaaagtttcaataatagctgcaatggaaatggagtgtcttacacaagtttaaccacagagttgcaacaaaatagatggcattgcgatggcaccacaacatatgccttgctgctgtagacatatgattgaataaatgttcacaatcaagtgatcaacagggaagctagctttgggtttaacataataccatacaaactccaaaagtctagattatacaacttcagcacatactcaagctatattatacaacttcagtacatactcaagaaatctataggtgagctcgacctcgagcacctactcgggcacctattcatttgctgacttgagcacctccttggatatgggtgtgggggtggcagttttcttggtacgttggcgggggaaatgatcacccctcctttccccttcttgctcagcgggcagtgtggttgaaaaatcatgaaaactttatctgccttcttggtctgcggataacaagttgccaaggtcatcaagacagttagccggcggcgagcatcaggaagctatcctggtgggcatttgcggtgagcttaatggagtccaccctatcagttcgaaaaggaaaacatcgatgagaaaacattttcgcacaaaacattttgcaccaaattcacaaaacattttgcaccaaattgcaatctcagatttatggctcactcaatgttagatttcatcagctgaaactctatcatgaggacgttgaaatcagcccgcaacaggtccatctcccgaccgagatcacggataagtaagccgccgggcagtggctaggatggtagggggtgtctgcgaagtgtagaagagacgtgcgaaccacgcaggtggcgtagatgcggcggcgccggttgtcgtcgcggcg

SEQ ID NO: 45957 - DNA, 11874 bp, Oryza sativa
ataaatgataaaattggtgtgcttgtgaatttgaatttttttaaagatcaatcatttaatatattcagagttttttaaacatatcatgtttaacaaaaaaatacaatcatttttttaagctgcggaggtattaatgatcctatttcatgatataagtttgtcttctttctttttttagatttttcaaggttattttctttttttggatttttttaataataattttgggtttactacatattctgagttataggagtaacgagtaggtataggatatttaaagaaggaaaataaatgtaaatttgttgttttagatttgttttttcttaataattttgagtttactatatattttagagttataggagtagcgagtatgtgtggtatatttatagaagacaaaggagtagaagtttgtggttggaaagggagatagttttggaagcctctagaatccatatgtgatatttttctctagatttttcctcacatatgattaggtgttttttctctagtataaatttatgattttttcttcaaagtaagagacgccaagtggaccaatcaaaagctagcaaaagctttagattattagatatggatagctgtttcagcaggtgtgtcatgctagtgagcaaaaacaaaactaaaatgaaacatatggggcatatgtcagatccaaattcaacatctctttttttttacctgtgtttttaataacgatttaaaaaaaatcaattatgtaaaataaacaacggtgcaaacccccctcaaaatcaactccaaaattaagattcaaaattcaatttttggttatggatcatataagccaagaagaaaaagaagaaagaaagaagtacaccaatgttcagagaaagagaaggtgaagatatgcactgacaaaagaaggcaaaggaaaagccattgaaattgcaatcatgcaggagcaactctaaaaaaggggttgatgctgcaagtgcaaccaagctgtactttactctgaagggaaagcagaaactcccctaaatataagggacgcgtcatttacacatgttaatacaccatctgatgactgtaaaacccacaggtaaagtaggtctaaaatggtgcaaaatttgcatgcaaggttcattacagaaaaaattgggagctaaaataggggcctgaaagttacatcatgcacggtgattttcatttccaggagacaacagttcagtgattaggcattacttttacaaaagccagcagtcatcgagtgctaagattcatcgatgatggcttccaaagaactagtgctttcatttttcctttcttgctgaatacatcatattacagtaattaacaaagaaatgaagaaaattggatggagtcaagggctgtcatgaggcgcacctatgagcgcaaaaatcatggtatgcaatgcaccaagtggcaccacaattttttgttagggctcttggctgttcacgcgtttctgaagctccagcatttcttggtgatttggatccagagaaagggcggctcgacagtcgcgaagagcgctggggacatccccgatatgctcgtggaacgccgcgcgaagatgcaataggtggaggtcagctttgaatgcaatcgccctggttagctctgcaattgcttctttctccttgtgactatccatcagtactgcaaaccaaagccatcaaaaatcttttaactactccatttcttaaaaaacaactacatcagatataaaacacgctttcagtgttgaaagttgcatgttcaaataagagaaatgaatacacagaggaaattataggtaaggaatactgcaatggtgcagttcagtcaatagttcactaactaaatttgctctgacaaaaagaagattcagtaatgacagcagacatttactctacttaaaagatggtagcaacaaagtatctgttttgtccagcaaggatgatgaacaaattaacagttctccatgcagaagccaagataaggtatagagtaacctacatagtaacatagtattcaaaactaaaggtaattctcaactattaagtaaactttagtctttttacctgctgcacggtatctgtacgggtaaacacgtaatggatccaactgggtcactatttgcaaatctgtcatagtttgctctcgttcacaatattccgaacgtttctcataagctgaagcattgtttttagctttctctatcaactttgtcatttcttcatatgcagcatccctgttattcctgagaaaatgaacacgggcaagaccttgatgtgccctagtgtgtcggatcttcaaagcactcgtgtagcaatcagctgctgcgtctaacttctcacaatcaacataaacaccaccaagattgttcaaagcctgcaggtggaattatgcaatattagagaaaagcttatcataaggaacaatcgagagcaacttgttggatctgactaagcaagataggatcaaattttggatgtttgtattactggcagtcataatacagtatttaggatctatttgtcttaactagtaggatcaatttcagacaaaaatcatagcaagaatgtcgccctttggtccatgattaagttaaccgacacttttcatgttcagattctttaacttctctctttttgttcatgcatctccacatcatggacatgcataaaacagagtaggtatatagtatgttgcactgatgatacctcaacatcaaggatataaaattttgagttattggaatagttttgaacaataatataatttataattagccagacaagacaacattatccttttctcaccagcaactcttatttcactgagacaactgatcactgtccacaaatgcaagttttttttaatggtctcattgaaaaatttaaggcatatttaatatcacaatgcaaaataagtgtgtatacactctatagtctatactctaagttatatccagctttctatagcagctagagatctctcagtctatgtgcaaaacagaatattcccgcaatttggagggaacaatataaaaggaattttctcacgcctcatacttaaatgtttggagggaacaatataacaatattaaatgttatcttcgctttatttactgtcgagcaaagcatgcagggtcttaaaaatatagaaagtttgggaaaaccaagttgctctccaccttaccaagtctgagcaatgtgagataaactaagtgttcaaaacaaatcaattagcataagtgaatgctacgttgaagcatttgtgtgctggtgcgcaacaatactaacctgacccttccgaagccggtctgaagggcactttagtgcatcttcaagaagcgatataacagtcgcagaataagaaggatcaacacctgagtcagccaaaacataggctttcagaaagaaagcctcaaatgacctttgaatagaaatagattcctctgctttttgtagggcctcctcacaatgcccagtatcgtacaaaagccacccctcatacactagccgttcatgctcagttgctgcatgttgccgtgccaattgcaaactgcgcattgcagcctcaggacagttcaacctgtaaacaaaaaaatattaagcatcatctatagttatgttgagagttgagaccaaaatggccacaagggaatcaacagagtgaggtgctagtataactaacctaaggagcagcaaagattgtctgaaatacaaaacaccttttgctgcatctgactcaagcatccggtaaatcactgaaagggaaccaatatcatccactgatgaccagcgttcatacagctgaagccaacactcagctgtattccactgctcgacatgtgccccaagaagagtgcctattttggaagcagctacacgaccttccaacattcggtactcaggagaaagtgtaaggatagcatggatatcacaaattgcagatttgtagtcttcgagagcaagatatagacaaatccggagctccaagcattccaatgctagcttgaaacccaatagtcggttgatttcctctaaggcaagtcttgcatccttttttctcatcaaggatgcagctcgatacatgtaagggtaagtgagagttggatccagctcagttgctttgtcaaggtcacccaactttttatcaccctctgaatacagagatctctccatatacatccatcctagtggtacacttgatgttatgaccgaactgagcttctcataagccaaaccctttctacctcttgtaccagcaattctagcaagaccagcaatggaatacacatgaccagctgagaaggcaacactaaattggtgttcagcttcattatattccttccttaaaagcctaatgcatccaagctgatgaaaagctatttgcttctgtgtaggagtaacagccaattgaacaagcttctctgacaagcacacggttgcctccgtccttggatcaatgttcattgcaacctcactaagcaagcaatataacaaaaaggaggcatgtccaaccatgatgcattgctgctgttcagttgcacttaggaataggctaactacatgctcatcatttagacaatctggaagctcctgcagaaacacttgcaagcaagatgcagcgaggactggtgcattttcttcaaatgccaatgccatgagctcaacagcatcctgccttgatgaaacaaatgaagctagtttcctatcacacgcatctttaagcctgtcacaacaaaatgtatttgcaaacaccaggatctccaacaaggtttccaaaggcaaatcctctaagctatatgtacaactaaattcagatacagccctcatgccctccagtgagataccattctccgacaaatcaacaagatcaagctgagattcagtgaatggtccattgagcatggaccagaaagggatcgatagagaagcaatcttgcacctattgcatgtcaccttcccatcccttatttggaaggtcactacaggggaaactttcgaagatgtgccgatatcacaagaaccaagtatctcaaagtctccctcgggcatctcggatgcgacatcaagtggcccaaactctttgcaacacttcctacatgacgcgaggacatcggatatgatatcctccccccgcttctcataccgcagccatgccccaaacacaatcttctcatgcacagtggtcgcgcagcgccacgcagaatgcaggctcctctggcgcaatttcgcctccccaagtccccgaaacacctgggactgtatcaaatacagccctggccgctcgctcggcacacattgctcgagctcctcatggatcctggacagcacctccacataatccaagggcttatacaatggtacgaccggcggctccgcgatctttatcagcgactcgctgcacatccaaacaatcggcacaaatcatcagtatatctagttcaattttcagtagcatcacacagaaatgagctgaacgcggtgagagaatcgaaaatcttcgaatcaaatgtagtggcccttacatagaggaaggcgagtaggacgatttgggcagcttcccacgctccacctgcagccatgactgcggattgaatccatggatatgctgctcgtcgcacggcgattccgacaggaagctgctcctcatagagcacaggaaggagaaaacctcccaaatctccaccactcccagatttttacacgaacctggatacgaatcacgagctaatgggggtacgagcgggaatccacaccaaccctagctaaaatttgcgcaagaaaacgccaagaatctgaacagaaaaagggttgggaatttggtggccaaggtaaccacctttttccagctccaccaccaccaccaacccgatccaaaaccacaagaactcgaacgaaatccacaagaaacgggccaaagatgggtcccaaatctcgccgcaaaaatcccacctttccgcgccccccgcgccccccgatcgaattccacagatcaagaagccgcgcccccgcggcaatggcggggaggagctcggattcgggatcctgcgactgcagggagcagcttcgatgcagaggaaggggggagaagaagaagaagaagaaaaagagaggatttttttttcctctcctctttcttctctctcttgtagtggtagtggatgtggagaggaataaataaagtatggagattagattaacctagtgttagaggaaaaaaatatttataaatttttttagggtgtgccttttgtgaagagagagagggaaaaaaatggaaatgctctgcacatgaatccatgcataggatgcagctggatggaccagcttttgggtgtaggaggaggtggaggggatgaatcatgaatgtgtttgttcaaatttgtgtttgtaagttttgaaaggtttttcaggtttggtctgaaatggcactttgccacaggacattgattgacattgtgattaagttgaattatggaggtatgggtacaaatcagggtttatattcctcttttgtaattgttgaaacatctttggaggtaaaaaatttattccaaaatgctttcagtgtatgtaagttgaattatggaggtattggtccaaatgacgatttataaataacccttttcagatttgactgaaacatcacggtggtgagaaaatttcattcgaagcatttttaattgatcatgggattgttaaaagctttggatctgaacataagttactggcgggcttactttacaaatttaaaaattaaaaaaaaatcccatattgggaccacatatttttaatttttcgctccacacacaattgaaacaacaaagttgaagtatcatgtgtccacaaaacaattggaacaatgttgcaggtgtcagctggtagctgagagtttggcatagtttgtcgtttgttgagaacttgcattaagagcagaaaccaaattaggtttcgttgttatgagacttttgtttccaaacttttttagggggggtttggtgaatctaaactatagtgaattgaagtggcaatcgcaactagtaacaaccgtactttgtttgtggagtccgtgtatttatatcatgttcgctggtatgttgtaggtggtactaaatttagaattaataatactacatgggaaactagttgtttggaaaaggctaaccaaatgcagagtctcataggttagccaagagttgattatataacaagcatcttattaacgataaaaaataatttataagtgaaacttttatatacgtattcttagcgacataaaaatcaatgctgagaagaaactatgtttaatatatcctaaaatcaacataaaaaattaagttttagaatttaaattttgtcaacggctgatttcatatatgggaaaagatgaggccgactgagaatgagagtattaatgatgaaatgcacacctaaacaaactcataggatggttctatcaatcaattttagctgatggaacccatcttttagatacttactcgctccggtttcattttaattgacgttttatacaatgacacagtctacaaaatatatttttaaccttatttttctattataatatatataataaataaatgtatgtttacttttattatagtattttgaaagacaaatctatatatgttgttctagttcctctaaactaaataatttttaagttatttatggtcaaaattataaaagtttgacttcaactttatctaaaacatcaattaaaatagaactggaggagtactgatcaatagtgagtaggagtagtagttagttgtgcatgcatgcatgaatttagttgaggtagatggaccagcaaacagatgatggattggattggattggataaatggggtcacgagatgagcacaagtagagtgaagacttagctgctaaaaaagaggtcaaaaaagaagtacatatatgatacaactagaaaaaaagggccaagggttaatgtagacgcattgatcgatcggaatggtcgttgggaatcataattgggtttgtgtggtaccctactcttgcttatcaagaacttattatggttttgaaaaaagaatttggcgtgcattgcaaatttgcagcataaatgcattttcccagctagctcaaactgcctgccttgtagacccaaacacacacattcttcagtagagaattttggaatgtactactgtgaaatggatttggagatgaaactaacgaattcttggctttgtttgtaataatttgaagctttgattgaacatttggacgccgttttgcccttcatcgaccatcatgcatccatacagactgcaaaaataaatagactataatagaggtctctttttgctgctcgatgcatcttgttctgtgcttgctgcccgaccatggtgacaaactcggcgccctctcatgcctcgtgttttccacctcactcacgctatatcgccgtcgcaaacatcgtcgtttaaaatgcacacaaatttgtgtaaaaatctgaacacgaaagtacagataagatggcattcgtcgggttctcatttttttttccaccaattttgcaacgatgcatatcatttgaacccttttttttcacaatggagctttcttgcttggtgtgatctcttggggttaatgggatgctgaatagctaactttttttaagatataaacaaacaaattaactattatagagttgaaaggatttttttcgccggccagccggtgacagaatgacgaccaatttattactccctccgtctcataatataagggattttgactttttacttgtattgtttgaccattcgtcttattcaaaaaaatttaaaattattatttattttatttgtgacttattttattatccaaagtattttaaacacaacttttcggtttttatatttgcacaaattttttaaataagacgactgatcaaacagtgcaagtaaaaaatcaaaatcccttatattataggacggagggagtaagattcaaggaaaatatgtaattatggacaaggatataatctttgaaaaacaatttgatcactattttctattataatatatataggaacatcaataaatatatgattttagtgaaatacttttttaaaataatacgtatagcacaacattgtaacgtaaatattgagctcggtccattcactaacttcacaaagccttatttcgatgggccgaagtcacggcccatacacttgcatgggccagatccaaacgaggattagggttgaaaaaatatattttcctcccttagttatagatccagtttcattcgaaatccctcgatcgtaaaatcagatactttcagtactgtagatataatatatcccgtatagtaatacttaaatataatatgcctatatttatacggaaaggtattccgtaagtatgcataaatatacacaccataatgggattccacacatacaccttgtcctgtttggacgcggcttgcctgctccccagggcgtgctccgatcagtgctcccgtatacgcggcacaattctagcgttttcctgtttttttccccttagcccacaaccaggagaaagattcagagaatcccgttccatcaaaccgaaaaaaaatcggcatttaacactccaccgcttccagctacttgctcttttagatttctttatcctgtggcagcagtggcgaagggtagccggctgccggcgaccagaaaccggcgagcagagccggcgtggtggggcggcagcgagggatgagcaggaggaagctgcggagcgacgagtggtggcgcatcacgcgcggccgtgctggtacgggcggagcaatgggtatcactagccactgggtagtggctgaagacatcgttgctgataggtctgaaagggagcagtacaccaggatgtgcaagaacctatcaaacaacacttcgaagctctgaagtaacatctatgtattgtagaatttcctaagtaaatgaccgcaatcaagcaggggtccttagaagcatgatttgatctaaaacaactgagccttttcaattagcactatatattggtttctgacagtaagatctgattgcattgcaggtttcaacttcagagtttacaacccacactctgctccacattttatttctatcatgggagatgttaaataattgttgtaatgatttgagaagacaagtagagaataaataaatgagcagccgaacattattcatgtacactctgtagttgaatccatcaggagagaatgatatttttctcataaacagggttgatcgaaagttaaaaatcaataatgacaaagaacatgagcatctatgtttatcttttgggtttctgctggatcatttagagtctcatccattgcttttaaattttggtgtggatatccagaagtgaggtctttttctgaaaaatgtgctgaggtgacaagctaatcctcagccattccaacgacgttacaattatccaggagtgaggtgtgattttgaaaaaattgctgaggtggcaagctaatcctcagccattcccacacgtttaataaatcaatagttgacgtgccgatcgaacaacgcatttgctttgagctggcaggagtagcaaccataccgcccgcgctggccggaccggccgtacgcaccgccaccggctccggctcatgcgcggttccgctctctggtctggtctcgagtctcgacagcgacccgaacggtcaaccacttccacgccaagtcgaaatcaccccccacccgcaccatcctcaccgtccgtccgcgccgtgcacgctcccagatcatcctcaccgtccgcgtgggccccaccccccaccccaacccgtgccgcactccttccttttccccgacaagccttccgcctctctcccgtctcctccccacttcccttccaccgtggtctcctcctcctcctcctctccacccgcatccgtggctccggttgcgctgctcgggagccctcgcggctttctaggaggtcgctggagcggccgattagaggggccagcgccggcggcgtcggattcggcgcctcttccggtgattcccctctccccttccccttgtttatcgcttttccgtgccgttgcccgggtgcgaaggcttctgggaacttttactgctgtgttcgtgctgcttcgtttgtttcggatagtttcgtagtctcattctctgctgtttcgtccagcgccgtgtcggtgcgcttgcgctgcggtatggtccccgcggcctggttagggtttggtgtcgaggtggtcgggggagtcttagggaaggcggcattgttgtatggaaaactgggggttcggcgatgaatccggatcgagcgcccgttagagtttatgcgagcttggtgcttcgttttggcgaatttttgggccgtttttgattgaagccaaaacgtgaccctaccaaaattttgttaagtttaatagtaaatgtgctagtttggattgaagccaaataattggtaattcccacgctcaatttggctatattctagaatcttcttcactcatactaaattttggttttatattggtattaaaccaaacatatactagctaactttgtctaccaaaaaattggtagtgcctagattttggtaattggtaattggtagggtagagaaccaaataggcctttgttccgctgtatttattctgtcagtaagagaaacttgcaacctttgttttgctttcttgtgtttgggtgtaactgtaattccatttttattttttttttgggaggaaagagacagggagaactccaagctcatccattttactactccctccgtcccacccacaatataagggattttaagttttggcttgcaacgtttga

SEQ ID NO: 45958 - DNA, 28189 bp, Oryza sativa
acgttgcaagtaaaaacttaaaattccttatactataggacggagggagtagcattcacttccctccgtccttacgtctgcggattacgcacgtgagaactgcgggggaatcaccggcgtccggcgtaagcctaacctcctgccgtgaggtgattttatttcgttcaagtttaaatacttttatatttaaattttttttatattattacattgaatatatgtacgcactctgatggagaaactatctttgatcggtcggtcaaaatccacaatagtcaggttgcaataaaaaactgctggttaagtttagagctatttattttaagtaaatttcacaaaactacaggtatttttcacaatttatcacaaaaatacatatttaagatcttgttttattaaactatagatttagtgtctactttatcacaaaactacaggtactttatataatctatcacaaaactacatatttaagaatttatttcacaaaactatagatttagtgtattcgtctatcccagaactacacatttagtgtcttcttttatcacaaaactataggtttagtgtctccattatcacaaaactacaggttttaacaacgctaaaacatatagttttgtgataaatgaagatattaaatatgtagttttgtgatatattgtgcaaagtgcctgtagttttgtgataaacgtagacactaaatctatagttttcttaaacaagcttttaaatatgtagttttgtgatagatcgtacaaactatatgtagttttatgaaatttactcttttttttatctttagtctcggttggtgttaaaagatctttattacagcaatcgagactaaagatctatttctagtcccggttggtaacatcaaccgaaacaaaagatcggcatgcgcggcgaagagtacaaggcatgtgcaagatcgaggaggagacgggtggccttatctcttcctctctaaccttatctcttcctcttccttctctccttttaactcctctcctcctttccctcccccatcatccccactatgatggatgagccgggcggccgggcagcgcggagggccgggcggccggaggcctcgcggcggcgggcggcgtgggagcaggcttttttttcttttttttagaatttatgattcggatctgtgtatttgatttgtgtgtgatgtgaatatgtgatgtattgtgatgaattttgtagaagttgtgatgtaattttttttaagattttgtgatgtatttggatatggccgatttggggatttgaggatttggggataatttatttgggattttgggatggggatggagtgaaattaatatattaaaaacacaatgaagaaaagaaaaaaaataatatatcaactggatctagctagcctagctctatctttagtaacaataaatggatttttactcctggttaattcactcgggactaaagatagtattctttagtcctgaattcgtagtggaaagttttccaaccgagactacaaagggttacgaaccgtgactaaaattccaatcgagactacgaagggttacgaaccgggactaaaaagcacttctccaccagtggaacactctctctgtcaaaaaaaaaaaaaagagacaaccctatgtccatatttaatgtactaggagggggtgagggggtgttttttttttttaaaggacggagggagttactgttagcacttgctagttactgttagcacctgcgcgtgtaatatttgcagagcacacataaatgtgttgttctcacgtgcgtaatccgcggacgtaaggcgtattagatttttacacggtatctaacatcatttattaattcctacaaaactgatattatgttaaaatacattgaaatagttctattccgattctatagtttttaacatgcggaaatgtagtactcatttaagtagtactagtagtcaacattttaatctataatactccatccgtttctaaatatttgacgccgttgacttttttattaaaaaaaattaagttattattaattcttttcctatcatttgattcattgttaaatatacttatatgtatacatatagtttttcatatttcataaaagtttttaataagacgaacgatcaaatatgtgctaaaagcctaaaagtcaacgattttggccgaaattttcgtttttctcaaattttaaaatatttgactaaaatatagtttttcatatttcataaaagtttttgaataagacgaacggtcaaatatatgctaaaagcctaaaagccaatatctcggccgaaattttcggtttctcaatttttgtgaatttagtcaaaatttggtcaagttcaattaaattgtccaaatttcagaaaatttcggcctaaaaatgggtgaaaatttcgccgaaatcgaaattggaaaccctggctaggggatgtactgattaatcgcaatattttttttttcaaaatttagttatcagcaacattaatttgaaatacctacagggcaacagactcccgcttcagttaaagagtgatggctgaaaccaagatccatgcaaacaagcaagcataagttgccatgacgaaatgcatcaaaacagacatcagaaatgagcaaacggcacaacgcaatactgccggtaactgtgttaaaacgtcatcctccaacaccgcagaagctcccgggcatgcatctgtcactattccgtccaatgttggcgagaacactatggctgacaataatggtgttagacaggaattgtcagacaaggaatccgacaccagaaggttacctctgctgctgcgggaatgctctctcatttcttgaaaggcgtgttcaatcaccaccaagaaggttactatattattctttttctatttctcctgttggggttgattctggcatccactgcaacatggctcgctcgtaagcacttcgcccaggcagttgcccttcttgcacttgtttcacaggttcttgtggctggtttgatcgcgtccacattttcataacaaaggctgaaggactctgcgatttgctcattcatttaggggtagaattgtggtatatgacatcatttaccacgcatgtctccacaaatacgatggtgtgcatactttagttggtacaaagggtatgatcgagttatacttccaatgtaaaaaaaaaaagagagggatagaatagtatattataaaatttacttgctgtgatactaaaatattgattaataaaatgttgctatcagtttgtcccaatgatctgcttggcaatttcagtaatgcattgttctcagttctcagtactaagtatcccaatttataggatgctcttatttttggaaaaaataaactcggtagttttaactaataattacttaagcgatatctacatcatttgatttgtatttaaaaatattttgaggtgatattttatagtcgttgatgacatgatatgaaataaagtaatggttaaaatatatcataaaagatcgtgtaaaaatataaaagccttgtaatttaggacagagggagtactgacgtgtaagtgtaagacaaatttattttgttaaaaatctatcaaattgaagtcaaatttgtcaatttgattcaaatttatcaaattgaaaccaaatatattaaacttgtatcaaatgtgaaagatatgtcaaaaggtttgaatatatgcatgttttgatgtaacagggccaataaaaaagcaagggtaaaagggactatttgctccttagttaacactgttaactcctcttaacggaatatggctagcctttatcttcgattttggaaaatagggtcaaataagcaaactataaaaagtagggtcagattagtgggtcagattagtgttagactccaaaacatggtcaaataagcaatttccccggaaaaaaatgttgcctgcaacgctttgtacatacaatcagatgtttacatgaacaaattttaactatcactagaacataggcatattaggctgcgtacgttcgagtgtgcacatgtttatcctgctaaagtgctaatcaacttctaccgtgttctttttataccaaatggatgaataattcagggtagttattcaattgtacaaatgaattgattaactaataataaaaaaattgaacataaatttataataatattctaagaaatttatttatagaatttttatcaataaaaatcacatatttaggagtttagaaaacatggacaatattcatccgatatttaatacaagccaaaaaaaaagaaaaaagaacaccatatcaaacaaaatttcaatgaccatatatatataccatcatccataacagtttgcatataccatcatccataaccgaacgcactcttagagttataaacaactaaggtatacagcattaaataaagaaaaaactagttcaataatttttttagatgtataagatactagtgccttccaacggatagcagacagatcgcaatgttcccagaaatactactcagatagacatagtacgcatatcatctatcaatttaatcaaatgagattaagaagggagtttttttttttgatctcatgtgaaaaccctttttgttttattataagctttaagttagcattgcaatctgaagtccaaaacaataaccttaccaaaactatgcacgagagattgtttattctttggacccaaaccacacatcataatcaaattagtactgtcacaagatggttagtattatatagaagattcgaacagtggcagggtaaatagtaaaatagctttagaaacaggttccaaatagtctacggatcgacataattatattcatttgcatttgcatgtgtacgaaagaaaaacttgtacatctcaagcgtcaacactacacaaaaggcaaaaggggccaacgtcaataccctgaggcacgaggtggggccacgaggttggatggcccacatgtcggtgacggtgagtggattaccctgaggcactagtactacgagtactacttactgctactgctaccggtgagactaaccccctcaaaacgcaataaatagcgctgagagtacggcagagacgctcagagtactcccccacgtagtcgtctacggagtactcttcacttacgggggaatcgtcggcgtaagcctaacgccctaaccctgccgagctgactttattgtgtttaagtttaactacttttatatttaaattttataactatttattaattacaaatttatttatttattacatttattaatacatgcacatatatacatgcctagctagccaactgcgtgcgtagtcctaatctcacttagatttttacacgacatataacatcatactgtaatcaccgactaatatattatcgataatttacatatatacttaacttcatacaaatctaacgatactactacatacgtggcactaaataaaatacacactctctcattttttttagaatactataaaataaactatggccactactccactagttattactagtagtagttacttaacctattttattaattcctacaaaactgatatattatattaaaatacattgaagtaattattctattccgattctagtcttgtagtatttcaaaaagtttacaaaatgtcgtcagctgatatttttaagttaaaaatgtagtataatgttagaacttgaaaattgtattttgggacggttagtatcagacctgacactgacaaatatatactgtatctctttaatccaacgattcattgatctcctccattctcaaggtcttagctagggaagtaattttgtcccttagctattcaactcaatacatttgtcagttcttccccagcagtgagccgacggccgagctccacgaacaagcagctacggacggcggcggcagcgcctcctccggcgaggtagcgggattggcggatccgggtaaggccttgttcgatttgaatggaattgaaaaggattggagatgattgaatgtgaataattccacaccatgataggtgtggaataaatcccctccaatccctccctcgtgaggattaaccgaacaaggcatgggagggtaggggcgaggagaaccagtcacatgcactgggattagagggggatcgatggcgacgaggcggcggcggtgttggtttgcagggacaagaaaaatagagtggttagacttagaattaacttagaagacggcatgggaggagatcgaggtggtgtgggggatcaagcaggggcgaagctaagtagtgttatgggggttcctaggcacccggctgcaaaagaaaaattagtgcttaatacccctttgtaaccatatgtgcacccccctcagctaagcttggtgtacccccacgctagaaatcaggccattgaagcacgaacggtacaaccacaaccacgataggagcccaattcagtcctgcttgccgcatcaccgtgaggacgtacgcacacgcacgcctcttctctttctttttttctttttggcgactcgctcttcctctttgtccctaccagtgccgacgcctcttgccgctaatgccacaattaatcctcgcctcttaccgccaatgccacaattaatcctggataactaatcgacgcctcagcaagatgatgggatgtcaccgaggctgggcacaggcaattccttgcctcctctatcttatgttctttttactaattctttaccagtcaatgcattcattcgaatagctccttcacttttcaattacgcgataatagctctgtttttttccagatcgaatggttatggttagtgcagtttttatctttgcttctttgttagtgcactccactgttatcgctgatgataacaacacgcaaaaatattataatttactataatattgctttaaaaaatatataaactactctctctgttcaaaaatataagaagttttaaagttggacacgattattaaaaaagttcagatgagtagtaaatgtaggtaggaaaagtgattggttgataaaagaatattgatggataaattgttatatatcttgcgataaattctaaaggctaaaaattgttatattctccccccccccattcttctctagctccgcccctgggatcaagcaccatggagaagaaacatggcttccgcgttggatcgagcacgacaggagagggaagaagaacatgcgatgatcggttgaggggcgttggatgcaaatccaatggctgctagctgtccggaagcccgggtcttccaaagctgaggtttttctattctccattgggccaaaaaaaaataaggaggagagattctttttttaatcaatggcgcaaaccctttttgttaaaagaaaaatggctcaagggattcattccctttccttttcttccctcttcatgcatactatgccacacggatggttttggtgttcacttcctactatggtactataagaaatgggtttagtcactagaatctgagcaatttaattagttttttttaaatgctttcattgtgtgtgttctgacctaatacctccgtttcagattataaaactttctagtattgcccacattcatatatatatattaatgaatctaggcacacatgaatgtctagattcattaacatatatatgaatgtgggtaatgctagaaagtcttataatatgaaacggaggaaatatctaacaaaatttgatcatacctcctaggggaccgatcgattaatcatagtggcggatccagaaaattgattcattggtgtcataatgtgtctattagtatcatagtatgctaattatacttatatcatggtgttataatatatggataaacagtttttgctatagattttatcaaaagtccttgctgtcgcctgacaccgaccattacattgtagatccacccctgattaatcacaatatattattcttttcaaaaaaaaattacatttggaagtaccaattagtcgtaatcaaacaacaccctgcatcctcagcaacatttggtcttgttttgcattacctacagggcaacagactcctacttcagttaaagagtgatggctgaaaccaagataatccatgcaaccaagcaagcagaagttgccgtgacgaaattcatcgaatcagacatcagaaatgagcaaacatcacaacgcaatattgccggtaacagtgttaaaacgtcatcctccaacaccatcgaagctcccgggcatgtggttgtcactaattcgtccgatgctggacaggacactatggttaacaataatgttgccggtaactatgttttactgccattatccaacagaactgaagctcccaggcatgtgattgtcaccatttcgctcgatgctggccagaacacagtggttgacgacaatggtgttagacagggattaacagacgaggaatccgatactaaaacgaagctgttggaaagaggtgttctgactgctgcctctgctactgcagcaatgctctctcctttcctgagaggagtgttcaatcaccaccaagaaggttactatattattcctgttctatttctagtgttggggttgattctggcatccactgccacatggctcgctcgtaggcactccgccaaggtcaggggcggatctacagttataagaccggtgtcaggcgacaccgacgacttttaacaaaacctatagcgaaactgtttattcatatgctacaacaccataatctaagtataattagcatactatgacaccaatagatgtgttctgacactaacgaatcgattttctagatccgccactggccaaggtggttgtccttcttgccctagttccacaggttcttgtggctggtgtgattacctctacatggtcttgacgaaggccttggccatgactcttgcggaactttggaagcatcattgatagatggtggaatcgtgagtgcatagatagggtccagggttacaattatacatgtgtatctgtgtgtaggtgattcagatggcctccttggttcttcccgacgtatctgtgtgttggtgagatgttttttttttcctttgagaaatgaaatatattcttttagaggtattgtacttaattaatttgtccgcaaaattgaagagcggacgtttcctttagataggcccaaatgccagcccaagcacgtgtttggggccgtatccaaattccaatacgaaaaagtacaccgaaggtccctcaacttgtcatcgggataaaaaaggttctcgaaccgcaaaaccagaaatacgaatacgagattccttacctatacaaaacctgggttttgacgccggttttggtttatgtggcggctgagttagcgtgggacccacatggtccccatatgtcaggtgtccacctcaccctatctctttcccctttctctttccttcctgatctctctctagcggatgaggagcggcgtcggcggccggcaggcgagcgcgcggcggccggcggatggggagcggcggccagtaggcggtggtggcggaggcggaggttgtggaggtggcagccccctagcggcgggtatggtggtcgtcggcgttggcgtgccccgcgcccgctcatcccaacggatcctctcctcctcgtcggcgtcgtcgtccccctctttcccgccggatcccgccgtggcgcggtggccggcgtcctcctcctccgccgccgccgcatcgacggtgcgtccagggagcgcccggcgccgtggagttcctcgtgtccgtcgtcaaggagcgcgcctccgtgggcgtggacgacgcaacgtcggccaagccactgggttcttcccaggaagagatgacgtgcggcgtgcatgatcccgcgaaggcgagctctgagcatcctccggcgtgcatgatccagataatcagacaagccattccatgtgttggaaaagaaaaacataatatcttgaccctgctaattccatctagctggatcaatcatttgtcctgtttattcatgcgaactcgatcctcaacaaacgtgcagaaataaccgctaaagatcctaacagatctgtctgaccaagtagctgtcgcttttgagaaagttcagtacatcacaaacgcaagtttggcctgtgctactgcttcagatttctcaatgaaggagagatcaggctgcaatgcatcaagagaattcagatgcacacatgcaatggttgatcactgcattaatcaaccggtcattcctcctgaaatggcacatggtgatgagattcagcagcacacatcatcgtcagttgatttctgggtcaaaatgggcaccgtggaggagttttcttcgatctgaacatccttttttttctcctcgtttgacattgctgcagtgtctcgccggacgaggcggctctgagcatcctgcattcgcttaagctctccgaggagagcttcaagagggtcttggagggcagcggcggtgaagatttcttggaaaccttggcgtgcgtgctgcggcggccgagctacctctcgcggatgcagggaatccacctgttgaaatcggcgctcccggctatgcccccgcgcggctgacatcggtgagcgccgtgctggtcgacgttgtggtgggggtggtggcggagaaggataaaattatagcgagggctaaatcaaaatggccaagagcaactatgagagatttagggttgggttaggactttttggccttcttagccttttgggtcttctaacaacctcaaaaaagggcctgttcactttgatgccattttcaacattaccaaattttgttaatgttgccaaaaaagtggctacatttagtttactgtcaaattttagtaactatataagaaatcatgccaaaattttagcaagttaccaaaatttggtaagttttttttttgcatcaaagtgaacatgcccaaagtctatattagcctctcatctataaatatatggattagaattttagggtgggtataatggaggctctaatggtattttagggggacccccccctcccccccacgctgtctccgcccctgcggacaggccgtcggcgaaggcggtcaaggtggcgctccacgtgctctgccggctttgcccttggagccgaaaccgcgtcaaggcggtcgacgtcggcgccgtgtcggcgctcgtgcacctcctcctcaacgagggctgcggcggcgacaggcgcgcctgcgagctcgccgtcatggctatcgaccacatctgcggttgcgcggaggggcacttggcactggtggcgcacccgacggggctcgcggcggtggcgtgcgcggcgacgcggctgtccaccgcgggcaccgagagcgctatgcgcgcgctgcacgtcgtggcgacgcacacggcgacgtcggcggtgctgcaggagatgctggccgtcggcgtgggggcgaggctgttcttcctggtgcaagtcggcgcctccggcaagcggacgagggcgaggtggaccacgagacggtccaggagctgccgtcgccggccgcaccatccttcggccgcgcgcgccgccgtgggtgccctagcgctggtatccccatgccctgcgagtgtgagagcagagagcgaggaaggaaggagagaaacagagaaagaaaaagggaaaagagatagggtgaggtggacacctgacatgtagggttcacgtgggtctcacgctgactcagccaccacgtagatcaaaaccggggtcaaaaccaccgaaggatctcgggtgaccgattttatatagttaagggacctcgtatgtctggttttggggttcgaggatgttttttatcagatgacaagttgagggaccttcagtgtactttttccattccaatacgtaactgggctactcgggccagatgggctaataataaatctgcaatggaataggtctatttttgcctccctcaactcttgcccctaattgaatcgtgtatctcaaccgtgatactgggtataaagcctcctccattatccaaaaacagcttaggaacttaatttgctccagttttcgtagatgaagagagcgtatatgtgatattgagattcaacaagggcaaggttttaagggaagctaaatcctaaccgttcttttttttctccaatttttgaattttttttggggggatatggagggtggaaccggttgcattagtaggctattttgaaaaaaaacttctcgtgtttgcacggaatatcagatatttctatcatcacgttgtattttttatgtataacccctcgtcttccaggaaaatacaacgcgaagaagagaaaattccgcttttaggggtagcgctgtaaacatgaaaaccatagggtttttttacaaaacgtcctacactaaacaaccaccccctccccctcccccaatcctgaaaccctcctcccattctctccctttcctctcctcccctcccctctcccaccttttctctctcggcatggattccggtcagaacaagcggtggctgcgcagagggtggaaccagtggcagatcccctccctcttcctagatccggtggagggcggaggcggcgtggagggtggatgcggcagcggctccgtcgggagggagaggtcggtggcggcggcgaccctcccctccgaatctagcgcggtggctacgcctgcggctggatccacagccgccgttagatctggcgaccgaaaaagatggcgcggtggaggaggatgaccgcgataggcgctggtgacggagtggcgtaggccgatgggtgcggcaccatcttcaccttcatcgtctgccgcccttgcacgggacatcgcgtgcacgtcggcgtcagtgcgcccctcgccccttctccttcccctcgcggcgatgtcgaagccggcgccagtgcccctacccctttttctcccttccctagcggcgacgttgggtcggaggcagcgtcggtgtcgcccccccctccctccgctcacggtggcgtcggggcgggtggtgcgttggtgcgtcggagccgacgccggtggccccggtctactttgagtgctccatcgacgtcgtgtcctacaattgcgctgcctactccagttgatataataatacaaaatatcgtatgagctgacatataaattatcagggactgaaatataaatatactaaggggtggtctctattttaggtagtgtggctttttttttatcctactagtaataagcccgtgctaacgctacgacgatatttggcaatacaaaccaaacaatacaaaaagataatatttttttaaaggattagatatattcaagattgattgaaaaaaggaacaacataaagttatattggtattgattatatagcttgtgtctaaaatataggaattttgtttatcattcgaagccatttaaattgttgtgctaaataaattcatatgtaactacagaaattccatttttagataaattcccattgtgttccaataagtgaatgaatagcaaatagttcatgtaacagaaaattaatgcatggtttcaaatgacagagaaacatagcacggacatctcataaaaaaagagtaaattgtacattgtatatatttttattttaagtttcatctttgtaccttcccacggacaatcttttcacttgtgaccatcttttataacaaagactcgtgaccgtatgggagacaaattaatgctctcgtgtttaccactactttggccaaaagtgcaacttttggtaaagatacagagttgaatgagaatcttaagttaactctagtccaatgtgaaacattaaggaaaaaattagtccaatctgaaatttactaaaaaaaacacggttatatacagtagtgcaatttatatcacaactcagtcaatcaaaatctaccaattttagaatctcgtgctatacatgacatttgagaaaaaaaggtcaaaacacaagtcatgttatgctaagtgtaccaatagtgtcattatgtgtttgctttgtacagaaatctttcacacaacgaacggccaccaaaatatttcatgtcgtgcccttctctctcgctttagctcgagaattggaattcatctccctagctgaaagatgatcaaataaaaaataggtggaagacaaaagaaggtgcattaaccaactgaagaaaaaagattcctaacctccaacaattatactgttagaaagaatcgcactactccaaacactttcatgtatcaccacgatgagaaattgagaattgagtacagagggagcagcccaaccatttgcaaataaatgatcagttgagacttcaataaccatgatatctactaaatcacttatacaattgcataatgccataatgcatacctatgaacccgaacaaaaaaatatcccgtctacatgaataatttccaaaagacagaacaataatccttttatccaatttagaaatggttttataaatacatataacacttgcattagtatcatggaccagcaccaaagttcctatacacgatggaaaagcacactgatttatctgttttgatgaaaataaactatagatatgtagccagctgcagcacggactttaagacgtaatgtgtgtatgataggtgggactatagactaatagtatagtaagcaattattgtatgaattagctattagattggttatagatgaattagagctaacagtgggatttactattagacttgctctcaaagccgcggcgaccccgacgtcctcgcgctcctgcgcacaagctgacctcgaggtgactttcatattctttatacttttgaggggtgtttaagatactaccctaaaatcttacaccccatcacatcaagcattcgaatatctacatgaagtattaaatatagactaacaaatactctcaccttccaaaaatctgaaacctattttttttcatcaaaaccaagaagcaattaactaactcaccatgtggcaaaaccaataaacatgtaaccaataagtactataatggctttttgtttctgatcaacaatttaatttagcacatagtgactataaataggactcagatttttagagaaaccaaagaatgaaataggtctcagatttttgaaaggagggagtaactaattgcataatttacgactaattttcgagacgaatcttttaagcctaattgcaccatgatttgataatgtggtactacaataaatatttgctaatgacgaattaattatgcttaataaatttgtctcgcggtttacatgcagattctgtaatttattttgttattatactacgtttaatacattaaatttgtgtccgtatatctgatgtaacacgccaaaattttacatcgctggttctaaacacagcctgagtacatttatatttacctcttttaaacatttacatgtattctttggtagcggttgagagcccatctccttcgcacggaaaacaaaacggtccatagcgcgttattaattaagtattagctattttttaaaaaacagattaatttgattttttaagcaactttcatatataaactttttacaaaaaatacatcgtttagtagtttgaaaaatatgtgcgcggaaaacaagagaggtatgggttggaaccgggaggaacgaacatagttataattatattttaacgtctagattaaaattatttattgttcaactatagaggaaaaggatggtgcttaaatagtaatgaggggattataaagtggttagcttttaatctagggataaagtgtgactaaaatttcaaaagcattttagtcacctgagatctaaacaaatccatttttaaacatccattacagttggacatgttaagttactggtagtactccttccatttcaggttataagacattttaacttctggtttaagttcgactaaggttgtagaaaaaaaataataacattttcaacccaagacaaatttattatgaaaatatattcaattattgatttagttaaactaatttagtattataaatattactatatttgcctataaacttagttgtttatagttaaacttaaagtagtttaactttaaccaaagtcacaaaaatcacatttactttcatggaaaaaagtccaattcaccaattcaactattgcgttaaatttctcgttaatataattaaaaaaataaaaacacttttaactaggagaacttattttgtaagaagttgcaatttgttcatatgagtattctattaatcctctcgtgcgcacctgggaatttctcggcatcgatgcccccgtcgatcaatgcgcaccatgcctgcgcaactgcctcggtcacccatcccaaattgctccaggctaagcacacttaaccctggagttctttgaagattggcttccggaaaagaaattgcaacttgctgatatgagtattctattaattctattaaaccctaggccggcatgtcacaagcggtttcactagttggtaatccaaacgaagtagttaaaactagtaaattttaaacaatgtatactatactgctactccatctatttcatattatatttttttagtcaaacttatttaaatgtgactagtttatagaaaaatatagtagtaatttcaacacaaaacaaacatattattaaaatacagtatcaatgttaaatttaatgaaactaactcgatattttatatgttgctaaatttttctatcaaacatattattaaaatatagtgtgcaatgttagatctaatgaaactaatttgtcaacgggtgaagtcccaaatcacggtgctctcccatctcttttgactctccccctaaaaatcccaaatcatcggtcaccagcggccacgaccgtacccgatgagcaaggtgtgttccggctatcaatcttgtagtcttatagtttacatatagaagtctacttgtactttcttatctgaaactcctttaatatacgaggtatgattttgtataagacttggtatatggtggatcccgctgagtttagtcgattactatatcgggtatgtattatccataaccctgacataatatatatgcccacggttatgggttagcttaacaatattttttatgattagttccacactaattaaaaataataatgtgataaataatgatactttggtttagctcctggtttgaaatggttaattcctggttcggagatttggtcggttcaatctggcttggttgttcatttatggttgggcctatgcaacgagtatgttatatagcgttggattagtactgtttaattaattactctatttatttataaattcttaactctttgtcaaatgatgctttgcaaatgaatactaaattatgccatcctatattatctatgtgcacttgtataatgttttgtggcttgcggacattctattgcaataatcatcaaacgttgtccaaaccgaccgcgaccgatgccagccaaaaccgtccgcgaccgatgccagccaaaaccatccgcgaccgagatgccccaggcccccaaccgtctaatataaaagccacgtactggatactcgtcccatcaagccgccgcgaccccgacgtcctcgcgctcctgcgcacaactacacaagccgaccctaaccgagctcgaggtgactttcatattctttataagtttgagtacatttatatttacctttttaaaacatttagtagttatcattatattttaacgtctaaattaaaattatttattgttcaactataaaggaaaaagatggtgcttaaatagtaatgaagggattataaagtggttagcttttaatctagggataaagtgtgattgaaatttcaaaagcatttgtcacctgagatctagacaaatccctttttaaacatccattagagttggacatgataagttactggtagtagttccatgtaatcgacaaaaatcgcatttacttttatggaaagaagcccaattcactaatttaactattgcattaaattccttgttaatataattaaaaaatcaaaacacttttaaattggaggacctacctctgtacagaatttgtcctacgtggcatacaagctgcagcggttttaccggttggtaatctaaataaagtgtttaaaactagtcatcccttcattttatattataagttgtttgactttttttagttaaatttatttaagtttgatcaaatttatagaaaaatatagtaataatttcaacacaaaacaaacatagtattcaatgttagatttaatgaaactaatttaatattttagatgttgctaattttttctataaactttattattgaattaaactagaaaaaaaagatttgtaatacgtaatacgaaacgatggagtactagttgacttgacctatcaggctctcaccccatatccccccgttagctctccgcctctccccccctaaaaatcccaaatcacccgtcaccggcggccacgaccgcacccggcgagcaaggtgtacatgttccggccattgatcttggctgcgtgaaactgagatgctcagcacgagcacaccagccgctggccgccgggcgatatgcaggatctgggatgggaggcacaagctccggcagcgcccggtgttggatccaaccaaacagcgggcgaagcgccgccgaagctgtctgtccgatctactcgcgattttttagcgcatccgacggagaccgcgccttccttcatcacgattttagccttgtgtaaggcttggaagaaatgtgtctctccgttggcttgttggaagaaatgcttgaagcgttatttaagatcgagcaattttgctctatgaagtgcttttgttgtgacttgtgatctctctaatagaattggatcacacctcctagctaggggcactcattaatcgtagtattattttatccttttcaaaatttaattacatttagaattgccaattaattgttacctgacttgtttgtttaagcaactcccatttcagttacaatttcaaaaacaccgtgcatcctcaatgacatttggtcttcttttgcattgcccacaggacacagggcaacaaaatcctactttaaagagtgatggctgaaacgaacagccctgcaaccatggaagcacaagcacaggttgccttgacgaaatccatccaaccagacaccagcaacgaggaaatgacatcaggcaatgttgccggtaacaatgttttactgccattatccaacagaactgaagctcctactccgaggcatgtgattgtcactatttcgctcgatgctggccagaacacaatggttgacgacaatggtgttagacagggattaacagacgaggaatccgatactaaaacgaagctgttggaaagaggtgttctcacggctgcctctgctactgcagcaatgctctctcatttcctgaaaggagtattcaatcatcaccaagagggttactacatcatcctcgtcgtatttcttatgacggggttgattctggcaaccactgccacatggctcgcccgtaggcactccgccaaggtggttgtccttcttgcactagtcccacaggttcttgtggctggtgtgattacctcaacattttcttgacgaaggccttcgccctgactcttgcggtttgttccactttgaactttggaatcatcatcgtgagccaagtgcggatccagaattctaatagagggagagcttatatcctcctccccacgcacacacgctcttccttctctctcttcttcctcctttatcatcttctctcaataatgatctagcgaggtagaagaagacttgagtgatgagtcccaccagtatccacgttggatctgttcctgttgtgagtgtatagctacatctacaagggtcgagagttacaattatgcatgtgtatctatgtgttgatgaaaaatatatatttttgagaaatgaaatattttcttttcaaggcattattacttaatttgtccacaaaattgaagagcaaaaacgtttcctttagataggcccaaatgccagcccaagcacgtgtatggggccgtatccaaacaagacgcaactgggctacatgggccagatgggctaatatatctccatttgtcgacaaccctcgtacgcgtccgctcaacgcacgcgctcacacacgcggtggactcggtccagaaggatccggtgcacctaccttacccgagagacgccacctcaccgcaccccgtctcacagctgtccgggccccaccgcctccccggccccaccatccccctccccaaaattcgaaaaccattcggggaaaataaaaaccgctttgatgctaccgttacaactccactcaccgtcaccgacatgtggaccacccaacgtttcgggccccacctgtcagcgagctttctcccacgggtcattctctccctataaaggaggatacgtactagtactactagtctatctcacacgggaagtcgttcgagtcgtcgtcttcgtctccgttccgttgcgccgcctcgtcgtctcctcgcgccgccgccgccgccgccgccgcggggaagagctagccctagaggagaagtgggggtgagttgggagagaggagagggggcgagatgttccggtacgagaagggcggggacgtcgaggcggggacctcgggcggggcgagggagctctacccggggatgacggagccgccggagatgcggtgggcgctcatccggaagatctacgtcatcctctccatgcagctcctcctcaccgccgccgtcgccgccgtcgtcgtcaaggtccgcgccatctcccacttcttcgtctcctcccacgccggcctcggcctctacatcttcctcatcatcctccccttcatcggtgagttccccgttcttcacatggttgtttcaattttttagggtttcgatggtgttttttttttcttgcgaaggaaaatgggggaagaattcgaatcagttcgattctgctgcgttgcgtacggtttagatttcgaatcggatccccccaaattccactggaaatatgtgttcccctgcaaaaaatgtgtagtgaagtttagtgggatgatcaactgcgctgggtttgcgtgttgtgtgtgttcgtgcgtgcacgtattgatgcctttgcgtccaggcaaagcgatgggttcgtggatggtggggtggtgggtgcgtggtgtattttcgcacatactcctaataatggctaatttgacctagttttcaccactagaattagattgttttttatttgtgtgtgtgtgttctactgtgtggattgcaattgtttgttctgaataagaatggttgattggtttggtgtgcagtgctctgcccgctgtactactaccaccagaagcacccggtcaacctgatcctgctcggtctcttcaccgtcgccatcagcttcgcggttgggatgacatgcgccttcaccagtggtaactgatcatcgatctcgccatcattttttttttgttttgtttctagtgttcacaatttttacacccgtttgtgtttcatgactagttctcttgaaatatcgatgtccgtttgcatttagtttcttgctttcgccgtgttaagtttgctaagaatatgcttatggtggggctacataggaagtttcggagacattgtcggaatgcacattttgcctggtctttgtgtaaggccaggttgttgtcactttaatatatgcttgtcgagtcataagcatttggaatatcttccccttttggcatttcttagtttcttaatcttataaaagtattcggaatacaatcagcttgcacgttaggttagtttattaatgttggctccttttgccttttgtaatgttgaggcttgagcatgtttaacttttcttttgtagacatgcaaatgaatagaatcttccatagactattatctggaacctatttctaaagctatttactatttaccctgtcactgttcgaatcttctatataatgccatcttgtgacagtactaatttgagtatgatgtgtggtttgggtccaaagaatatcttgtgcatagtttttgtaaggttattgtttaggactttaggttgcagtactaacctaaaactgataataaaaaaggtttttcacatgagatcgaaaaatactcttatcttaatatcatttgattaaattgagatggaatgcatgctatgtctatctgagtagtatttcttggaacattgcgacctgtctgctatccgttggaaggcactagtatcttatacatctataaatgttattgaactagtttctttgatgatgtgtaccatattataatatgcccgtgttctagtggtggttaaaagttgttcatgtaaacagcagatgtatgtacaaagcattgcatgcaacattttttatagatattttagtagataatgatgtttactcttcatatgctatattcctatctttgctcagtactctgtttctgtcccggagttgctttttttttttggttgtaaaagatcaggtggtcactaatatattatgctgttttaacaggcaaggtcattctggagtctgcaattcttacaacagttgttgtgtttagcctgactgcctacacattctgggctgcaaagaggggccgtgacttcagcttccttggccctttcctcttcgcctccctcattgtgctgctcgtgtttgcgttcattcaggtcaaaagatgcagcattacactctcttgatctcctgtgcacctcatcttgttcttgacaaactcggtggctgattcgaaacttgccgtttgcagatcctattcccgctgggcaggatctcccagatgatctatggcgggatcgcgtcgctcatcttcagtggctacatcgtctacgacacggacaacatcatcaagcgctacacctacgaccagtacgtctgggccgccgtctccctctacctcgacgtcatcaacctcttcctctccctcatgaccctcttcagggcagccgactgagttcctcgcatcgcgtcacatcgtgttcatatacgttttcatcagtgaatgtgaaaatgctctgcctttatcatgagtcgcgtacccaaaaacaacaattgtatagatgccacaagtaggatggtcttttatcatgctgtgttcaacctagtgatcttatctacgtaggaaatgcgaacaaatttagattctatatggatatggaggtgatgttggatttgggttaatttgcttgatgtatggtggacggatggatcatggatggcttggtttacctttggatgaatggaattgcttctctctttttaccattgttttaacccttttttttaactaaatttactgctcaattctgagcaattttgatcctgtaaattcatccttgaaattctttggcagccataaattttgatcctgcaatagaaaagagggggtatagtgccacgtggcatctgccactcccgccatctctccgttgtcctctccaccgaccaagtgttgcaagtgcatgcgcgtcactggtttgcggcggcgatatgggcaagcacaaccaccacgacgtggaggcgccggccgccggcggcagcagcttcccgccgccgccgccggcggtaggcgtcgccggcgtggcgtgcacgtacatgatcgagaggccggagctccggtgggcgttcatccgcaaggtgtacgcgatcgtggcgacgcagctggtggtgaccgtcgccatcgccgccgccgtctactccgtcccggccatccgccgcttcttcctcgcccgcacgccggcgtcgctcgccgccttcgtgctcgtcatcgtcgcccccctcatcggtgacgactgacccacattaatttcatgcagcgctaattaacacatctaatacatataatgccacgttatagtatgattaactgttggattaacgataattatattgtgctgatgggtgacaatatggagcagttatgctgccgacgatgtttctccgtaagaagcatccgatcaacctcatccttctagcattgttcaccatttgcatgagctgcgccattggcctgggctgcctctcttccaaaggtacatatttgtgttccctacaaaattttctatcaaattattgcattccaaacggacttgcatccatcttaaaattaatattctctcttttcctttccccttccttgaaactaagccggcattgttataagctatctaaaaaaccgtcacaattttttaatggaaaacttttaaatttaactacagtatgattgtaactgaagcgggtattccaaacggatattaaccttgcatccatcttgaaattaatattctcttcttcttatttttttttcttccttgaaactaccaagccggcattgctataatcgaagcggcatccctaacgttcgggctggtgttcggcctgacgctctacacattctgggcggccaagagaggccatgacttcagcttcctccgccccttcttggtcgcggccttcctcgtcctcgtcctctacggtctcatccaggtctcataccaacaaccaaacagctgcatatcgatcgcaaaaactaaccattttcgtctccgacatcctgaatattagatttgatttcgaactccgtcattttcgtctccgacatcctgaatatttgatttgattttgatttctcaatgacatttgtttggtcgtgcacagatgttggtgccaacggggaaagtggcgacgacggtgtacgggtgcgtggcggcgctggtgttctccggcttcatcatctacgacacggacaatctgatcaagaggcacgcctacgatgagtacgtcacggctgccatctcgctctaccttgacaccgtcaacatcttcattgccattttcactgcactcgacgcttcagattcatagaatatatctctagagtttgttactagtagttgttaccctgctgaaaagcagcagccagtaactataactctttatagggaaaacatatgtagttatcgtattgcattccaatgtattagccatgaatttgaggtaaatatgaaccattacagtaataataataatgtacgtggcttacatgctgcaactgtttatgatgttggcaaacataatttggtagatgcgttgtatgtgaggcgtctcttagctcttacaacagtattcggcagggagatcagccattccaggaagaacagtatttgcacagaatacaatctaacgaaagagggaaaatttagctactgcactggcaaaaatatgcagagaacttggtttgaacttatctttcactgaggtgatatcatgatagtattatcctaccacagttaaggagcacgcgataaatttgagggcacgggattgcaacgtccagctaagttgcattgtagtcatcgaatgaggatgatttgtgatcaagggggactacaaagggattgaaatgcaggtgagcagattgtcccccagaagctcttggcacaagtcataagtcattgtccactgtttcctagggttcatatctccaatccagaactcaacagccaccggatgaacaacaggtttcaaggtgcgtcgagctgtacagtcctcaccttacgcaacaggacaccaagcctgtgtatgtgcatcaagctgacagctaattaacctgggaaggtaaggagataaagaggtttgagccgttggaatgacccaaaatggtagcatgacataccaatcaagatatcttctacctcatcaacggccaacaggatggcctagtaagcaattccgaacccgaatgataccatcatagcagaaacactatctttaagcaaatgattgcctgcagcaaaatgaagggaaaaatcataagaccaggtccttggctccaaagatgataaaggttttcataccatgtttgtcgacaacgaacagcctcttggcgaactctccttttcttatcatcaagagccttgattgcagcttgtaggatctgcaagagcatgcctttgtcatataagtgttttcaatttaataacttctatttgcgtctaacaaattcatctgaactaaaaaatatgaactaagcaaataaaggtaagttgtattaaatgcatttatctatttgtactaaaaatgtgcagctgaagacctgaagcatgacaccttattatctcctgccaataaggagacaactatccatgagccaaggcccatagtatagtacaagtatattaacagttgacaacattatgcctactccagaccatatcggctgcatatttttccaaagaggatactacagactattgcatgcatatttttccaaataagttacaatcagaattacctgtggtcgcatgcgataaatttttgagtgaggaagactagacatggcaactaaacattgtaaggctgtctctcgaacaacctaaaggaagggcaataagaaaaggttgtgagacatgttgagccataaacagaacaaatgcacggttagtattgaatggttaatgcaaataacacaaaggtaccatcatgtgaggatacgaaacgagctgcgtaaggacactgacaatgatgtggatgttctccacaatgcattctttgcctgcataggaaaaatgatactgataagttagcaactagatcgaataatgtgcatcaagtttgcagcagtgacaacaaaaaatgaaaatgtatataaaacagagcaataaatgatctcacctttttcatccatcagcattccagataagacgagcaatatactatacactagatctttatccttaacatcctgacttaatttagctatgctatcaaccatcacaagtagaatctgaaataaaaagggggaacaaaacaatgggttgattagcaatttaacatggtctggatgtatgatccaacaaaggatgtccatgctaatattaatattgcacatgtaatagtatggatcataatcaagaactaacccgatgggcttctgttataactgctggtactggagcattggaaatgatatgcccaaaagctcgatacaaaaccaatctgcagagaatgatatttttctcagtaacttcgaagaatataacatttgtaaaaggctccatatatataggaatcaattttctaattaataaggccactgccaggcaatatcataacttaaatccagaaacaaaaagagcactttttaggcataaactcatgatgaagacattttatgagaacaggcatgaaatttatacatagttaatgacgcttatgctaattagtccttaggctataaaattacagtacccaactaatttgtcaacagaaatgccttccccagataaaagaaataggcataaaagtctcttttacttcagtccattttggattgttatgcctgaagttaactatgtatcatttttgtatgacaaatgatgcagccgtgtcacttgtttcagcacagaccataaggaaagcagtacgaatgtagacacttactttgtagtcatcacagtagattccttgattttagagagaaaaattggcatcaatattgagaagaaacgctgcttatatagtggttttattcttgcatgaaacttcttattcaggcaaacttctgaatcactcatcatcacatggaatgcatcagctgcagatgttgcaagagaagcatatgatgaatcactgataccatgttcttcctgatgggatgaaatgccagccaaactctgatctgagcatagacatttaagaagaaacagtgaaacatccttcaccttttcatctcctctcataagcaatcccttgccaagccaggccaagccagagatgatatcgtcctttgattcaatgcttccagacaagatctctgagcaattagcatcatctgaacggccagcacaagagagagatgtcttcatattgcttcgcactgatattgttgagaaacacctctcaagaatagtatcaatcactttatccagtttattctcatgtgagaattccgaattgtgtaggtttttgttgaaaatagaagctaatgcatgggcagctggaatttgtcctttcagtaggaagaccgtaaagagattaatcatcatcagcatatctggtacaggtgtttgaggccgaagaccaactatgaccgatgaaagcatacacatgagaaatgtatcacgaacagagtatagag

SEQ ID NO: 45959 - DNA, 1840 bp, Oryza sativa
cttgtggaagggtcgacggcagcaatgtaggaatcgtagttagccagcagtttttcccgccggcgagcccctgcaaagttgcgcatttaccgtataaaggtcggtgtcagatgacaccgatgactttcggtaaaacctatgagaatttttacggtacaatatactatcattatatactaccaatatataaaagggtatattcggaacttaaaaaaaattgaataagggatttttagtaattcgtcagatctgatggggagcaggggcggatccaacgtgagtgcaggggggttcgagtccccctgcacccacaagatctatggatacccctggagcacccccttcaattttttcaccatgaatgataaattaaaggtccttatatggctggagattgaagaaactgtgtaattgagcactctcaattttttgtttctatatctgccccctgatggggagtaatcggtcttggatctcatcatgcatcgcgagcgcgattagattatggcgcgtgtggcggctgcatggtttgatgagcaacgagaagccgaggagacgctggacgcaggccccaagcattcgcggtggcctgtggcctgccttccggctgagcctcaccggccacggcaagaaactgcgacgagctgattcatagtgtacattgagcgatcttgttagttcaatgtagattctactcaaaattgttggctagtacggacaacgtgaggcaaataaatcaggtactgatttagtgctcttgggcttgtcttgcgttcagtaccagatcggcagatgaacatggaagttcataaaaccgactgtgtacattgcccttacaattttatactggaatctcattaagtggggaggagaatgaatctacaccattggatcatttatgctagcagtgtatactggcagtatagtgtaccgtctaaacataattagcatactatgacatcgataaatacgttatgacaccaacgaatcgattttctatatccgccaccactgcaaacctcacacaaacgctacagcgtaacaacgtgcttttctcgatgcattatatatatcccctctacttaaaggaaattacatgcaatgcgcgcgagcagcgcacgactgaactcctgctgtcctgcacttgccgcgcagacccacgactcaaaaaagaaaagatgccaccgcatgaactcggatacttaggcctatagctgtgcacatgaacgtgttcgtgcagatcctaagaaggatactgtggtacatagcgtgactcgcctgaaatatgtcaacaattctcagtacgggcccacctctgacggtccacaaactatgagccaaagtgctcaaggatgttcacagctttgatgaatccattgagagatcgtaacaggtgaagccaccggccgaggctcgtcccaggtatctagacacatgtgacgggccggcacccacacctaccagaaggatacctctgtcaggtgccagtgcaagcccatcacaggtgaccaaatacctgtgacgagcctcgcaattacgtctcgtttgaggtgagtataactcatatctaacgggcttaaaccctaacccgttggagttgtcttgtcgtctataaatacccccaaccactatatgtttttcatcccaatcctacgcactgttcacattttgggcgggagaataaggggggtgaatttttgttgcaagaaaacgtgtgataattatttgatgacgaatattatgtattttgtctgatacttgtcatcttattgtttgcagatggaccaaagttggatgtacggtattgatagttggtcccaagagtatagggatggggtcg

SEQ ID NO: 45960 - DNA, 872 bp, Oryza sativa
ttgttcttctgctttgaagttccagcaatatctgccataaagcttggtagaaatgaactatttggcaattctgggacacaattacgaagatattcattgctagtgcccaaagacaagttgggaaatagatccggtactgacttcaaatgcttaagtggaatactgtcttccagactaaaattaggaagacccagtttcccttgaaatgaaggaatggacgatacaggattttctacatgatcaccaatccccttcccggatataggaggaatctgcacacaaaaaccttgtcattctttttctttaatgatgctcttaactagataaaacatcatatatgctgtactcaagaatggattctttttttcccaattttgcatccataaaaaatattttaaaaactaatatcagggtaggttgcaccatttcctcctaataagtataaagtggacaactatcttatatttttcacttttgaagaaaaagcatgaacaacgataaagcaactagatgaaataatatgctaccaaagaaagaagaggacatacaggttggaaggggaagtaactgtctggaatgatattattcagccttcgcaaagtctcctcggaggaaccaggaaacataggcttacaaggagttggttggccatcatgtatttgttcgctagaatgaccaacagcttgagtcaacagcggtttgttggctaattcaccactagctcttttttgctcctttgtgcttggcccacaaactgaccctttatatgagttcatctgatcagcatttggagcacaaaggccaagaacaggtaaaaggtgatgtggagttcctgaattggagatatctgctgcctttgggtgatgttttga

SEQ ID NO: 45961 - DNA, 5043 bp, Oryza sativa
ccgcaaggaggacacggtggccgccgtccgcgagcagctggagggctgctacctcctcgccgggatccgctacgagggcctcacggtgaagcagctgcagggcatccgcgacaccctcccggagacctgccggctgctggtggcgaagaacacgctggtggggaaggccatcgagggcacgccgtgggaggcgctcaagccgtgcatgaaggggatgaacgcgtggctgttcgtccacaccgaggaggtccccgccgcgctcaagccctaccgcgccttccagaaggaggagcgcctcgaggagaccaacgacttcgtcggcgcggtgttcgagggcaagttctacgcccccggggacttcaaggcgctcgagacaatgcccagccgcgccgaggtgtacgccaagctgctcggctcgctgcaggggcccgcgacctccgtcgtcaccacgctgcaggcgccggccagggacgtcgtctccgtgctctcggcgtacgtgcgcaagctcgagcaggaggtcggcgccgcctgatggctgttgagagatggttttgtggcttcgtttctctcatctcactcatttcttgtagaattcctgtacttttactgcctcacgtttgaattgaatcacaaaagttttacctcttacaacgcatgcctactggtctgatttcataagattaccgagttctgatgttattaggattacgttgcgtacttagagggaatgcttgttccacaactagtgttttgataatttaattttacctgtagagactacagagatcaaagtttagtaggttgaggggcaatggcaatgcacaattagaatggtcaataactactagtgcttgtgtagttgtaccatcaatcagtgtatccaggtttacaacaaagttgttcaaagcagtatgatgagatgttttaaaatcatgaacttaactgtgctctttttgttaagagcaaacctccttgaagtgaacaaaattaaatgattaattcatcttttagtaacagaataacactaattagagttggaaattcttctgaattagcttctgaaacttactgttggtcaccagctcaccacatacctaatttgtatcatttctgtctgaacgcgcagtggatcaagaatagaattggcaaaattgatgatcacatggtcacttatttgtttgatactgatttcttctgacagtcatggtattgtcctaggttattgtacttgagtgatagttgtagttttgcaggagtgactaccaggcatgtcaatatgccaatatcattcgcccaatggataaggatgtgagaggctcttgagaatatagaggaaagcttgttaggaccaagttgcagtcttacggatgtgaaattgctttggtatgggaaaccatttctttggtccattcctgaagatcgtgttgtttggttataaaagatacataaaagatacatatgtctctagcaacatattgtgatttggctgcttaggatctattgcaagctaaagtggaatacgtgcactgccaccaagcggttgtgaaataaagtatcatctggataagtgctttcctcaatctctgaattcttcaatggaactcagcaacatgatcttgtttgtctttaagcttttacattaatttgaaatttgtttgcaatggcatgcttagacacaatttgaaatcatagttattccatgatgtataataacaaaccttcttgtacagtaaatttagtcctgattgatgtgtaaaagtaaatacactgctacagcctcattatataactggaggggatttccatggtgcaaatgtgcatttgcttgaggtctaaaaaaatggtgcaattcttttgacatctaactaacatcagagttgtattcaacacatcattgcatctcagtgacactgatgaatattttctttactttgtgggtccaaacatattaatgccttgcatgcactactttattcctgcagtgctgtatctccaaacagataaacctaaacaagttttcccttcatgagcgaactgttgctgtgttggtccttttgaatttggtgatgcattttacgttccttaattaggtctaaatttactttatgtgaatattactattatatgtaagataatgtaagcctgattctgttcttgtgttgataaagctgggcaccaccatgtgagcgcctgattggcttcgaaagctcacacctgttttttcacctaacttcgatgcggggtttaccacttgactgatgaaggaatgttagcaagttgccaaacactcttgaaaaggagcagattcttgcacagctgctttgtgtgatggcaccggcgacctagcatgagcacatgacacttcctggtccaggttcttcctactcgttggtgtttcacgaactcaatagtcctactttttttcccttttcttaaacgtgttcgatatctctgctccttcaatatgcccgtttggccgctggcaaggtgagcagacggcttcgatcacagctgctcgcttgatcggacggtccgtttgtctcgttggacaatctccaagcgcgtaccagtgtaccaccggattgagactctgtaacttacttttctttgacatgtgaaccctctatccagcgggtctatatgtcagtgtctcaaaaacaaaggaaagtaagccaaagatcatcttccgtgtaccactaatgtatcagcagtaacaacataggcgccgctctcagaaaaggaccaaaggggatcgctaattagcgcacgtacattttcagtgtacatatttttctccttcttagtagcattctcatataaaactttcaacttcaactcaaaatcatacgacttttagctcaaattatatggaacttccaaatgtagatttttgtttgcaaactttttatatgaaagtgtgccttaatagcacacgtgcactaattagtactaatcctaaatacacagaaagctaagggtgcatcttttttattatggttttaccggattagtggcacgcgaaacgagaaatataattagcatatgattaattggtattaattattaaaaacataaaaatattttttggtttttcaaaaaaaaaattttatataaagttttcacggtaaatacattatttaaccgtttaaaaagtgtgctaacgaaaaataagaactaagagcagcttcagtgtagggagaaatcgaacaatgagacagaaaaatcgaatagaggacactgagacagtcgactggtgcatatcagacgaaaaaatggactccaaagaccgaaccatactgaaatagatagatacggatgtcaggccaagcatagcttcatctgtccagagaagaagcagcctagatttattattattattatttccttgaggccaacgatcggatgcagcactatagctctagatcaaattccacgtcaaaacgaccttataatcctctaaaatcgagttagcaatttaaaacgcgccctaagtcccctttaggcaaaggtgtgatacacaattcgtcttcctctccagcgctctccctcccgccgcaacgaggaaaccaccgcctcaggatggccccgcggccacgtgaagcgccgggccggtgcgaatcagctagggctacagctcatcatctcgccgaagcgatcaaccaaattattacgcgcgattggagacgttgttcagccgggagcaggagcagcagatcatctgattgatgccttccatgctgaactttttgccagtgctgtggctatcaaaacggcaaaggagaagggtatggcgcgagttgaactggaaacagattccctgatgctgtgcaatgcactccagagcaactctttcaacttatcagtgatgggtggagtaatccttgagatcaagcatgtgattgctagctgttttcattctttctctgttagttactgcccacgaaactgtaataaggtagcgcatgaattagctgctttgggttgtaacctttcaggacgcttcctcctggacaggctgcccgcctgggatggaacgactggtgaccagcgatttagctggatcagttatataaagtttcggtttccctaaaaaaaaattattacgcgcgatcgagcaagcgagcgcgcgcgacgcgacacgacgccctcgctaatacgattacactaatacgcgtggcacggcgagcgcgcacggcggcaaaaggctcggaccgcggccacacaaggaaagcgcgcggagggtgggggtgaaagatgcaaaggcggttcagacgcgggagtcgcccaaaaaaaaagcaggccgtctcggccacagccagccgtccgggggggataagcgaaagctggagcccgtcgccagcagccttgtggtttgatcctgataccatctcgctctccacaaaagcacgagtagcattcgatcggtcactccgttccctgcatctgcatgtgccctacttacatttcatttcattcacctgctttaattttgtctctcgatcgcttgattcagtggctaattatagctccaaaaattaccgggtaatcctagtgctcataacgaattagtaatactctaattactccaattatcaagatcgcagatttcagcgtgtatcttggttaatggatgggcagttcgtgttgctggcttgctgctactttacaaggaacatgcgcactaagggcgtgtttggttgctgccctggcgagtatttgcctggcctagagctagctggattggttgctttcctgaatggtgtccatgctcaggcaagggtgccggactcaggccaccaaaaatgaacacctgagtcaggcgtgggtatgtgtctgatcctcccccattgattcttcattgatgtgactgctattaacacttgtcaatatcttactcaagtaaacaaaatgtttatatataatatattcactcaggcgtaggttttcaaccaaacaacaaaacatcacacatgcctggtcaggcacaataaaacacagcttttctaccacacaggcatagatttttctcaggcaagtcactca

SEQ ID NO: 45962 - DNA, 5885 bp, Oryza sativa
ttcttgtcacatcataaaagatatattgacatgacaccctatttagtgagaatggaactcttattaggaatggtctaacggtgattggtgaatcttctattaggctagacatgcaatcttctaaaatactcactctgtttattaataattggcacgatacactattctctttcaaacactcatctttctaaaaaatatttataaacactaaaaaccatgtcatgtattaaagtgggttatgctttaaatataagtataaaacttttgttcactccggtctaccctctccatcttaaaataactcaacctaatatatggtgagatccatcctagtgtacaatgaatctcaacaaaagcttattcggatttcttgtattagaatggattacagcatattctaggctaagttattttaggatggagggagtaacaatttaagagtaatcaatggtcaaagctttaactgaaatattaaaattgtaaccccgattaacaaattgtattaagatggatcacatcacattctaggttaaattattttaagatgaagggagtaacaatttaagagtaactaatggtcaaagcttcaaccgaaaaattaaaattgtaacccttattaacaaataatcctttctaccacctataaaagatatcctttcaaccaccgagagaattaaatgatgcttcaggagaggataactttgcaatgacaacgttgattttatcatgattccagaaactagtcgaagcagacatatctcatcatatccatgtaatgatcaataatacttctccccgtcccaaaatacttcctattctaaatagtttagcataaattaagatttaagaaaaaaactataatgtctcttatttaataatgtacggttagaagtgaaataataattgaggggtataatcagaagaaatttgaactgacaacaagtattttaggacaaaatgtgaatttagtaaagacaactatttcgaaagcaatgtagtataaagttaagagtacatcattcatgttatcattatttagtaattactccattactccctctgtttcatattataagtagttcgactattttcctagtaaaagttatttagattcgaccaagtttatagaaaaaattaaaaaaaatctacaatataaatatattttgatgatatgtttgttttatgttgaaaatattactatattttctaccaacttgtttcagacttaaagaattttgacgaggacaaaaatcaaacgacttataatattaaacggagagaatactccctccgtaaaaaaaaacccaacctaggacagatgcgacattttatagtacaatgcagggtgtatttagttcacgccaaaaatagaagttttattgaaattgaaacgatgcgactgaaaagttagaagtttgtatgtgtatgaaagttttgatgtgatggaaaaattggaagtttgaagaaaaagttgggaactaaactcggccgcatattcattgtactataaaacatcacatctcatctaggttagtttttatgggatcgagggagtaagcaataaggtccgtatccttttcaatttaagacctactaccataagacgtactctcttcgttccataaaaaaccgatatagtactagatgttaacacattgtagtactacgaatatggatatgcctatatctagtactaggttaagttttttgaaacggagaaagtatatgttaagggcccctttgaatcgcaggagtgaaaaaaacagaggaataaaaaaacacatgattctgataggaatgcaagtgtaaaacagatgattgtaaaacacatgaatgaccgtttaattggaccgcggaaaaaacgtgggaatcaaatgagagagatagacttaaaggaaatttttcaagaggttaaaatggatgttaatttttttacatttttcctctaaaatagtaggaataggaaagtttcctatgttttttcttttctcattcctacgaattaaaggtatggatagtgtaggatttcagttttttttcctccaatttaaaggggctaagctttggtggaaagatggctatttcccaggcacaaaataatgataccgaccactatagcgaaaaggcaaataaaaagatagtaataataatgccaaacaattccagctccggaagaaggaagaacgcggcggtgctcttgctcacaaatcactctcaaggccccggcttaaacgccgtcaaaccatgccgtgacgatctttcccaccggagcgtgggccccgccgcctcctggccccacacccaatcctcggcccaaccagccccacaaaggcccagtccgcagcgacccagcaaaggacgcggccacgtggacggaggcgatctccgctgcgggggtggatcccgggccaactgcgggagcgcgcggctttagatttcgtcggatctcgggcggagcgggccccacccccacaccctccccacctccacttgctccacgtcacctccccccgtctcctcccccgttatctaccgcctcctctcaccaccaccgcctcctcctcctcctccgccttccgcctctcaccaccacggcttccagctctggccgtagcagcagcagcgcgcgcgcgggtgcctgtgcccgccgctgctcacggctcctcgccgccggcttgtgcctccgatacgtgagctccccacggtgcggcgccccgccgtacgtcgccgcgtgcgcgacaagagctcggtcgcgttggggtttggggatcgattgatttataggcttttttgtttttgtgcggcagggggtgcgagggggtctggaaaccggcggatctcggccgctcgccgccggagtccggcacgggtggaggagtacggcgacccgcttttttcttagcgattttctttcctcttctctcaggctgaggcatgcttcgagcgcttcgtccgttctgattttttttttagcccgactgtttgagaatcgtctgactgacctgataaagcctaattttactgccattttagctccccaagcgccgtgaattggtaggacttttgtgggaggcgctggtttctgctctactcacagcaagtttctaaagtaggtgaatcctcacggctccggatctcctcttttgaggatttcccccgaattttgatcagatgttcgatgcttttcaggactcggaagcaattgattgtgaagtattcctttcagttcggcttgaagtagtcctctcagaccattgccgcatataagagtagcttattaccttgtataggaaaaagtagaaagcttattccgagcatgtcttgttcataatagactggactctttgattcctgtgtgtttctggcagatccaagtagctgactgggtgcagcatatgctttttctaacgttgggcgtatgatgcaccccacaatctgtgaactatccctagtcactcagatcaacggcgcattatctctcttccaatctggttgatgggtagcgcctgcgaagctggtacggacgagccttcccgagacgatgttaaggggacagggaatggcatcctggagaatggtcatagtcacaagccagaggaggaggaatggaggaatggcatgggagaggacttacccaatgggcacagtacaccaccagagccccagcaaacagatgaacagaaggagcaccaagtgcagattgtccggtgggagaggttcctccctgtgaagacactgagggtcttgctggtggagaatgatgactctacccgtcaggtggtcagcgcactgcttcgtaagtgttgttatgaaggtatgcactgcaaattgcaataccaatttattgttaataagtttttctattttccgagggaagttaaattacttttatgatcacatattcgtattggagaatggagattaagatgaagattttacctcggttttccttagcatgcttttcaaactactaatgttgttttatgtgaaaactttgtatataaaagttattttaaaatatcaaataaatccattttcaaatttgaaataattaaaactcaattaatcatgcgctaatgactttctcgttttacgtgtacatatttaatcttcatgtttagcatgttcaaacggggactaaaggtttcctaactacatatttatttctcaattccagttttatgttgcattcagttgtgattttttctatacaagggaaaatttgctctctccactatataaaaaatatgtattgtgcattgtaaaaaagaaagtgcggttgagtcacatttttgaacttagacgcggtaaaaattcaccatgctatgaagctatatttagaaaaaggcattttttgtctaattatctcgcttaacaattagttgacttgcccttttttccttaagaagaaaggttccaaatattgaatatcactatctttatgcatcagctgattggtctcattggcatggtcattcttggtaaccagaggggtatagcgcataggcctgcttccaatacgcacggcaggcactatagttagcatagacagcagacgagtgcatattccaacacatggcagttgaagatagactagtgggccagatgtggactggggatattctggtgattttttctatatagtcttgaatttagttttaagtactcatccacattcctctcccaatgaagaaaaaaaaatggaacatagtgcctctacattttactacaggctgcccgcaggaccaatctcttcagtatcctggatcaagtaactgacatgaaaagacctgctataggcatcggtgttattttctgttagcaccacgttcccccaattttcaaatttgccataccatcaagtcatctcagcatcactactccctcctccctcttctcttgttaatatgctcaactaccttattattggcgctggatccagggtaaaatgccactagggtcactctacttacatgatggtagcattgactatttacaagagcaatttaccataccgaaggagcattgactatggacctgatgcttgcatgctggacctgaccctgctgattgtgaatgcttgcattacatgatttttcttctgcaatttgattgggcagattcaagagggttctgcgcttccagatttccaagtgcaggtgctgatgcaccaactgccattttcagataagagtgtgatctggtcacataggtgtgacactggattcctgtatttgccatgcaatgcaccatggctttgccctggattttatcattagataactctaacaatagtgctattcctacagtttcatttttggtttgttcttttgtcaatcttgcttccactctcttcttttaaaattttttacaagacctgaaccaagcccagacattcatgtgctaaaggcctgctcgacattaagatggtttatgaatttatgataacctcagggttgtcgataataatagttccatgacaggattccctatgattctgtcctctccatgaaattaatcataatattacacatatttgaattaaaaacagcatacatagataatatactcctagatttctgttttctttaagattcctaaacctgtttaaacttcaagaatggggagtactggatgcaacacctactactactacctgctagacaattagattgccaatcttggtggcaattgtcaaaatatcgaattatgctgaaggaagcattttggaagttacatgatcaaggccagtagatccaattgtttctctcttttttttcatgttgaactcaaccacatctattatttagttaaccttattacactaggtagaagaagatttgaataaggtgcactgactgatttgaacaactcgattatggtca

SEQ ID NO: 45963 - DNA, 2521 bp, Oryza sativa
ggggctatattctactcagttagcaaaaacgagtggtagtatattctaatgattgggtgaacaaaatgacaattgatacaatttcttcgtacggatgtgaacactactttagaaaagagtataaaaaagtgttgtttcttccaagggtgggccatactttaataagtaccaggatcgaaccagtgaattactacattccacaaagtaattcataatgtctaatgaggggagtatgatctttaggcaataatcggttttgacactgttgtttcacttttgaggaaaaagacacttttttcttgctgttgtgcctgactaaggttagcattgaaccggtatctttctgatggctttgtccgcctattttcaggtgcgctatcagagcagaaagaggttggctgagcagcgccctcggatccgcgggcaattcgtgcgacaatctggacaggaagatcaggcaggccaagacgaagacagataactaagaaccacctacatatccaacatggcatctgctttgacagctggagagctacgcaattcattccatagctgaaagcagctcatcgatccccacattggagtgctcaataaataaaacccatatgattattttctgtgcctgactccagatgaaatttgtgctatggagtggaccacgcatttaattttaatatggcaatcggtaacaacttagatgcgatggttatttgtgacctccagttcccttgcagagatccacttggacactttgtcgagtctaaggaggagcaaaccatctgacgtttctatcggatcatgaatgctaaatctttactctactactacatcgagctgacatcagtgagggttcaactattcattgcgagacattattttcaagtcaaatagtacatacttttctgctggctgcatttctttttcatgttaatttccgctggctccaattttgtggttgactactgttatggagtaatggcaaccccagtgcagtaatgacggtttctttttaagttttgctttagctttgtcttgtaatgaacctctgtgatgtttgggatttcttacaaagccggatgctgacgatctttcctctaaaaaaattgccatggtaggctggttcagataactttctggacaaaatgctttcgtcgttttgaacctgaaaccagttacgctatgaaatgatgcaactaacgtagtgtaacgatgcctatctagcacggttgagtaaagacaatgctacatgcgggagaacctcagcttactggttcttcccaataaactgaacctactggtttagtcctcaattgatacattctgtgaaaacatttcatgaacatttgcctaaaatacaggagcgacacgcattacaacttccattgcttctgtgattcccgtgtctaccgaagtgatacatcaatatgcaagctaatgtctgctcccagggtagaaaaagtcagcgccgttttccttcactctaaaatggaagttccaaattctctgtgcttttagcctttgctccctgaatgtacacttgtttaccactgaaagctgttgaaaatgtttgagcaacttcaatagttattataaatgaaatatccaaccctggtaataagattctcatgcaagtttatcaacaattgctacattttctacagcgtggactaataagggcaagaacctacctgtccatgaacatcagcagctaaaccagtgctcaaaggtgcagctctgatcacaagatctgcaatgtagcgcagatgcaaaaggacccccacaccttcctcactcgaatatatatcctcatgaataaggaagaccaacgagcaattctgccaagtcataaacaaaaggcaaaaaaaacatgagtgcaaggcaaaaattacagagatctcagcaacttttaatagatctaacatttaccatctcagaggtaagtgtaacacaataatgcaagaagtccaacacatcatctacagaaccacctgctgcaacttctaacagtgaaacatcatcgatcatgagagtaaagcggcctgtattatctcctgtcctgctagcgtcgatggctctttgaatgtcaccatacagtctaacaaaactatcagaaatggcacctccctttgctccacctgcgtacagaagcaaagcaaacctgtaactcagtaattatgcctttatgcaatatcatttggaacgaatacaaggcattgatgtgattgcttgcctgggaaggcctgcaagtcaaaaaaatgaagcctctcactcttcctatgcaaggataggttacagccctggtaaatttgagaagaaatcatattacatgctatatttcaactaggaaaggcatccattatgcatagcactgtatagcagcttgtccaaatcaaggttcataataacggtagtggaaaggaattcatgatttgtaataaaacggttatcccattcccaccctccagtgtaccagtagaaactttactaggaaatttatcccatctcataaggcgcaagaact

SEQ ID NO: 45964 - DNA, 3480 bp, Oryza sativa
tttcaaccttctagttctggtgcaagacaccttattgaaaattgaaccaagagctcattgactaatgactagaatctcggaacagttcaacttctcataacatctggtgaactaacagcccccatcccctttcatgcgcacttcgatcctacttcctccgtttcacaatgtaagtcattctagtattttctatattcatattgatgttaatgaatctaaatagatatatatgtctagatttattaacttcaatatgaatgtgggaaatgctagaatgacttacgttgtgaaacggagggagtactattttgtttttcccatccatccttaatcaacactaacaaatgtgtgagctccacggcattaaaaatctaacatgcaccattaacccgaagaagaacggcaggcccttgacgcaattgaagttgagaacgaaaactaattgctggtctcgaatatgatagcggagtgctcaaagtgcgacttgtaatgtgaatcccccggtcattggggataggtcaacgaagccgatagacaaaagacatgttcgacgaaacgcgggcaagggagtcgagcggatcgaacggagcggagcgtaccatcttacggagaacccggtcgtagtgggagaaaggtgagcgagggcgaggagcgccgcggcgccgccaccggcaagcgcgcgcttgaggaggaggtgcagggcgaaggccccgggcgcctcgacgcggtcctccaccaccaccacgcgcgctccggagcccattgcctcgctcaggaggtccccgcccccgtactcctccatcggggccttggagggctggaccctgatcgccgcctcctcgctggcctccgccgccgtcttcaaaggccccgccgcaccttccctgctcccttcaccgtcccgttgtgctcgccgccggtccgccgccgccgccgaatgacagaggaaaacctaccgcgagcgcgaggactccacgccgccaacacgatggcccaggcacgagacgggcacgcctcagtagacgggccgttccggcccacgtgctcggcaagcagcccaagcacggcccaagagcttcaccggccgggccgtgtcgacctgggcacgacgggccaaaagcagcacggcagcccgtttagcccgcaaaatatatatttattgtaataataaaagaaaagacaaaaacggaaggtaaaagaataaaaaatgagggcgaatgggaaaaaaattgggagaaattggaaaacacgggaaaagagaagatatagaaaaaatagataaaaaatatactcccgttataaaaaaaacttaaggatgaatataaacatacatatgcccatattcatttataggaatagactctttttttttttgaaacataggaaatagttcagatttttttaatggagggtgtacatccctatgatcatagaggggtactaaataatatatagtgggctagtagtgaattaggatcgttatagtagcttaaaagggatcgcagacactatattctgatattatgatagaggatgaaagaagtactcggattttttagtttattgtgtatatatcatgagttcaaattctattaagtccaaattcaatgtagaaggtagaaataggcatgtatgtaatactgtaattaatatttagatcttgttgattcttataccaaccaatatttgtgcattgatgagagtcagctgcggaaaaaaaacatttaactttagctttcaattttcaactctagtaaaaataacgatttttataacgtcgtattgaataatcgttactgttattattaagctaccgtagcatttgtaacattacaagtcgttatttggaagtttttttacaatagcggtagcatccttacggatgctattgttgatataataagtcatctttatccccactatttagtattattcacgtgattggtattactactgcaagtgataaaaaggagttggagaggagcaattttttttattctctctcatccgtcaacattttttaagactaccggtatccttcgatattgctgcacctttgcactgaacaccccccaacctctctctctctctctctctctctctctctctctctctctctctcttcccccgtcttcttccatcgctgccgcaacggcgcgcgcttgcgcgtcaggaggagaagtcggcggcggccatggggagctgctctcatcggagggcggcaacgagagcaggaaggagtccgcggagaggccacagatcacaccggacgagacggccgcctcaggtaattaatgctacggcctacgggctctcctccccttgctcttgacaccctctgcttccgcgaacgtggcatcggttcttggccatagcattgcttcggaatctgatttcggcgctaattaatttcttggtttcgagtttcgacccgtttatgggcgatgactggtcgagcttcgtggttttctgacttcctatgcgagggttcttgactcccttcttggattcaccgggcgggcgatggttgctggctctcgcgcgatcaccgtggttttggattcctccccttatctttgcttcatcggttatgacttgtgatgttcttaaacgtatattgagatttttgctcgttagcatcaaggcatggacctgaattctttttatttctggaagttggaacttgggatgctttgaaccttctaaaaaacagttcagaaggcaccatgatttttctattttctaatccgtgctatgtcgcaagtaatcagattttttttttggaaatttagatagtccgtttaattttcttgccgatggtgtaactaatgtcgtggaacgtgattctgggcattgaattgccctttctttcatattatggtttgcctgtgctgttctgattttctttgaaaggtgttgaaactctttacttgatttcttgccagtggagtattgatttcgtaaagaaatggtgtttgggcattggcatgattttgtcctgatctcctgagtaaggttctccgcttgggtgtttcttgtcagctttcactggcttttcttggaacggtgggagtaatatcacaaaatacgcgtgttttacttttttgtctgtattgctttcggttgttttgataacaatactagtagaaatacttttactttgtcttatatatgttaatgttattaccttatgttctgcaatcttacaatggtttggtttaatttgtcttctttctcttgttgaatttaaatagctgacaccattgcattagtgtgcctcatgctcatctgttatcattgtttctgcagagatggatgtgaatttaaataccacaaatgctgattccatctcgaaccatggtatggagaggcttattcatggccagtcattcacctacggggagctgtatgcggcgacagggggcttcagtgacgatcgctttctaggagagggcgggtttggccaggtgtatagggggg

SEQ ID NO: 45965 - DNA, 3110 bp, Oryza sativa
ctaatgtatctgggtgaacattacgggtctcaggtagaattgaagctgttagacacaaaaggattgctgtagtatttcctttcatgtatattattcctctcgaattcatgctattgttaaattgataagaacagttagggtttgcttaaggaaaatgtgaaagtgtttgatgcatgtatcatctacgggtgttcggcatgcatttcggcgtagtaacaaggaagatgtccaagtcaatcattatcctctttattatcctttctgttatttggttttgtccttcttagtcagtttggtgctcttgttagaacttggttgctgttctttcttctgttgcagctcttttgtggcaacttgatctctttgtggttgtttgtactttgctcttgtagcagactactctctttatctccaattgaagtggcctcctgtagcatttcaatttttttgtctgtgaaaattgatagccgtgactcgtgagaagatcttgtagggtctaattcacttgtgtgccactctaattctcgaaccatgcaattggacaggaggtggctataaagattcttaatctacaaggcaatcaaggagacagggagttcatcaccgaagcttcagtgttgagtaaactacatcacacaaatcttgtcaagcttattggctgttgtcaggatggtgatcagaggcttttagtttatgaatacatgcctttgggttccctgaaaagtcatctccatggtatgttagtatgttacaaactagtaacatatatagttccctccttcattacactgcttctaaataattagaagtttgtctaatcagaactgggtcttaatttttccagatctttcccctgataagaagcctcttgactggaacacaaggatcaagatacttgtcggggcagctaaaggcctgcagcacttgcatgtcaatgttgaccctcccgtcataaaccgcgacgtgaaatctgaaaacattttgcttggagatggatatcatccaaagctttctgactttggcttggcaaagatgggtccaactggtgatgacactcatatttcgactagagtgatgggcacacttggatattgtgctcctgattatcttgagagtggtaaactgaccgtccagtcagatatttacagctttggtgtggtcatgttggaggtcatcacaggacaaaaggttatagatgacagtcgagctaagcctgagcgaaatattgttgaatgggtaagccatttcttcctgttttaacttaattgtgttatttgcttctcctgcatgcacaagtctgctcatgaaagagcacataacactatctttatataattacttcaactatttgatcatcttagacttgtgtgcttctgttatttttatttcgtctcatcattgcagtcgcgattttttttagtcttacatattatgtcatgagagaagtagccagtaaagatcgattttagattctagcttcatccagggtttattttactcccccacattcaacttatatcctttggccgaaatctattttctttgtgtaccttgaattttaagcaaaattggaagataccaactgttaacaaaggagacaaaacagctgatatgttaactgcttccattatggctcttacatgctttgttacgagttattctttcgccattaatttgttgcataatttcaggccatccccaagatcaacaaaaaggattttcccaaattagcagacccggtgcttaacggtcagtaccacatgaggtccttgttccgggcccttactgttgctgctctgtgtgttgacagaacagccaaccggaggccagatatcacagcagtagttgatgctcttactcagatctcagagtcacaatccagcagaaagcggtggtcatctcgtctgcaatcatctgtaggttccagtgcatcgactgaaccgaggatagaagattggaaccaagccaaggatcagggagaaggcagctaggaagcccaattgcagaacagcaacatggtttccctgtcactattagtctcaagccttgctctttgtgtcgtgagccgtgatggttactgcctgagagtagtagaaactgaagaacagcgctgttccatttcggaacatatggttgaatttctggagggaacttctgttccttttcttctgtacatggatgaggcttgtcattttgttgtctttcgacatagagctccatactccgaaagcatctccagatggtttcatggcattgctcctatgttgaaatcaggatgagatgggtctcacgtttgcttccctttgttgtatggatgtacttaaaagggattaaagttttttttgtgtttggatacaactttgttttaaggttacaccgaagtgtcagttcaacctctgtccatttgttgtatggatggacttaaaaggggttaaagcttctctctttggatacaactttggttcaaggttatacccaagtgtcagatcaaactcagtccatttgagtatggatgcacttaaatggcgttgaagtctctctttgcattcaactttgctctaaggttatattttgttttcagtattcctcttctttcttgttttggccaattggccgcgtaactcttgaccagccatcaataagatggttataaggtagagtctctctacctttcagcgtcaaaaaaatatctaagtgcttgttcaacctgcccattccgggcagtgcagatgcttcgacttgtctagtttgccaagtcatatgcaatcactacaatgttaagagtgatttactgtcgttaacgaggtaccggttttatactttgtagataccttgaaccataaaatttctgtgttatggcagtgacagcttgcgcataaatggatatgtctggtatagaggttcaaggaagaaataggcataatctcaccaaaattctgaatgaccattcctgatttattatatgatccagtggttgattattattatttatttatttattttaaaaaagagcattctcagtggagactcggtgtttacacaacatatgaaattaatatgcttaaggcactcgtgtgaaagcaagtcacatgaataaaaaaacatcattt

SEQ ID NO: 45966 - DNA, 2848 bp, Oryza sativa
aatgaacaattgtacctcaagtttgtatcatcttcctagagccatttggctcatcatgatgttaatattttttttcttttccaaatatgaaataaagaggatatcccctttttttttactcaaattaagtcgtatcttgaagcattaaacaaatcaaggtaccttgcttttctctagccaaccaaggcccctagaaagcaagcccaatctcctgttaggtgcatcctggttaggatcttgatttggcttcccagactgaggggcagcacgaggtgaactacaaaagaatcccgagtaaacgaagtgtcaccatgcaaagacagtgttagaaagttgaatgttaaaaaccaacaagaaacatcagtaatatgtcatttgtagctaaggatgatttatgttaataaatgaatggagtactgagaaaacgaaaaggaactatctgaagcatcaccactagcaagtatgatacgatgcaacaaaagcaaattagtcatgcccactgctccctaaatgcttaatgtgtggttttgtaaaactttaggaccataaatacctgggattatgtgccacattccgaaattcctgtggttttgtgcaacttataccataataagtgtgttttatgaaatttacttaattaataattatcatttgatcagaactcatccatgatactggacatatagcataggagtttaaacataccttggattgaaggactggttggccttaaactgccctgcctggtactgctttgtagcttccaacatagtttcggccattacagctctcttctccatttgtcgaagtgctgccatcgctgcgtcatacttctcctgaatgtacgaggaacaaaaaggttatgcaactccctttttacagatattacaaattgtacgtgtaaaactagcagtttgagagaacatcttgaagcaacctggagcaactgagcagcatatttcttatcagcagcatctctctcagcagctatgcgggcatcttctgccactttctgttcctgctccattcttatcaaaacctgcaggcatatgtaaatatgtatatattttagccaaccagatggcataaagcacaggcatactaagctgtaagatagaacctgaagcattgcctgctcttgctcttgcttgtctgcaaaggactttcgcaactcagatacctctgcctccaatttctcaacctgagaatcttttctaagtcaagaatgaatgtgcccaaatttaagcccgaaggacaaaacagatttaaggactataactacactactactaggtaatcttcaagcaattggttcaattataaagaagtcttggattgcattaagttgtgcagtcctggaggggaaagagaagcagttgtagataacatcttaccttagcactcaacatatgtctgttgtcctgcttgaccatttccatcaaagcagtttccaactcctcgcttctgagagcatgacatgtgttaatagatcatgataggagttggacacagtacaaaactaagttaatggcccaaaacattacagcgacaacttagatgaaagtatgcatgaatttgacgaagactttaccaattattttagatgcaaaaattatttaaaatttactgtgaaactgagaaaagggggaattattcttaaagaactaattactcttgaatgctgggagctggcctatctggttggaaagaaccagacacatctttgatggaatgctccaaataagtttagatggagaaattccctccttaacgatttatatttaagagttccgagttttgcaggttgttatatctagcagtggctgggatagcttccgtactattgctattcttctttgtaactatacctgtacaatttaactatgtggataaatagatccagaatagaagcacaacaaacctgagttcagctgatcttttctcctcgagcagtttgcacagctcaactttcaaccatgttacctgtgagcattgcttgagtagttgagtatagaaattcatcatgtttaacataagaaaaggtaactaaaaattccatattggcaaaaaaacatctgaatattaagctcagaaaggaacgtaaatattgataggaaccattcaattatacagaaggaccgtgacacaaattcctgaatgtcaattatcagaatgaccaataaatttgaatgcatattataagcacattgtttttttgtttctgttagagaaaacatcagctcattcagtacaaataaatcagtacagagaagttcttacctgatcttgaagatcaatgccctcttccaactcattatctagagctgaactagtaaggtaggtttctagatttgctgacccagaatctaaaaattgcatttccccattcacttgcaaatcatcttccccttccttggaattaacttgtgggcatagaggatcatgtttaaagctgtaaagtttagttgctaaacccttcttatctttccaagaatggcggtcttttgatctttcctccatagcagatataatatcaggcctgtgttttttccttaactcctgcagccctatttccctgactgcttgaaaacccatacaagctgtcaacacaagttgactgctgtcaaaagtagagccagcaagagattgcaataatgtaattgcatctccagcatcctttgtggtcaccagggcaggccctacaaatcaacatacaaagacaacagtgtagattacacttacacatcaatgcttattagaaaagaacaaataataggaaacaatagctttttcagggattaagttataccatataagtcgagcaaagcaagcgttgtccggaacaaca

SEQ ID NO: 45967 - DNA, 60734 bp, Oryza sativa
  unsure (1)..(60734): unsure at all n locations
tgttttttttaagataatgtgaaatgcagaatgctacaaaaggacaagtgtagtaataatatcattgaaatacaaaccaagttttgggaatctttctcgtacaacttcctcaagaacaagctggtcaacctgtaaacgggcagtaacattaacgaggattttgggaaacattacatgtatcatgaattaagaagtacctgagattcaatcatttcctcagtgtaataaccatcaaaatactcatcaatgacccccaccagagccctgaaaattcaaaatgatgagcgaaaacgagaaaaataaagtggaattagagttagcatacaatcttgaaaatacaaagaaaaattatcaatcaagtattttttttcaagagacaaggcatttaataaaagcataccagaatgcatgctcttcaggcatgaataataaaaataggccagcaaaaaagttcatggcctgcaagaagaacaatgaagatataaggtaaagagtaaaggcactctagttatattgacaaaagaaaatgcaacagatgtttctgagccagattaatggtgtctagcatatagaacatttaatgattttgccagccttgcaaagctagctaatagttgaattgcatatttggaacttgggatagacttaattgattttaaccttgtaaatcacctctgaagttacaatattcataattcgtttgtcagcgtggatgattgaaaagtgacaagtttcatagttcacgatggatctctcagtataaaatacagccctcatcaattcatcttttactcaaaggtatacattatttcgcagcacatgcatatgattataaattgggtaattttaccatccttgagaaggtaccacattttctagtgtaaaatttggtacctctaggtactaggtactaagtaccttgattcaaaaaaaattgaatcagacgagtggtcaaacgttgcaagcaaaaactcaaaatcccttatattatgggacggagggagtagattacaagaggttaaaaactaacataaaattatccaatgagcatttgttcacctggcagtatccaactgatgggttatgccttgcatatgctgttaataaccgtcgcaaagcatttctcccgtcctcatctagtgcagggtgtcccggaaatgttcgaggcaaatcctataatgataacaggcaaatcaagcattcaagtgtgtagagagtagagacctagaacagtagaacttctaaaacatgacattagttcctcccatttcaaatcagagagcaaccttctctatctgtcccttccacttctctgggggctttttctgtgcatttgtctgatctttcaactcttggtcctcagggttcttttcatccaattcctcagtaccttcatctagtaatttgttgtagtacccagtaattttacgagcaccaacacccacaaatgcttgccacatctgcaataaaatcaaccatatgtgagtgtaggtatatatctattataaggatataaaaacagtacagataattctggttacagttgcacctctcctctaagagccattggcacacctccacggaccaagctctcgagttcctccctccaagggaaataagactcgccattgcctccctccaaagcagcactcgcagaatcaccttgttccctgtcctgtgcctgctccaccttatctggattagaagattcctctgctggatcccctctacaactcttatctgctgccctttcctcctcttcaattgatgcaagctgtgcttcaccatttccacacatgtcatttgcagtgttccttatcttgcccactcgagagctcatcattttctcaatgattctgattgatgcccgcacccgcttcccagactcaactcttataggcttcagttcatccaacaaccccttatccaagaaaagctcttctaacttttccgagttgtcgttgttcgcttcacctaatccttccaaggcaccatgagaatcttttaatccttcagaatcaccattctcatcatttaatagttcctctgaacacccactcacctccttcaattcttctggagctttgtccgattctacggagtttgcaatgctctcctgtttcagattttctgagttggcagatacatcattgatatcgtccgcctcaccatttgcttcttgcgattgattgttgccatcaatttccttcgaattttctggtgtatcgctcttttctgcatcctcttctccctcctcttcttcattgttgcattttattccacccctattgctattctctaagttttcagctccatcaaggtgttctccaccattgacatctccagcagcagagtcctctttggaaggtgaaatgctggttgtgatgtcatctgcagattcagccaacctgtccaagaagtccttccatctgtccgctctctcctcttcttcttcctgataaaccaaacaacagccaaaaaaatagtacagtatgtatcaaaacttaacctgaaacaaacaaaaacaacgcatttccatttctactctgcccctggtaaattaccttgtaaatcttggcatactcgcggaaacgctgcagatgctgcggccgcaccgcgaatccatacgcgtccctgcgccaaacctcaccaccatcaaccacaactcccgaaggcaattccaaccaccgcattatgccacacaaatcctaacccaaatccaacctaaacgaacaacgacgtatgcaacaatacaagacaataaatgctagcgagagggaggcggaggaaaggaaaaggaggcgccttttattgggttttaccggcactcgccgtccatggggatcaacgcgcattaaagaagaagcgacagggcgacctcggcaccgcacgccatggattgaccaaagccatactaaaccctagccccgcgccccgagatccacgcacatggaatggggaaaaaaaagaaagaaaaattccgcgaagggaatcaaagaattgcgacggatcgcggcaaggtggagctgcgcgcccgttaattgcaccacgcccctccccgcgcgcgccgcccgaggccccagacgcgaagcaacggagatagatatagagagagagagagagagagagagagagagaggaatagaagaacaagaaagagaggaaccgcagattgggggggaaccagaagacgaagaagaaaaaaaaactcgtttttcgcatcgaggctagagcgggaagcacgtggcgcgcgggacgacgatgccgcggcgagcgcgcgcgccctcgcctttgactcctgctgctctgcctgcctgcctgcaatctgcatggcttcgctgtaagcagctcggtctcggcgatttacctcttgtactcgaagtcgaacgccgccgcgcccatggcgcccatggcgggcggcggcggcttggcggcgcacgccgtgccggccgggtcggggagcaaagcaagcaaaagcagagcccttcttcttcgagcacctgtcacgtggaggcgtggacctgtatactggaaatggtgcgagccgagccgagggtgcagagattgcagcgctagtcagccttggaggggagaacgggaatagaaatcgaatcgcctggtttgacctggatttggaggttgtactactcctacccgtttggtatagggagtggttgtttacagttgtgctatattagagcaaggtcaacagtatagccaactgctggctccaaaacatttatagctaatctaatagctcattcatatagtagttaactatgaaaatatactacaccattaatacacggtctcacctctcatacacagataacattttagaaaaatccgtgttgcagccggctacaaatatgtagctcgctttcttcttttttcttttcgatatatggttacagccggcattgtacctgttcttagcagtactagttgattgatgaatggtccatggtgtcattcactcgtgtggtgtgttcttgtttgtgtcaggcatttggccatttgcctacactcctgtaggataatctttgctctcatccagcatctggctcgtcgtttggtggtttggtgaggaccggataatccgtgggccagcatcctgatgaaacatggtactagtaccaaatcggttgatggtgtcacctgtcagctcatcatgcgatgcaagcacgcccacaatccgaattttagacagccgcatgcctgcatcttgtttgcgcttctgtagttacacctgcctgtagtcctgtacaagcggaattagtacgcttgagtgtcgggctgaacaggacgcgattcctaccggacggtacgatccatctgggtcccttttgttcgttgccgcgccactcgccagcacatggcggggcgaggagagcgcgaggcggcgcggcgcctggtggatggtgaccgccgggggccgtgcaggcacgggggggtggttgggttgggtgggggtggggtgggggaggaggagctcagctcgcgcggcgcgtgcgacgactggcggagaacgagaaaatcagcggtcgtggtctcgcgtgatgatggcaaagcaaatcaacccttccgcccgcgtaccgggccggcctcgcgcgcgaagcagttgcgttagaccacgctcccccgcggcccgcgggcgtgcaagcgcgagggcagaggcgcggtccaacttgcgtgatggtgagacggcggtggggaggctcggggcccggtgattttgagcggacgataggaagaaaacgagccgggtaggtgagacggaactgtatgggcttaggccagcggctgagcggcctgctgagtaagtactttgggaaaaaaaaacaattttaaccctctttaaaaaaactagcatggtggcccgcgcagattgcgcgactagcatcattatattttctctcatataatagcatatatgttttctcattatattattcaaatatattaaaatgacaacataattttaaattttgtaataactttacaaaactactaatgtgtaatattcatattgtattttatatacgtgttaattattaattatttttaatatcaaattttaattatttgtaaattatatatattcctatatggactctagactcgtcttttaatatttctttttttttaattccgaattttctgtaaattgtatttctatatagactctatgctcttcttctaatattatttatttttattctgaatttttattatttctaattgtatttttatttggactctaaactcatctttcaatattctttaatttttaatttcgaatttcagttacttctaaattgtattcctatattgactttaaactcttcttcccatgtttttcttaatttcaaattttagttatttgtaaattgtatttttatatggactctaaaaactctaattttaattttattatatttattccaaattttagttagttttaaactcaatttctattatttcctaattgtatttctgtatggactctatactctacttctaatattccttattttttaattccgaatttctgttttttcctaattgtatttctatatggactctatactctacttctaatattccttatttttaattccgaatttcagttttttcctaattgtatttctatatggactccaaggttgtcaggatcgggatactaggtagtatcgttttgctcaaagtaatatcgtatcgtaggatcgggatactatgagattttcttttttaaaatttaattaatatttatattaattatatatagccattctatataaaaaaagtagtaatgatatatgtcatgtaaatagagacatttattaagagaaaccacgttggttttgatatatttaactgattttcatataaatttgagcatatttagttacactattttcaaaccatgttattttaaataatattttgtagtatcgtagggatcgtagaatcgggataccacctaagattttgtaggatcgtgcagtaatgaatagtaggattgagatgctatgaaaattaggatactaggtgggatcggtatcgtttcggcttggtaagagatcgtagtatcgtaagatattaggatactgtcggtgacatgggatcaggagtatcatgactagaggtttgaggcagacacaatcgcacacgtggcctggtactcccgagggacgtcgggcccgagggtgatatgttcgccctcctcttagtccccccgagggggtcgggccgcacccgcctcggccccgagggccgaggcgcccctacccctcgtgggtttttgctccgagtgtatgggttaggtgagcacagtggggctcacctaaccacatttattgtggtttggctgagcgtgtcacgccgcatgtaacgcagtgcagtgcactcatttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatgacacgatagtcctggtcagatatatgccaggcttcatcctaaccattacaggcaagatgttgtgtgaagaagggcgaacatgtagattgctaagctgacacgtggtggacaagaatgaccgacgtgactggtctgacaccggtcatgtcgtcagcggacagccatgattccacgtcgcatctgctcccggcgaaagtggaggtagttgtgggccgtctcatcagaaggtgactcggacggcaactatacaaatctccgtccatttatgaaaaggtggggtaagtccccacaaaaaagagagaaatggtgcatgtggtatccccttaagatataaaaggaggaccttgcccacttagaggggggactggacttttccagattgggaacccagaacaagggagaggctggctcatactttgtagctccttcctacacagatctcacaaaaacataggagtagggtattacgcttctcagcggcccgaacctgtatacatcgcccgagtcttgtgtgtttccggtctcgcgaaccttccacatacagagagcttagaatctcaccctgagtccccggccgaaccggcaaaggggggcctgcgtggtctcccggtgaggagccccacgctccgtcagatacgaatcgggatactgacaacattgatggactctagtcttctcttctaatattccttattttttaattccgaatttcaactatttctaaattgtatttctatatggactctagtctcctcttctaatattccttattttttaattccgaatttcagctatttctaaattgtatttctatatggactctgccttttctttttctccgattaatgtgagaatttctaagccatgagagcgaacgtggaggctccttttttctattcctttaataatataatagataggttgaatctgattcgtatcacttaaaccgctacaacgactcctcaaactactaaaaacactctaaactaacttccttaactggtttgagagtggtttttactaatataacatccacgtggcagccaaattatttgatgaattaaaaatagatgtgcacccatatgtaagtaagtgacaaaaaaaatacggagtccatatgccagagccactctttcttcgttctttcagacgggctggcacaagaacccactaagtgtgttgtcattgccgacagccttctcgtgccttcttcatcgccgctacatccttgccagagcacaccaagaaagatgacgaagcacaagaagcgacgagattgaaggagctcatcctctccttggtggggccgcaacccatcctacaccacggcaccgtaaaggcctcattgatgccctcagccggagcttcttcctcccgctgcagcttcttgctcaatgacgtcgcgatgacccctcctctctgacactcgctgtcgccgggcatggggataagcccctgccgcatggtcttgtccgcaacgtgggcaagtgccatagggagggatagcgccatggaaggttgtgggagggggaactcggtctcttcaatcaccaacaatggtggctcgtctagcggctccatgagagtgtcgaggttggctgtcgaggagtgtgccgttgactcacactctgccgccttcctcggttgatccgctttctcactctgctgagtttggaccaccgccgctccatccttcgttcggagcgagatataggaactggcattcttccgccattgcatcaccccaaacgcccaatgagagcagagagaggaagaaaggagatatatagtgttattgacaagtgggtcctacatctttttttattattttcttttaagactggttgccacatagatatcacatcaatcaaaaccaccctcaaacccatcgagggagtcattttacgctggtcttgattgattgaggagtcattatacccggttttgtggttgagatgtacaaatcatatttgaaaattttttcctagtactttccaccgtttggccctctttgaaaactttgttttatatactatagtagaagaacttttttctaaaaaaggtggaaccctttcaaacaggaacataatatttgtggtcatgtaggtatacataggatggtccatgaaaaagttttcatcggagtttatttgtgaggaaggaccaaaactccaaaagagattattcacgccaacgtggtatccagtccatcatatgagcttctctaatcggacagttatgtgtgtccatcgggtcatttggattcacacgtcgaaatgtgaaaaccattcacttgcaaaaccacaaacatgcgaactatatccaccaccacatgctagctcattggacattggtgttgcaaaagctgtagaagtactaatttcatcttgctttggtgccgaggctggaacgtcggtgacctgttgcccttctagctcggcacgagattattgatgcactgcaaaagcgaaaacaccatgctgccggcccggtatcaaaacaacgtcgaccgtttcatttgtggcacagtggcatagtgggttttgcgtcaatcccaaaacgccaccacactagatgcttgtttagttcttaactttttcttcaaacttttaacttttttatcatatcaaaacttttctacatacatgaacattaaatttttttcttgaaacttttaattttagtcaaacttctaattttaaggtgaaactaaacacagactaaaatactgggagacggaaggtatagacgtagcgacggtagcgtcgcctagccgcgtcggtgcgaggcctaggagtacagcattgtagcggctggctaacatcaacgtcgccgccgtcgcgttcatacggtggtggtgatggtagtgcacccgtgcggcccatgcaaaagccgcgccggcgaatcgccatcgaacgtggggacctctccgaaacgtgagggcaagagcggaagggaaggatacgatcaacccaacctagaatcgaatgcctctggctctccgtccaccgtccgccacagaaaatatcttcgtccatttccccctgaccgcagtggcccacaatacagtagtactagcactactccccggtgtccagatccagatcccggcgtccccatcacgtatacgtccgtggcggtggccgccgctatcagtcggccagcctaaccgaaacccccaagtttagccgtgcgatgcgagtgcgtaagcgtaactcctccctcctcctcctcccacgtcccccgcacctttccccccaacccgcagcccaaacaagagggaatcgaccaatcaatccatcaatcaatcaaccgatccgacccatgcccccatccgtcgccacccacgcatccctcctcctcaaagccgccgccgcagccgcgcacctccaccccaagcccttcttctccccacgcgcggcgccgccgcggatcccgtctgcccccgcgccgccggccgcaggaggcagccgctaccgtccgacgacgacgacgacggcggcggcgacggcgaccagcgccaccgccgcgtgccgctggttccggtggcccccgcccgcgcaggcgcccgtgaggggtctgtgctccttgccgcattctggcggtggcggtggtggtggtgagggtatgggatctgaaggggtcgggaggaggaggcgggtggtggcgcctgcggtgaacggggtggcgaaggacggggcgccacagccgcctccgcccaagctgctcacgctgcccaccgtgctcaccattggccgcgtcgccgccgtgccgctcctgataagcagtaagttcgagcgacagcttgtttgttccttttaactttgggaatttttttatgcgtttcttgtcgggttgtgacgcggtcgtgtatattgatggaactagtaccgagagctttgatttgttggcgactttctttcgtgtgctagtaatgtgggaaatctgtcaagatgatcagggttgtccttcgagcacaatcaagttccccgaagatagtgctggaaacgctaggaaattgtaggttatcttgctgcgagtaatgtgccggaacaaattgattgaggaatagttgaaactggaaagttttggagtaccccagctagatatgctaatcccctatgtccctctcgttcgtggtgcatatccatttattgcataaaacaattattattgtgcttaatcgtcaaggaaatggaatcagcagatcggtagatcaggtaggtaataattcctgaatcgtcagaacaataaccataaatggaattgatggtccaaaagatcgacactatcctccgttttatttttaacatgctgtgctgctaactggatgatactgctatctgtttttgtatccgtaatttcctaaattcagaacatggtgcatcgcagtagttgacatataggggcacctgtgcagatagtctttactgcctcttctgtctattgttttccaggctaggcctgtctactctacttagaactgttaatatgcactactcactagactttggagctcatctcctatgtgacacagtgctgcgcttagtctgcttagtctatttcatcaaaccttcacaggacctttttccatcctcaatttttttactgtatcccatgttgtgcctgagaattcctaagaatcctcccatatgaaccctgttgcattatacacattactcttcccacccattggggaaacgaagtggttttcttgttaatctgtgtgctaagaacatgttcatttcttctcccaagacacctacttttttatattttcccttgttagactaagaaagcatgcctcagtcactgtatttgacttttttctagaacaatagggcaagaaaaaccttttccaagtccagttccgttataatgatgctgaaaggttgtcctacgtgatgcttttcacctcctataaactgaagggatatgcaaattaaagtatcctatcagcactgcatttttaagtttctgggataatcactatatatatagaaggtttaaatatctagctccaatgtacatcccttttacaaacatgaggagcttttgcattcattcacagtttacatccattagctttatcgaaatgactagtgatgcttttttgttatcaatgattcatggaatttctgcaacagttagatggatttgtacaaacttatcatctgtagaaagtaagaaaatgtacttgtttgtttcctgaggtcaaatagtatgtttacctgacaataaccagcaggtaaggtaacatcaatgtagttgaacttatcgaatcacctttacatcctttagcagttatgctctttcttctatttggatattgtcttcacagtctttattgaacctttgcctatatatttctatcagtttacactgataaatactggttgatatgcatctggttctggtgcctgtttgtttatttttgacagactaatgccaatttgtcgctctgatttatttacattttaactaacagcttaatatttgtattgcgaccagctttctacatggaggggccttgggcagcaactgcgacaactggcatcttccttgctgctgcagtcactgattggctagatggttatattgcgagaaaggtgtgtcacaaataccgatttaataacatgccagacaaggtgcttaccagcatttttttagccctttaattgtttcctcacacaattttctgtacagatgcagttaggaacaccttttggtgcatttcttgatcctgtggctgacaagggtgcttttctctttctgctgctcacttcttaaattgcccttcccacccattttgttacttgaacagctgtgttttcgtttttcctgttggattgtttatgttcaaatgtgagctaactttgttactgccattccctgctgcagcttatggtagctgcaacattagtgttgctgtgcaccaaacctttggaaatttcactgctcagagatgggccatggcttctaacggttcctgccattgctattattgggagagaggtatttccttagccaatctacattgtcaattcatgcacatttagtgaaaatttggtttatagtaaatttttttttgttggtgagctagcataaatcttgggtaacatcttgatttcttgggttattggatctggtcagcttatcttaatctctaagtttatgtttcaaacctatgcaatatatgataagttgacaacttcccataataaaaagaagctgacaacttggtgttttgcttttgcaacgtaggttctatctagagcacagatctaagggtaagactacataatttatgatttaatgaatgctgtttggccaacctctatcttttgggattgagccaattcattctcttttctgtgaggtagagtgccaccatcatgtggcttgcttgaaacagaagtgaaaagcctgcattgaataagaaattttatctcttctttttttcatgctttaagaccctaattccatagtttcttgtcaaccttgtaattccatgcgaaggtgtgtggtaccatgagcaccattatttctattttctagttatgcaaacacgtgtatccatgtagaacaaacgtaactgacacagtgtggtggaatagtgatggttgctacaagctagtatcctaacctattacacatctatcttgtgtttatgtagatcacaatgtcagctgtgagagaatgggctgcgtctcagaataccaaagttcttgaggttcctcctgtgctcagttatccttggattccattgtcataatttgttcagccatttaaatttctacttgctacaacaggctgtggcagttaacaatttggggaagtggaagaccgcaacgcagatgacagcattgactatcctccttgcgagcagagacaaaaggtattcttgtttggtatttgcatggagttttaacattgcgcagcattctttttattatttctgtgttgatggttcggttttttgtgctttgtactttgcagtcttcctgcacaagatgctctggttacttccggcatcgcattgctttatgtatcagctggacttgccatatggtccctagtggtgtacatgagaaagatatggcggatacttctaaaatagccgtagcacatagtgtaatagaaggaacaggagcaagccagcaaggtgatattacatttcaagagcatacaatttttgaactgcggagttgattgatggacctagaattggttgagatcctcagctacttacgcattgtctcagtttggcggattagttgctaagttgctgtggctgcaagatctccgtagaaacaaaaaacatagtagcaagtagtatgttgcccgggtgattacttcttcgaaagctatttcagagcctatcacggctcgagtgttggacactgggtgtaatgatctgcaaaactgaaaaatgcagaagattgtaaccgtatacgaatacaaaaccatgaggtttgagtgtgtgactctggggtttctatagtttctaccattgtaagtttacccatatgatatgtcagaagcgaacattattctttggacaagtggtgttcttgttgtgcatttgagccatttaaccaaatctgtttgatattacacctggattgctacacctcctttttcaaagaaaattaggtgaagaaaacagctattgccgtcatatgtgccacttgctctcgtgggcctcgtggccgtttgatctgatctcaacggtctagatcacgcgaggccctgaactagtaggggtcacagccaaaagcccaaaactctcatgcccgcgccggcgggtgatcggagctgagcatttcacgagcagcggatgaagctgccggcgtggctcaccgccgtgccgccggatcctagggcgtacggtcacctcatccagctctgcgcggaatccggccacctcgccgctgcccggcagatccacgcgcgcctcgtcgccgcctccgtgacgccctccaacttcctcgcctccaagctcatctccctctactcccgcgccgaccgcctgcgcgacgcccgcagggtgttcgactctatcccgcagcccagcctcttcgcctggaacgccatcctcatctcgctctccctccactcgccggacccttccgcggccgtccgcctgttcgcctcctccgccgtctcccccgacgagatcaccctctccacgctcctcaggtccctcgccgcgtccggcccggcgctctccccactcgtcaccggggagctccacgccgtcgcgttcctgcggggcttcgggtcagacctgttcgtgtccaatgcgctcatcaccgcatatgcgaacgccggggacatgcgctccgctcgcgctgtgttcgatgaaatgccgagaagggacgtcgtgtcctggaactcgcttatatccgcgtgtgcccgtgcaggctggtatagagagtgcttggatctgttccaggagttcgtgcgggttcgttgcagtgatggtgatggtgttgggccgaacggtgtcacggtgacaagtgttctgcatgcttgcgcgcagctcaaggttgttgatttcgggattggtgttcaccgatttgctgcggagagtgggctggacatggacatggcagtatggaactcaataattgggttttatgccaaatgtgggaggttacaatatgcacgacagttgttggatggaatgactaggaaggattcaatcagttacagtgcaatgatcacagggtacatgaataacgggcatgttgaagagggaatgcagcttttccggcaagcaagtgctcggggcatcagcatgtggaattcagtgattgcgggcttagttcaaaatgggcgccagtcagatgttcttcggttgttgcaagaaatgattgcctctaaagtactacccaattcagccacactttcaatcgtcatgccttcagttccttctttctcaacactactgggagcaaagcaagctcatggttatgcgatcagaaatgactatgatcagagcatcagattggtcagtgcattgattgatgcgtatgcaaaggctggatttcttgatacagccaggaaggtgtttaaactgactgaacatagaagcacaattgtttggacatcaatcatatcggctgtcgcagctcatggagaagcagttgaagcattgagcctgttcaatcagatgattactgctggtgcgaagccagacactgtaactttcaccactgtgcttagtgcgtgtgcccattctggcaaggtagctgaagctcgtaaggtttttaactcaatgcaggctgtttttggtatctctccagtgattgagcagtatgcttgcatggtttctgcactcagtcgtgcagggatgctcaaggaagcagttaagctcgtcaacaagatgccttttgagccaaatgcaaaggtctggggtgcattgcttaatggagcagcagtagttggtgacgttgagttcgggcgttatgcatttgatcgcttgtttgtcattgaacctaagaatacgggtaattacattgttatggctaatttatactcaaatgctggcaaatgggaagaagctgaaaccataaggagcatgctgtggggagttggattggagaaggttcctgggtgtacttggaattgagggagaacaatcgcttgcaagttttattcctgtgtttgccttaaagccgaaagctacacacattgatttggttgttgaggggttaaatgggttgaatgatagaaaagatcttgacatcaacctaagagttggatgaagacaagttatgtcgatagcattcaatagagctaaaagttgaaatgtgattatcatgcctgaaagcacatcggcattttggaattatttggaccatcggattccatacgccattatgtggtcaattatattgatctgaccaattatcaaaccctaggatgacaaaggaaaatgagaactggaaacaataagagctttgctaccacaatcttcaaacctttcgaagtgtatgatcttgagctctaatttttaataaggccaacagttactacagcaacaggaaagtcaatgattacaaaaatgatgaaagcagttgcattctgatttgaattttcaggaagtgcctccacaagttaaatctcagtgtttgatgaaacaccaaaagagcagcatacaaaagttagttcagttcatcaaaagtagttgttctagcttcagtgtttttatctcatgaaaatcactactggatcatttctttagcccaccatgcttttttgcattttgaaactggaatctgtggttaatgggattgaacctgtgattttttttcaacatttttttctccgtccaaaccaaatccttgtctgctttgcatgcatgtgcccaatcctatcctgcattagaattacaactgcatagagctagcacaacaagatctgtcttttagtaccctcgtgcttgtggatcacggttcacatgcttggatcattctacctcttcacttcccaggtcatgaactccaaaaaggaaaagcacacaagcagctctccggactgtgcccaacttgctctgatcttactaccagaaagccacgactcttatttcgttctgtgccagcactcacatgctaaaacttcacaggctgaaggttgcagcgatctccacatgcactgaccgaccaaatgaagcaggggatagtattactagtggcaacattgatgtgaattccaatgtgagctccagctcatcctggagccttggagttttttgccgggtggagccttggagttcaagtgaagctaagtgagtataatcaccacgacgctcttataatacaataggtggtacaatctattcattcgcatttgaacgtatacaggtggagcgctccataattgggatcacatcatgcataggcgttgagcacttgagcctatgacagaggttgttactcatccanagagtcccaaggccagcaagacaaatcaggtggaactgtttcctctttaattttcttttggctttaccttcactgtttgtatctacattgttgcgcggttgtccatttctgtgccttgatctaatccagaatttcaaaatgttttgaatagtttcggtggtattatatatgttatatctctgtgcacgtgatacacctcccaagcctcccaggtcacggtaatgaccagcggtgggagacaaaataggccgtgtccttcagtcctttgtgcattggctgagcggtgagccggtgagcgtggcatgggctatgtcctatgtgtccctgcattcacttgctgaagaagcgtcatcatcatcgttcatcggcctgttgcaaaggctccactcttagatcaggaatgatagtcaccgttgcgtagtagggtcgtcgtaatgatgccgggcaaaaaaaaaaaaaagaaaagaaaagacctggaccagcagtagaagaagaatagtacagtagtgtacctagcagttactagttacatagcatttccagtggaatctggttggaaattcttggggcaggcaagttctttttattgttccgcttccatcgctttgatactttaactgcctgcttttttcaaagcataatttttgacccggaaagctctttgtgtagctatggtggtcgaagatcctgcggcctgcagtatcatcgctccagaatccgaagcctcagatgcctaggaaacactgtgcaccgtactgagcttatagcatgaaaaagccgcagctatctgtctactacgtaccactctactacctccagccaaattgttggtgtataatttcatagactgttaagctcgtgggcaaggaattgttgcgccaatagaatcagcaggagaatcaaaagtacactcgcagatcaccactcatccctcacatgatgttgggtgcagtgctaacttccaatctcaccaagcaccagcgaattcctcgacattcaacgtggcagatcagttcagctcagcctaaatattccttccgttccattttaaatatataaatatagttgtgaatttttattttaaatatataaatatagttgtgaattttcatgtctaacatttaactatctatcttagttgaaatatttttatgattaatatttttgttgttattagatagtattttatgtgtgacttgttacttttttaaaaaaatataattttttctaataagacgtacggtcaaatgttgaacgcgaaaactcacaaatgcatttaaaataggatggaggtagtagtttacactaatttccaccaaattctgtatatattgttttcagagttcaggctattatttttaacagccgcatgcaggagaggacagctcaaatgtcattgttaatacttttgtcctgtcgctaatctgatgggtaaccctactcaaatcatttcaaatgcagaagaacacccataggccgctcgtgactgaggcgccgcgacagggacactcgaggcgtttttgtctttgtactaccgcagtgtagccgtcctcctcttcttttttctctagaaaatacagaagtcggtggcttcccagaatttcagatgctgctaaaaaccacgaggaaaagaaaacccggcaagaggacaccaaggcctgagaagatggggcaaaacaacgagcgggttaaatgaacattgcagagcggcctttcacgtggccttctttctgccctccccttcgcttcgctccctcttacactgcagttatgcaacccccaaggtaatgaccccacatgtcccctgcgaccatctctttgttaattatactagtttagtagtatcattaccacgcttatctgtactttgcaagttaggttaggtttgagcttgtgtacagtatacaattgacaagtcttgttggcagttggctgatgcaaacttttcttaagctcctcaacacaatctctagcatgttacttctcccttctgctccagtgcatccatctcaagacctcataccatctctcttttgcaggaaactaatgtttgcgtgcagattatgtgactgtaaaaaaaaatcaagacaaatgcaagaagtgcggtcattgaagaatgtagggaggtgtaaaaaaaggaggtttctagggacaccagttatgcacctcacgggtggcggtcacggacagagccggttactgtggtcatcaaatcagtaggttcagtacacgtccccttaccgtgatgaggcgcctcacctcacgcctcagccatcagacatcagacggacgccttcggcttcaagcctccactcctactacctccctccaattcagcaaccgtctgcaccccaagcccaaaagcagaggcgcatgcagcggcagaagcagccacagccgtcacatatcgtacgcccatccctgaccccaaatcttggtcccttggatactactactaccaccagaaacgtcgacgagagaagggaagctaagctaggagaaatggctgccacagccatgcaatgcaggtttgctacaattttgcttcttgggttttttcttggatgccttcttctagctaggatcagttcttggattttctgttgatggatttatgggatcctaggatcggttccttgacatcatctgcatttgcgttgcgtctcattgattgcaggggaggtgagcgcagcgaggacggcggtggcggtggcatgaggacagtggagtgcctgagagggaggctgcttgcagagagggtagcatccaaggctgccaaggaggaggctgattcactcgccaaaagggtatcttctcttagccacattccctactgttacaacctccttgataggaagtgtgtgatactgttcttgagctttttttggtggttggttatgatttggtcgcagctggatgagctggagaagaagctctccgacgaggtcaagatcaggaacaaggcggagaggaggctcaggagggccataaagaagctggagtccctcaagattttggatgtggagctctcggacagctccatcgggtcactctcctccaatagctgctccggtcaccgcgcgccggagacggaggcggacgtgaacaatcctggctcctcggctggttcatgcactcaggtgaactcctcccaggaagggagctggtgctctgttgtgtccgagcaatcaccatctgttcattgcaaggaggaggaggagaatggcttggaccctgaagatgctaagaactgcggctctggggaggaggctggtgaccatgactcagagaggtaagcatgcggattaacaagaggtgttttattattggtcaaaagttaaataacctgcttaatgtttctaggattaccgtaatttcggtaggaactaaacaatctcgcataggtatttctgcattttaggtttctatgttgccttatgtctcgccagaactaggacataaattccctcctcctacgttttgtttttcggttcatggcggctagctccacaggcatatttcacgattattgttaggtattgaggaaacaacctgtaccctttgtgtctccacaagcagaatgattgtgtttaggatagcaaggagatggacggattgtcggtgttgtacgccacacaaattggaccaagcccacctgaaatttttcactttggtgaatgttagtaactcaactgtacgaagaactgactacgtgtagctgccaccaattatagcataaacatgtgcacaattgactccggtgttaaaaatagagcagttgcgcttgcttaaacggcaacttgatccttcaaatttgactattttttaattccttggaaaatgtcaaatgctaactttgtacttaacaatttaacaacctgtattactgatgcagaacacatggaacgctcccatgtagcagggatgatgaacctgttcatgtgccatccgacttcggctcatcaaaatcccaagataaccaacgcgacgaggacgacgacaggctagcgctggtgctggtagacccgcagccgaatgcagaaacaggcaacgaagacgatatgcgtatcgatatccaagcacggaaggctcaggccgagcccagagagggagacggcgaaatggaggaggcgaatgagctcgcgatcgtgctcgtggacccgcaacccgagcccaaggcggagcctgcggcgacggcgaggccgcgcaacgacgtgcagtccgtgctcctcgcgctgcggcaggtgaaggagcagctgcggtacacgatcgagaggaggtcggagctcgtcgcccaccaggagctttgcggccactgttgagagcgctgcacctcgtcagttttgagcagcggctcttgctagtatttgccacgatactactagagttcttgacagtgatagtgtagtagagtatttgtagagaaattggaataagattttgctcccgtggctgtgttacatacacgggagacaaactgagataattcagttgtgtacaatttgttctccatctgtcaatgttatatatgatggtctgatacgtctgttgaaaggaaagcatttcatggatttttactatccattgcaaatttccaggatatccatcggttggctctttagaagaaaaaggcggtttataggtaaaacttctgtatatatgtccataacgatttaaaagaaaaggctataaaataaactacaataaaaaagtttataaaatcaactctaaaattagttttaaaatttaaattttggcttaaaagcggttgaagaagcgaaacgatgggagccacaagcttttagtagggagatcgtggaccatgtatgcactaacgaaatgcatcatcagatattcacatgccccgctgccaagacattggcattgttgcgtatgtcattttgtaacacgaaggaagcatctaaaacttagaatacgataacgtcttaaaagctaactacaacaacataagttactactggtacatacctaaggagccatggtcattaaaagagggaggtaacaaaagtacagtattatcccaaaccaagcagcaagtcaagctacactgctagggaagtaccgtaagcaagtcaacacagtaaatagcactcaacatggctaggagaaaacatgatgccactgatgtcgttagtgttgtacaaactacggcttcaccccaaaagtaagggccatgtccgagatctgcaagaatggagtgatactttgcatgtcaagcaacaagcccttggcaatgggaaatattgtaggatgatagcagcaatatataacctcacaaaaggcagggagtgcttccattatgccgtgcctgccacagtggccgcgtcctgcgtcttgcaacacacatatgggtcggatacaaaaacacacaaaagaagcaaaagttacacacaataccatgataaacttaccggcttggagctgtctttgccattttcttgagatggtccactagatgtttctgcaaacctgggaaagtagtgaagagatgtcagctatagctgatagctaggttaagattctattagcaagaatgatatagcactgccacattcgtacctaagagctcgtgcctttcttttctcttcttcccccttgtcaacatttgtactctgaccaaatcgttctaaacgagcttttttcttagcgtcttcgtcagcagaagatgaggcaaggccaaatctgacaaagtgacaattcatccaactatgtatcagttcgccattacggggaataagaaaaatctacaatagcagagtgcaaatagtggtattaacacacctctcagccctggacttcctcttttgttcctccgccttttcatttgaagatccagtcccaaaccttgtaaacaagatgagagttagtaactgaaataagttgtttgggcaacatatctgatgcaaagctaggagaggcagaaaattagtttaacaaaggagacacttcatttagttccagtcaaatttaaatccagcaccaactagattgaaagcaggatttacttttttaaaccagtactaatacacatgattgaatgacagtctagtaaatgagctctgatatcaaccaaaggtaccattatttccatccgaataacatctaaagtagctgaattctctcaaaagcttttgatgaatcatgataaagcaaacagatggtttaattctaaaggaaaaaaaccatagcttttgtattcaaaacaccctcttcattaagagcaagaaatactatcataaaagaatagggtgtagttaacggccttttattggattcaatataagtctgtaaaaggaaccaagaaacttcttaaacatggtgtaaaatagtataaatcacagtaattaattaaaagcatgaatgccttaagagcattcagcattcatccgtacaacggcttaatttggatgtggcttgcctgtgccctctgtatgcttcaatctatgttcctcaagcaagtgtcaaccatcaaactttagtccatgccagagaatttttctcctctaatctgctccatctcagagaagatatcatggtggccagtgttggatttcatagtgattgaaagctagtcaataagggtagcctaagaaccttcctataagagaatgcacttttcttgtaagttaaaccatgatgcaagtttattgttttccttgttgtaactaactgcacttcatctaaacaatttgaactggaacatattttcacaagaatactattaacccaaaaacagatatttaattttcaaactgtggcagctagatttcagacatgcattgaacacaccattgggtaaaagctttgttaagcatctcccacctgtattcttagtgactgaatatagataaaataactatgttgccaatggttcatgggatttggtagttagtccaatgaaataaaggttgatagccaaaactcaaactgaatacccaaaactaggaccactactgtattacagaagcagtatgaaacaggacatttagtgctaaacgcctaaaccaataatatcctagacaaatgaactatggtttgcgctaggacctaggtgatgcagcgcatagagactaaattagcaagcaattgcataaacctcacaggatattgccaagggagaaacacgagcacccttctcttaagcagggaaaccttgttaaaagagactgaaaggaatacatcgtattcgcctttttaaaggctcctagccgtctggtagcaaacaacaaagtactattttctaccacgggaaaatctcctcaaaatccatgtataaatgatagagtaactaaaaactgcaacattggtgcacagttaaatcctgcatgcatcctatatattgttttctaacaatactaaacacatctgttcatggctcaatattaccaaggtctttttctgaatccatcatttcaaaagacgattaattatcccatattcaccctcaccatgaccacgaaatctccaggatctgttaggccaaaaaaaaaaatctaaaccctagaaaagaagggactggacagagcaatcacctctcggcgcggctgctgcgcttctcctcctcggacatcaccacggccgtcccgaaccgctcagcgcggcgcatcttcttctccagatccgtggccccgccagcggccgcccccgcggcagcggtagggttttgggctggcgtggcggccgacgcggggttcggagccggcggcgcctcccccgctgctgcggtggccgccggcggggacggctcggcggcggcctgcgcgggcttggtgctctgcgacgccatcgaggggggagctctcgtcggggggagagactagagagagaggtagagaggtcgcaccgtcgcagactcgcagtgggcggagtgcggccgagagtcgcctggtttctttctccttttccgcgattttttttctgtgttttttgctttgtccgcttgcgttcccccgtttcgacacctgcacttcgcatatgtgctaccaaatgggcccttgggccattgtagatgggccataatgctccttatataggagaaattgcatttttggaattttttattttaattttttaatatttagtagaaaataaattcgtattttaaaattttgcagaaatatattcctccgacgatattgtaggacatggcatgtaaattgccctatgagatggcaatttatttgacgtgacacaccacgagagatgcgtcgtgccaagtttttaggtggcctcctctgtgataaaccgctctcccctaggacgatttatcaaaattgtcatggcacgacccatgcatcatcaaactttgcgtcgtggcaattttgcagccacccccacaataaattgccctatgggagatgttacatagggagataaatcatcgggaggggggcacctacaaaattgtcgtgttacatagattgctctatgcccctccctaaggtagagcgggaggagatttttgcaaaactttgaaattgtaattgtattttttattcttttaaaaaataaatatatttttttcttaaaaaatcacaacactgttgttgtgagataaggcataaaacctggtagcacaagcatgctatctaaatcgtatggtatatggatatgctgggaaaatatgtggtggaaatcacatatgtacttatgtagggcctgttcggccgcttggtacagccgctgcgctgccacagccgaaagaaacaacacactgtgctagttggctgcagcacagtgaaaataatggcagtcgaacatagccgtagtggaaactcggaaactaccgatggattgaaaaatggacatccgagattcgtccatgtcatcacgagtaaaaatgttgctcacggatatattgcgagatttttactcgtaatgatgtggacgaatctcacaagtcaatttttccatccaatggttgtttccaaatttccactacatatgtggtttccaccacatattttcccggatatgctacctagtttttaataagatggcatcgttaatttttaacgcatgtttaactgtttatcttatttcttaaaaatatgtaattattatttattctgttgtgagttgttttattactaaaaatattaacaatgatgatttatctcttatgtatttgtataatttttttactggaggaattctatccttactcatttttttatataattgcctggcgaaattttcgtttataattagatcgcataaaacactactcactatgtcccaaattataaagcctatattttttacatggtctttaataacatattttaaccaatattttattctattatatgatcccaacaaatataaaattagcatcacatgaaagtacttcacaataaatctagtaatataacgtacataatacttaaatctagtgatataatatatataatacttagtatagatatagttagtatgattattagtcaaaatattccgaatttgattctcttaaaaaaaaagagcgtcctataattttggacggacggagtataacgctatcagtgactaagctactcaagatgacataatcagttatgtcacaggagaccaccaaacaaaagctatagaaattagaaaagggccaaaaggcaggttacattcttcagccacaaaacctaccacttaaaacataaagatgacccaatcagttgtgtcaccctgccattacgcatctcaacacaccattagtccagtcaatgattggagctaatgaacttggtttgccaagtgccctcgccgccacggacacagacgtttccaaaccatttgtccaaacaactgcgacccaataacacaatgtgttaactaatcaactcgtctcccatctcctgcaagtataaaaatactcacccagatcaaccacgaatcactcagcatatcacattcacaggccacataattggatcactcctccctctcccagctcatcgccatggccgcagctgcagcaccgcgtaggtaagccatcatttgattagtagtagtgctgtgaaccaactactgattagctacggaaaatggcaaagtttttaccctaatgacgatctctgtgattaattacggcttcgcgtgtgatgcagctccgggaaagaagcgcttcccgctgcgctcggctccgcctctgagccccctcgcctcttcgacggcaccaccaggtgaggttaacttacgtgacagataattaattaccatgcctctaaatccctttttttttcttttaacttctgcgtcgaagtaaatcttcttttgtgactcttgtgaaggctttacatttgctacttctgcccgtttgctcagcgcgcttggattatcaggaacttcaaggtgtttgtttctgaacttctctgacctttggctgcagagtttcatactccttttactcctcctgctaaaaacctgaattttttttgtacttttttttggctgtcaatttggccagggcttgcaggacaagatcgagctagtcggcattgatctgcaggacaaaccagcttggtacaaagagaaggtttacgaacagggcacggtacagtacacctgttcttccttcctgcatgtcatctgaatctcttcatgtataatttttgtcgatgaacaattgagtagtatggatgttgttgtctttctcgataggtgccttctctagagcacaacggcaagatcatgggggagagtttagatttgatcaagtacatcgacagccatttcgaaggccctgcactgctccctgaagtaaggcagagaaattcagtgtaacacgtgacagtgatgcagtttttttagggagtgacaatgatgcagttttctttttttgggagtgacaatgatgcagtttttttttctctgagacgtggtttacagcttataataatgtttggatctggaaaatgacaggatcctgagaagagacagtttgctgatgagcttattgcgtatgccaatgcgtttaccaaagcactctactcacccttaatctccaaagcagatttgtcagctgagacgggtaagagctactccctccgttccacaatataagtcattctaacatttctcatattcatattgatgctaatgaatctaaacatatatatctatctaaattcattagcatcaatatgaatatggaaaatactagaatgacttatactgtggaacggaggaagtagttgtgtcaatctagcattgcagcatctatgccatgtttgtagataaggagatttgcagttttaattcatttgcatgctgttcgagaaaattcatttgcatacatgctgatttactgaaattatgtatcatcatcagttgctgctctggacaagatagaagctgccctgtcgaagttcggtgatggtccattcttccttggacaatttagcttggtatgtcgattcggtttgttacaatgtggttcattttcctttccaatgtttaggatgtgtcgaaggtaagggttgggaacttctttcccgcgtacataaaacggagtaattcattagcgcataagtaattaagtactccctccggttctataattcttcatgttttagacaactatacggtctccaaatatatctttcactatgttttttattataatatgtaaattaaataaataaaattttacttttattatagtactttgtaggtaaatctattgctctagtgactttaactaaatatctttaaagttattgatagtcaaaggtatataaaacattgttcaaaatgtcaagagtaataaaatcggagagagtattagctaaaaatacttgaaaaatgaatcaatatgatttttgattttttaagtaactttcgacatattttttttaagaaaaaacaatgcatcctttagtggctcggaaggtgtgcggaaaaaaaaacagagagtagaagttgaaactcctacggagcacacccttaatttctcctaaaaaacttgtggccattcttcgatttccaggtggacattgcgtatgtgacaattattgaaaggattcagatatactactctcatataaggaaatacgagatcaccaatggccggcccaacctcgagaaattcatcgaggaaatcaacagaatcgaagcatatacacaaacaaaaaatgacccgctttacttgctcgatcttgcgaagacgcatcttaaggcaagaccacttcctgaaacaaatgctcagcctccgcaactttgatctgccagttttatagtcacttgacaattgcacttctttaatttccaggttgcctgaagatgttgagccagcgatgtactgaatgacagaatgatgatgatccatgccccccccccccccccccacacacacacacaaaaaatcaatactcttttcttgctactccagttgatagtacatgttttgcagcttttgcttccaataaaccgaagttgacatgtggtgtaaaagtcatgtttgagtaataaaatactggtgtaattctatgttactcaatgtcgttggtcttaaatatactttcatgtcattgaaaataatcttttgttgtcaaacttatttactagtatttattatccctacagtttcatattaataagacgttttgacttattataagcagacctctaacttaacaaagtttgtagaatagggtagtaatatttttaacacaaaacaaatataatactatgtaaatgttagatttaacgaaactaatttaatgttgtagatagtgttatgttttttttcctataaatatagtcaaacctaagaaagtttgtctgattaaaaagttaaaacatattataatataaacagagaaatatgttttttaaaagggaaataaggtttttgaattgttgagtcacatcataagtcctttcaaagcaccattagtgtgagtgtttcggtgaaatcattggtatatatgaccatacatacgatgattctggtgcctataatattacatagacttggtcttatttttttatgaagccatttggcacacttgaatgatatgaaaacataacacccttcactagaacgtttagcaacaagttaggagtttgtgctattaatagaatgtttcgtgacgttatctttccttttaacggaaaatagcacaaaagtgccttttcatttaatagagtagaagaaaatacaacctctagggtaaagcgaaaaagagagaggtcaccgtaagctatacactatacaagttgcgggacgaactcgtgcaatcttttagcccctgctaaagcccaaaggctagcctcttctttgatttttgttaggagaaagcttgttgccacctctttgtggtcgaaaatccgtcgatttctcaccttccagatttcccagacgactaacaagatgagggatcgaagacccttttttaggacgttgagcgtatttgctaggctctcccaccattgatggactgaccgagcttcctcccactgagccggcaccaattgttgatatcccacccatctagcaacgaggtgtcagattatctttgtatatcctcacatggtgacgagatgcaaggccgtctcggctttacaacgacagagagggcaatggctgttgttttgtcaactcctttcgcaagccggtcagacgtccaaactctattctggatgatgagctatgcatggaatttgcatttccccggcgcccagattttctagaacaaggagttgagacttgtgtttggcgcccgcaagcactgtgcatggtaggccgaggaggatgtgtagtgcctattacttatgaatttccaaacaatctggtccggttcttcgttgtttaagttcacattccgaaccgcttcccactagcggactaactggtcaacaaggttgattgtgaaatatgagtctgcatcgagggtcaggtcatgcacccaggtgtcgtcttcttttacttggcgtagggactttcctttgttcttggagatcgcatagacaagaggcatgaggacttttggtttgcacccatcaatccatgcagaacgcttgatgttatggtacgtcttttaagtgtgtcaaagggagcagcttttcgtgtgtgtgtacgtaggggtaaaaacggtcgaaatcggtagcatctcttcaggaacaacggtcgatcagccggtaattgatcatatttatcatttaaactactcagtgtcgatattaatacgatgcagaaagatattagaaaaaacaaaattttaaaatagcaataaacggtatggtcgaaaatggtaccctttatacaaaaacggcgtttggaatttccgtaaccattttcacccctatatgcatgtatgatgcgcacacgaactcaaactaggatcgaaataaaacatactacttcgtccgtcctaaaatataaggaattttaggtggctatgaaacatcctatcacaataaatctggaaggcttatgtctaaattcattgtaataggatgcgtcaccttcatcgaaaatttcttatattttgaaatggaggtattaatagttaggtgggtctcaacaggcctatctagaacaattccctatgtagtgagccaaggaggtaggatagttccctccgtaatggatcgaggatgtccgtctccttaacccacttcaaaacgaacatattgtggttttgtataatttgggccgaggaaaacccgaaaacatctccctcggtcccaccccaacaaaccaccggtttccttctggagaaatcccggaagaaagcacaggaacacgggaggatgtgcgtgcacccacaccacgttctcgtccaggtgctgagcggcttgacgaacctgaccttccgcgcccgaatcagctgctgacgtatcgcctccgccattaccacctcacactctctctccccatgaattcgctcgctttccctcgcggccgatgctccccgtcaccactgacgcgcccctccacctcccgtagttcttccgtcccatcgtcgcgcacaataaagattcgcccgagctcgcgaagcgtcgcccggtgcaacctccgcgacgccaagaatctctccccgtcccgcaccgtcgccatggctgccgcggccgccgcaccggcaaggtgagcacgcgtgccggctgcggcgaggctgaggagaagaataaaccgcttgttgcggttcttgattaaaatctgaatttctttgcttctcttactcatgtgcagctctgagaaggaagtgctccccccttccctgacctcctcatcggagccccctcccctcttcgatggaaccaccaggtagggtttatgcagacaaaaaaaaaagtttaaaaaagaaaaaaaacgaaaggaattgcagttatctgaacttttctggtttctgcaatctgcatagattaggggtaatttgatttgtttgccttgcgcaggttgtacgttgcgtaccactgcccttacgcgcagcgcgcgtggattgccaggaactacaaggtattacatgctgttctttgatttgcggactcggttcgtagttttgggagattggatcacataccctccatttagatcgggaattgaagacttctctagttttgtggtggtgtttctccgataaaattggatcttttttgtttgtcttttcgtttccagggtttgcaggataagatcaagattgtcgcgattgatcttgcagacaggcctgcttggtacaaggagaaggtttacccagagaacaaggtatagagtatccctggtgttgagttgtgatccaaatttatttgcacttaataaaagcgagcttcagccgacggatcgtcatctttttagggttccaccatatatatacctcttgtaagccgccgtgcggcgatgtaatctcaccccagatataatgaagatattttgctggctagcgcccgtggttttttctgtccggttttggaagggttttccacgttaaatctcgtgtcttatatgattgatctattattatttatcgtttgttcgcctatcgtttcctaacaccttgttactgtcaagtctcaactctgctccaataaaaaagaaaaatcctttacagcttaatttgctataggtgtgcacttacttttttttgccgggtctgtgtatgcacttttactttttgataggtaccttcacttgagcacaacaatcaggtgaaaggagaaagcttggatttggtcaagtacattgacaccaatttcgaagggccagcattactccctgatgtaagacgatatgttcaactttcactggtgtaatgcttgcaaaaagagaagtaatttataatgtgttagcctttgaatgtgtaatttgacaggattctgagaagcagcagttcgctgaggagcttcttgcgtacactgatgcgttcaacaaagcatcgtactcatccatagtcgccaagggagatgtgtgcgatgaggctggtgagagcactcgtgtactactacttgattactcatttgaacgattttttatgcataaattctgcagtttgtatccacgtgctaatctgctaatataatactcttcgtcagttgctgctcttgacaaaatagaagctgctctgtcaaagttcaacgatggcccattcttccttggccagttcagcttggtacgccactatagtctgggaatgtttttccctggattatcatttaaaattatttttgaaagctttttgtttttgctgaaaaaaatgtgcttgatactccttatttctttccaggtggacattgcgtatgttccatttattgaaaggtttcagatattcttttctggtataaagaactacgatatcaccaagggccgacccaaccttcagaaattcatcgaggtaattcagaatgatggtacatgagaatgtgagattgcgccatatgttagttggttgggattatgtttaccctatttttattgacgttgtttcgaatactagttcctgtggccaaagatcacatggtgtagttcaaatcaatgttcttgttagaaaaaacttcgctgaggagaaactaactcaaattgatatgttacaggaagtgaacaagattcatgcctatacagaaaccaaacaggacccacagtttttgcttgaacacacaaagaagcgtcttggggtaagatatatttacaattgttcttatgatctccttccgccgacccggcaaaattgttcttatgatccatttcatctgccgacatactacatttatacattttttgcacattttaacttccagattgcctgaagatgtgaccaaggatgaacccacaacaacctgcgatggagacagggagctggtgcagtatatagtagataaagactagtgtgcttcattttagcatatggtttatcttgaataagataatgcatgtcatgcagaccatgcttatggaacaaactattatgtatttttggtttggctgtgtacagctgttaatgtgaatttcccgtcatataattaattacaagcttcgcggggcgttgtctaataaatcaatgcttcttgtatcattattactagttgtcaggatgattttcatagtgaagtacttctgcaaatatgctaagcagaagtcaaccggacgttctaatgatgggtgaggaaacttggtgataagcacgtatcataaattcacaatcctccagaatggatcgttgagaaacgtctcctgcgagaaagcgcagtgaactgcgtatgaaaaagagtaaaacagagttcgttttttgtttctccgaagccccgaatggattgaatcgttactgcttttgccaacgaaatgaaggccgatcctgaagccctctccctctgtccttttccactttgctaatcttcctcgtagaagcatgattatgcagattattgcattggcgtaagtgtgaggacatgccatggttgatcagttacagttagtggttcaaccatggcctattggttcagagctgcaggtgttactaacttaccagtattaggcgattcaaaagcattcaagtagtataaaaccggcggagtaatttatttgtgttcagtttacagcggcaactgcaaatattactcatgctcttgttagtactaccttgtaatcctttgcttaatactccactactacatgaatacctttgtatacatgttaagatcactgagttggctgagcacgagtagtcaaccaaactcgagaaatgaacacaaatgccagtgtccatttcatgtggccttgaaaaactaatcactcttttgacagtcatcaccatacaagaagtctacgatgtactccctccatcccataatatagcaacctagtttcagacgagacacttcataatacaacgaatccggacatgtttactattcagattccttgtaccatgaagtgtcccatctgattctaaattattatattatgggacggagggagtagcaaaaattggttagatgtctataccacgcatgatgattttagttgccttgtattctcttaaaatacttgtatctccctgctctctcttttttggcacctctctgtgacaccctttaaatgctgaaactttgtatgttgaaactttgtatctctcttcttctataaacgaaatggcagagctcctgcccgttcctaaaaaaaattgaccgctctggcacatcctgtgtattcttctccagctcgtgaagaaccgtgtgcaagatgccgactaatcaccgctttgtaacgtgacacgttccaggagcgacatggcaccagccatcaccactcgctcctcttttgcttcggccgtcaccgctgacgcctcaagttttcttctcgttttacctttcaacgcccgtcttactcctgtactctcgtttaccagagcacggtgtgacagatgcagcggtttcacctacaaaaagtgctcatttttgcaagttgtgtacggcaatcgcaatggcaatggcagcagcagtagcagcaagtaggtgcgatgcagtttctactctctttttttttcaaagaaaagtttcttaggacaagttttataaaagaggtggatgttgcatctaatgttgaccacatcatcagctaataaatgtagaggtaacatgtacaatatatcacatatatactaattctaatacactagccccaatgtttgtttgcccaatctactcttcacctctctccttttgtcttgaattttgtgtagtggttgcctcttgcatgagaggtggctgctttatctctctcatctcttctctcctccacctcactattttagcttatgtggcatctaggagattatgcttggatgccatagtacttgccctaaggcagcgttcgagagggtgagagagtgagtttgtttgtttcgttttccgcacgcacgtttcccaaactactaaacggtgcgttttttgcaaaaaatttctatagggttgctttaaaaaaatcatattaatccatttttgaaatttaaaatagttaatactcaattaatcatgagctaatagctcacctcgttttgcgtatcttcccaatctcctcaatccccttcttctcaaacacacccttactctattgcaacgaataatacgtactatatctgaatcacataattgcacggtatgatttatcgtctctgttggatttaggcttgcaatggaagttctcccgcctactatgccatctgcttctaagcagccacctctctacgatggcgaaaccaggttgatcaatcattactgtttatctgaaattaccttctccctttcaaatctttcagaaaatatgctatctgtaacgtccacaatcaccttgatctgcatttgtcaaatcatctcgaccttgctaatgtataaaaagttgcaatggcagattgtacatgtcaacatttgcccatatgcgcaacgggcatggatcgcaaggaactacaaggtactacaaaaccaagctggtcttctgaacaagcttgattcacttgtcttctttagcaaattgtacgtcggtggttttgaattttgattgttttgggcatcagggtttgcaggagaagatcaaattagtccccatggacacgaatgataggccagcatggtacaaggaggtgtaccccaagaatacggtgtggctagtcttaaatattatatgaaaatgtagataatacttgttttcttaatgcttgatacttgtcatgacagctgccatccctggagcacaacaacaaaatcattggagagagtttggatttgatcaagtacatagacatcaactttgcaggccccagattgactcctgatgtaagcctatcaaactgcttaactccaaatctgtaataacaagccctgacaggattgatacctctactggtgacattaggattctgaaaagcaaaggcttgcagaagaactcctggcttattcagatatcttcaatcaggctgtgcgttccgctctgatctccaaggatgctatgacagcagaagctggcaagaactgaaaacactaaccataattcacttgtaattttgacatttttttctctttcaaatatgagactgacttacgaagcatccctgatcatcagctgctgccctagacaacatagaattctccctatcaaaatttgatgatggcccattcttccttggccaatttagtctggtaatttgcataaatgatttgaaaacctcacccactggttattgctggttaaacatggtattgatgtttttctttatcttttggacaggttgacattgcgtatgcaccttttattgatggatttcagacactgtttgctggcataaagaactatgatattactgaaggaagggctaacatacagattttcattaaggtaacagacagcaagagaacaaaaaagaagaccaaagatagagcatatgaatgatgattttgatgatttacttgtgacacggaaaataatgcttaacaggaattgaacaagatcgatgcgtatatgcacaccaagcaggatcctagcgaagtgattgctctcacaaagaagaagctcggggtaaggacgtaaggttgaccagcaaccaagaaatgcttattacaatatctgcaaattactcaaacttgacgttattttccctgcagatatgacgatattcacatcgatcaactggtgaaggatgcacgcataggataggaccaacctgctatgagcacaataaaatgtcactacgtagtgcagttagcaaggacgtgtaggactatctcgtcaggcagatgtgcacatttgtgatttaagacaaaatggcattttgatcaggggcggattcaccgttggggcttgagcctcagctccatctcggcagaaccccctgccctgcatgcagagcagcagccgcatggcttcgggagagaagcagcgtattgcataagtgcagatcaaccaggtcgcaaggaaggagcaaacgaagacaacatttcgcgatccatgggtgattaagtggactaattggctgctggaccttccttattaagctactgtattagtttttgctttcttttctgcctacttcaatggatggaacgatcaggggattagtgaagtgagtggtttttactcacaaagtaatccaacaattatcaacaattgtgttattgaatttgtggttgtgcctttgtcgtattgtctttcataatgggaaagcgttttcattcctcgaggggatatcccatcattttatgcatgtcatctaaataatcatcaaaaaattgaaaaaaatgattaatatgaaatatatcactccacaaacatgcaagttaaatttcaacttctacaagttgcgaaaaaaatatataattgtgaatatacgataactattttcaatttaatttgttatttttgttgtaacttgtagaagttatatatttacggagtaatatatctcatatcaatccatgttgtcatttttttcaaattaattagaactatttagatgacatgcaagcttccatcatacttcctaaaactcattagaaaggagcaccccctatatttttgttctagattcgccactgattttgatggtgtaatgatgtataagttcataacaaacaattccatcatatcgctcaaccatataggactactccatcagtcctaaaatatactacctccgtcccataataagttaatctagtatgagatatgatatatcctagtatatgaatgttcatattcatactactaaaatatgtcatatgttgtactagattaacttattctgggatgaagggagtagatatttctagcgttcaaattttgtcccaaaatatagctacttagagcaccaagagatgtttatagtgaattagtgataaaatgtctaaaatacccctatgttcacaaccccaacctcccaccaaccaggataattaacgaaggtaacccagtcttccttaatctctataagaagtagctatattttggacggagagagtacttctatattgcatcatactatggattaaagtgcctgataaatatcagctaacacttaatggaactaaaaggagactatttgtggttaatggaaaattttacaacatatttcatcccagcaacaagccaggcgtttcaggcaggcattttgaatgcatgatatgcgccaccataagcatcccaacaatggaaaagaaatgtgcaattttgaacatttattacggataattccttctgatgtttctgttgtaaactgggggcaacagcaacttccagtttacacatgaaattagagaaatgaagtagcacaactaaaagcacaaacaaaataacataaaagcgactgacagtagagtgcaaacgtacaaagtcaaactttctaccacatttgcagataggagttcagatccaaaggctgagagggttcattttggagctgattgccataagcacgataaaaatggacgggctattgaagaacacgcatgctcacagggttgttcaggcagaaaccccggttcttagtaatgaaagcattggcggcatcagtccttgagcggaatttaaccagcaccactctgataggatctgggacaccaggtctgtgcagtagacatgggtggaatcaaacaaggatgaatggaacaaatttaaatgctacttcctccgtttcatattataatactttctaacattgcccacattcatatagatgttaatgaatttatgaatgtggacaatgctaaaaagtcttataatatgaaacggagggagtagcaaacaaggatgtctgtccaaatgcttacctgagaaagctttcaaatggcggaggttcaacattggtgccacacaggaatcgttctatgtcctctggtacagcatttcgagggactccttgcaatagtatctgcatgggcgcagacacagattacaattatttccagataaattattatatccataattgcatatgaattgtaactataagataatgaatagctggtaaatggggggaaataagataaagatatgtcctcccgatttttgacacccactcaatagtattccctcagtccctctatccaaaagtgttaggcatatactccctccgttttttaatagatgatgccgttgactttttctcacatgtttgaccattcgccttattcaaaaattttatgcaaatgtataagatataaatcacacttaaaatactatgagtaataaaacaactcataacaaaataaattataattacgtaaattttttgaataagacgaatggtcaaacatgtgagaaaaagtcaacggcgtcatctattaaaaaacggagatagtatcagtttttgctttattcaaaagagatggtcatatttgtagtcgccttgtgctaaattaattgttgataagaacccaagcagccatcttaaatacttattggttgcatgcatgcatatagttccatggttttgttatatgaggggaaaagggggggggagttaattcctcctttgtcttggtgacaaaagaaatactcctatgtcttacattttttgatggagggagtagttaggaagaacagagataaaactacacttgcttgccaaaacacaatatattcaagttttactggcctgcccagaggacaaggcaaaacaacaacttacagcttttccatcataagactgcttcagatcaaactcctcacgactgatctgtaacatcatagtataaaaatatattggtgttttgccataagcccataaccaaatgatagaagtgacaaaaacaagcttagcctaaccatctcaagcctgtactgacgaccttctcgtgtttgcctgactgctgtgttaaataatggcactgaagaaaacctcaacaacctgatcaagtgaaaaaaagtttcaggtcaatagtcacatcgcaagtgggcagaagaaaatcacttactcatatgttcaacggtaaatctatgctcttgtcactgtaacaatcacagtgcagttaatgagagtgcattccatacatttatttttcaacagcattaagggaaagatttttatgggaagagatcagctattcatttttaaaaagcctgcctagcaaaatggagaatatgaactaatgacgaaaaagtcaagaagtaactatatttcctgcgtatcaagcacccaagaaaaagtgaaatgtgttggcagcctgatacatagtgtactggccaacaaaacatgagcattcactttagactttagtactttatgaatagacaatgacaaagggtaatctggactgaagcttaccaaatacaaataaggcctcaagaaagacttcaaaagtagggatgggcacgggttactctgtgcctctgtgggtacccgttgacccactctaattcaacaaatcaactaaaatgcactttttattgttttgtgtatttagttcatttggttgaaataaaagtggctgttggttacccacgttgtgcactgcacctatgtttatcattatcgaaaaaaatatgttgacacttcaattacaatcctaatttctaacaggctaaaaacatagctgctctagttgattggaacctcctagcatcacagaatataataggaatattatgatattactcagcaatataaactgcttatgcatattcagtccaaaatcaagtgaaaaaggtacataaataaatggatatatgtagtatttgacacaaaacaaggaaagatgggaaataggaaaggaaccgtacgcgcccactggataatatcccctgttataatcaatcttcacatcgtccagtgacagttcagatttatcaaggtggtggataatatcagttttgagcatgctcttagggagacggctgcctccaggaataacactgtagaaccttccatatgccacacctgtttccacagaacattatttctgatatatacgatgtgatactgtaaagccaaatgtaaaaaatgaagtttccagagttacaagacaatgtaagttgcggttatatgcacttgttaatataatgggaaaaaaaaccgtattgcaatatgatagtgcaaaagtacaacttttagaagctgtggttcgcatttccaaacgtttgacactcgtcatgtgagatattcgcaccaatatggaataaaaagaatgtaatttctcattagtgcaacatcagagtgaggtattttactgtatctaatccatcaatctacattcctgaccccaaatcctaagcggctaaagacattataaacatttaaacctcaaacccctaattacagatcaccacagggaaaaaaaaagcaatcggctccgcaaggatgggagacctaccttcgtcagaaggcttgaagaaaggctcgtcctgcgacccctgggcggcggcgcccgccgcgggggtttctccggacgcctcggtggagaagaggcgaggcgcgaacggagcaagcacggacgagcgcgaggaggacgaggggatcccagatgcggcggtggccctccggagcgcggctgccgcgagcctcgtcatgcctaccggctactgctcgtcggcttcggcggcggcggcggcggaggaggagaggaacgacggagcttggagcctttgggggacacacgaccgacggagcaacacgacgcgaatggacccctgatgggcttctgatcggtggctggcagcgaactagcaaattataaatgggcctaaatgggctaggcccattatgtacatgggccttcttgggctgtctagagttattgggctatactatccttgagacacggcccatcagcccatgtagtagtatttgcgtttaatcgatataagaaatacgttttcgtagaagagaacacgggaaatattaggttacgcctttcgcacgtggctctggtttgtcaagcatcgggttcgcgcaagaaggaaccagtcctttctctttctctctctccatcgggtggacgacgagacgacgacggcggcgaaggaggaggaggaggaggagaagagcgaggaaacccgtctgcgcggccacgcgacgctagggggccgagagcctgcagcggtcgccgcggctggagcatgaggtggccgcggcccatctcgcctggccgccggctcctcccggtcgtcgtgctgttcgtcgccctctgctcgatccctggtgagatctgagctctcgcctcacctaaggcgggtctgtttaccatttttttatgttgctaatttgatcgcgcggacaacttgaccgtattaatcgcatgtgttttttctattgcttcgatgggaagtgctagcaatttttttaagtttgtgtaattgcaatggatttgtagatggccagaaaattggctgcaaggtaaggtattggatgtgattggcctctcaagttcaatcggcgttgccggaagggaaagtagaaatgatgatttatggagccctgtgtgcaaagcaattgaatttaatcagattggtcatagcaccgcattgattttaatagcaaataggatcagcaatttgaatagcatataaggtatgtttggaaaggaaaacttagccagagtagtacacattcctgattaaatatttccaaaaaaaaaggagatatggacaagagggaaggtctttagttatatgcctgtgatgcagacatctctctcctggtccgagttgaatcaagcaatgccgaactctggacagtctgttttatggcgtatttattggttcagctgaaggaattttttttctcagacttcataaggtagtttaagtgttgggatgttctttgacaaataatagcggaggacagattgtctttcctactcttgttcctgccatattgtcctaataaaggatgggcaaattttggatccctcacctaatattattacacggaaaatgatttgtgtactaatttctagggtcacgtgagaggaacccgattcccgatttgaggagtagggcataacactataaattgatttctgcatatataatatgctgcatttcacaagttatattcaaacagacttgctgtgatgagtccaggggactcaaccagcgatgctaggtaaatgtttagttaaaatgtaacgatatggcctatttctctagaacctagataatgatcggtactgtgtttatcctgctttgttgttttcttaaaataaggctggctactgcctatgttccaaaacagaaccgtgctctccctctgtaaaacattgtctggtttggttattagagcaatagattgaatgctccgcacctcaagtcattgatgattttatcaattccagttagtaaattatatattgcatgcccatgttttatgtcattgacggatagcctcaaagaaagaaaagccaaccgatacttctcctttgttaaaatagatcccagtgtgacacgagtttgaaatacgttattctttttgtggggttggggactatatggaaggtaaactggtaaagtgcccatttcaaagccgtaaaggcttaataatccttaatgtctcttatctctgacgagatggagatgggtaaaactgaaagtcatggatatttatagtagtatcatttttaactgctattttttgcgttgtcttttctgatacttggagagggtagctgaactccatagatgccttctattacactcactagctctttgttcatcactgatgatgcttaattttgtagggattttttctcagaggctcgtcacacttgacagcattgatatatttactactcatgagtggttcccgagtaagccaactgtgtatttcctttgcaatggtgaggacaaggtgtatttgcctgacgtgaaggatgcaaacaatatatacacctttaagggcgaagaatcatggcaggttagtcaaccaaaagggctgcttcctctcatgtctcatgcgcatcacaactatacttttctgttttcatttcttagtttccttttggcagcccttaacagaacttccagaaaagaaatgcaagaggtgtggtttgtacgaagaggatacatttaaacatgatttgtatgatgaatgggagctgtgttctagtgatttcaaaaaaggaaaatacacccatttcaaggagggccagttcaatgctactttcctatgcccaaattgcactgcctctgcgggtacggctcatatccaatgcctatgttttagtttgctaagatatttttcattcataaactcattgagctggctagatccacagttgcttttctgtcatatgcccttttgattttaatttcctctatagaattgattaatcataaaatactagtaatgatcttggtggtttgagttcatcataaacattgcttaagatacctttttccctaccaggtgattctgcaaaccatgattctagctcagaagtggaaactaaaaagtcatccgttactgtaatcataatagtcagtgttctttcttctgtccttgttatcattgcattatttgggggctacaagtactggctgaagaagaagagggagcgggatcagttacgattcctcaaactcttcgaagagggagacgacattgaagacgaactgggccttggcaatgaactctgaacagcacatatagttaggttcctgaagctctgtggagagggaggtgacactgaagatgagctgcccctggcaaggaactctttccaaaacatcacgtacagtctgacctgggaccttttcagatggattctccatgtcatgtataaatggacagctttagcttagaaatttttgttatgtagtgatacaccatagtttctgaatgaatgattgacaaaaaaatgttcttcaattcatagaagttttccccagatacaatgtgcatcatttggaaaccttctactggtctacatcaaatttcactagagttaacttcggtttagctacaaatatcactgcacatggaagaggcgcattgcatattctagtcttcgtcatatgcttctctctcccccttgtcagacagatttccaagcttgtccaagtagccaccgttgacaagctgaccaaagacattcttcagcactgccggttccaatgccgggtcaaaaatctcaaaccccgggatgccgtcagcggcatgtcgcttgaccatgagcgcgaacctgacggccgcgccatcttgcctgatgtgtgggatggtgtgctcgtcgagatcatcgtactcctccggctggtagagccggtggcagcggccgggccccgagaatccggcgatcgccgcccgcgcggccgccgcctcctttgagatcctcaccggcggctgttccgacaccaggccggtgtcgacgacgtacgtgatcccgtggaccagcacggccgtctcggccacgtcggtggccagcacgactctcctccggccgtcgggcaccggcgagtttatcagcatgatgtcgatgagctccgccgggaggttgtcgtggacgtagcgaacggccagccctggcactggcaggccgagcagcctcgcgtggacgccgatgatgtcggcgttctccggcaggaacgcaagcacgtcgccgggcggctgcgacgcgtggatggccgccacctcgtcggccaccgcggccgccatgtcgagcacgggccctcgcgagtaccgcacctcgacctggtgcgccgcgcgcgggatcgagacgaccggcgcgccgccgaagaaggcggagagcatgccgtcggccggcccgccggcggtgcagaccaccaccttgcatcggccgcccatcgtcgtccccgtcgccagcgcggccttgaccatcccgaggaggacgtcggtgccgagcgtgcggtcgtgcgcctcgtcgatgacgacggcgccgtacccggcgaggaccggcgccggggagctgaacctgtcgaggagctgccgggttgtcgtgaactcgatgtccgaatcccactcctcgccgaccttcgccatggccacgaacgcggccaggtggcggggctgcgcgcagagcaccgggccgtatccgctctcggcgaggcaccgggggagcaccgacgacttgccggagccaggcgcggcggagacgacgacgacacggtggtcttcgaggtactcaaggatcgccggcatctggtggtagattgccggaggccacgactcagcctcgtgctcttggttagagccggccatgactgaaaaaattgcgggaagcgacgagacgtggaaggaaaccgtgacgcgcgcacaggaaccgttgaaaacgcgagtcaatttattgaaaatcacactagattgtaccagtcagagttataaataagattatactgttaagacttggcggggtccattataatatcaaagtcttatacggaatcaatactcatatacgaaagttatttgcgataagaaaataaaaacagattcctactcgaacactacaaatattactcgaatcatacctctctagttatatttgaacaaggagacatctgacgatataaatagaagactcctcaagaggagtggggaatgatacacgaagacatgcctagatggaatgatagatctagacaagccagtacagatcaagacaaaaccaataacacattgacataagcctagacaaataccatatgaagccacaaagaccgataaaagggatttagcgcgacctccaatcttgctgagttcctgttcgagaaagccgatataaattatccatcaaccacctgatcgagcttccgctattagattgacggagactagatcaactcatactcaatattgtactcgtaagatattgatatataaaggcaacactggcttcggtcaaaaggaatagtgttattacatgtcagtaaggggcctcaaacctatataaaagtacatgtgtcctatatattttcacgtgtatactctgatattaacgatctccgtactttacaaatagtgtagacggctacacagcccatcaatagtaacacacctcattttactcaagcttcgcctaaaaaattcaaagccgatgttattatagccattgagctgacattcttttcaaaacactccaccataccaccgaggtagtatatacaggagtagtttgtaggaatacatgtgagcaattccactgttaacataaaaacctaattacttactaatttattttccacatagtggtataatttcttttaaaaattacaggtggaataagcggatagatgaaaagtctccgcttgcccaccccgtatacctaggctatgtttagtttacgtcaaaattagaagtttggttgaaattgaaacgatgtgatgaaaaagttaaaagtttatgtgtgtaggaaaattttgatgtgatgaaaaagaaaaaatatttcggaactaaacacggagctaatatcttgtgcttggctgctactcctgccttgcccgttgctagttgctgcaagctaactatagtaactactgctgctgctgctcgctactcctgcatgtggctagctgctgcgtgctatctactgttgctgctgctcgaatgggccaaggcccaaggccggcggctctgttgctgcatgcgttagctagctgcgctgactgcttctgccttttttttttttttgccttttgctcttcttctcttcctattttcttttctttactacatattaatcttgcgatagatttatagctttggatgtttctaaatttttaatcaactagaaaaaatgcccgtgcgttgcagcgggtgaagactattttaattttattattgttatatggtttaattaagatgaaaatcactttgagaattcgcttggatatatgttcttctagaaaatcataagccacaattaggagtccgatcatcacaagttagaatgcgagttttttaaaaatatttttttctacgactccttctgtattttcaaaagagaacgaacttagaacttgactcaaatacagatctacatttccaaaagcaaacgaacttaaaaaccgactcatatatggatgacttaccaaagtaccggcaaaaaaacaacttcaattttttataatagtagagatataatatatatatataataggtaaagaaatacaaatattacatattcaactggtgaatctgtcaacgggtgatacccgtagaccggatatagaggatatcggggtatgttggtacaagggtctacgtaatacgacatccagcaaacaaaagacgaagattatactagttcaggccccttgataagtaatagccctaatccagttgatgtgggatatatgacggaaaacacaggttacaaagggaacgatggaactcgatggatccggcgagatcgtagtcgagttggttcgactagatccccggcgatttggctcctgcaggctccgacttcgtaggctgtgggggttgtgttggctctgagattcgatcccttaggtcctccccggggggtcccttttatatcgcaggtcaagcggttttcaagtaaaactcggagacatcagaccctacacgatacattgacgacccagtcttgtccgagtaggactcttttcgtccgtaaactccgtaaaggatttccttagtgtatgtagagagtatccgtatgcgcgtgggtatgccataccgatatgtgacgtatatcgaaaggtaaagggtatacctaacccgtaaccccgaatacaaatattacatattcaactggtgaatcaacgaaagaaaaacaatgaatacagttaaaagtggcttagtgaaaagatgcacaacacaaacgtacatgaaaaacgcatgagttgataaaattatcaaattcatcataaatcatgtataatatcttatcccatttatttataccaacataaagatgagaattcaacagaaaaaataataattaactatttagctgggcaggagcagaaccagccaagacaggaaggagcccaagaggcctacggcgatggacagatggctcagctggtaaaaaaaaatcaggactcaagagcgcttactgccttcctcggtcagatgcaacagcgcctgtacatctccgtctccgagcgacgtgcgggcgtgcggcaactatgccgatgcgacgacggataaaaaatcagacaacgtacgaaaatttgaggcaaaaacatcttaaacttttataatagtggagatgtatatggcccatttaaatgaaaataaaaaaaataagcatataaaaatctcaaatatagagaaaaaaactattctaaaatctaattttgatgcactataactgtgtgtaagtagtgtaagggacgcatgcatcattggaatttaagaccaaacattgaattactcgactcgatgatcttacgagttagtacatctttcgactcgaattatacttacaacacctgcgaccgagaaaactggtgtttcccgcgaccaatgcaagtttcttgcatataagagatcaatgaaaatctacaactttcaagttcttccttgaacataaatacagacacgaacatgtacagagacacggtgttgttcatctatcggcgtacttagatcctgaagaagaactgataaccctccgcgtcctccgtgtagctcgagatcctaattaccacggcagccaacctttcagccgatcttcgccgccgtctttcgccggccggccgtctccgatgacgccgactgacctcggcttcttgctcggcattctcgccccaatgtccatgcacggacacgcgagctgcggatccttcttgctccccgggccaacgatctccatgcacggacaggtcctcacgacggcgccgacctcgagagagctggcgtcgccggagcactgcttgcgcggcggcgcggggtggaacaacgtcccgcacgcgaaggtgtcgagcaggacgagcacccgcacgccgccgtgggcgacgcgggggtcggcgcacgcggcggacacgtacgcgcatatctgcttgctcgccacggccacggcgcggcggtcgaacgggtgcccgacgagcgggaggacgcgctcggcgaggacacgctccacgctctccgggctccgtagcccgcgcgacggctgcctccggacggcgatgtcctcggccaccttccggacgatcacggcgccgccggcgcccttcgtggggttcgggccgacggggaagtgcctcctgacgacgaccctcacgtcggccatcagcgccggcggcggccctgcggcgccggatgagccgcgtcggccggcaccgggcgccgtgtaggcggcggcgaggtgcagctggctgccgacgcggattgccgggacgacgggaagacggaggccgtccatggatgcgacaatgcgaatgcgcgcgcgcgctctggtttgctgaatcgctcgaacggtggcactggacgagatcacgagaacacgcgaagaccgaagaggtggggagaggagagcgtaatggtgcgaccctatatctatatgacgtgttctgttcttcctctccattacggagtcggagatgtaatccgaagcgaactatgaatcggcgtatgcttccgaattccgatttccagttcctacctcggtttgataattgggccgagttgggaaacctgaccctaaccgtaatgggcctctgagttgggcttttttgggccaatagaccctaatcgcatgcgttcggcccacttagaaatggatcgctaccattgctcctggcctcctgccaagagactcttacacatgagtacatgaccgtggtctgtctgaaacataaggattagtatttcagattaaaagaacttgtttagtgtccttcagatcatacaaagaagagcacctggtggctggtgctccatgctccaatatttctgtacatgtactttactggagtgtcaagcgtactgtagtacagtgtgaatcaaagagattgcgagaagattgaaccaaaagtataactgagaggttgtttgcttgctagccacactttgctaccgggtaagacttaggatatcaatgtgtcactaatctcagtagttaataaataaaatcccaacggaagacgtaaaacaatgttcagctattcatgcacgacagacttgttcacatattcagatttcacacccttctgaatgattaatgagtgggtgaaactgtcaaagatttcacgagtaaaaggcaacggttgatggtgatagttgcatcacctttaggatatgtatttctacatgtaaatgcgtactgggcaaccaaatcacatctacacgaagacttctgaagaaaatatctgcaagaagatttgcttccctatgtccctttcaagttaagaagtcgcagcaatatgtttcagatttgttgccgcagtccgcagatcgtgctgctttgacatgtctctagtgagagaattgtaatcgtgaatactagcaatcagctatatcttgctcgtcaaatgacggaaaaaaaatgtaaccagtgcgagagattgttgtgaactgcaaaatgttcagatctgcttggaagaccggacttcgctttattctctgcaaaaacaattcgatctccagacaatctagaaaattgtgggggctatcccaaaagtattatattagctggcagcagcggttgcacatgctcggtgtgattatattcagatgcgcctaccgaaaagcctgcaccaagaactcaagaatcaagagcatatgttttaataatgcaaactgtaagcctccttttgaaacaaagaaaatgtataggattaaatcatttttttcttctatttgatcatttgaatcatatgattggagctttctaattaaatcctatagaattcgaaaggattgactcaaatttttttagataatggaaatggacatctccggcttctgtcataagacacacaaccataagtttaatagtaataaaaaggtaaggtaaaagtaaatcaaaatgagaaataagatgatgggacaaatccccaacttccctttattattgactagtgttaaaccacataaaattttttttagctagcaattctaatggaactacgccacccatagtgaaataagagacccttggctaccgattccaagagtatagcaccattgcacatagtatcttgctcctcctgtggtagcatcgtagaccaaaagtggagcaagtaagaagacataaagataacctgcatagggttagataattgtttaccattaaaactttatcattacgacaacgccaaattgaccagtatataacactagctccaattagaatcatcttcttaatggacctagatactcctctaagccaattaccgaaaatgtttttggcgttacagggtggggggatattaaaagcaaaaaacacacatctccaaacaaactgagcgacatgacacttaaagaaaggaggttggattgtctcttgtgcatagcaaaaagaacaatgtttgtctccccccccaaatttcttttaaccaggttatctttcgttagaatttctttcttgtgaagaaaccacataaagaccttgatctttaatggaattttcaagtcccatagaattctctttttatctgaatattacagttcatgatcgcaacatacatagatttaacggaaaattgaccattcttatggagcgactatacacagagcagtccttttcatttgacagagttatattaactagcctgaggatcaaatcgttctactcgattagcttttggccaacaatagctctcctaaaagagatatttagcgccgttgtggtcatgacctctgccacagtagactgtttctttcgagccacattatataatgtagggtattgatctttgaaagcacgcgatcccaaccacgtgtcttcctaaaatcttatgtttgttccattgccatatttagtgcataaagattttgtagaaaaattagtaagagttctaatctcttgttaaatttcctttgggtggatctttctaatttgatttttatgtcttttctatgatctattcaaatgatcatcaatgtgtttttcatatattttacatcggattcctgtgaaaatcctatattgttttctattgcaacgctttctcacttctatgattcaaaagagccataaatttcgcctcattttattttttgtttatgttcggacagtacaatagccacaagttgagagagcacattacaaagcaaactgtaaatttcgccgcaaattatttgttcatgttcagacagtacagtagccacgagttgagagctcttattgcaagttgcttaggccgtgtttagtttcctcctattctcaacttttcatcacatcaaaaacttttctacacacataaactttcaactattttttcaaactctcaactttcttcaaactttcagcttttttcaggacaacacacccttacaccggattctaattctcgatccaccatctatcaaagaacaaaaaaggcaatagaggacggcagcagggtttcccttaccgccggtaaccgtgcggttaccgcggttatcgggcttaccgccggggtacggtaatataaataccacggtaaccttcttaaattcaaataaatttaaaaaataatttaaatttttgataaattttacacgattttgtatggttttttacggttaccgtggttaccgcgcggtaaccgtgcttaccgtcgggacacggtaaccccgacctcggcggtttgggaaaccctggacggcagcgagttgctcgcctggtagcgacgacaagaagatcctgctaaaaccacatttgaaattgccgcatcgctcccagttgctgcatgatctttgcttcactgatccttacgtgagcaattaaacagcatttgggctcactaccgcaataattcagatttttttagcgagaaaggtctttgctttttttaatttcattatataataatagtcctagacatatagtaattctacatgtggcgatcttatcgtttgagaggttgtcaatggtcatgatttgcttctatgacaagcatgccacttagcttagacttagagaactcacttcgtgcaagcaaaggttacgtggataatatacctggtgacttccatgtgttcgcacgacgatagggctctgacttcttatggaagatgaacatgataaacgtagatgccttttcatatagtacgacctacctgaagacatgagatgagatttattagacgttttgctggtcaacacacaacacgtcgatgactcgtgcgacgcaaatgcaaatccagatgagttagtggaccctcacacttatacataggagtaggtgtcatctgagtcaatatactagcaagagtgagtttgaaagagatgttgggattgagcttttttttagcacatataaaacgagataagtcattactatatgattaattaaatattagctattgcaatttgacttctatgtaaaaattttttttcaaaaacatatacattagtttgcaaagcgatgaaatagtttacccaacttctctttagaactcagcctaaataaatctaacccctaaatatgctaaatgtgccagccctagtccaaaatttaatgagacctaccataagaatgttgacatgacatcttcaccaatcctacaaacccttaaaaagttaaaagtttgaagaaagttggaagtttagaaaaaaagttagaagtttatgtgtgtagaaaagtttttgatgtgatatgatgtgatggaaagttgggaatatgggggaaactaaatacggcctaacaagtatggcacacacacgctttatttttaccttttttcttctttttattctgtctttcattctccttttctatttctttgcttctatgttcttcctcaagcgagccttccttgagctcaagttgttgccattgagctcatggtgggctggtgggcatagtcgtgcactcacactaagcaactatcgttaagctttccatggctgctgtaacatcccggcccagggcttaataggattaatataagacttgtgcacacgagtgaggacaaagtgtgcagaaaagacttgtgttggtctgtgagggcagtctatgacctatgaaagctgccagatgtaagcggaccacttcttttctggaagccgatgtccaaagaactttagggttaagcgtgcttggcctggagcaatttgggatgggtgaccgaccggaaaattcttcccaggtgcacacgagtgaggacaaagtgtgcatgaaagctgccagatgtaagcgggcccagcttgggagaggcgggacgttacagctgcgatgcttaagcgtccctatcggccgccaccatcgagctcgtcctacccttggtcaccaccactcctctaccatcactgagctcctatgcatccacggccaaaacaaaaaccctatccttacgtatctcctctttcaccaaccgaaacccaccctagcctccattgcttcagtcaccgccattaaacaatattagatcgaaatcctaattcttcgccagcacaaaatgactaaattcattagtgttgcttctcatgttccaaaattaaacatgtatacgagttcattgtacccggtaatcatttcgcctctcctatccttgggtgatcactagcatagttcaccatcacgacaagcaaccataatgctcaagtgtggagattgggggcgaggcgaactcgacagtgatggttggggacaagagctcgagcatcctgatcatgggatgctcaacgggggtcatggcaagctagacagcggaaagctcaaactcaagaagaagagagaaaaaaagagaaaggaaaaggaaaaagaaaagaaaaatcttttataggtggcccacttatcctttgacgtagaattggtgaaggtgccatatcagcatcaatgcgacatgtcatatcggattttggtctaatattaatacatttagtaagttaggcgggattaaatgtgtgccttttaagtttatggacctaaataatggctacttacaaaaccatggcttgcaggtgtatgttactcaaaaatttatttcaagcggttatcagttataactggttaactggaataagcttggtgtgcaagactacatgaattcaatatcggtgacatcaagaccttatattgacattataattgaaattaagatactgtgaaatttagacagcgacatcgtaaagcgatggttcgatttctggacagatacgtggaaaatttataggttaaaaactggggaactaatggtgtgccgctagccttgcctaccatttagcagtagtacatagcttcagaccctgtttagatgggaataaaacatttaagtccctatcacatcggatgtttggacactaattataaatattaagactattaataaaacctatcaataatcttggactaattcacgagacgaatatattgagcctaattaattcatgattagcctatgtgatgttatagtaaacattctctaattatggattaattaggcttaaaagatttgtctcatgaattagtttttatttatataattagttttgtaagtagtctatatttaatactctaaattagtgctaaatatagggactaaagttttcagggatgctgtttgcccgtgatgtggtacagttaagcatcaattggtactactactactcgcatcaattggacttgtattctcgcatcaacaaacttccaccgagttgtgtcggagatgccgcccagagatgattcggtggagcaccgaagtggtggacactcttgtccaatcccgtcgtcgccgttatctgctcatttgtttactccttccagggcgtcgttatcgtaggctgccaaagtgctgacgtgccaaagcgcctcttttttcaacgcgatcgtctacggcgtggctacaatgtactcccttttagagagcgacacggtctctaaaacacaaatttgactttttatttctataaaaatatttatttaaaagtgatatatgtatattttgatgaaaatatttttcaagtcaaatctatcatataatttttatatttttaaactcaacaacttaagagttattcatgatttatattcccaaagtttgacttaaatattgtcctaaacgatttcttttataagtacggagggagtatggagtgcttcctctattgttcctaaatactccgtctccgtgtaaatatttttaatttaggttgtgtttagttcatatcaaaattggaaatttagttgaaattgaaacgatgtgatgtaaaagttagaagtttacgtgtgtacgaaagttttgatgtgatagaaaagttggaagtttgaataaaaagtttggaactaaacaatgccttatttagcaaagattacaaataaggaaacagattccatccaaatcatctcattggtcaaatgttagattcttttatattcccctcttaaatacaccctttccgtctaaaaataacacgttttagttatatgtttttgcacacaccttcaaacacaatatttaattggttgaaaatgcttgtattttttcttcttgagcattttcttgaaactgagagtagagtacagttttgctctgcgggcccgtttagcataacttcaactgttaggtggtgtttggatcacatgaactaattttagcccctgtcacattggatgttgggacactaattagaagtattaaacatagattaatgataaaacttactacctccgtaccaaaatatagttatttctagcacagtagcttatcttaaaatgaagttatttttccacctaccaccttctctcaaccaatcacaaccattctccttcacctagtacttcctcttttcaaccaatcacacacttcctctaatcattcgcacctactttcttaatacccatgccgacctaaaaatactaacattttgggacggagggagtattctataaccctggactaattcgcgagacaaatctattgtgcctaattaatccatgattagactatgtgatgctacagcaaacatatactaattatggattaaaaaaatgtctcacgaattagctctcatctatgtaattagttttataattagtctatgtttaataatccaaattagcatcaaacatccaatgtgacagggactaaagtttcgtccctagatccttggactaaattagttgtacctcttctgaagttggagtacaacagaactatttcagctctatccaaaaaaggtgaagcggactaaagtgttatcacaaaatgaataaggtgaaactgggtttagataactttacaatttcacttcagacctaactttaaagttaaatttagaagttgaataccttaaaaaaaagaccgtgtatttcaggccgagtttagatccaaagtttttcttcaaactttcaacttttttcatcacatcaaaactttcctatacacataaactttcaacttttccatcgcatcgttccaatttcaaccaaactttcaattttggcgtgaactaaaaacaccctcagcacggttggtcgcagagtttaaacagctgcgaggaggtgcaaagaatccaggtgcactgcagcgagtgccatcaaagcgagaggggtccggtgtcccgcctccccatgctagatcgacaggtcacaggtcaaggcctaaatttccggagggatcccacgcagccactcccctcccccctcccgttcccgtcggcgccatatccgcccatacgttcaccgcagaatcatccatccaccaccacacctt

SEQ ID NO: 45968 - DNA, 10386 bp, Oryza sativa
  unsure (1)..(10386): unsure at all n locations
agggcaagcaagggatctcgcagtgtagacgagcctggtgggagggaggagggagagggagagtgacagttgagacttgagagagagagagaagagaggcagattgggagcagttggcgcgtcgccgtcgcgcgccaccatccccaccctgcgccgcgtgctgcagcgctcgcctttattacgcccccgccccgcagagctcgcctgggcgagcgagcaggcaagcggcgctcttcgtctgcgcacactggggcggcgagcggagctgatctctcggctttaggttttgttcaggtacacgggaaatatctcatcctttttgtttcgtcgccgccgccgcaagtggcgtcggctctgtttgtgaccgggggggaaggggctgattagatttgtcccggggtttcgctggatcgatcattgttttgagattttttttttgcttttttttgggggattttggctgctggttttgatcctttctattggtgcgtgatgcgggatgagtgttgttgcggttattcttcaacggattggtgaattcgtagtggtatatttggatgcttccctttcacgcaagcgcgtttgtggggcaagcctttttttttttgcttcagcacggcgacggctagctttgagccttgagtagttttgctattatgccaccgccgccacgcttttgctgataattggtagcgctagccgccaggtgaatcgcggctgattgatttcatgctttgttcctctgattacgatcttgctctgttgcatgctgtcttgattaaaccgaattctagtgtaaaaaggaatcacttttgcttggaagattaatctactagagttagtgtttgagtttatctcctactctggttgtgccattgtcattaacaattgatagatttgtctgttgctttgctttgattcctctagaacactttaaaatactttatttaaagtgttcctttattgatactgtattgaatcatataattcagtagtatagtagattattctctttggtctgcaaagagacaacgcattatgctagtatttaggtattcccgtgttatgatctgtcgtaccatcagctcatttattgccggttggtacgcatcacttgagcgttttcgtctgttcttgttattcttggtttcttccgggtactgaccgcggtttgtaccagaggacaccgaatattggctggtggtccacgccaaggcaaagatgtcggtagccaagaaggaagaggtacatgaagtttcctccttggaggtccattctagtgggctggatgtctctttctgcatttgtataaaaattctggatgttgtatgagcaggtttgcagtcatcggctcgggccgcgattggatgagccggcggtcggcgtgcccattaagaaaaggccagttttgttgtctgatagattgcttccgtctggaatgccgccctcgatgagaccatcgtctccggcaacggggatggccgtttcagttgcagaggcaggatgcagcaaggacactttcttgaacagatctgtatcagaagaaacaagtgcaatcacaaaaggtaatgggatgtttaatccccaggatcaaaggcatgccaagaggtcattcattcaatctttgaccgagaaaaaagggctgtcacttgatggatcaagtggaatcccttctcgcatagagagtggtacaggtaatgttgctcccgttgatgatactcagagtcagaagtttttgagtttgggtttgcgttcagcatctcgtctgaatggtaagatcaattctagttccaatgtcaaggaagagaaagttgatcagggtctttctagctttccatcagcagattttcagaaggatgctggagcaacaaatgaacccaaatcatcttctgacagtagctttgggcgactaccgaatttggatcttaatgtgccattggaccctcatgatcttgctgaaagtttgcctatagtgcaagattccagtaatatactctaccatgaaactgttcagcttcagaaagcacatgttcccccagtgcccccagtttctacagtgagcaatggactgcatcgaaacattgccagtactttgaacctttccaatgcatatggactttctaataagcgtggggcagctgatgttaccttagacttgcaacttaaaccaccagctagacctgagctaggcataaactggaaaggacttgctcctgttccaggactaagtctctctctgtctagtaagcatgttgaagagtctgagaacaatgctggattaaatctctctctatttggtaagcacattaatgagtctgagaacaatgctcctaatgttgcagttagatctgaacctactgtaagtgccaaaagatcaccagggaagttggtataccaaggacagataaatcaccagttgaggaggttgtcaaattggtgcccttgaatgaaaaccctcataaaactatatcatcaagtgtggctagaatttagagcatggcatctggttgtttggtgaagaaagagcctgaagaacagtctcaacgacatgttcagaatgatgtagaaaaagaacaaccattagaatcacaaagtgttggactagctaacaatcgcgctgaaattgaaaagcctaacggtgcccaccaagttcctggaaaagctgcccttgatttgaattctggaatctttccaaatgtagcaactgctaacgttccactatcaactgaaagattgcgtgatgccatccgcactgaggccatgcatgctgaccatgaagttaagaaatctatcaagtgtgaggaaacaactgctgcaatcccaagtcctgcaactgcatcagtaagtagtcgctgctcaccactgatggccacaaagcaattgcctttgggagaccgtgatgctagccgcgctggattacgtgtatcagccagccagccctcattgcctactgaacctgcatgctgtaatcctgatgaggctaatgttgattgcaaaccaacaatgagtcatgtgaattctcgcaatgctgttgaagtttgtggttcattgcaaagttcctcgaatcctatacctgaaccatcgatttccaattctcggaatcgttttgggtttgatggtatgtcacaagggagtgctgaaatggactgttcagaagatgatgacaatattgtatcacatctatctactaccaataaacctcatggagggacactagggaacaatcaaacctctgacagtatgggttcgggtagaaatctacagaaggaacatgacagtaatacacatcagaattgctcatttgtgacaaataagatcgacatgcaaggtattagtgatgacaagcgtattaatgttaaagatggtgttttccctcattcatgtcagaacagtcatcaaagtggcaatgttgtcaatgaagagtccaaaaataaacaactattgggatcagataagaatactccaatgaataacaacgacagtaccatacgtgttaagaccatcacaggctcaagtacagcagatacccgaaggttatcatctttggaaacatccacttcccctaaaattgaatccattatggaaccttataaggaatcaggcagctgccttgagaagagtacaactcctaaaataaagtcaaaagggtgtcaatctccacttggtaagcaagctgctaattgtagcgaggaccatgcggaaaatgctgctgtgaagattgagcattagacagtaagtgaagaggttgccaaagtcttagaattgcacccaagggattctgtcctaggtgaagattctcatcctgatggcgcttcaagcagtcaactgcacgatgagtgtggaatggtaaagtcggcatctgagaggtcagaatgtgataaatccaaacctgactcttgtaggacaacttctgtacagaatgaaagagatggtcaggttgacgacccacattggagagggatggggcatccttatgtcaatgtcaataggtatgattcttgttgttttgtttcttttgtgggatgctgcagtaagcgggactgggtttcctcatccatatggtaactatctgttaggtattgtatttggctggagttacaaagtctttgttttcttctcctctttgtgcttattttacaggaatgaaacatgggagaggcttatgcagtctaagagagagaagaacaaaggagagtaccatggtggcaggcatgcgcctgatacattcaatcaacgaaggccagattaccgttatggtggacgtggtgttggatcccgtggtaatccaaggaacttccggggtccaagaatgaatgaatctgaactttactttgacgatgaacctatggcccgcagaaggcgcccctttgaagattacctagggcacatgcagcgaattccacataggcgacaccgctcctcgccaatgaacaatcagttgcagggcggtttgatgagagatatggacattgatggtttctctggaagagatgttccagaccctaggctgctggcacatgagcatatggaagatctatctgatgacatgatggaggagaggttttatgtaccacattcccgtcggcatcatatacaaggtgaccatgcattcattcacagaaacaagagccattcacctgggtagagaaggggtgcacctatgcatttacatagaggatggtctcctgaaacaatgggcagatcaccaccattaatcagaactgacagaccatacttacctcatcgacaccacacccgccgccatggttcgccctttgaccgaattgagcatgatgacagaggtatgcaaagaaacatgagaaggtgtggcatgcatcatggaggtgtagaaggagactccttcgagccacatctacatcctgctcaattagccgaactacatgcaaaagctgaacttaccgagagaaggaagtttggcgagaggagaggccatcatctccgaccctttgaaggcagccccgatgacgacgaggtcatactttcctacggcgcggatggtgacatggacttcgccgaaggtggcagcggtggtctgccgccaggagagctcgacggccgcttcaggaggcacatggggagggatgaggaagaagaagaccacatgtgtcatggacctcatgggtggcgcgatggcagctctaatggcagcagggcaaagaggaggaggtactgacctagtcgcacaactgtgacagctgcgagcctatctaaactaatgcatagtggcgttttttggttggctggttcatgcatcaccgactcaccgattctcttaaccaaaccttgctataggtttgcaagcatgtctccttcaatatttatggcttgtttctttcattctttcctcatggaagtacgctaccctgcagcttaacacccacaaggctgtctgaagtactactatatttacactatatatctcaataaggtgatattagcatgtggacatggtcacatggaggtgaaactgacatttcaggacaaatcaaagtaaacgtggacttgtctttgcccctctagcttgccttttttgcttggtaaatcaaattaatttgaggaaggagaagaatatccgggtcacaaagctgctttgcatgccattggctggtagggtccttttgtattgaagtgagctgtctcctcaaagtttgctttgatctgatctagaatgaagatgggatagtggggttatacggagtactcttacctagtagctttggtgttttggctatatgctttcttggactagatatttgtttctttatcggacaggcatggccaaggggcaatttaatttgcgccttgtaataaattattgcttggcatcttttcgtagtgtgtggacaaaggtacgcaagttgtgaagttttgacaaggacgacatggcccgggatgtgtcacatgagcaatacctgccataccttggtcgtaggagctaataggaagcagccttgaagcatagcgcctccggttggtgaagtcaagtcgtcgggtcaagtgttaagaaatttaagcacgacgcttttcattggctagtctgagtcggcgctgcctgatgtgccttcttgccgccttcttcgtgctggtccaatgagatgcaaaaatcagcaaatgtaaacagtttccgccctgtacggatagcggtatatcgcccactggtataggtaatagatgggggcaaagaagttgtgcgagctccagcacgaggaatcaatcgtggttggtacgaggaaacgaggcaggtaatggcataattgggcctcgatctcatcctgatgctaactccacgcgaattcacatcttggcatctcagaatttgagaattaggttcctcaattatgtataaaggaaggcagttcttatcacaaacaagggcgtaatatgaagagtacagaaaggatttctctttttcacacatggttaaccaaatttcggtggagtatttcacagcgcggtttgtcgataccgtaccgtaactcgaggaaaaagaaaccaccctaccaaaagccaaaataccacgaagtgaagtgcccattcattcaccagtctgtcgtcggcattacgggactggcgctgatctgctccttattatacttacgaacacgacggacgacgctggtccggcagcagaagcatacaattgttgcgctgaagatttcccttccagaaccaaatgtgggcaagcagcctgcagcatacgcagcaacatgaggcacaatcatgatactattgaaaatttccaaactcaatgaattagggcgaggaaataaaaattagtccacgtctaacggcacgtctcaatgtgctctggctggcaggcgacgtacttgtgcggagggaggactgaggaaagggattgattctgtaatccgttggtaagtcttgccgaaattttgtcttcctcaactacagccagagtttgtttcggaaatgctctttgccgctcgcccgatgcgggggagccggatcaggcgctccccccgcgccccctcccccacgtgtctacttgggcccacccacttctgctccccttttttctacaaaagatgtttcacctagtgtatttacaatgtttcactatttatagatctaatgttgcagtgaattaaaattctcttttgcaaaaaaaaacccacatattttggaaactctatattaagggaatttggtttattttttgttccacctaaaatgtttcacctagtgtactcacaatttttcactatgtatagatctaatgttacacttaacgaaacatttcattgcaacaaaaagcccacatattttggaaaccccctattaagggaatttggtttattttttgttccactgaaaaatgttttacctagtgtactcacaatgtttcactatgtatagatctaatgttgcagtgaactgaaacattttttcgctatttgctgaaatattgtttttatacaaggtgaaacaacacccgatttaaacaagtgaaacatttttgatctacttagtgaaacaattctgatatatctggtgaaacatcgtgcaacatttaaaaataattcaataataagctaaaaaaaatttcgtcggaatatatccatgtgtggtcttgttttgaagatttaattgcaacgaatttaatggtgcaatcggatcatgatttggataagtaatttaagagataaattagtttaaagtaattttgcacgtaaattggacgctaacgtcagcgcccgattttacccctcccgatcgggcgcccaaccgggagtcatccccgtttgatttgggtcccttacccacaaatcctttctttctatgtagttggaacccccttagtgcaattactactataaagcagccaccaggttaagccacgtcatcacaattatctcagctattagatataatctagatgctaaacgattatcgaaccagcccccttctctctgaatcctacaaattcttagtggatccaatccccttcacagctagcctgccgcatctacttctcccattacgataagcaattgtgcagcagaaactgcctccaataattatagcagcgagaccaaacgtcatggttaatcagatttattctcttccaaagcatctttaaaatcctcctgcagccacacataccagcgctctcttttgcagaccaaccggcccccatatttgatcatcagatattgcatggtgagtgatatatttgctatcatttttttcttattacatctccatattaatttacaagtattatctttttttcccaagggcaatagctttttctatcaactaggtgataagtgaataagtgataacatatttgatttgatgatttgatcggttcatttgactctgacttttgattcgatgctgatcttgaaagtaattttgtacaacctccagattatattgccttccgttgttctatcaaccgcaggatagctttttgatgatttgatcagtttaagtcctttctttatttcactctgatttaaatattaatggttcttgggcaggtatagaaatacgatatgggcatatgggtgtgctccaagaaggatgagtcaatgatgaatgtgctaattcaaggacaaatttgtagcagattatagaacatcgaaggatgcttatatacaatgattggaatgatatgttgtcaatggtctacagttttctttccggaaaatctatgcacgccatcaattagctatactgcttagttgttcgtctgttttgcatgtgaaattttcatagtttcaaattggaattcataagtatcctagcagttgcttatatttgtagtgctgtgtatttattcgtaaactacaattgttatcatctttttcagacttttcccttgcacattgtaggcattgttgctaagagctgactgttaaataagaacagttccttccctttttttttcttaaccagtcaatgaatcgaaagtttacggtatgtcctatgattgatacgatgggtgattctacctatacaacaagaatagccatatttcttggatttatattctatctggacaattgtatctccactatataggcattgccctgaaacaattagtcatcaccaatttgaattaatgctattatgtacacacccatgattcatgaacaaaaccaaaagttgtctggttttattgacttttatctcaatctttcacccattcttcagttgtatttttcatttctcgcggcaacacgtggggtatcatctagttagatatatgatccttgactattaaaactagtctattttcctataaaaattggtctattttgcattccagagtggtttggataacaattttatcgtacgtgatgtgatctttattcaacatgacgcctacgtggtgcttatgtggtattgcacttaagaaaaagtaaagtaaaaataattataggtgtcgaatgtcagtaaccctttgtctgctctttgtatagtttatatcctaggacctatttagggagctttagattttaataagtagctagtggcactccgctgatggattttggttttggcttctagtttttttttattctaaaactataataactttttagaatctacgtgaaagactcgactgtttggaattgtttttgattatgagagaacctgcagtctgcagttgtcagaaggacaccaaacattgtcagaaggacaccaaacaagtcccttgaattttctctcctcctgtgtccacggaatcattttttccaggcaactaccacgacagttgatggaggagacgatggcatggtggaggacccaagcaaagcaggaagcccggtgcccattgcggcggtgcgcagtggagccatagattcaagacggttggtggcggcggcggcgaagatggctcctcgacgacagtcacttccacgctcattggttcttcgcaaagtaatgacactcgactacttgatgacgatgaggcagagctccttgccaccagccttactctcctaccctctccaccctccgcgccaccaaccttcctaccatcgacggaaacgagcggactccagcacaatgcgaggcagtgcctggcgatgatggtgatgaagaagaagatgcgtgaggggaggaacttgcgacgaccacagcgaaggcctgagtcctagtggcggcctggcgggacccatcctagggaagaggaggaagggttgcttcccgccattccccctagccatggcatcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45969 - DNA, 19476 bp, Oryza sativa
  unsure (1)..(19476): unsure at all n locations
aattcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttataagtggaagatcacggatattatctccgttataaaatatagaagattttatctatataagtaagattaaatgggtaaaatctcttatattttataacgtggtatataattaattgtctgtactttatacgtcacacataatgcaatggttaaaaactctaatattattactccacacgaatgtgcgcgtacattgcttagctagtactcacatctttattcccagttataacatgctaaggctacattttatagccttgattattcatccactgcacgctgaaacatccacagacacataatacgttgaacattaatacgtacgtacgtgatgtgtttgcaacttttgcatgcgcacatcaccatgtacgtgcaactaaccatggatgcttagcggtgcacaacgatcttggtgtacttggtcatgtcagtggtggcgctgcgtgcgctggtggcgagcgggaagtagaagggatagatctcgtagcgcaccctgcagctactgtagttaatctgacatccctgttgtgcgccgcagtattgaccgaaccttgacaccgccgttgacagacactgtgcgcaagccagcggtgacaagtcctgtgtgcactgtgccagcccgtagatgttgatgaacggcgtgtactgatccttcgtcctacccagcccaccactcccagcctgtgatgcctgcgacgttgccttgcccataaccttccctaccgccttctggaacgccttgccgttatccatcgcctgcacgttcacaagaatcaccccggcatctgtgtccgtctgcccgatgaagttctcgttctcgaaccgcatgaagcagtagtcatacctgcacgtagaataattatagttttgaagtttatcagtcgcctgaattcattgttttttcgtatgtttgtggtcatcacacttggcatatataccatattcttgagtcggattggtagttgcagctggtgaggatctggttggcggcggaggcgaggcaggcctggcagtcgctggtggagacgtcgccgcggcattgcgcgagaccgtagatgacgttgttggctttcccggcggaggacgtggcgaagccgccgccggtggagcccttggcgacgaggtcggtgaggacggagttgatgcttgccacggccttgctgttgccggccaagctgttccctgaacagtagctgccaatggagtccatggccatgctcagtgggagcaaggcaaatgacatgagcaccaagcaacggcaagctttgctactgaatgccatggctatgatcactcaagctcactctcactctcactgtcactgctgtgtatcacacctagctagttagaagtgtgtgtggggggcttgggttcactggggaggaatggttggatcttataaagatgagttggatatgggttaggagcgatgtgattgcagcctttttttgactctttaattggttgcatgcaatggttgatgttgacggtcgtatatggagactactacgagcttaactattgctgagtcggacatggcaatgtcgatgcactagtttctgcagatattgcgagccagctggctgattggctgcttgctacgagtcgttgactagttatatttgactcggttaattaggacgttatccacaacgactaacagggactgtatactgtgaagcaaacgaaaatatgtaccaagcttaggatgcaattatgcaaaactaattgttaatccaaactggctaggatgtacaggccatgttttttaatccactagcaaaatatctatgttatatcatcttcgttttatattataatttattttgatattttttctaatcaattattttagcttaatcaagtttatagaaaaaaaatatagcaacatagataacacaaaacaaacatattttcaaaataaatttaatgtaatatttaacgaaactagtttagtgttgttttgttgctaaaattttctacaaaccgatcaaatctaaaaaagtttgaccagaataagcaaaagccttgtgtatcttttgtattaagagaggtgaaatttttaaactttacaaactttaactataaggaaaaaaagaaaaacaagggaacacaaaaggcgtgggtctacatctcgcgacaagtctggcgactgatcagcggacaacgcctcaaatgggcaggtcagctgcgcgctagactgttgctacctccgcggccacgcttgcgctacttcctcccataatttcctttcatagttgaacacccaattgtttcattccttccaaattatccaggctactagggtgacaaatggtgtcgaagctcagtttgtttgctttgtcaactttctttctagcatcacaccaccactcgaagaaaacactattggaagggaagcaaagggcttgcaggatgatggcgaggacatgccaccaaagctgtttggatctggggaagcggacaaggccttgcaaatatttggactgccgctctcgacccaaaagctgacgaccacagcactgcaaccgctggtggactaggttgcacgtcggttgccatattcgaaggccgaacagctgcaacctataacatgaaacgaagggagtagtacctagaaggttcatttgtaaaatatgtcttggagggcttatgttatgaaaattaaactccaaggttgacaaaaccattcaacattaactaaaactaaacaacattaatctgaactcaaccatagttaaccaacaacaaactctgctcatcgatcgactccagcaattgcattgccctctggtgcagcagagtgtgaacgtgatcgctgtcgccccgctctccaggttcttgctccgaccacctcaatgacacgaatgttgttgacggtccttaagtatcaaatatgactgtcaaatcctcaataagaagccggagcccttcgaccaacaactatatccactacactgacagttgcataaacattcaactgtgtcaacaactatatccactacaccgacagttgcataaatattcaactgtgtcagacatcggttagtaccccttcttccttattagggtgatcggctaagttcaattaagtagattaaagatctacatatttatattgctatctactccttttgtactaaacaaacaaatctagtactaggatgtgtcttattatgagacggagggagtaccggtcaatttgctcatcagcgagggcggttggggccgagcaggcaaaccggttgggccgtcaaacacatatctgaggcccgtcgcgtctgggctcagaggacggtttgtttagcaggccatccaggccctttttgccaaacactcaactgggctactgcatcactgcttgtcctcacctgcaggctgcagctgcaaggtgtgtgaaacacggacaaacacgtgcggcctaacatagatgcggccatgggggtcgacgggatcagatcgtacgtgctagtggacagccagcgttgctattgaccaatcgtgatatagaaacaggggctgcttaggcggtatatccggttgaatcgcccctaactctctgaatcttttggtcttttggttacgtatatatgtcacgtcgtctctgcaactagctcgtcgtgcggcccatatatctggcacgagttttggagttcacgatatatgtgaactctctctttcgaagcatcgacccccctttcagagttttcgacgttgatttggaccatcgatgcaactcatgccaatagcagatgctctatcactgctactacagaaaaccggattggtgctggttggggtccggtcttaggtgacagataacccaatcggcacacatagtaggcactaggcagcacccatatatatgtggctcctttctttcttttcttgtttgagaatttcagccatatacactcttcccatcaacccatccacataattaaaaattggtaaccttttaatttcgtgaactatgtcatgatcatatgacttacaagtcgcagctataaaaaattaaaaatgccttccaagctggtcctaacaagttgaagatcaattttcagtagcacataatatataagtttaacacttcgataatattactgctccacacaaacgtgtgtacattgctttgctagtacacattttattcccggttatagtatgctaataaggctacactttatagccttatattattcatgaaccgcatgctaatcaaacgtctccacacacattgtactatagtttatactttagtatgtgatgtgtatgcgtacaagcatgcatgcacatcaccatgtatgtgtaggtagttcttagtggtgcacgatggtcttggtatactttgtcatgtcggtagtggcggtgctactggtggcgagcggaaaatagaaggggtaaatttcgtagcgcaccatgcagctactgtagagtatccggcatccctgttgcgcgccgcaatattggtcgaacctggacaccgccgttgataggcattgtgcacatgtcagcggcgataggtcccgcgtgcactgtgcgaacccgtagatattgatgaatggcgtgtattggtccttcacccttcccagcccgccgcttcccgcctgtgacacctgtgccgtcgccttgctcatcaccttccccaccgccttctggaatgccttggcgttgtccatcgcctgcacgttctccatgatcaccccgttgtccgtgtcagcctgcccgaagaaattctcgttctcgaaccgcatgaagcagtagtcatacctgcacataatacaattattacagttttaatttgctatctttcgtatgttcgtggtcatcacacttggcaagttggcatataatataccatattctggagtcggattggtagttgcagctggtgaggatctggttggcggcggaggcgaggcaggcctggcagtcgctggtggagacgtcgccgcggcattgcacgagaccgtagatgacgttgttgcctttcccggcggtggacgtggcgaagccgacaccggtggagcccttggtgacgaggtcggtgaggacggagttgatgctggccacggccttgctgctgccggccaagctgttcccggagcagtagctgccaaggggatccatggccatgctgagtgggagcaaggcaaaggagacgagtagcaaacaacggcaagctttgctactgatgattgccatggctgtcactatagctcgatctcacagtctcaatgctgtgtgtttcacacccttagatagttgatcaagtgtgtgtaacttgggttctctcgggaggaatggttggagcttatatagatgagttggatgggttaggagtgatgtgattgcagccattttttgactgtttaattggctgcatgcatgcatgcaatggcaggcagatgttgatggtagtgtgagagtatgagactatgggcttaacctagacgtagaaattactttcccaatgtccatgcactaggcagtttctcatgcagatattgcgagctagctggctgcttgcgatgactcgttgactgtatctttgattcggttaattaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttaggacgttatccacaacgactaacataggctgctgaagcatgcaaaccaaaatatgtataccaagcaagcatgcaaatattcaaaagtaattgttaatctatacatgcttgtattttttttcaaataatctcatacatgatttgatgattgtaaatttcctgcatctaaatatatttaattatagaaaaaagtacgaactacccccaaactattacagcagtacccaacgaggtccgcctccgtcgctggtcgcccggtccgccttcgccaacccatccctaaattgcttcaggccaagcacgcttaacctcaaagttctttagagatcggcttccggaaaagaagttgcaacttgttgatatgagtattctattaatcctattaaaccctggaccgggatgtcacatccaccttcgccacccgccgcccagacgaggtccacctccactgccggctgctggtccgagcgcatgtgcaagagagagttggggggactgaagggattgggttgagggttaagtggcccagcgagttttttttattttgttttgctgactggattgccacgttagcgccacgtgtgtaatttatatataatcaaaaccactcaaaacagtgttagggggttatttgttcggtttcaataatcgagggtgtaaaatgtccggttttcgagttcaggggtgtaattcggtcaaccacgatagtaggggtaatttgtactttttccttatttatacgagacaaacttttgatcggatggactaagttacagcacatttgcagacaaattttcattagaagtccagagttgaacaaaatttacatactactacaactaataacaatatcatctcgaaaaactaacacccctgatcccgcgttctcgacaacttccagattatagattatcacagacacactttctaacttcctaaacagtaatttattaatgaaaaactttcttcatcattattttttgagagttttgtttttttaaaacaaaatcaagctatcaactttctgaatttaattcatttgtttgtgttgaataatatgatcgtaaactcatccatcggccataatctattagctacgtcccctcaacgctgctcaacttagtgtgcccatatgcatggacaccctctatgaattatacatggtcgtctgatgtatgacactacctcatgttgcatcgagctatgtatttacaaatgagcgattttattgtctttgagtgggtatctggatatatcatattttctaatgtaaaatgtatctgggatgacataattattatatatagaaaattggtaactctcaagaaccccaaaatgtatcatctaggtaggtagtaagtagagtaaagtatgcggccggtccttaacgtgttagagcgaggtatcacttagattcatgatcttgaaaaatcgatattagggtccgtgatcttgtttaaatgactcattgagatccaaagtacctttgaccgggttgactagcttacgtgaccatccagagtggcatcatatttgcattttagccccctcgcatccgatccaacacttcttccccaaatcttctttcagcactagtggtgaggacgacaacgagcggctgatggtggacaacaacaacggcacggccaatggtatacaacgacggtggtggcgaacggatgacggcacagcgcacgctgttgagggccgaggagaggggagcagcggtggagggcagagggcgtcgagctccaacggctgagttctatacaagctttaggccacaatggcataggttggaccggcgacaactcagagtgtggtggcggcagcccggtgcggcagcggcttatctcggggacgacacgagtgagctcgccagaggtcactctcgtgctgctacttcgtgtcgtccacacacaactagccgggagacaacgaggggatgacgagcggtggtgaacgacacaaagcaagaagtagtagcacatcaagggccaggagacgacgaggggacaaccagccgcagggatatgaccgcagctgggacggaatccgccggtgtgcgtgtcgccgcctagcgcggtgacgtccacggccttattgcggccgtcgttgccggatccgacggataactcgatgacatcgctgtcattgaggctccgatagtcgtcgaacttgagggaggactggtggatgaagaggtcctcgccgtcgnnnnnnnnnnnnnnnnnnnnnnnnnnnnnngtggcgtcaaaacccttcaccgtccccttcaccctctccgacaccatcttgccctcaccgccgagccctagaagccgctcgccgccccgcttcgctggccagccgctgccaccgccctactcgcccttccgcttcccttcgcctggggcgacctcgactcggccagttccgggtacttgaggcggctcgcctagcgcttgcaggtcccgccgcggccacaacaagcgatggcgagaagggctggccgccgtcccccgcccttctccccgccagtcgcctcccttctccctctttgcgcatgctcgccaacccaccgttgtacccgcctccctcctcgtcgtcattgtcgtcgtcactgccgccgccgcgtttccactgccaccccaatcggcccgcaaccgcaaaccatagaaatcacactaaaaaaagatttagggaagaagggttggatcggatcccaaggggatgaaatgcaaatatgctgtcactctggacggccatgtaagccagtcaacccggtcaatttttcaagatcatgacctaagtgacacctcgctccaactttaaagactggccgtgtactttagtaaatacatgatgccacttggtcaatttgtagaagaaaaaaagggagaaggttacactaagaagttttaaagcagggataaattatagaagtgtcacattgcatctgtgtatacggaaataggttcccccactcccaccagtgtccactgtctagcacgcacttgcgttgtgtgcagtatcgatcagttatactagggatggcagcaggtcaggtcgggcacgggtagagcaaaaccatgcccgaccccatgcccgtcgtcacccacccgaaccctacccactagagttagcagacaaaactccgtgcccatacccatgcccgacgggcacgggtatatccggcgggtacccaatggatctcacataaataataattcgaaagatagataatttaacaaagagaaataaaattaacaatttaccaaattttagttatcgacaataatttgaattacatcacaacttattattagttagtatcacaaatgaaccaagagaaatgggtataaaaattaagagataagttgaaattagctaatagatatgtatcgggtcgggcatgagttaccgacaggtaaaaaatgaaacccgactgttacccacaatgtcttcgggtatcgggcgggcatatccacggataaaaaatcacacccacacccatgcctattgggtcgggtatccgcggatacccggacccatgagcaaaattgccatccctgagttatacggtattacaccttgactaattttctacatcagttcggccgatggccacggctcactgtagctagtggaaagtgaaccaaccagtagtacacgcccaatctgtattccacagagcttaagattaggtaacgacgcatgcggcagccatcgacgatcatgggccatatcttttgctctacaacatatatatatatcatcgatgctagaatttaaatcttaaaacttaattttaaagtttttatatcgtagtttttttaaacattaacgcttaagtcattaagaacacacgcgcgcgcgcgcgcgcgcacatatacacatacatacatatatacacacacacatattatatatatatatatatatatatatatatatatatatatatatatatatacacacatacatatacatacatacatacatatatatatatatatatatatatatatatatatatatatatatatatatatatatatatatatatatatatatatataagttttaattataaattaactctctatcactcacatatcgtttgatgtattatacataattggtcccagatggcggcccaaactaccggcctactgctagtactgtgagaactggacgacagcctatacaggacaggacgcgtgcacgtcggagcacccacgccggcagcggagacacggtgaggttgatgccaaagatcgattggtcgttttttttttttctcttttgtaagggaacatgcgaaatgctctcacgtctttgtattaaggaacgtgacggttggtcgtcgttctctcgatgatgaattaagaacggatcgtgagctcgttcgggtttctattaattctatttggctgccacctaatgacgactgaatacttaatttagtcgtcctctctccatgtggaattgtggatgcggcttacctgcagcaacagcagcgacgagcgacctgctccatccaccgacggcagcagacaggcagtacacccagcattcagcgctgcgccgcgcatcgtccgatgcatgagccaggcaatggaataaaatccagagatctactaacgccgggattagtaccagtgatagtgtggttgaccgatcaatacgatccagtgggcgacctcgaatggatctgggtctgcctaaatatcaatcccaacttctgcaaattctacgggagatttgtgggcagcaggctgtgctctcttgggccgtgtttagattctaatcttttttttcaaactccaatttttccgtcatatcaaatgtttgtacatatgtatggagcatcaaataaaaacgaaaaaaactaatttcacagtccgactgtaaattgcgaaacgaatcttttgaatctaattacgctatgatttgacaatgtgatgctacagtaaacatttgctaataacggattaattaggcttaatagatttatctcggagtttgcaggtaaaatctgtaatttgttttgttattagtttacatttaatactttaaatgtgtgtccgtgtacttaaaaataaattagcacacgaactaaacacagccttggtaaccaagtcaagcagggatccagtagaagatactcccaattagggagtttgactcgtagtaggttttgctcgagctctagacaagacgaatccgagccatctgtcaaagctcacgagctttatcgggctaagctttagctcataacgagcctaacaatatatgagttttatttttttaataaactagtagattaaatatgatataatatacgcacacaatgaaatagcttgtattggtattatatacttcatccgtttcaatttttataatgtatgaccttctagaattgtttatatttatataaatgttaattaatctagacttacatatatgagcgaatatgggcaatactaaaaagtcttacattatgaaatagaggggatcgagtatttattttttaagagattatcattgaaatatatgttgtactacttatgaaccaatctcgatatatagtcgagctgatcgagctcgactcgaatctggctagaagttcaaaggttaacaggctcgagttgagcttgtattgagctcgagccggtcggctcattgacggaagagcagcccatcagcaggtctcgaaggatgaaggggagatctcctccgaaaccagatgaaagaaaaatataagactaatggtaccgagaccaaagcaacttggcagtacgtgaaccatatgataatctgtctctctgcatgcaactgctaatttgcacatgtttacatctaaggtctgatgaggatggttgaccttttgcttatactgtaagtctgtaataaccaggaaaataatgtaaaacaggctatggcctgcccggccggctggttactggttactatcatactcgtttcgatggaacctcgttgctaatgagtaatgaacgtagagcccattaccagcccaggtccattaaaaacttactaccaagtgagttttttctttatgtagctagcccatcaagctcaaagctctcaaaagaggagcaactttattttcattttgcggaacacattaattctgtagcttatcaaagaggctaacagtaatttgtggctcaatcttactcgagtggctctagattagatggggaatttaactatttgccacttttaggtttggcaattatccaaatacctctcttaggctcgcgcttaataatttgccaaaggaaagacatgatttcttaattattttccacttttacatacgtggcgtgcccgcgtgaaaaacaacatggaccccacccgtcagccccttctcgctcattctgctcctcctccggctgccaagtctcatccttctctagatcttggcagcggaagcaagctagcatcggcggcgccgtcggaggcggacctcgcgcagctctcgacggtgaggaggtgcacggggaggagcggcctgcggtaaggtgagcaaggacctgatccatggcggcgatggcgcactgtgttgtcctagtgcctgtcctcgtcatcgcctcctcccttgttgcggcggcgtacggggcggccttgcgttcgctcagtgccaacgaaggcaagggagaggtcaacaccgacaccgccgtcgacctcatcaccaccagccgaacctcaacactgacgcagggtggtctcgccagagccgtggccatcgttaggttggtctcacctttgtctcctttttttttaatccctgcgaagtccaccttcgatgccccgatgccacgattgacgttgccgcgtcgctggttgatttcgtcgctaagatttggagaaggaggctgtgacggccggaggaggaaaaggagaggggaggggctgacgggtagggtcctcattgatttccacacgggcacaccacgatgacatgtcacgtaggcaagagtgacaaatagttaagaaatcatctatctccagtggtaaattattaagcgtaaatctaagaggggtatttggataattgccaaatctaaaagtagtaaatagttaaattccccagattagattggggatgcgtgaagttcaggcgagcaaggcatgtaaacactgacgcaaatcgcaatcacgcaatacatcactacagcagcagcggatcaaagatcaacaactccatttcccaaaatttaatccataatgaaagacatacactgatatacaagagcctaaacatttactaatcatcaacaaaagatagctaggaattaattaaataatacagctacgccaacagtgcgtacgtcagcaccattcaccccacgcttttttagcgcaatgtgtagccacccagcggcattgtcagaaaaagttgagggcttttttggtgcagccttggagtgttggactacaacaactcagtgcgcgaacgaaaacttttagcgtgttatatggatattaatttaaagtattaaatgtagactaataataaaaataaattataaattttgtctgaaaactacgtgacgaatttattaagtctagttaatctgttattagcaaatatttactgtagcaccatattgttaaatcatagagcagttaggtttaaaatatccgtatcgcaatctacacgtaatctgtgtaattagtttttttatatatttaatacttcatgtacggatgtgacagggtgaaaaattattgtttagaaactaaacaggctctaaattataagcaccgcgatattatcagaggtttgatgatgaagtcgatggtcatcatcataatctctctcaacgtgcctgcgagtctcattgccccccaactcccccgcccacgaaatgattcccctgctcgccggcgtatgtcgcaagcaacacagcgatccaacaacgagcctcgcgccctcgcggctccaccacctgcgcaccgccgcatctgcgttttctccgtgctccgaacccgacatccttcgccaccgggtccgaccggccggcccgtacccaaaaagtcaattttcccgggccccacatgtcagtgaggtaccagcccatcccccggtcctaaacaacttaaccaccggtgaacaactgagcaccgatgccccacctcgcagagataattataaagtattagggcctctttgaatcgcaggattgagaaaacgtaggaataggaaaaacgtaggattttaataggaatgtaagtttaaaacagaggattgcaaaacacaggaaaaacataggaatgaccgtttgattgaacggtgagagagagacttaaaggaaagttagcaagaggttgaagctcttgctaagggcctctttgaatcgcagggtagaaaaaaacggagaaataagaaaaacgcaggattctgacaagaattgaagtgtaaaacagaggattgcaaaacacaggaaaaacacatgaatggtcgtttgattggagcgcaggaaaaacgcaggaatcggataagagagatagactcaaaggaaattttccaagaggttggagctcttgctaaatttcctccaaaatccacatgcaatgtgtcattccatacgaatttcataggatttggaaagcttcaatcctttgaatcaaaggcccaaataggaaaatttcctataggatttaaatcctatgaaatttctacataaatcctttgatttaaaggggccctaaatttcctccaaaatctctataggattgtccattccatatgaatttcaaagaattggataggatttaatcctttgttttaaagggctttataggaaattttcctataggattgaaatactctaaaattcctgtgttttcctccaaatctaaggagcccttaaccggggaaatcgctacctaatctggcctaaccgaggtaattatcgagtgggattaaccttcgttcggggcggtgctcgggtcgggcgtccagatctcgggctcgctgagctgtcgccatcgacccggagtccctcccgcaccagctaacctttgcttccgttggaagcgccagccagcgctcgccgttgtcacctgtcacactgcgttgcacggattatcgtttttaattaatcgtcaccagattgttttttttctttctttttgcaaatctcgcttcgcttttggagtgggaggaattaattgtggagttgggtagatcgatcaggggcagcgcgagcgaggcccggttggtagcagtcggtgcgtgtttgtgcgtgtgcgcgctgcttctgcttgcatcgtggtgcgaggaggggagaggaggggtgctgctataaatacggctcagatctgggaggctttcttcctcgtccgcctccggtctaatccgattcaaacccgccgtttccaagcttgctctcctctcccccccaatccttccctcccgagtggcagggtgagcattccgccgctcccgtgtttttttttttgatccatctccgtggtggtggatcgcgatcgcgtgtgtggggttgaggggggtttcgattttgtggtttgggtggtgttggttttttttttttttttgggtgggggggggggaattgtgacgatctgagtgttggtgacggtggatctgtggcgtttttgtgcgtaccaggtgctcgacgggatggcgcagaaggaggccaatggcagcagcaacggggagcacaccacccgcccgccgccgacgccctcgccgctccggttctccaagttcttccaggtgattttgccgggatccgatcgctggatctcgccgtatacgtggcccgatcgctcgacctggtctgattgttcgtgggtgtttgtgtgtgtgtgcaggcgaacctgaggatcctcgtcaccggcggagctggcttcatcggctcgcacctcgtcgacaagctcatggagaacgagaagcacgaggtacggatgagatcctgtagtacgatccgtttcatttttgttcggcttgcttgtctattggggggtttgtggcattgacttgtgccggtcggtgaggtcaagctccgtccgttgtgaggaacagtagctagatctgagtgatctagttagggactgagggttcgagatctatatcagaaacggtaatgaatggagatgcttctgccagatctctggggtgcaagcttttctgctacgttttgcatggcgtggggttggggcatttatgtctgaaacttaagcttgaagcttctctcgagtctcactacctgagaatgttttccacaacgagagagatcatagatatcagtgtcaatgcttcagggatcttgctaggagtacttcattatatgccctgagctttagctttggatctgtttgagaatgtgagagttaatccaagatccagtagcaatgttgtagagatctcgctgctagtacttcatccatgataagcagagtaccatgctaaggcttgagatctttcttgcgcagtgcatatgcttcatattcacaagagtttgtactttgtagaactcaacaatgttgcattgttgccttgtgtgactgcttggcagatttttagctgagaaagtgcgggcctttgatcatgtgttcttttctgttcaggtcattgtcgcagacaactttttcactggttcaaaagacaacctgaagaagtggatcggacacccaagatttgagctaatccgtcatggtattgctacattctcagtgcatttagttcatgaactattgttacatactagtaataaagttttactgctagcaagttttttcgttcaaaatttgagaaacactatagatcttggttagtaaattacaaacaaagcaccgtattataattttggctttgagtcaatgcttacacaaatgcagtcttgagttgtctgttcaacagaatgtacggaatttctgcacttgtcattgaacctctcttagtcaagttcatctttctatcttattagattagattatgagtatgtttatgtgactttctattggtaaattctgttccaacttccaaacaaaagtgtatgctttcatgcttatatagttatatttatgacttatgaaaaagggtgtttggcccaaccatgaaaacaggctgatagatgttatcctgtgctcatcttgattctgtagtgtacttaagacactaaactttttttgcgatcagttctatcgtatcttcaaaagtatattattgtgagatattaaaattttgaccttttttttattcatttcagatgtcacccagcccctgcttgtggaggttgaccaaatctatcaccttgcttgccctgcttcaccaatcttctacaagcacaaccctgtcaaggtacagtctctattatatatataactctgttaagtccaactattcaaatacaaatcttgttcatgtcctgttctgatatttaaatggatgtataatcatgtacagaccatcaagacaaacgttatcggaaccctgaacatgcttggacttgccaagagagttggagctaggttggtgtttttttaatgctgattaacttgtcctatgcaacttatgagaactatataatgaagggaggtttttatgttgtactgcaggattttgttgacttcgacctctgaagtttacggtgatccgcttgagcaccctcaaacagaggcctactggggaaatgttaacccaattggtacgtctgttctatcacaaatacactacatttatcctatattttcttaatctagtgcaaagttcacttacttgaattgatttacttcatcaggagtcaggagttgctatgacgagggtaagcgtgtcgcagaaacactgatgtttgactatcacaggcagcatggcattggtaatatttttagttcatacctttttgtcttgtgatgtactggattgtagttctccttaataagtattttccaatctatctctgtagagatccgaattgccaggattttcaacacctatggacctaggatgaacattgatgatgggcgtgttgttagtaacttcattgctcaggccgtacggtaatgctcgctgaacttctttcaacattctctcaggttgtgtccagttggtcctggagcttattttcatacataattttacagtggcgagcccctgactgttcagaagccaggaacacaaactaggagcttctgctatgttgctgacatggtttgtcaccccttttgaaatgtcattaattaatagctggctgaaactttgatatatcattgcatcacatcatcactggtaccattttaatgcaggttaatggtcttattaagctgatgaacggggacaacactggaccaattaatttgggaaacccaggtagatttacctctgcattcgtttgatttttctctacatgtggtaatctgtactagcaatcctgtggtaatgaaattgattttcacgtccttgtcactaaatggtcataatatattgtgttgtaggtgaattcaccatgctggaacttgctgagaatgtgaaggaggtaagatgaatatcctgttgccgaacatcattccatgggatgtttctgaatggcatgctaagtttccctgcttttaccttgcagttgatcaacccagaggttaccgtcacaatgactgagaacactcctgatgatcctcgtcagaggaagccagacattacaaaggcaaaggaagttttggggtgggagcccaagatcgttctgcgtgatggcttggtgctcatggaagatgatttccgggagcgcctccaagtgcccaagaagaaccaggcctaagctgctgcatcgcatttggcgaaagatgtcactggagcatacttaatagttgggtttcaccattatttgtgtcgcagttcattgtggaatttgggttccaataaattctgatacacctttgttgttcacctgaaatattgtgttactagaatcgtcatacggggctgggctatttgtatcattaccgcttttggagaactctttatacttttgtttgtagcctgtgtactcgcctaaatcaattatagcaatgttgatgaatttttagcttgtttgttttattactgctgagtaccgtttcacatgtctgcctatttctttgctgagtattccaactctttggcctcaaataatctctttgcgtcagcttggaacgtagaattttcttcgatctctgcacaaactaaactaattgttgtgatttcacatctctagt

SEQ ID NO: 45970 - DNA, 2211 bp, Oryza sativa
gatgtgatagaaaagttggaagtttgtgtgtgtagaaaagttccatgtgacggaaaatttagaagtttgaagaaaaagttagaatctaaacagggcctaagttttatgcacggtccagccgatagcattgggaggtcagtgcaggcgatagcagggaggttgcccaaccgacgacgtgggaggacgtggtggcatcagggaggccagtgaaggtggtgtgccgcagaggcctgcggcagctgaccggcgaggggcattggttgagcgatgtcctcgcgttgacagagacgaggggcgttggttcagcaatgtcctcgcgctgacggaggatggcatgtggcattggttcagcaatgtcctcgcactgacggaggatggcctgtggcagagcaatggagcatgcagatcgatattggttcagcaatgtcctcgcgctgacggaggatggcctgtggcaaagcaatggagcatgtagatcgatattggttcagcaatgtcctcgcattgacggaggatggcctgtggcagagcaatggagcatgcagatcgatattggttcaacaatgtcctcgcgctgacagaggatggcctgtggcagagcaatggagcatgcagattgatattggcagggtgacaggtgtaaaacctagctcagctttgtcagcccgacaatgataacattttcggtatcgtttacctttttaggagcgctgtcgagatgtccctctctctctggtggtgttgtcgggggaaaaccctatcttcgttctcctcgagaccttgatgaatgcaacactgctcatcgctgcttttctccatggagatgtcgtctaggaggccctcttgccaaatcttctcttagatagcttgtttgtgctttctctatacgtttgtcctcttatgatgacacactagctaatgcaagctaaccatgttggcgggccttgtggggaagagcggttccatccttctcggggcatttaactttctaccacttttaagatgtggcaattaagaatttgccactagcaatctatgatatgtgggcctagtggcaaatagttaattattcctggttttgggcgattcggttatagctactttattgatctagtggtgactggtccggtgccaaccttctcttgggttctatgtgttgtcggtgcgaggtggtggttttattctttcgcgactactgccttacagagtgctagccttgcaattttttcttctctattcaatgaatcatcgtttcgtctggcgttggtcgttcaagataaatgaaattcttatactacccctaaaagttgcaacataagattagatgatgaggcggaggagagataggatgagtcacccccttacgcaagggaccatctttacataaactttcaaaacaaagtgagatggtgtgagagtgaagcaataaaaaaataattggatttttatgtgttggaagtaaattattgtatacgttgcctcttaattaatactccctccgtcccaatatataagaacctaggatcggatgggacattttctagtactacgcatgtccagatttgtagtactaggaaatgtcccattggcatgtctagattcgtagtattagaaaatatcccatccggtgctaggttcttatatattaggacggagggagtatgtagatgatataattaaatttagagatagcagtcattcctattataaaacttgcacaaacagagctgagcagctgctactgcttgattgattaattgaatatcaggttgtaggttgtaccgagtaccgtacgtacgggttaacaaccacatactgtaacaaaagattagggctacccaacaaaatctggtcttggcattttccgcaaacaaacggacgaatcagcagctgtcgtgctcagaggtcagagctgattggtctcccctgcggccttcctgtactgttcctaatctttccgggctgttcttgtacggcttcccagcgcaaggaaatctaggagtaacaacattttgcacggtctggagcattggttgcatgcatgatccaaagggtggagtcgtcttgcaacagcgcatcacaatcccgacacaacaccagcattgctaagctagcggtgacctgacctcatgatattatatggaacttcaattcgttgataatactattttttggattgtttgtttatcaatgaatttttattctctctaa

SEQ ID NO: 45971 - DNA, 18259 bp, Oryza sativa
ccccctcccctcctccccctccccctccccctcccgcatcacagccattcgccacttcaccaccaccaccgccataatccgtctcgccccgatccagccggctcgtcaccgacgcgacgccgccgcggccccccagatcccgtcgtgcgcgcgcgcgatctgctctcggtgagcgcccacttctcttcgtctccgtcgtttttttttccctaggtcggtgtcgggggatcgccccgcccggccgggttggactcgtggatcctctcgtctgaaatttgttctggcgccttgagggggggatagatctggctggcccgtgcggttgtgcgttgtgatctggtgtggcgcggggttctcgtgcgtgcgcattccgcgtttgcggcggggagagggatctatctgtctacctttctggtgcaggggaggcggtgagtggtgccgatcaccgttgttttgtggttcgttcgttcgttctacttggttgtggatcatggtgagcattgccgttagttagtacatatcacaatcacaattgtttaacgtgaagaatttgattatttggtaaattgaaggctagatcatgaagccgaggtgctgtttggtactacgagagagacttcgcacacacacactctctctctctctctcagggatccatgtttatgtcgctccttttctcaaataaatcgatactagatcagttgcggtttttgttttttcttcattttccatgggtgttaactagatctgctttttataattttaactctgtcttggggtgccttttatgacgtcacatgtgaggatactcttctgatgccattttgtacacatcagcaggcgaagatggcggcttacgagcccaagaacattcttataaccggcgctgctggtttcatcgcatcacatgtggcgaaccgcctagtcaggaactatccgcactacaagattgttgtcctcgacaagctcgattactgttccaacctgagcaatctcaacccttcacgtccatcgccgaattttaagtttgtcaagggtgacattgcaagtgctgatctggtgaactaccttctcacaactgagtcaattgacactatcatgcactttgctgctcagactcatgtggataattcatttggcaattcctttgagtttacaaagaacaatatttatggtacccatgtccttcttgaggcctgcaaggttactggtcagattagaagatttattcatgtgagtactgacgaggtgtacggagaaactgatgaggatgctgtggttggcaaccatgaggcctcacagctgcttccaacaaacccatattcagctacaaaagctggggctgagatgcttgtgatggcttatggaagatcttatggccttcctgtgattacaactcggggcaacaatgtatatgggccaaatcagttccctgagaagctcattcccaaatttattcttttggcaatgagaggcttgccccttcccattcacggtgatggctcaaatgtcagaagctatctgtattgtgaggatgttgctgaagcttttgaggtggttcttcacaaaggagaggttgggcatgtgtacaatattggtactgtgaaggaaaggagggtgattgatgtggccaaggacatatgcaagctctttggcttggacaccgagaaggtcatcagatttgttgagaacaggcctttcaacgaccagagatacttcttggatgatcagaagctgaagaaattgggatgggcagagcgcacactatgggaagaggggttgaagaaaacaattgaatggtacactaacaatcctgattactggggagatgtcgcaggtgccttgctccctcatccaaggatgttgatgacacctggagttgaaaggcataactggactgatgagatcaaatctctttccacttcaccagatgaagctaaggaatctagcactgcggttcctgcagccactgccaaaagcaccagcagtgcccctcaaaaggcctcatacaagttcttgatatatggtaggactggatggattggtggtctacttggtaagatatgtgagaagcaagggattccatatgagtatgggaaaggacgcctggaagagcgctctcagctcttgcaggacattagaaatgtgaagccaactcatgttttcaatgctgctggtgtcactgggaggccaaatgttgactggtgcgagacccataaacaggatactatccgcaccaatgttgttggcaccttgaaccttgctgatgtttgtcgtgagcagggcttgttcatgattaattatgctacaggttgcatatttgagtatgatgctaagcaccccgaaggatcaggaattggttttaaagaggaagataagcccaactttactggttcatattattccaaaactaaagctatggtacgttcaagtcgtgtttttaagaactataacatctatccttttatttctctcaggtactaacgtatcttttattataatgcgatgtaatgcaggttgaagagctgttgcaagaatatgacaacgtctgtacgcttcgagtcaggatgcccatatcatcagatttgagcaacccccgtaacttcatcacaaagatagctcgttatgacaaggtggtaaacatccccaacagtatgacaattttggatgagcttttgcccatctccattgagatggcgaagcgggactgcaggggcatatggaacttcaccaatcctggggttgtcagccacaacgagatcctggagatgtacaagaaatacctcaaccccgacttcaagtggaccaacttcactcttgaggaacaggccaaggttatagttgcaccaagaagtaacaacgaaatggatgcatcgaagttgaagtccgagttccccgagctactgtccatcaaggattctttggttaagtatgtttttgagccaaacaggaaggttcctgctaactgaagatttacgggcgcgggcgggagttatggaggttacgagcgcgggcgggagttatggaggttattgcacggatgcagttgtgaccatacttttttttgtagtttttggttatatctggtgttttgttaagatacatgtaggtgaactacataccgttcgatacttaacctatttatttatatattcatagcaattcgtgtgcacggcatgtgcatattattttttttgctttggtttgtgcggtggttcagaatgtatctcacctctacgttgtactctttgaactacttactctatctaaaaaagggcaattcttacatattaatttgggctcaaaacttttgtgattgattgatgagcagccgacgatctggtagcgtgagagtgaatcctccgttcggcatcagcatcggatgatctggtagcgtgagagtgaatcgtccgatcggcagtagcatcggtcgatccggtagcgtgagtgaatcctccgatcggcggtagcgtgagtgaatcctccgatgctccgatcggcagtagcatcgtctcatttctaaatgtattagtcaccttaaagtggtttctaaatgggattagtcgccttgcaattttgcgctacagtatacaaaattctcgcagcaactaaacattaacttccctacaggccgcaatcgacaaagcatggtcaaatacgacggtagtaggtacaacactgcacgatcacgataccaaattacaaattacatcatatgcttttaccatcgaaaccgtgacaagcgaaccgcaaaaatgcagcaaccacattaggcacgcctgaagtatgcatagtgaaaaatggccaacgcatcaaacaaaagactcgcatgcaacaaaaatgcacaaaccaaattaggcacgcatgagatgcagtttagcatagtgaaaacgcctgacgcatcaaacacaattcaatatacggtatttaactggcaacattgttcttgcaaaggccactgcgaaaacatgttcaccaaaggaagaagtcaagcagatgacagcaatgcttgagggcaaaaaactgcaacgcagaataaacctcaagcctcaattacaacagaaggagcaaattgaaatttccacatctatcacctaggagctttccacattgcaaacccaaaaaaaaaaaaagtaaacctattttgctttatgtaattgaatctgggcaaagaatctaaacgattatttcaattccagttaacctaatgccatctaaatgatgactacaccgtaccatttccaaaatactgaactgatgccattgacattgcctgacaaacatgaccatcgagccagccatcaaaatttgcctcttataaggttatgaaatttgttattcaacacctccaatcaagtaggccaacacttggatgatactcaaataatcaataaactgagaaatccttattgatgagcaacaagatggatggatccttctgttgaaaactgagtgcaacagttgaaaactgaacggcagggcagaaacatgagcataatagatggatcttcccagcacagttacatgatcatgacatacctagttgggatactaaaggagtttgatggctatttttaatgaaaatgaagatccactgcaatgctaacatcacacagaataagaaggcaatggatggagggccaagaaatgaagtccaaagcctacatatgctgttaagacttgaataactatcaaatatcaatagcaaattttaaatcagaatttgcacctcgatgcttcttcaaactgacgatcagctggctagaagatagaataatcatatgacggtgcagattttgcaaggaggaaatcaactttaaaatgaaagtgacccctccagccgctgtcatatgaatcactaacgggtagaagaatattgctaagcccaaaatcaacaatagcagaatgataaataacaaaaaaagcaccagccacctgcaagatgagaataaaagaacctttaaacacatgaaacagaagcaaataaataaaaagaccaataaacagtagtaaatatagataaacagataagagatgatgcatacctcattgaggatggctgagccttataacccttgtacagagaggaacaatgtccaaataaccatgcaacaatgccgttgaagatgatgtatgttaaaggagtcagaagatacgagcacctcatacatcttcagtaacttctgtatgtggagcaactcgagcaggccttcactccgcagaaaaaggaacataagtggcaaccaagtaatattcataacagtgttcaccagcatccacttaactctagttctatgtagacacataaaaccgtacaattcagtaaaccaagacccgacaaacaaaggttttgttgttgccactgaacatggtagcacaaatagcaggaacaagcagataaacatccttcagatttcatgttgaaatatcaacaccgtgaagatctagttggtctgcatcgcatctgcatggtatttctccaagtcagcatcaagttcttcagcagactttggctggctacgctctttgccacggcgaccaccggatccaccaggaccaccactgcctcctccgccaccacggcgcctcccacccccccttggacgaggtctaccctgcggtagtccagctgggccaccccttggtgcactgtaacatttcaaaaacaataaaggtaagttggcaagatcttatatgaactggagaatgatcagaagtgcacacaaaataacaagaacgttttgaaaagcaaaaaaacaaatcaatcgataatgagatatcaacatctctgatacatagatacaattttaggcttttagcaacaagtgcaattataaacaattaacagaaagcatcacaaacaaccaatgtatataatcagtcaccatgtttgacttgaataaaaaattcatgtgcaagaattttctgaagatgatgaaatgaaatgaaaaatcatgcaagtgttattttgtggagcacagatatcaaattatagaaaatactcagtagtattttagcatcagccctcacaatcaaaatacatcacagcagtgatgagcaatcatgcaaaactttagcatacaaacaaataaaggataatgtagcaatccgaacatacctcttagcaacatttctaacgtagcctccgttatttgctggaagagcagctgcagctgtaggagtattggtcccaagaatctctattttcattggcttaccatcaagttgcacattgttatatttcttcactgctgcgacagcatcgccacgccttgcaaatacaacttcagctgttccctggaagggatagacaaaagtcaggctatcacataaaaaacaaaaaaaaaaacaaatgcatgtaaagaagtgtaagattgaatctgtaccttagacctcccacttctgtcatagtgaattacgtatttcttaagatcacctaattcagagaaaagctcctgcatcattaaaaaataaataactcagaaaaatgcttaagggaaaaacatgtcacatgaagatttcaggcaatttctactggctaatgatatctacttaaatgatcacattgacatggaatttgatgaaataggacagtaaaaaaatatcctagaagtagacaataattaattgtcttaaaaaattcaaataacccatgggtcaacatacaaatcactaactagagcatatcactatctttgcacaaattaatcaagaccttttttcagaggaaaaaagatcagatctcgatggaccagaattatttaacatcagatcgaagctagcagtatgaacaaaaccaaaatattgctggaattttacacatgttcatgctagatctggcgaatagcttaagctaatcacatatgcaaccaaatatctgctttcctctagcgctaattgctcagaagcgactaactcaacgcgattattatataccttgatatcctcggtcgagacgccgaagtccaaattggagatgtagagcttggtgccagtctcgatagccgagaccctcccgcctccgccgctgccgccgccgccgcctgccgcgacatccgagtacatgtcgtgctgccacgccgattcaggggcctggatcgcgtcataccacagtgagaaaaccacccgaccatccatccacatccttccccgcctcgccgtcgaaaagcggaagcccagctcctccgccgacggcgcgcagcaaaccctagccccacgttcgatccgttgctgttcgtaccttgggcggctggtagggccccgccctgttccccgacctcttgaagggccgcctcgtcggccccacgccgccgccgccgccaccaccaacacccccacccccgccgccgccgccgccagcggcagatccgcggcggccgcggccggacgaggggttggccttcttgttgttcttgatgatgtcgtcgagcgtcatgtcgagggtctccgccatggcggctgctcgggggcgggtagatctggcgcgctagggttgggcgagcgagcgagctcgacgacgaacgaagaggcggcggattcgggatttggggggtggaggcgagagcggcgttagggttggggaattgggagatttttttcgtcttttcggtggcgggcgcgataaaaataaaggggggagacggacgcgtagggataacgcgtggtgaggcggtcgcgagagagacccacgactccacgagggcgtgatgcggacgggaaggagaggagaggcactgattggattggatattgggatgcctgcagtgccgggtcggggtctggctcggggtcgcctcgttccgttgttccgagtatttctcgctggagtatcttgggttcgacctcgagtgcttatcttcctcatgttctttttttttcgtggcaagtcggcaaagtcggttgactagtactcactctctgtttctcaaaatatgaaggtttttaatattcagactttatatcataatataagcaattcaaaattcaaaaggtaacaaagtgacttaaaagaaatctttttgacgtaaacttagtatttcctagataacccaggaatccttatatatcgtaatggaggagtatttgggacaaccacatgtcgataaaaaaaatattttaaatgatatcatttaaagtactccatccgtttcacaatgtaagtcattctataatttcccacattcatattcacattcatattgatgttaatgaatctagacatatatatctatctagattcattaacatcaatataaatgtgtgaaatgctataatgacttacattgtgaaacggaggaagtaatatacatatataataaaatttcctactgcacaatatagaaaagagctagtaaaaaatgattgtctactagaaagagaaggtacgagagatggaaacattcttttatgtacagagatagaggtagcaagcgcataaggggaagcaattgaaatcaaataaaaaatgtgatgccatatttttagaaaatgtgaactaatatggacaattgtgttaataaaaaaacatttggattatgcatgcaagatagtgagttaagtctcacgcattgatctgttgagtagaaaaatggacaaagtaacaaaataaaactcttatatgtatgtgtccttagtgtttaaaagctggagctagaaaatacctctaaagtttcaatgttcaaaatttagcaacagctgataagcaaacaggaagatacggaagttcttctacagatagatgcgagaaggaagaagaatactagtgtatgatatgtgtgggcagtacaagtttagccaccaacatggcataaaaataggtgaaacttgcccaaacttgaaagtccaggtgggaaatactcagtccggtagcacgtgatgaaaaatgaacatccggcgaagtttcgaaggccgtgaataaacatgtgctctttcttaaccccagttgccactagatggtcataattaatctcagagagaaccttggaggttggggccgtacatagcacaagttcagtcttttgcatgaaacaccttgtgggagaactggagaagacagtggaagatacttttctcaagcagacaccaaaactataatttctcccatgtataaaaggagatccgatcgtttcgatgctagaaagagagagagaaaaaaaaactcccgtctactgctccacatggccgtgtttgggatccaagttggcgtgcatgtgctcccaccaaggcaccagccaggctccaccaagcctgccttattcttggatcgattcactgattcactcattaatctatcttcattgtctgagtgcgtgcgtacagtctgttcatgcacgcgtctgatttttggtagagatagtaaccgccactgaactgccattagcaagagacgcatggagttttggacacagaaaacaacggcagtaaactatacaagttctggttttatatttattctgcgagtttgatttgatcgcaacaatgtttgcttacaactgcaattgtgttgctgttcatgatgataacgattgtatccgagcaaaaatttgtcttttcggtcaaatgccaagacagcttcgatccaaccagcctcacattccatgcaacaaaaccttccaagagtggactcagggcctgtttggttggtgacctgacacacatgcctgatgaaaactcatgcctgaagctagcctgaaagtttaaagacatttgcctgaccaggcagcctgtgagatgagttgtttggtttgaaccatgtgcctgagaagaataatgcaacgtcaaactgtaataattactcttaacagataatattaactcaacaaacatgatcaatcggtgggaagaatgaaaaaagcaagaaaaagaaaaagtatgtaattaatagtgggacccatagctttcacatcaccttaatcttgctagcttctcacttgtctgagtcaggcgttggaatttcgtcgcctgagccaggctaatcaaagcggctagctgtcaggtcaggctaccgcaggaacacccaggacgccaaccaaacaaggtacaggcatgtctcaggcaagcatctcaggtcaggcacaaacacgagggcagcaaccaaacaggccctcacacagtcagcttcagcctggaaaggctggattagtaattaaaaaggataatacgcgtcatgtcgcatcaaaagatgtcgagaaagtaggcaataacaaaggacgtaaagcctatcagtgcctcatcaagttgggtggattggcgccaaacaaagaaaagcactataacaacacagccaaccgatatggaacatgttacacactggccttttggacagactatcaactagagcaaataatggaagagctgatacagctgtaggaggtccaagacaaaaaagaaaaaaggaaaaaagaaaaaaaaaagcagttgaaacaataaagaatatgagaggaagtttgtgtagattacagtttcaatttgacatttcttagtaattgtgatgacagtttcagatgagccccattgaccccggaacataccactagacatagttgtaaacaacgtacaaaaacacaaactcttttacttgacccttttagtatcctgaatgatacggaccatcggacgctcacactttctggcatatataacttctccaagtataatatatctctagaaagaaatcaacctcagcggaagccgccttccgtccaataggagccaccggtggttccgttctgattgctccccttgctgggggtgctgtgattgtaactatcaaaattgtcatccttcccatcatcccagccggcccaggagtcactgctttggcgttctttcgcaggctcatccttcttgactggctcatcccaatcatcccaggaattggaattgtaattctttgatgaaccatcatgagaagaagaattccacccattaccattggtctcacgctcaaacctatggtaaggctcactgccctgctccctgcgttgccaatcatccccccagccattcccaccttccttggcatactcctcaaccttttgtgacgctaacgccattacccctttcataattccccatgttctacttccaatctctgcggttttattggcaacaacatttacagtttcattcaccttctgatcatagcccccttccctcatctgcattccagacaagcacaaatcattaactgtgtaagacaaggacaaagctctccggcaaataatcttaaacacaacatgttttatttagttcaatatagtccatagtaacattgattcttgaggagtaaacgatgatcacgagatttcaataattaagtccttgataggaaaatgaggtgggaaatataagcaaaaatgtactcacttaataatgctggtagaagaatatggctcaagatacagtataaatgatattaagagattaggcttgatgtaagacaatatcaaggagacacgccagtaaagatctattcatctatattccagtattctgatgagtgcaggttaatatatcattacaatcagattgaaccatgcaactaggtaagcacagtaaactcagagaaatccatgttctataaaaaaactatactctggaaattcaacttgggatattacaaaatcagctgacaaacaaaaggtacctttgattggaactcttttgtgccaacttggacaacactggcagcagactgggcagcagatgctgcaactagtgaaagccgtccaattccctggagatgaaatggtataggagttaaactgatggacagatgaaaataaaaggtgtaatactggcacaactgcgtctaactagatacacacatcaccctaatactgaataataataatatcaagaactgtttaaccaacacacagatttaacctggactcaacaaagataatgatatatgctattttgtgggcatattaggaagagtattacaaataaaacggcttaagcatgcttaactattctatatattgtccatttggcacagcgaactctattacaacagtgtcttcaaaagctacattttagtcgctgcaggaaacagggcatatcaaattttcaaggtgatgctaagacctattggcaaagaatgtatagcttgacaaaggccacccaagatacaaaagtaagcttaaaaaaagagcagtgtaattatatctaagagagaacctcagttcacaatttcatagcataaaattaacataagtaaaagatgatatatcattggcaacagaaatgacttcagggaagaaagcagcaagtgatgttcatgtaacaattgctgcaatagtgcaatactgccattcaacctcaacctagtaataccatgagcatctatagcgttttatcacttgtagatctaaagaaaccagatttacgatacaacagtatatccctttgcagatagatgatctaaatcccttaactacgaaaaatacgttacaaactgggtaagcacaaatttgtatttactcctttgaagaaagatgatctaaatccctaaacttccacgttataaattgggcatgcgcaaaactgtttattgcaacagttagctaaacatatatagaagtatagaacaagtaataccgacgtagcaagaatttttacctgggagacgacctgcatgacatcaccctgagcagcagcgccgttccgattcgccgacggcgccgggctggagccgaacccgacgtatttcccaccctgcgagggcgggatcccctcgggcttcgactcgttctccgccatcctcctggcgaagaagctgtccttgttggccgccgacgcctccagctgctgcctcgtgtacatgtcctgcgtcgatttggacctcggcggctgcctccctgattccgcccccgactcaccgaacgaccccaccgactggttcctcctcatgtcgggccggaaatcgtcgtcccagtcatcccatccgccgccgccgccgccgccgcctccggcgggcaagggtggcttcctggtgggggcgggcgcgccagatccgggggtctccttcacgacgggcgggtcggtccacgggcggccctcggcgacggcgacgatgcggtcgcggtacgcggcggcggcgttggagttgtacttggcgacgtggggggtctccttgggcacgccccgcgcggcgaggaaggcgttgaggcggtcgttgccgccggcctccatcttgcggagctgcgcctcggtccacgagtccatggtgacggagcggacgaagctgatgtgcacgccgagcccccggtgcttgcccgagcactcgaggcacatgaacaccccgtacgagacgctcgcccactgcgggttccgctgcgcgcagtccacgcacgtcttgttccccgcctgcccctgcagctcccgtagccgcctcgccgccgtcgacgccatcgccgccggatcggatctcggatccgggaggagaggaggtgggtggtggtggtggtggtgatggtggccgcgggacgcaaggcgaggggaaagggggaaagagtcgccgacacgagacggggggattggtcaaatacgggctgcgtggacgcttttgccccccgtcactgcccccgggcggtggcgaggcagtcccggtaataacgctcgctcgagcaggggtaggtttgggagttcggtaagccgtggccgaaccggagaaggggtatcctctcccgtgtcgccgataccccgggcccagcgcgcaggtggtagaggaggctgctacacatggaacgtacgatatttagcaaaaaaatcggacgttgttcacccacatatctgactatatataaaaaaaactatagtagttaagcagctacgctgcaagcctataccctactctcatgcatgtatacatgtaatctctctctttattttctgtaccctttaaactttttcgttctaaattacttatccgattttaccattgtgttctttacaattaaatttttacaacaaaatcttacttggctatatttctgataaaatttataaatatgattatattactaactgaaacatttatatattaatagaaaaaatacacgtgcgttgcaatgggagaaggctattttaatcgtattattgttagattttttttatttaaaaggtatatgggatttttattttggagtatagatatctaattcagaatccttattaggatgatggttagttggttacatcctgtacatgctttattatggtctggtgagaattttgaaacaattaggagtccgactctcgtcccaagttagcatgcgagatttttaaaagaatttcttatacgactacttatgtatttccaaaaaacgaacaaacttaaaaactaactcaaataaggacgacgtatcaaagtatcagcggaaacatcttcaatttttataatagtagagatacgtgaaacaagaagttataattattaaaacattagaaaatattcactgcaacatcccaatcaacacgtgcaacatttataaatgaattaccgaaacatccaataataccacatgcaacattcacaaataaactagtgaaacgtcagaaaaatatttattgaaacatcgaaataatgccatgcaacattttatatgtgttttagaaaaatcaaccttttgttgcaccataaaattgttttatcacttgtacggataactcagcccactctaaaaaaatatttctgagagatgtaacttataaaaattactaaatgcaacaataaccaccgtcacatgaaacattaggtcccaactaatgaaacataaaaaaaagattcaatatatttgcaaatattgatttgttaaaattttatatcattcttgaaacgttaacctgcaatttttgaagcataaaaaaatatttgctgaaacatataaatagatcatgtgcaacaataactatataaaaattattggctacaataataaccaccattacatgaaacattaggtcctacatttgaaaacataaaaatatatataatgcaacatatttgcaaatactttattttgttaaaattttatatcactcttgaagcgtcaagttgtattttttgaaacacaaaatatatttattaaagcatataaaaagaccacatgcaacattacatctgaattagtgaaacatgagtaaatacttattgaaacattggaataacattatgtgataaaaatcatcggaatattgtcatgtgagatcttgttataaagagttaattgtaacaaatccaatagtataattagttcataattccgataaatagtttaagagaaaagatcatttaaattttaaatccatgtgacttgcatgtacttgtcatttaaattggatgcatacacttgtcatgcacctgcactactactactccattggttgcatgcatttttcctccttcctcggaagtatgatgataagcattttcgggagagttccagagtttgctggtggtggtgggggaaaacgtacgaaacaatcggggatgaatgaatgggtgattgattcggttggcgcgtcgtagcgagcgagcgcgagaggcgcgggtggccaccggacgcggcgttgtttcggggcgacgcacaggtgggtgggtggatggcctccgagcaccgcgcggcccgcaaaacactcccatccaacgggggcggacgctcctcttcctcatcttctctcgcacatcacaaagaggctgagacgtctcaccatttacgagttcctttttttcgtgaaccaaatcacacctcgcctgcagtgtctcgtgtcccagaacgcgattgcgttttttttttgcacgtttggtttccatatccctcgtctcttgtactcccttacccacatttggcctagccggaggcggtagccagggcccagggctgcttcttatggccgcgcaggagatggaggttatgatggttgcgatggcggcggaggcgccggtggctgtggaggtggaggcggttccggcggtggcgggggggctaaacgcgacggtgcccgcgttgtacgtgggcgatctccacgaaagcgtgcgggaggagcacctgctcgaggtgttcggcaagattggcaccctcacgtccgtgcgcgtctgccgcgacaatgccacgagcaactccctcagatatggatacgtgaattacctctcccaggctgacggtatacaaaaaacctgtgcatgatctgtgtcttattaatttatctcatgtgctattagcattattttgatcgggttaagtgcataattgagttttgcatagaggtggtctcagtactcgtgcaaatcaaaacacttggtatatttacaaatctgcatgacattttgtatgaacaatgtgtcactgaacaagttaaataacccagatcatcgcacttattttattgacagtgtgggggttgatgcatgcatgctatcatattaaccgttatactattatccatagaagtagttggatgtattttaggatgtatagcttgtgttccgctagctgctgccacatgatagaattcttagttttaagaatgtgtgcgggcatcgcttgttcctttctttcaactaaaaaggtgcgaaaatctgatcatatgcccttcgcctagattaaaagtatttacccttttggcccacatgcaagccaatctcccaaaacaatgtgttgttcactaattatgttaaacaaagaagttacagaggaattgaagttgatgtggtcatgtcaaataaggtttagtacaatgtatcctgtatcaacatgatgaggtcgattatattgtttaacatatatcttcttgttacatttgtcactttgatttttaagagttgtatttgtaatgagatgtataatgatttatcttattcttgaaaaataactctttatttttttaatctacttttattagtttgtatgcaagtcattaaattgaccatcgctatcttgttgtgactttttattttgtaacatttgcttatattttgtattattgatttattttgtattgaaatcctagaagcaacttatccaaccatgtgtgcctttcaattcatgccatgttttatactaatgatttagcacttactttaatgttcttgttatctaaccaacttttcttgctaatggatattgataaaattctcattactttttaaacatttgatagctgcaattgctttggagaaactaaatcatagtcttattttggataagccgatcagagtaatgtggtctaaccgagatccagatgctaggagaagtggggttggaaatgtgtttgttaaggtaaaaaaacaaattcctcactatatactttcttggtgtatattgccatatttaactgctactttactatggcattttgcagaatcttaatgatttagttgacaatgtaagtctacaagaattattttgcaagtttggagatatattatcttgtaaagtcgctaaaaatgaggatgggacaagtagaggctatggatttgttcaatttgcgttgcaagaatcagcagatgcatcaattcaaaatcttaacaactctcatttttgtggcaggcaattgtatgtttacttctttattattactcgtctttgttatttgtttattctttgtccggtcatagtttggtttacaattatgatcatatttatgcaggcatgttgctacatttattaagaagagtgaacgatctacaaacaatgatgacaaatatactaacctatacatgaagaaccttgatgatgatataacagaggaacttattaagttaaagttctctcagtatggtttagtaattagtgtaaagataatgaaaagagatgatgggacatctaagggctttgggtttgtaagttttcaaaacccagaaagtgccaaaagagcaaaagaatccatgaacgggatgctacttggtaatagtccacttatgatattaaaataattaaatagtgaaaattcattaagtagtgaaaccttattattctattcaatttgatatacaattgtttgtgaattgttttattaggatcaaaaaccttgtatgtagcaagagctcaaaagaaagctgaaaggaaacaatatttgcaacgcttacacgaggagaagagaaatgaaataatcaccaagagcaatgtaagttccatttgccctctacaatctgtttttttcatctaaaaatgcatctctctttttttaggggtcgaatgtctatataaaaaatattaatgatgaagttggcgacgatgctctccgtgaa

SEQ ID NO: 45972 - DNA, 3687 bp, Oryza sativa
tcggtctacttcatgtcttcatcatgttggtttttagtgtttttgcaacagtgctctatttcaattagtttcaaacttccatagtttttttttcaacaacattagtctctactattgtaagcaaaagcttttatgcttaattgtaagtttagtattattagattatcatactcactagatgttgttatgtgacatgtcactatgaactaagttgttcattggactttgtagcattttgttacgaagagtttaacatgctatccttttgaatttacgcagcgatttagccatgctaagtatattccaaatgacatcatggccaatggattggctattcatcatggtgactctatttcatcgatgaatgacgcttttaacaacctgctagctactgctccacccgaggaacagaagaacatgcttgggaatagactatatccgttggttgagagacatcatgtaaaatattttgcgcatatgttacattgacataccttttcacttatatttggaatattaaagggacatacttttatattaatatgacacgccttgttttttgcagcctgaccttgccagtaaaatcactggaatgttacttgagctaggtaattctgaagtggtcatgctactttactcatcaaacatgttgtctgccaaaatagaggagtgtgtcaaactgctccaagaggtaaaacccaaacctgaagatcaagaggccctgcaccctggtttcctcctagactctgctggtgtaaacgccaactaagaattcaatgccaatccaagcttttgaccgtgctaaatatattatgtatttgtgttttagagatgctaattagatagatgctctttatttcatagtttatggaactatattattgggcttgttatagaacttactaataatgcctaggatttaggtagaaatctcgggagtttttcttaaacggagcttgttacgaatcttagataataaattatatatgatggtgttcttgtgttatatatattttatttggtttagtgggttggttcttaatttttatggatgattcgaaagtgtttggaagttatgctgcctataactatcttaatcaggttgatcgaaaagttagagaccaaatactcattgtatttatttatttccttttcttttcttatcaagacattgtacagcttaggtaaaatacaatagaaatagtgttttacttggttacatgttggtagccgattggcttacgtagagatagtggtgaatgtgtttgacgaattgaagtgtattgtatactacatgtgtcttccacagacaattgagtctttgcacaaatgcaccatgtaatgcatggatgttgcaagcttgcattatatgatagctcattgtggatggcttgttttggcccaattataaagttgcacggttactttatcccttccaaaaactatggtgtatactatattttggttggtaaaaacataatgaacataaaaaactattaaaaacagaggtggttttcttttgatgatgaaatgaaatgctttccaagaaagaaatacatgttaactgtagcattcagttgacaatattccattcatgttctatagtttgtttcatttctaactccattgagttacttgctattagcttctcgagcgtcgccatccatcggaaactgattggacttgctttttttttgtctcaaacttgtggaagccagaaagaatttgcattgttgttggtagtacatcaaagttggttggataactctttttttaaaaacttaatggtttttagttgattccctattaaagttaacattttttggaaagaattccaatgtctttagaactcatattctaatctcagaataagacatgatttgtgttgtattgagttttgtaatgcaaacaatgatgtcggagggtgaactcctcaagcgggggattatgagaccccccccctttagtttggttgggggcagcgggtgagaatcgaggatacggtggaagatgtgatgtagaaggggtcgggccctgttacgccctgaaattcatgaaccagaatttctaagctgaatgtgcattaaacccctatccaggaccagccagggtacacaaacgacaattgttgacatacagatccacgtcttacaaaaatacaaaagattataaatgcagcggaaaaggataaaagcgagctaagcctgaagacttgacacctgcagcgaggcgactccattccaaagacatccttgacggcagcgacgaaaccaacttcatcgagacatctccaactgagaagaacttcaactctagggtgggggaaaagagagcaagactgagtactacccactgtactcagcaagtcataccggaagaggaggtatgatgcaggaaatatccaagggaggctaaaggtccttttgcataaagctagcatttaaaagcaacagctgaaagcagtaaaacagctgtagtaattaatcaatattaaccatcactgtcaacgctacaccatgttgagtcaggcccaaaccaccacctgaactaaccagttcattagctaactagggtgagactaatcacggtgaatctggtcgactgcccataaccgtgggcacggctattcgaatagttttactctgattagaggtgtacaactgtacccacaagacacagccccacgacacgttaccatgtgccgacatgccaccacgacataccggaaagaggccgtgacaggacccttcgcataaccccctctaaccgatcgcaccacaccttagggttcggccccgtccccaacaggcaacgggcagcccccctttcgtgccgcggtgaatccggaagccgatcaactggacaccccggccgacccaactccatcacgcccaccctcgcctgggtacgtcggctagaggaaagctacactacaagcccagccgttgcccacgctggcttgtggtaagtacgataaattcttctagggcctctcgcgaaccggtccttaatcgccatgggcacgactagcaaaaccatgcacccacagcccaccatgtagtgtattttaattaactaacacccttgcggtagcactaatccaaagctattgccaataatcaaagtctatgcattaatgtgattcccccattgtgtactagttgaactaagtatggctaagcattccgtaaaccaacatctaagcatcttaatacccaagttatcaatggcataaggtaaacaagatatggctgagtagtaggacccatcccacatgatattgtaaaacaatgcaatatttaatagaaatgcgggacatttgtaaattgggtacaatttgatcaatcgtaatgcatgacttgccttgctctcgcactaatgagaccacagcaacgtcttcgagaaaccgcagatcgacgaaacgaccgaaatctatgcgacaaacaaagcacacaagcaaacaggctataagactactgaaacaggaaaaaaaaaaccatttttaatggattctacgcatttttatgaatttactgagacttgaatggacttaatcggagctcggatgaattagatatgaattttagaagattatctatgtttattactataaaagaaaagccttaatgagttttattacgcaataaaggatcccggatgacgtcagcaaaagggggggggggtggc

SEQ ID NO: 45973 - DNA, 1131 bp, Oryza sativa
cggtggcggctataggggcggcggtgcacggccggaggcggcggcaagcggcggcgctagcggcgaacggcgcggcggcgttagagagcacgggaggagacggctagcgcggaaaaagagagagagagagagagagacatggggagcgttttataggggctcgggaggggcggacgtggccgggggcggccggatttctcgccgacgacgtgtgaggtggagagagagagttggggggattcgaattgaatctcgccctttcgggcgcgcgcgtgggcgggagaaggcggggcgtgggggcggcgatgtgggggacgtgtgggcgcggagtggggcgcggatgtggaggaagcggcggcgtgggcggcggtttcggcggcggcgctgccgtcggctagaggtggaagaaggggccgacaggtgggccccacctgtcggtgacccgtagagaggagggagggagtgggccggcccagcaaggaggaagggcgtgggaggaagtgggccgacggcccaacaagaggaaaaagggaggaaaaaggaagaaacagaagagaaaaggaaaaaaaaggattttccagggattatttattgcactttgcttattttaattggttaaaattatttccaaggctctgaaaattccactgaaaatcctgttagcatattttgacatgtagaacccaagaaaaattccacatgccaattcctattattatttgcatttattaatttagggattcaactctaggttaaattaaacaatttcttcggacgatttatttaacaaattttaaagcaaggaggggaacttcagggcgtgacaggccccttaggaacaatgagacaaaaggggtttatacaggttcgggccgctaagaagcataacaccctactcatgttcttggttgattgagtatggaatacaggcacttgaatctgtgagacccaagcgtgagctagccaaataaccgatccctcccctttctccctaagcaaggtcctccttttatatctcaaggggctaccacatgggcctaaaagtctacctagggatcaaggaggacattctttacattaactacatgtcttgtttcttgacttggaatccacatgcacaagcgcggtagc

SEQ ID NO: 45974 - DNA, 24514 bp, Oryza sativa
  unsure (1)..(24514): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctttatacgtcaacacttgcaaacattttcatcttgatgttgaaggtgatttgcatcttttaatcatcccaacctctccttcagggttctactggcattcagttattatcattattttctggttacatgaaagacgacgtgtcatcagctgttgagactcagcttgcagaatcttgtcgcctcgagagtggtacacattttagatgatgcaaacacccctgagaaatcaagaagcattgcaggcagctgattgcgatgcaaaggttaaacaattggccggccataagccctccctaagagcaaggctagcaaagctttttgacggcggtaacatatgtccatgtcatctagagttgatgattgtagattgcttatacaaaggacaaactataagttggctttatataagcgtgaattggacttaattattatatgcacagatgaacaaaaccaagctctatatctatggtccaccgtgcttgagctgttgagcataaaactaacactgaaccggaggcccacaaaccatataaaatgtttaatatggcctaaattatcgtgctaccacccggcgcttcagcaagcactcgctctcttcgttttcatgttttctccctcctccacgtaatacaacgatgatgtggatgttgttatcaccgactgaagaagtgctattatacctgctctaacggtgtttggttcatcggtcatttttgtctatttacttaatcattatcttgagcttgaactgatcctgacatgttaaacaaaaccaatgagggatcgagcaatggtcaaccagattcagagttccagaccagcatcgtcctacctgacactcgttgccacgtggcagggagagggagagacaagagcctaatccaaaaaacatctctttttttcctctctcactgctgcaacgatcctgccacagccggtgcagcaagacgccagcaactgatcagtaaaatactaacagacagtaacgcagtttgcagtagtgcaaatctctctcagaaaaaaaaatactgatgtgattatcattattagaggttgtagtagtaataaagtgctagtactaatcagctactaatcatatctgcatgtaaaaagaagtcaaggcgaaacggccatgagaggccggagctgaacttatttaatttttgtgagaagtggcaggccctcctattaattgtggccaatcgatccgcccagttttcccgtgtgctcctctgaaatttctcggcatgcttgtgatctcttcccatctcatgtgtttgatttggcaaagcttggaggttataattagcagcagcctgagttaaaacggcagcatctgagaggagaggagagggaggccaagcaaacgacgcaattaagcgctctgcttacgccacacacgtagcagcagaggagtatttagcagccattgctatgccttctctgccgtagcgtcgacattgctcttgcgatctagtgcctgcctgtgcctgcatcctcccattgtaagaacttttgccggtttatgttctactttgtttgggccatctgcattgcaagagaattcagtagaaagacacgagcttggttgttcttgttcgtgtcaaacctgtgagcttgatagctgcttctgtttctttctgtgatttctggatcttgtggtgtattctgggattttaaagatgggcaggtcttagtttattggattgattgtgatgaattgtgtgtctctgaaaaataatacaaattcatccagaagagcttgactctgttctggttcttcttttaacttttgagcaatgggtcttctctgtttcttgtctactctaaactactattgattctttttcctcttaactgcaactgaacgttgtgaacttgtgatctttactgtaattctctaggtgttgaaacctgcaggcttctggtgctgagagcataatcatagataatgtggaactgctctgcaccatcgtctctgctcataccgttcactgacgatacggtaatttcccaactgccatgacattttattttcttctctgtcgaatttatttaacaggtttcttcagttgcagtgaaatgcgaagcgtctaattcaccttccacaactgtaggctttgacagaatgtaagtgttggattcggtagtgagggccttcaaatgatctttcaattcaatatctttttttagataatggaaatggtatacgatctttcaattcgcatgaaaccactgaaaatttcttcgtctctttggtcaggatcgccgcggactatgacctgttccatcacatgagcttctcgccgtcgcttcagaatcttcagtcaccaacgtttttcaccacgagaagttcagagagctacttgggtaactccactctttcgaaatgctttctgcgtggatggtgagattgttttactttgatactatttttctgatgaactgataacaacaggagagagctcgatctatggcggaggcgccaggcctgcactcgcgcagttcagctattcccagccaattgctgctacttctgctgctgtatgtaataatcctcttcgcctacctgaaaccttgtgataatatcatcaagccagtgaagtttgtgttattaatttttacgtggtttgggaaatgcttgtttatgtcgtcagcatttggtgagatggacggcggccggggagccgatgaccggcgacggcggtttcaggagctccaagaggctcaagacagcaactacggcgacgacacaacctccaaggcatggggtgaagtgccatgcaaagccaagaaatcaaactacgaaggtagtatcatttttgagtatctgatagtgaaacaattacagttcttgtaatcatcacttcatcagtgttgtcagtgtaggggctttctctcgttcatattggctatcttttccctctcactgccatcgtaaatgcaggcaacatgtaagaagaggagccagaaactgggcgacagaatcacagctctgcagcagttagtttcaccttacggcaaggttaattaatcaacgacctagctagtgttttctatccatgttaatcatcagtgattttgctgatctgagagcgttaattttctgaacctgatcgtccgagcagacagacaccgcatcggtgctccacgaagcagccgcctgcatacggcaactccaccaacaaatccaggtaatcgcgcgtcagacatcgtagccaggcacgacgagtccatgaccaaggtttacaaaaccttacgagtttttaaaatcacgataaacctcatggtaatagtacaattttcacgataatcacgtggttaccataataaccgttttaccgtaaaatgatgataaccccacccaaaataatttggtgaaccctggcatctgcaacccaatggactaagtcgttttcgcgtgtttcacatgataaaaaaagcctgcagaatctcagtgtttttcacttcctcttcagattctgacagcgccttaccctggaacaagctcctcctctgcatcgtcgcagcagcaggtcgtattttctgttcttgaaagttgcagccatgtcatgtccttctttactgcaattgcaacagttttgtggctgcaggatgccggaggaggaggaggcacggcgacggagcttcgccggcgaggcctgtgcgtggcggcgctgtcgccggccgtcgtgagcctcgcggcagagggcggtcgccgccgcacggacgtcgaggatcagaagaggatctggttcagtaatcagtagctgcaactgtaaattaaacgagacgtggcagctcgtttgaacttactctaatcggagttacgggaatactactagtttggatgtttgattagcagtcacgcgtccacgaagttacggggctgtttggttcccagccacactttaccattacttgccaataaaagttgccacaccttgcctaaggtgaggtgatcaaattgttagccacaacttactaagcctaagggaatcttgccacacttttttgagccattgacacgtgggacccaatttgttggaggggaatcttgccacaactgtggctacaaccaaacacctgtcaaatttgcctaaccttaggcgtggcaaactgtggcaaagtgtggcttgcaacgaatgcattaggcgtcctttgagtcaataagaagcaagcattacggctgtaaaataccaaaattgggcatgtgtaaaggtagcagctagcaacacaatgacttctccaacattgagcaaccttttcatgttcatgatattcgcatgtatttctggaaactttgccgtaagcccgtaaccaactctttggccgagttaatatcttgctaccatatgtgttgtaaaagtaattcttgtttgtcagcgtttcaagatgtttacaaattgctacatcgatctagcttcaaatagactatagcctatgtttatttgggataggttacatgctcaaacaacctctattgcacttgtgttcacgtggcagcttaacttttactcaattggaaagtgttaacaaccctcttctccaatcagaaattgcaatagtatcccattcaactataaagtgtttggagaggttgaagaagaggaaactaggagatacacaaggtttgagaaagattctagatacaaactagaactagaactgagatatgaccttgaaagaagtagggaggatgaggaagtcggtgttgtctattgatgcctgagcacgagcattgcagaagtgtgtgcttttgttacccgtctcttgggcctagttgggcctaacgcagaccagattgtagcccaacaacatgtggcaaagagattctggtgccaaccgatacatggcccgtggtaccaaatctaaagcccgtcgctaccagatcagatatcccataggtaccagtgataccctgtcagtaccaaagtttgatacccatttgtaccagtcgatacccatcggtactaggttagtacttgttggtaccatgaggaagaagagaaagctgcacgcaccaagagcacacgtgttgtcctcttccttttctcctctctctcacccccacatcacaagacccccgactaaggatcagcaaggtattgttgactacagagaaaagaataatgagcttgagaggaagaagaagcttgatggaggatgttgaatcagaacgtgaaacgacagcctcgaaggaagacactacatgagataatgaaagccccaatatcttcctctgcaatggtaaaaaacaaaaaactaatagctcgatccttcctccccccccaacctctcctatcttttatgtttttctcctttcttcctatcttcctccttctatggtcctagaccgagccctgactcctctctcctctgcaccacatggccgggagaatttgtggcatcattgtcgccaccatcaacttgacccacactgtcgcgacaaaaattggatcgcttccatgccgcaacagccaccgcaaatcgttgcggtagccacatgccccgtcgagctcatctcctagcacgagggagggagtcacaaataagatctcatcccatccgaccctcgaacgggatactgtaatatggcattcccaatatgaatacaaccacaatttcgcttggtccatcttatttttcttatctaggttggggcttaggagtagttggatggtgtccaacaaacatggtcttttggaatatttgttagatattgatcatttaggtattactagtaacatatccttgcactataatgggtctggtcatataaaatagggatggattgtaataagattaaggataaaacattggatctggtgaatacctatgtatgctaaccgtgcgagcacagtgggagaagggggtggaaagaggacaactccaattttaaagcagtagagattagttagaatattttattctacatccatcactgcttgtgccacatgacagtatccagtgattatgttgatagatcttgaatatcaaagtagcatgctagctagacattttctcgaaccgaagattgatctaacttcatttaactttttgtcacctttaagatgtggcaattaagtatttgcctcaaagtctttgacatgtgggtcctcatgtgcctataacatgtggacccagtgataaatccttaattatcacttataagagtggcaaatagttaattattcccccaaacatacacataggtctgcacataccgttgttactttggaagtatggccgtgtctagttgtttggcctaaattttttttacgtatacgaacacacatttgaaatattaaacgtagattaataacaaaacaaataatagatttcacatgtaaactgcgagacgaatctattaagcctaattaatccgtcattagcaaatgtttattgtagcactacattgtcaaatcattgcgtaattacgctcaaaagattcgtctcgcaattttacatgtaagctgtgcaattggtttttttttctcgtccacatttaatgttctatgtatatgtctaaatatttgatgtgatggaatttttagaagtttgaagggaactaaatacagcatatatgttttttttttctcccgaaaaagaaaaaacaacaacatagaattgactgcgcacgagtccacggcccaagacctacccgctcccggccctctgaccgtcagtccgtcaccaacccatgggccccacctgcttgccgcctccaggcctcgcaccctaaaaaaaataaaaataaaataaaataaggactaaaaacccggcccgctcccacgctgtgtcacacccacctgccacctcgccgcgacgaccccctcgccgccggccgccaccgcgcgtcaactgccggcgatgccgcccccttccctcctgctcctccatccacgcacgccgctgccgcaccaccaccgctcctccttccggacgagctctccgcggccatccaggatggtctgcgccgctgccgaggggtttatctccgcggcgccgatcctcctccccgacggcccgtggaagcaggtgggtaactggtttccggtgaagccgcgggggcgttgggctgtgggtttttttttttcagtatgctgaatctggtggctggttgctgatcgggtgcgggttcaggtggaaggcggcgtcacggcggcgaaggggttcaaggcggcgggtatctacggcggtctgcgcgccaagggcgagaagcccgaccttgcgctggtcgcctgcgacgtcgacgccactgtcgcgggtaaaggctatcaccaacactttctattcagttcactcgtagtagcagaagtttcttcagagttcagacttcagtttcacttctcgttaccatttctcagcaactgctaacggctgcagaatgtgtatcaatgcgtgctcgttaggatgaacggctgtgaatattttgctgttctgagttctgagttgcgttggtgtatcggcttgtgcagtgccatatgaaatctgtcggttgggcttagttattgtcctgttgggttcttttcaggagcttttactacgaatgttgttgctgctgcaccagttttgtactgtaagcgtgtccttaattcatcaaaaacagtaagttaattctacctctcatctcaccttttgacaaataaatggaagtaataattcattgaggtattctatgttttcaatgtattgttttctaggctcgagctgtgttaattaatgctggacaagcaaatgcagcaacagtaagtgtttctgacaaccgtatccgttccgctggctctgtactgtattcgaaaacaccgtggctagtattgatatacttatctaaataatttatctcagggtgatgcaggatatcaggatacagtggatagtgctgatgctgttgccaaggtacttacttgccgattggatgcctataagttggccaggcatcaatgatgttttctctaattggctatcggtttttgcagcttcttaatgtgagcacaaatgacatactgatccagtccactggtgttattggtcagagaataaagaaggtacagtgctgccacaaccaaactatggttgagtgactgtactaaactagtaggctaacctagtacaatttcatctgacgcttgggttttgacaatgcaggaggcacttgtaaattcacttcatagacttgtgggctcactgtcttcatccattgaggggtatagttagcacgcattgcatgtaaaatgcatctgcaagtgtcatttctatatgactatatctaacttattacctctgcccctgtcacagtgcaaattctgcagctgtggccattacaactacagaccttgttagcaagagcatcgctgtacagacagaggtttgactttcttagcctcgtattattctcattaggtttatttggtttgacattatctttgttcttatcatctctttattgaaaagttagattggaggagtgcctatcaaaataggaggaatggccaaaggttctgggatgattcatccaaatatggcaacaatgcttggtgtaagttctgtatcaatctcattttccacacagtcctactcctctattgatccctttctcaaggcatgtatgagcttcattataaccctttttcttacaggttttaacaactgacgctcaagtcagcagtgatgtttggagagaaatggtccgaacatcagtgagtagaagcttcaatcaaataacagtaagtactgagaaaccattcctcttgagttgattagcatgtcaacagttactcaacctacaaaagaacttatcaatcttaattactcacatcacatgggtaaatatgggcaaattaaactgtaataacaaacaagagaactgtctgcaaaatgctcctaaatttagcaagcattgaggtttagttttctttgtgttatggaaatctaacgggcataatgcatcctctgtctactaatttggtatggttgttatggcaatttgatcctgaaactagtaggcaaacatcttgattgtttacgtcataattctttaggtggatggtgatacgagtaccaatgactgtgttattgctctggctagtgggttatctggtttatccagtatccttactcatgatagcactgaagctcaacagttccaagcatgcttagatgctgtaagttttacttcccccaagcttttccttttcatgtgactccaggctccatgttcttgtctccatatttattttgaaatgcacttttctgtagacttatcagattactccagtctgaaatttcttttcttagcttcccataggatggaccgatatgaatcttattttcttcttggttgcagagtttttgatgtatttttatttacagcaaactgtacctataaaggaaaaagatgctgacctatttatctcctgtaggtaatgcaaggtcttgcaaaatccatagcatgggatggtgagggtgcaacatgtctaattgaggttaagcgcttagcatttcattcacttcgcaccatcagcatagtatgctgcattttcttttagcatgatgacttgacgtttgatatacaaattgagttatctggcaactgctgcattcaattattcatcatatcaaatttcctttcttaatttcttcggtgtgacacaagcttctaaagtgcccattccctttgtaggttactgtagctggtgccaataatgaggctgaagcagctaaaattgctcgttcagtggcatcttcctccctggttaaagtatgatactgtttagcagcaaaattttgctaattaggagaggattgacacccctctgtcattcgttagcccagaaagcctgagttgttaaattattttttatcaggccgctgtatttggaagagacccaaactggggacgtattgcttgttctgtcggttattcaggcattcagtttgatgcggaccagcttgatatttcccttggagctattccactaatgaaaaatggtcaaccactcccatttgacaggttaagaaaccttgacaacatagaattattttttttattgacgactttgaatgaattgtaatttgtgtagatcttacaatagaatttaaaatatctactgtttcttcatagatctgcggccagcaagtatctgaaagatgctggagacatccatggtacagtgaacattgatgtatcagttggtaagcattcaacttgttgcataactcgacttcttgttgcgtggctgaatctgtagtatgttcttgtgtcacaatgttagtcatggacttctggttgcatcatttctctagaaagcacaaatgtgcctcttgcatccaacatatatttgcactgaaccggagtagttttattggcttgatgcatttgctttggggtatcctttcttattccttgatttcctatttggcatggcacctttagttgaagaaaacttgaacagttgcgcacaaaagtaaatttgtttttaggaaagctaagattacgtcttgcccagccgtgttttttacctgaacaaccagatgcttcattatcattgtcttgtacgaaattgtttgagactggcatatgacgcatgttcgttgtgtttatctgccagggaggggaggaggaagtggaaaggcctggggctgtgatttaagttataagtatgtcgagataaatgcggaatacacgacgtgaaagtcttacactgtctatgaagaacggtctccgcttgatggaaatggaacgctgttcggatgcagctaggcatctgagcgatctgtatcatattgagactcgccctttgttgtatcaatcggctgaacgtgcattcttttgtaagtgtaaggaatgcgctatacaatgttacggcacaataagtaagctgtctgccatgccatctgattcaattctaatttataacagtgacaggggatgtttgggcgcacgccgaataaagtttgtatttttgtgtgcaatcatgtatgtatatcgtttctttgggggagaagaatcagttaagctccaaattcggcttgctccatggcacgggtttttggcccggccaagcacggcatggcccgactgatgttggccccgtgcttgggcctttgtctcggcacaataggtcggcttggtccaacgatctggaggcaaaatagatgagggagctaaaatagacttattccaaccttttaaaggcacagtctaaagagatgagagacgcaaaatagacttattctagtcatataagaaacggcccaaagagatgagagaggcaaaatagactttttctaaggaggagcacgatgggctttcgtgccttcgggtcggcccagcacagcccgagtcttattgggccgtgcctggaccgttggtgcaacacgtgggcgagtacggcctagcccgcgtgtaggtcgagccttgctaggcctactaacctcgagccagggcctggtcttgcctgggccgagcaacccctttggccatctataatggaattttttttatttatacttttttttattaaaatatttacaaaaataatttgttgttttgaaaatttacaaatctaatcgcctgccgccctttgggagggcgatttttaaaaatcgcccttccacagggcggcaagggacctaaatgtaaattttccagtataacttgttagctctatgattttacaatttaaaattatattatataaagtcagatgaaataaaactttatatcaaaagtgtagagctcaaggagatctacaattttgtagttaataactttttcatttaagatgtccaaatattcgttacaaaatataaaacacatttaaaaaaatctcagatctacatttcaaacgatattggatggagataaactttatataaaagttgtagatcttgatgagatctataactttgtagtttatcacttttccatttaaaatcatttggagtatcgaataagcattattagtttttaagcaattaaaaccggtgggaagggtttgaacacaaataaaaattttatatttagatcccttgccgcccttggagagggcgatttttaaaaatcgcccttctagagggcggcaggcaattagatttgtaaattttcgaaacaaaaaattatttttgtaaatatttttataaaaaaatgtataaataaaaaaaattctctataatggcaggcaagaaacattgtgcactctctcgtgcactgcatcatgtacctagacccaatatcaagttaggttggaaacattgatgatgctcttagtgaatagatcaaacgagatagtgtgtgtttaaatcatgatgcagaggagaattatatgctagctaagaacattcatgtgagggaaatttatggttcaagtatttggatatcagatagcatgattagctagggcttgaatattggtggggtttccaagcaaagtggaactttgaggttcttctatatgggccctttctcgaccatatgggccgggatctataatagcaacccatgtatgaagatggcttagggtttggtccatgccaaaaaatgtatagagtacaatttttttacatggacctaaccatgagccatctccatacactggccgctatcatagatcctggcccatactactaatagactcattattgcgactgtcatagactcttgtatcggttcaacggagttcttgtggaattcgtgttatgagatcatgttgacaatgtgtgattcatttccttgggcttgtatatgtgtctatggaggctgatactccttttggaaccttttggtagatgcaactattttcataacctctagcttcccaagacaattcaaattctcattatagattatgaaagtttccttgtgagtggaagtgagcttgatcaaagtttggatggagtttgataaagccgccctaaaggcctaatgggcggaatagtttggatagttgtgttgtccgcctggttactaaacttgtctgagcaatcgaggatcaacatgctagacaatctgtcttgtacatattggcgtacgagacagtatgtttgtcaaagtcagagttgtataggctggacagttcccttgtgcaaattggcgtacatgacaatatatttgtctaggctgatgttgtacaaatcggattgtctaggccaaccagattgtttgggtgaagttgatcatcgacaggctagatagcacgcttcaatggaccgtattgtctgaattgagataggataatccaccagttgaaaggtcctcggactatccacctcttaatggcccgatagttagtttctcatcgaccgttgctacggtgtaaagggccgagctatcaaggctgaggcgatgactagtttgagtgattgggctataaataccaaatgctataaacttgcttcaagatttttgaagtaatgactagtttgagtgacatgagcaactaaggccctgtttctttcagcttaggattattataatccaacttattgagtcagattattataagctggattattataagctagaggaaaataagctgtgagcttgacggagcgtggggctcctcaccgggagaccgcgcgggcccccctttgccggttcggccgggggcgctaggtgaggttctaagcactcgatctgtggaatgtttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttcccgagctccccccttcttaagtgggcaaggtcttccttttatatctcaaggggatcccacatgcaccacttctacctactcttcttttgggtggggactcaccctatcttcccaaaaaagaaaaactggcttgcgccttcgcctggaagctaaatcacaacttgtctttgagtgaggcccagcgtcatcactcgcctgacaccggggatctccctgttactccctcattaatgggcggagatttgccatggctgttgtccgaatgaccctctgatgggatgggccatacctaccttcactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagtcagcacgccggctccggctagggacgagtgcctagaggctctcatcattccgacgggacggggcgaggcgtgcgaaaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcggggagacagagggaggggcggccacatcaccctcgggcccgacccccccgagggggtcaggccacgtgggtgactgcagctgccccaaacctctagtcaagatacccccggtcccatgtcaccgacagagctgtttctttctctagattattggaaacctggattattgagtttgcatggctaaagtctagaatgccctcaactatttttggatgcctttgtcatcattcggtgactttatacaacagatataaatttgatgtagataaataaaaaattgacaaatatttataattatacattcatgaatatttcttccacatatataatagacttaaaaccaaattattatctcttagcaaataaagcatcagcaatactatcacggaaggcatttgcgtccccatcttcgtctcccatgtgactggcattcccttgagatgaaggcatcggcatgtagttttcatcattatcacacagatcaaactcttcatcactcaatttgctatctcgaataaaattatgcagcgccatgcaagcatgtattatttttgtttgcttgagcatcggataacttggtaagtccaatagaattctccatttcatttttaaaacaccaaaagagcgctcaatcacattacgaagcgatgaatgcaagtggttgaacacctccttcttgccactaggacgtggaccctctcgaaattccggtaaatggtatttggtccctttatatggagatagatatcctagttgatttggatagcctgagtcaacaaggtaaaatttccctgttagcataaacataaaccatgagacattattttataattgatgctagttcgacgagactgttaaacggataagagaagttaccaggtggtggatgagggaagatagcggcatatttgcgcaaagcatcattgaacaccctcatatcatgtgccgatccaggccaccccgcaacaatgaatgtaaacctcatgtcaaagtcacaaatggccaagacattttgcgtcggatatttatttctacccacatgttgaaccacctttgatgcgggcacaactactggtatatgtgtcccatctattgcacctatgcaattgttgaaatggggctcaaaccgatcaccaagtagtcttgggtgaatagttgtgaagtttgggtctctaggtttgacaagatcttttgaaaggagatagatactctgcaacacttcattgaattttctactgattgttccttttgacctctcaaatcagttcttaacttgaacaaatgattgtggagccccaatggtccacaaaaacattcctaaagcttcaactgaatccatcttactagttgacttcagaccataagataagaccaacaaattatgtaacctctcaaagagtggcctactcattctaaacatgtcataacaatcttgtggaacttcaaggtttctcataacccaagcatgacccgctaaattagcttttttatacttggacttgttcaaataattttcagcatagaacataccaaatgatgtcaacaccggtccaaattttctcatcatatctagttgtctgctagcaacaataatagtttcatcctcctcctcatcgacatcatcacttccatacatgcccatctacaaacaatgcaacaaatgatatcacctcaatagtcacagaaagaccatgttgatggatcactaaacagtagttcatccaatcaaaattaaggcgccatattacatggccaggcaatacataagttcatgcgaataaataagtagcaatcttgctaatacatattgtctgacaaagtaaaaacagagataactagttcatgcatataaataattagcagttttctactgctgcccttccttctcgcaccatctctgcaaccaagagagccttcccgccttggtggtaagagtcttgaacatatcacgatgttcagctttcacaaataatcttgtagccatgaaatgctccgcacttccttctgctgccccacaatccaccaccaaatccatcacctccttaatggaattgaacctaaattcaccttgcatcaccttgttggcaatatcacaattgatatccatagtggtttgaatattcctcattatcctaaccatggggttcttaaccttcttgtatggactagtggcggtgctggaagaccctcgcttcaatggttttttacccaatgagcaatctaccggtgtgtcgccaaggtcatgtacatcaccacttgcatcatcccctccagcattttctccaggtacgttaatccagaaattaaatgttcgggttgtttaatagatttgctatacaattaaatagataatccacgacaataatatccttaacaatatataaatcaattgaggcataagttgccttctttggatatggttcctttctcgcaactgttatattagaagttccaatatagaaggaatttccaattcttttgtcgtattatcctatctacttccacttataacatttatttagcttatagttttaaattcgctccgttacctccctctaggccggaaccaacaaaaagaaagtttaaaacagtagggtgaaaaaaaaacaaaacttccaaactcaccccacctctttccttattttttttcaaaagttatcatacaaaaatccaatccttaattattctcttccaaaattttatcaacatgtaaggtgtgtttagttcacgtcaaaattggaaatttagttaaaattagaacgatatgacgaaaaaattagaagttggtgtgtagaaaagttttaatgtgatgaaaagttttaatgtttgaagaaaaaaattggaaataaacaagggctaagatgtactaatcacaaaatcaccaaatcctcgtgttcacagctcagagcgccatccacctcaccgtccgcctgtgtggcgctgcttttttccccaaaaaagaacaaccatcccgcgggcgggaaaacggacgcgcaaaaaaatttcgtgctcccaaattccctctcctctgattggcccatccgcccctcccacggatcgcgcccccgcgaaccccatccgagccgtccaaccaccccacgatccgaccgtccatctcccctcccacggatcgacgggcccaccaccctccccttcccccaaccgtttaaatacgccaccccatcggcctcgtctcgccatcgccatatcgcattcgactaaagaaaagggaaaaaaaaatcctcctcgccttcgacagcagcagcaaccagcttagctaggctagccatggacgccgccggagccggagcgggtgggaagttgaagaagggagccgccgggaggaaggccggcgggccgaggaagaaggcggtgtcgcgctccgtcaaggccgggctccagttccccgtcggccgtatcggccgctacctcaagaagggccgctacgcccagcgcatcggcaccggcgcccccgtctacctcgccgccgtcctcgagtacctcgctgccgaggtaacaacgctcgcccactcccccactttgtcgtcagcctcatctgcagatttcgatttgtggtgctgatctggtggtgtcctctctgttcgattgcttaggtgctggagctcgccgggaacgcggccagggacaacaagaagaacaggatcatcccgcgccacgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggccgccgggaagtcccccaagaaggcctaggcgtcggcgcctcgctttgcttgtttagctggagtagattggacgggatgtgtgtctgttagtagtctaatgctgttgatttaatctatggtggtgtcgttgaaccttgtgatctgtgcttgtgtctgttcaagaagataaatttaagagatgttaaatttttcttcagagatgtttccattcttgctccttatgctttggctgtggagatctgaattttctcaattgtcagatccgatcttgtgagatgttcgaatttggttgcttgggttgggcgggtaacttaaaatcacccaaatttgttggtggtgtgttgggcttagtgccgcctcaaaaatttggtgtttggaatggaaatcaccgaatgcctaagtatgggtatctcagcatctgtgattttgttggatgttgaagtgattggttggaatttgcattttgggaggcaatctggcgctctggtttgaattagtggagggggggaatggcgggaagccgggtacgaaatgaaaatgtgtcttgggatttcgctatggcattgggcgggctaaatccatggaagtttggtgctacttggcgcctcaattgtgtcttgagctgtactccatttatgggccaacaggcaaataaacttgctcctcaattccgctatgaacttattttgggtcaagatccacatccttatgaatagaccatctctgtatttatgttactacctgtcattttggtgttgaacacgggtaaaattaaatgtattatgattgtgatttgttgagaatagaaaataggtgaggatattaagaggtagaaggttgtgattggttgaaaaaaaaagttattatatttagggataaatgtactcctaatttgttactcattctgtaaaaaaaaaaagagctaacctagtaggggatatgatcagacctactatgaatctggacagccaggaggaaggagtcacatccgcttctaggttgatttttttggacggaggaagtatattttaggacaaatgaaataatatatttgaaagatccatttttgtaatagggtcttgtttgtaccctccttaagcaaggacatttattttttagaaaacatagtacaacataggcgctcataatacgcactcactctatgaatacgcacatatatatcctaactctacgaacaatcatcatgagtacgtcgtctaccattaaaagaataattagtcgtaaatgtaagtaaatgtgtcaaagtctatgtgtcgaatttgagtgagctagttccaccataaagaatctaaccatttaagttacactcatttcgtcaagggtatttaattttgatcaactatataacctttgtacctatttccatatctcacagagcacgcttaatttttcctgtagtgaactaatgatggattataatattatatctgctagtacaatttaattttgaagaaatggttgtatgctcctgtaaacaagaaacttccggcacatcctcaggccaaggcaactcagtagtacaagatttttttaaaatctttttatatttattaaaaaattaaataaaaaaaatcatagcacaattggaatcgtccccatatttggactggaggaattttatacaagaattgaactaattactgcaaaattcctacatagaaaggagcccttacctatcctaggttaatcagtgcattctaattaatttaattgaactaaagtgagataatccaactttagccatgcccatagaactataacctcttagagcatctccaatagaatggccaaatcactcttcaagttaaattctagcaagttttgagaaaaaaaccactccaacagcctctccatccgactggccaccaaattggctcttggctacgccaaatttggccatcccgcctgcctagccaaattggctgctagccatgggccccacgttgctcccccccccccaaatctctcctctctctctctctctctctctccccgcacagatcaatcgccgccgccatcgtcgtaccgcgccatcgccgtcccgcgctgtcgccgcctcccacctgcaccgtcgtcgccgtccgatttcctccgtcaccaagagagctccgcgatgacgaggcaggagcaagggaggctgtgttggcgacggcaacgagggagcagcgatgatggggaagaaggggtcggatccctctccggcggcagccgctttgccttcttcccccgtgtggactcctacgcctccttcctcgccggattcggccggcggcgtggaatcagggggccgcgcgacctccgccgccgtctggccgccagctgctgtcgtcgccaaggtctgggccgccatccttcgccgtctggagctcgacggcgctcgactacggggagtagttggcggggagagggagagcacctcggcgagcgtcggcgttggggggccgccgtccatcggcatgcgtcggcaacagcggtccgctgcctgcgccgatttgccgcgtccgcgtccgccgcctccccgcatcgtcgtcccaacgtcgcgccactccctagcgccgcctccgccgcctccaccgccgccggattcagggtggggggcgtgacctccactgcctctgcgcggcctccggccccgcgcgtatttggccggcggggtggattcgggggccgcgcggcctccacctctgctccatggccgtcgtcgaggtaaccgttgcaagccgccgccgccatcgccaatcaccgcgtcaccgccgtcgccaatcacctgcacgggaagagggccgacagaagaggaagagggagagaggagtagaggctgacgtgtgggtcccagtgtcataggcttgtaatgaagagtgtagatgaaaagaatattggagtgaggaataagtttggcttgctaaatcgactgaaagctgactatatgggtatttagagagtttaatttggagagacagttggagatgctcttaggtaatgtgttcataggtccacatggtccacatgtcaatgatcacattactctgacgtagggtacaaagccatccaaaaccagttcatcggatatacatcacggctttaatacttttgagatcaaattcaaacaatatcgctttatagatgacacagaagaaaacggtggaagaaatagctagtggagcaggggcgggtatatgggtcatccagcattctacgcacatataaccttccagcccgggttcataaattcaacctaaccttccaacaacaattttcctgtttgaaagctttcttttgtcttaaaaaaaaaacaaacaatgttgttcgcaaaccaatactgggctcaacaaaagtcacaaaattacgcattcaggacaggagaagtgctcataggtcttgttggaactgagccagattagccatgtacgagtacggtttaaggcaggaaaactgcaccagttcagcaacgatggtgatagactatgccctatgcagttttattcttttgcaatttccacaaaaattagtcttccacgaatgatctgccaaagaaaagatttattgaaagtttagtcttacaataaaacagactaatcaggggaaaaaagaaggctggtttagtataaatctatgctgaatacgaatcatttccacatgaagaaagatctgaatgaatcccaaaataaaagcattctgcagtgacaaaaatggtggagggccaacatgctagcaagatggatatctaatctcaaagtttatggccaatctagaagatattttctttgggattaacagaataaaaagaactatataagcaacacaatgttcacaatgttcctcacagaaggaaataaaccacacagtttggtccacatggttttacagaaaaaggcagcaaaaagtttgcttcacatgatttttacagtaaactagccaagttctcaatctgggttgaacgtaaaatactataaatccctgcttagtgtctcgatctcatagaactacaaaaattagttctgttccacaccatgcagttatgccaaagattacaaacatgcaacacattatatcttgaaattaggtacatcagttttgcaggcaaattgtccttttcatttagtactccaggtaagtgcctcagctaatgtagttgtttgtaaagagtctaatcagcggagagatcagttctgcagtcaacttgtccttttcatttagttgtccagttaagtgcctcatctaatttagttgtttgtatcagtggattttttttatccccttagtatctgaagtagatcagagataacatcacaaatgaggcccactcaatctacgagggtaagtgttatcatgaatcacgataaaccactctaggcttcaagtaattaagctagaaatgtgtgtgtggtgtgcatgtaccttcaattccaattgaaaaccaggtagaaagtactatatacagattttcagaactcttctcagataaagaagaatcaaaactaacatcagaaaggtaaattgcgggtcataggcaagataggggatgagcagagcaaatacccgtccatccatttccttaacagctttctctccgtctgcttgagaagaatatttaacaaaaccaaatccttttggccttccagtttggttctcttaccaatcgagctacgcttgataaggtagataaagcagagtgaaacttgaatgccaattaagagcaacaacaaagatttaaattgcctgtgctgaaaagcatgtgactactgagtactgactagtaccttcctcaacagcgccaaatggtgagaagacatttttaagttcttcctctgttgtgtaaaatgatagccctacaaaatcccaaaatgagtgaatggatgtttaagctgtatgagcaagcaacatcaaaacatgatagaacgagtggacaatccactaagaacataacttgcatggctttagcgtgcacaaatagcagaatatctacagacaacttatgtgttctactcatggtccatgtgaacaggtgagcatctcacaggctcagcagattagggacttctaagtactctatcaccaagagaataaatcagcatctgtcaaactctatgagctctacaacaacagctagctagtatgtatctaggctgtaattctctaacccgctagaaagcatcctctgatcgatccttcattgcaatcaaaaggaatcatattctgaaagcaccaagcctcaacaacttaaggcatgccatagctatcatattcagaaaaaaagaagggctaaaggacacaccatttagtgctcatttcatccaccacaccccccagaatcacaccagatcaagaaaccccattcactcatgaagttctgacgcacagatcatcacaagcggacctgtgaagcagcaggacatcacatcacaggctcacacagatccaaacattttgcaaaccacaagattattacgtaggcggcgaaaatttaattacatggagatgaacttactgctcacaaatatctccgtgctgaaaggcttggctccaaccatccgagaggccaagccacccagccgcccacctcgcagcatcatctcctcaaaccctagatccccaaatcgcaatcgcaaagagaaaagaaaaacacaagatgcgaatcagccaccgacaataaataacactcgacacgtctattacttcaaatccaagctgcccattatgatcaagcacaatttacaaagcaggcacaagtttgcaactactgccacctagcacactgcacacgaggggaaagggaaggagagaagcatggcatcgaaaccctagagagacaggcctagttgctggtgaacttggt

SEQ ID NO: 45975 - DNA, 5416 bp, Oryza sativa
acctgcttcaggaccttgaagatgtagatcttgtaggtctcgacgctcttcttcgccttcttcctccccttcttgtcgccggcgccgccctccttggacgacgccttcgacgccggcagccgcttctccgccttgggcttcttccccgccggcgccttctccgccgacttctcctcgccggctgcgggcttcttctccgccggcttcttctctgccttgggcgccatcggagctgcctctcgagggatcggctcaaatggagagagagagagagagagagagagagagagagagagagaggcgggattcgtgaggaggaggaagaccttttcccttcgcgtggagttgaggcaaaaggggaagaaggcctcaattatatataggcgcgtggtggaaccccattggtcgacatgggtgggaggcggatcgatgacgtagaatttctccagagccgttggatgcgggagggggagtgaacgctcgggattgtagtagtactaaacaggctacggcccgttgtgcttttgtaggggcctaaaatttggatgggctaatgggcccaactagttttgtacggcccaaattggcgtgatatatcgaggagaggttttttagtggcggcgatggagcagcggcgtcgtgtggccttggttgcttcggaatctcaccacccaacccgttcggattagatagcccgcttcctcctctctctctcagctcaccacacctcgagtcgccgccgccgccgccgctgctgctgcttacctcctccgcgccgcgcactccttgcactagcccatggcgacggctatgatggctgcgaccgccacctcgtgctcccctcgccgcgcgccggtcgtcgcgtcgtcgtccgtgcagccgcccaggcggcagcagcagcagcaaccgcggaggggattgaagcagctgccggggctcgtggcgacggcggccgtggccgtggccgcggcgccgctaccggcgctggcggagcagatggagaaggcggcgctgttcgacttcaacctgacgctcccgctgatcgcgaccgagttcctgctgctgatggtggcgctggacaagctctacttcacgccgctgggcaagttcatggacgagcgcgacgccaagatccgtgccgagctcggcggcgtcaaggacgcgtccgaggaggtgcggcagctggaggagcaggccgccgccgtgctgaaggcggcacgcgccgagatcgccgcggcgctcaacaagatgaagaaggagaccacccaggagctggaggcgaagctggacgaggggcgccgccgcgtcgaggccgagctcgtggaggcgctcgccaacctcgaggcgcagaaggaggaggccgtcaaggcgctcgacgcccagatcgcctccctcagcgacgagatcgtcaagaaggtgctcccatccgcgtaatggccgccccgccgccggccgttcttgcctcccaaacaccaaccatctctcgtaaagattttctccgtgttttatccgtgtgtatacgctgcttctcctaagaatgtaatttcagtgaacttctcgtgataagtataaaatcaatgatccttttgctagaaattggattgaaattataaactgctttaataagtgcttactgcattatttgtgaggattgtgaactgaaacaatatatcaataagttttttacaacttccatatagaaatttttttaaaaaaacacaaggcgaaattgcgcatgaaaaactactcttcgtcctttcctatagaacacaacctacttgaaataagaaggggaggtcgcgtaagtctatatggaggtgggagctctatacgcgatagttgtggtatagtgtgaggagagagacacactatatcacaacaattaatttcaattgcagcaaatttactttcttcaagctatcaaatgaacataagttgggataattgcaccaaatttactttcttcaagctataagtgcgcataagttgcgccaatacgctcaaacataagccggcaaggctggaatatctatatctgcgactgacaagcactgtcataaaacgataaaggatatgtaacatctattttagttttcaatagcgatactctactgctaccttgtcccaacatgctgggcttttgcttcagaagtttctccaatgatctggatggctcgatgatctatccgctggaaacgagttgttctctcctatgcgccatattttggaccggatggcgtgtaaccgcgtaactccagcccactctgctatgcggacctggtcaggtcgaacccgaacccagcagatcggtcggaccggggatatccgcagcaccgcaccagagccaaggcggaggtagggttttagccggcggccatggcgctctcctcctcgctgctccaccgcctcctccgcggctctacccccgtctcttcctcctccgccgccgcctcctcaatactccgcgccaccttctgctcctcctcctcgtccgcccccttgcccaccgagtcgcccctttcctccgtcttcggcgacggcgccgaggtcagcaacgtgccgccgctgaccgcccccaagctcttcatcagcggtaactctcccctccctttgtttcacatcacatttttctgcataagatggatatatttgttatgaagatgatttggggagcccgatttctcggtataatttgggatggctgtgtgtactgtgctgcgatgttatcatgttttatgctaaatcagagcaaactagtgtgtttgctttctacagatctgtctctgagtatgcttcttaatctcatgctctattctgctctttgtcaatatctttgcccgtatatgcttacatgaacaactgaacccactgactaataatacagctgagtcttgtcggcattcttgaggaagacatcatatcctgtactgtcgaattctattacgtttctatatttgttgttgcatgtactaatactacatttatgtatttgaattagactttattttttatgtcatgctgtttttgtttgcatgctcacatatgcctaatgtgatgcaacacaggcctttcaaggttaacgacggatgagaagcttaaaaatgcctttgctccctttgggcagctacttgaaggtacaaagcttgatccaagtagtaaatgttttgaccactggtagctttcttcacaactcatattgatgtgtgttatactgttatttattatcttttggcctcgtgtagcaaaagtcattacagataggatttctggaagatccaagggattcggttttgttagatatgctactttagaagaagctgagaatgctcggcaggagatgaacgcaaagtttctggatggatgggttattttcgttgatcctgctaaaccaaggcagcagaagcctgctcctcgtcctgacactgattcatcacacactggcttcacaacaaacaaaactgtaggatggtgtggttagtcactgtggtgttatagctaaaaaacttggatacacatgtttccatgcctcattacattccacagttgtctacatgtctcataatattctgtagttgtctgatagatatgtcattcacatggattataagatgttcatgatcattgttctaaatattgaacaccaaatttaccgccaattgtagaaaaaaaaatgataattgatgattcgtggagccacactattgtgttactttaacattccgtgccacccaattttgaaacttataactttgatttaaattagtttaagtgttcttttattattttctattttttagctttggcttctaaaccgttaagagtctaagtataaaagtccagtcctaagaatataagtttaaaagtccacccctaacattatttctcgttaatttcaaattagtttaggtgttcttttattgttttctatttttcagattcgacttctaaacagcgaagaataaaagtataaaagttcagtcctaagaatactaacaacagaagtatttccagctctaaaattatttttcgttgatctgatatgtcacggcttataaaactgcagtaaaaaggaactcagcaatcagcgacaaatcttctgccctgagatggtatgcataccatacagatacgggatacgggtacaagtgtgacaggatattaatatgcctaattgacattaagaaagtaaggaactgagaacatgtgtggcaaatgatgtacatcacacacgcaaccctctcagcagagtatataatgtcagagacgcttctattcttaggtacttcagcttcgaatcattcactcgacgttaatcacaaaaactactcttttttttagtatttcttttgccgattactacttgctaaaaaaatctactgagatgcctctactctcttctctatacatcttgagcctcgaaccatccattaaaaagatggcaggctacaaaaactgtcctgttgctctccaaaggtaacattttatcctaaaaaccgcgtaatcggtcttctcaagcaagtgatttctgcaccaagcttaggttcgcaaacatcaccaagggatgtgccatcagcatagaatgcttctgtcaacaagcacagcatcaatagtgcaatgtcagtactgttgttggagagattactgttgttggctagtacaagctaatgttttcagcaaccacaggtaatgcacaaatacaaggaagggttgtattacctgttcatctgacaaaatagtgtacccaagtttctcagaccagattggtgccatttcaggatcaacaggtgccgtaagaagacggacattccaggcctttaaatgcgcctcaattagacttagaagaagcgaaaaataaccctgcagagagacatgcaatggctgagagcaaatgcctttatcacttcaagtagtccgaaaaaaaaacataaaaagcctgattcgttaccacctgcaggctgcagttcggcaactaacaattgtgcaacttaatttttggcatggcaatagaaacacttccaaaatgaggctatctatggtagtactccaatatttttaaaaagaaggaactggaaggaacaaaaatgatcaaggaattccaggaatgcgaaaaatgctgcatgaagggtctgcttatgcctgtggttccataacaacaaaccaaatataagtcatgatcctttgttcaaaccacaatccaaatcattaaatttatgttttggcttaagctaaatccgatccattgttccgtgggtttctaccttttcagggaagaccatttgttaacatttccaagttaggtgcacagcatctctcttcttaagccaaagaataggtttgcctttgtgcaaatatgcaaactagattacaccagataaataacagagttcattatggactaaacagttcaaatatttcc

SEQ ID NO: 45976 - DNA, 1108 bp, Oryza sativa
aattcctgcagccctgcatgtgcacactcatatttcttttgggggtgtgctgttgattgtgtgggtgattgttttgttatgtgtgtgctacaccacagatgtattaccttgtggttaacactgcacaatagattccacgaaaatccttctctccagttgtatcctttctgcaaccattgaagcttagagttatttacttaagttcaatacacacacaaaaaaaggtgaatggtgattcatgtggtcattcgcatgccagttaaaagtaagaaaaataagtgagaacttacgaattaaccatatttcttatgtcatcaatgtcctggggagctgtttctgcaaatgcatcctatagatacaggataaagtgagacttttgcagcacataagtcattgacatatggaggcatatttaattatagacaaatcaggagttttcaaaatgacaaccagaagcaccacgcaacttactttgaagatctcaatgacctgatgttgcacatcgctcctcatattcgttccatttaaaagttgccaacaaatgttgtatcttatccgtctgagaaaggcaatatcttccctctttttcagtccttcgtgtaaagaagcacgtagcaactggcatttctcacaacacatgaagttgaattgcgtgtattctcccaaaactttcagaggtgcctgaaatgttgttcaagacaacacgtgcctatcacaaatcaaaatgatagccttcctccaccgcatacaaaggacaaggcaacatacctttggtttttgaagtccattgttgtagcacttaacatgcaatgctctctcacactgtacatgagaatacggcacaatttcaaggtgacaatcttatctttcttttttgaatattataagactgatctaagtatcaaaggcaatctgttgtgggagaaaaacattaagcagaacattaacctggttacagaagacaatcatgtcaacactaataactccaagcaccgtatggggtttcctgtcaaaattttaaggtgtagagttacatataaatgagcttacataatcttgacattgcgaccagtccacatattcttattcttaccgacacatataacag

SEQ ID NO: 45977 - DNA, 1095 bp, Oryza sativa
cacctttatatactttcctccggagatgttctccgtcttcttcatgctcctgccgccgtgagcacccctgcctctcgtctcgcggccgctgattgcttgccggtgtacgggatcgtcgaaggagcttaacggcgagacgatgaagccgccgtcgccaccaccgcagcagacggcggcgaccacggcacgaggtttttttaataatccctagatttttaaatttaaatgattttcacggattttacaacgaatacctacaagaatactcatgaaaattacattgtaactagtgaactttacattgttccatcttcgtttcatgaacaggtgatagatcgtatttttgttgcttaggttgtcttcttatgcacaagcgatacttatacctctcgtttttcatgcacacgctccctaaaccgacaaatgatattttttttgcaaaaaagttctatacgaaagttgattttaaaaattatattgatctatttttcaatttagttttagctaatattctgtctgtttcatatgatgagttgttttgacttttttatagtttaaatttaaccaagtttataggaaaatatagcaatattttcgacataaaacaaaacatattatgagaatatattaaatgctagttttaatacaactaatttggtgttattaatgttactaaatttttctataaacctgattaaacttaaataaatttaactataaaaaagtcaaaatgacttataatatgaaacagagagagcgcttaattaatcatgcgctaataagaaaatgacctcttctcccgaatacttgtgcggcaattaggcctactagtaatactcgagtggtctaatgattaaggcccaacaaagatctgcggatgcattggtgcacagatggcgtgccatgtaggagcgaaaaaccaactgaaatcataattttcttatatctatttagttacggaagatatctcttcatcaagaaatcaagatcagttctaaaaagaaaaaaaatcaagatcaccttttatatattttcctccggagacgttctctgtcttcttcctgctcctgccgccgtgagcacccctgcctctcg

SEQ ID NO: 45978 - DNA, 13819 bp, Oryza sativa
  unsure (1)..(13819): unsure at all n locations
gatagaacatggccgcaagttttttttggttgtttggttgatagatagaagtgggatattgccacccggcagagaatattctatgtagatgttggatatgcagctccaggcaaatcggccggatcccacatcccgaagtgggatgagtcgcacgactctggactcgcgcgtgcgctcacctctgccccaatattttatccatgtcactcgcttcctcaccgcatcaactgtagccacaatctacttcttcccttcttccggtggcacagggggcagcactagacggcgcaggggcaatgtaagtggcggctgtcgagggcgctcggcggagcatggcaccgctggacagcgctggggcgttgtgggcggcggagcacgagcgacgcaagtggcagagaccacggagtagtagcagccagcaggtcgcgcgctcggccgtcgaggtggcgtatgccaacaggcaatagcaggtcctccgtagccctttgccgccattctggtgcccgggttcaggagcctggtgatgagcagttcaatgtcttcttcttgttttttttatattggttcagaacttcagatctgatgtttttttaggattgggatggtttttgttatgttctgtgtagatctccgtgtataatctgatggtgtattagattttgatatatgtgtgcagggtgaattttacagagtgaaaatgttatcatttataaatagtggctaaaattaatttacaacatgataaatattactcacaatacatgcaacaagcatacatatgcatcaagatgaaattgtttgccaatgggggtattctccaccatcttatccagtggtaaccataacagtccatccatcctaccaaacaaaaaaattgactcaccatatccacatgtcatccctccaaccaaacaaaaatcttgtttattccactctccttaccaaacataaaattggatggccatatcccatccatgcatgaccaccaaccaaacacaccctaagtgcatgcaagactaaaggcatccctgtggtttgattcaagaaaaaatgactattaattgatgtattgctctatttttcttgtgtttaggatgccacactattaagagggatatgatatacatataattggagtaaacaatagtactcaaaccatatttttcttccaagtgtttgtttagttatggtcaaagtgaagcatgtaggcctacgttgttaattttggtaattaatattaagcactaattgtggactaactattttatttgagtgagataatttaagagagggccacatgatgtgtataccaagaatgattaccggctaccgcagattaaaattgatagtgcaaagcaatgagaggaaggtgataaatatggttatgtttttaacgatcgaagcgttgggtgatcaatttgctaggttttctttatagctttaccgtactatttagagggggtggtaatcttgacaaagaggtgatctaaataacacattagtgcatgatgagggtttcttgtatctttggctttgatctttatttctagagctagccggtcggactgagcctatccagtaccgttttggtgttgcaacgatagcatcgggcaaattgtcttggtacagagcattcgtcgtgcacgacgaacaatgccggtcagaccaagcctgggaggctaggagctggtcggatcgggcccattagttggtcagacctgtgaaagtcccaaattgcttggtagcacggaggccacggttggtcggaccagcccttcgccagcggtctaatggccattgcatttattgcacccccaacatatagattttgaactagtttcagggcggctagccgtttagattgggcccctcaatggtggtcggaccaatagagcacagagttgggggattttgacccccaaagactagttttggtgggttgggctataaataccccccccccaaccagcaggaggggaacttcctaggcacttcattcaattcactagagcccttgcaacactctgacaccagttaagcacatttctctcgatttgtaggtgtttcaagagttgattaagacaatacaagtgcattgcatctttgctagatcttttatgcagttgctcatctctgagctttggttgcgactttttactcttggaggttaccacctcctagacggcttggaggaattgtggcccggtgatccctccggtgaagcttgtggaggtgacctggtgttgtttgtgcatggtttggacctacgaagtggaggaagaattaccggctcccgccttgcccatccatttacgaaggggttcgaaggcttcgtggtgtgagcgatgaggttgggctcacctcaaaggtgacataggaagctagcaagcttccgaacatcaggtgaaaaattcggttgtctcttctccacgattcacatttctagagataattttagcccaaatcgtcctaggcttgcaaaacataatttagttagttagcgtgtgatccctaaaacaagcctagtgtcatgccttgattttcttgcagggatttaaaaatcattaagtaatttatttatataatttattttaaaatgtgaatcaatttacaagtgcgtcttgctacctctatggacttagtccactgtaggtcaccctccctttgagccgccacgcggggcctgctcgtcagctccgacgccccatgccgatacattaaatccactttcctagttaaaaaataaatctttctccatgaggccgtaatcccccgtctcccggagtcctgctatatactttctttgtcctaaaataagttcaattttagccaactcacacgtaccaatataaaaccaaaagactataatatccccgctttatcaaattccaatgtatttattccctactttcacaggcaatgatgattaaaagtaaacttaaattgagataaatgggagagggtaaaaatgatcttattgtagaacggatggagtaactactttcttttgcacgagaagtcagtcaaaaaaatggcagtcttggcagttccatatgtacaccacagtttggttggaagatatctccttactcagctcatcttatattttttccgattttgctaaacatattgcgacacatttttccaataatattagttgaattctggacggttcaatacactttgggatttgtgcatttttatgggccggagcaaatggtatgctgcacgtgcgagataagggaaggtctagacctgcattactccctccatccacaaaagttacacctattacttttatcaccaaaaccaatgagaaattaaatcatcttggatgttacaaaatcaagtagtgaatgtaagcatacaaccaatgagtatttagatgactccttgggttctaatcaaacatttaatttatctatttatttaactcttgaatacataaagactacaaatagaacaacttatttagaaaaactcaaatgtgaaatatgtctaacttttgtggatggagggagtattagattagcgatagtaataaatactttggagatagcctgcatgggcgtagttgcctaacaatcttttatcagggttctctatgatgcttagttttctggatttgctagaaaacttatgcaagttttttacccctaaaacttttagatttgtgaccattagatcgccttgagatttatgtatgaaggaaaaaaatgttagaaacaaaatttcacacatgtcatgcgtaagaacctagtgctaactaaccaaaccatagttgaataagttgtatagtagttacatacagttacaatgtaattacactttaaatatactatagttacatatgaaaatttttgattcaaaaaacttgcggcggttttttaataatccctagatttttaaatttaaatgatttttcatggattttacaacgaatacctacaagaatactcatgaaaattacattgtaactagtgaactttacattgttccatcttcgtttcatgaacaagtgattgatcgtatttttattgcttaggttgtcttcttatgcacaagcgatacttatacttctcgtttttgacgtgcatactccctaaaccgccaaatgataccttttttttgcaaaaaaattctatgataagtcgttttatatgataagtcgttttgacttttttctagtttaaatttgagcaagttgataggaaaatatagcaatattttcaacataaaacaaaacatattatgagaatatattaaatgttacttttaataaaactaatttggtgttattaatgttactaagtttttctataaacctgattaaacttaaataaatttaactattaaaaagtcaaaatgacttataatatgaaaaagagagagcgcttaattaatcatgctctaataaaaaacgacatcttctcccgaatacttgtgtagtaatactcgagtggtccaatgattaaggcccaacaaagatctgcggatgcattggtgcacggatggcgtgccatgtaggagcgaaaaaccaactgaaatcataattttcttatatctatttagttacggaagatatctcttcatcaagaaatcaagatcagttctaaaaagaaaaaaaatcaagatcaccttttatatattttcctccggagacgttctctgtcttcttcctgctcctgccgccgtgagcacccctgcctctcgtctcgcggccgctgattgcttgccggtgtacgggatcgtcaaaggagcttaacggcgagacgatgaagccgccgtcgccatcaccgcagtagacggcggcgaccacggcgcgagtttttttttaataatccctagatttttaaatttaaatgatttttttccctagactttgagaggtgtcaataatctttatagatcgcaagatatacagagctgacatgaatctatactcaagaactgattgcccatagccccatactattgcgtagatgaaacccttcaaaatttacattgcctaggtgatgcatattctgaattttgtgtggcagcacaatttaattcaagcaatggaatcagaagaataaaatggcataattgctcatgtaatcccttttctatgtagaaagttctccacaatatgagtgtacaaaccacattcctgaattctaaaacagtgcatatcaacatatttactgatccaaaattactcttcaagtattaaaccagaaagagtaatacagattcattactttactgaaagtatataggtccataagataaaccacacgctggagcaatagtatgaaggttaatcaggaaaacataatcagccattagcctcattgcctctaacatcgtcaaggggaacaaaaccacaactgcaataagaaatgttaaatcacatcaaattactcaggtgagcaataccatgccaaacattttgataagaacatgctaaatctaaagtatgtaagagtaaatcaggtgagcaatacatggcgcacataacattagtctgggcacaagatgactaaatctggatcagcagtttcaacaaacaatatggtgctctttagtctttacagctgaatatgtattgacatgtatgcaatgatgtttatggctcatgatctgaagatccaagttattttttaaaaattccattagtccatggcccaaaagctgactgtgctcttggaaaataataaatagagatattctaaaccataggattgacagtatatgagatacctaaaggtttaatttaaattatttatgttcattctggatcatatgaaaaggtcaaaatggcttaagtgaatttttattcttcaaatatatgaaaaggtatatataagcataattattgtgcactgaaaaatcttaaaatttgacaacagacacacactgtaggggaaaaaagagaaattggtttaaacttctctataggggaaggggcccagaggatggctggcttaatgctatgaattgggttatttgtggtaaatgccagtacaagtgcaagctacctttcatgagatataatcaactgtttagcttttgcatggttcgtacccaacttgcttttgtgtttctcataacccctaggaaggatgttgggataatgtgaaaagaaataaatccacattgtaaaaaccagtaaagccaatcatagcgtcttcagtgtctctgaaaatatcaacaaaagcattaaagcatgcagatccccagctgacaggttaaaacatagtcaccatgcaaaccaggacaggtttatatggaccattcgcaagaaagtcagaggagcatatatatatagacaaggtagagtaaaccttaatgagtgaagatatatagcctagccatgtgacgatcccttttttcttcaaaacctcagactctaaaagtcctacagtattagtcaatcaatttaccatacaataataaggtacaagaagaaattcttgagaatttaaactaacagagtctgaagtgaaacaatacaaataatatatgtgcttgctgcaatccttccgaatttaataaaggaatcgaactaccagaatctgaagtcaaactataaaaatagtatatgtgcttgttgcaaatgttcttaatcgtgcttatatatagtactgtacaatgtggatctagatggaacagtcgacgtggttgaagaagacctcaggcggcgcatcggtgggtggaaaccagaaggtagctgtcggcgaggaagcaggtggagaggtcgtcgaggggcgcgacgatggcttcgatggggtgcggcgcaggattgggaatttgggagacgagcaagctagtcatcggctgcggcgacgcagaacgcggcgggtgcgaggtccgctcaccggttgatggcgatgctggtgtcatgccccgccgcgtgagctacccgacatgctgctttgttctctcccggtcgggccaccccggcgtgcacggtggagaaccccgcgccgccgagcgagtcgtgcagtaccatccgtggcggccgcggggaagggttcccctctggctcccatgtagccggggattgaggcggcgatggggaggcgccgcggcacagcagcggctgggggcgggggtgccggggatgggcgcgcgcgatggggaggcgatgaggtgcccctgagggggcgccggggattggcgcggatatgaggaggcggtgaggtggggagaaggggttggagtggagggcatgggggaggaagagctatgtggcggcggcaggacgaagacggccggaggagggaatgcctgggttgtgggaaagggaggggatttgctactgctagggaggtggaggtggagcgacgacgagggatcgacggaggatgggcacttgggatcggggcggcgtcggggaacggaggtcgtggcacttggcggagaggcagcgagcggggaggcgcagtggcgctgtggagagcgatgggcggcgatggcgttgtgtggatgggagcggggacgggatccgagtgagaaggagaaggaaggatcgcgccgtggcaggatcgtgaaaggaatctcgtccgtaggatctagcagatctaaaggttaggaataaaagttgcaggaatcaccaccaccattacgaccttgtataggagtagagtatctagggtgagtttgagaagattgggaagatatgcaaaacgaggtgagtcattagcacataattaattgagtattaattattttaaattttaaaaatagattaatatgattttttaaatcaattttcctatagaattttttttttaaaaaaaacgcaccgtttaatagcttgggaagcgtgcacgtggaaaactaaacaaactctctctctttctccacccaacgaacgcagccttagttacggaagatatctcttcatcaagaaatcaagattagttttaaaacatgtcaaaaaaagattagttttaaaaaaataaatcaagaccttttatctatttttctccggagatgttctccgtcttcttcccgctcctgccgccgtgagcccccctgcctcttgtctcgcggccgctgattgcttgccggtgtacgggatcgtcgaaggagcttaacggcgagatgacgaagccgccgtcgccaccaccgcagcagacggcggcgaccacggcgcgggggttcgaggttacctgcgtgaaggatctcctcccgctcctgcagggcgtccccgtcacgtatcgcttcgagaagcacaacgtgagtcgcccatctccacggctcactgacggatggggcccgccccctcccctccccagccagcgcacgcgctcccctcccctcgcccccgcccggccgccgccgggtttcttcctcgctggtttttttttttttgtgtttctctctgttttttttttcctctctcgctcggtgaaataaccccaactccccgcgcgcgcgcgcaggcgaagctcgaggggacggtcgccgccggcggctacgcctgcgcttgccccgcctacgcgggctgcgactaccgcggcaaggtgagatcccggttttttcgcctcccctcccggtttttttgcgcggagagagagggggtgaggatttttttttttttggttcctcaccatcttcttcctcttctccggcggcgtggggggcggctgcggcgcaggtgctgtcggcgctgcagttcgagaagcacgcgggggtgacgtcgaagaaccagaacggccacatcttcctccgcaacggccgctcgctctacgagctcttccacaagctcagggaggtgcccgccgagaaattccccgaggcattccggatggccgcgggggtgcccatgacggtgctcgccgccgcggccgccgccgccgctgaggaggcgccgcgggagcgggggcttgggccggggcctgtggcggcggagcagcccccggcctcggcgacgccccgaccgcgcccgaccatggagatgctgaccgaggaggagaaggccggtttgtctctccttggcttgaggtgagtgacctccgctgcttgactttcgtcgggaaatcgctgcgcagtagtactgtagtggtgtgatttcacggcagaggtgtatttggccttcccatggggatgaattctatagtgactgggggaattgtagggtattttgtcaaagctggaaacaatgacgtgttagattagtaaaattagtaggtagttgcaggattatgtcgggcttaattcgattttttgagcagggcaagtggctcaaggaccgaaataaattccatggacggcattgaagggcttgctacagaagcgattgggaatgcaccaagcagtgaccatgcgatgcttgatgcagaagagatggggaatgcagctgctcagcgacctaggaatagtggtctttccacaaccacaactgttaaagtgccggtgacagcacgcaataaccatgcaatgcctgatgcaaatgaggtgaggaatgctgatggtggtcggtcagcaacccttgctgttaaactggaggttacatctggcagtgaccatgcaatgtctgatgcgaaagagttgaagaatgcagattatgagcaacctagggatagtgtgctggcaacaacctctgctgttaaagtgcgaattggagcagccaatgaccatgcaatgcctgatgcggaacagacaaggaatccagttcttgagcaaccttgggatagtagcatgttaataaccgctcctgttaaggtgcgggtgacagaaaccaagtatcggccagagagtatactgaaagatgtaaggggattgctgtccactggtcttcttgaaggcttcagggtaacctacaagaagaatgaggtccgtgtggttccttcgctgttgaatctgacttgaagtctgcttttgatttatacctgaagaaaaatatgtttcttttggttatccttaggtggagaggattggaagaataaatggacaaggatattcttgtggctgctcagaatgtggatatagaaatgtcagctttctgttgtctctattagcgaaattttttatgtctgttcccatatattatctgaaaatttgacctgacattaatcatgtttgacaaattgcagataatgaatgcatgtgagtttgaacagcattccggtgagtcgtctaacaatcaaaacaatcacatattcttggacagcgggatttctttatatatggtgatacaaggactgaaatacactaaacttgatatgcttggggatgtgattggaaaagtgatcagtctccctccaaatatgattcaatacgaaaagtggaaaggtatttaattgagtacctagcatttacagctttctagcttttgtatacttcaagatgctaagctttctgttgggctatctttttttaaaaaaatttttatgtcatttagcttcgtttcaactggaaaaggattatttcgatgatgcaccttcagatccttgttcaactcaaaggtgagttaccgtgcatgtgaaattttagtgtgtcttgtattcaggtttcccagaaacccattggtgtaccttgatttatatgttttgttcttaaacattgttttccggcttgaacttttcaataggttctctaagccccatagtagtggcagcttaatgctatacatctgccagtataaatgaggtttcaatttaagctcatgtccaagcatgagcaaattctttagtattaccattttgagttgtatgctacctcattttatcaagaacatttaggttatcataatccaccagagactgactccagcattcttgaaaactcaatttctagctcacaagagtcgaatattgccttgacggattccttgaaagactcaaccagcaacgccagttcaatcctcaactggagttcattcaggaggcgttcagataggcagttcaaacgaggaggcactgagacttcgactccaatcttgagtagaagccctgagaaagagatatctgatctatctacaagcacttccatgaagagtgaagaaactcctagtgagaatactgcagggcttctcactactgatggtataaaacataattctgctggacctgttgcattgagatccacgtcttcagagtgtgatcccattaatatgacatttcctttgtcaatttcagttacagtaattcaagatcctccaccagaccacaatgttgactcaaattcaaaagatttggggcaaccaaaagtgaggtaaaaggttaaacctacaacatttcttgacatttgtcacatttaggatatacagctgcaataaatggagaaatcttagctctcgaatcctttttgttttatcttttctccagagataacactttgcacccgatgctcttcaaggaggggggccttccagactatactttgttaacttacaagttgaagaacggagaggtcctctaaatagttaaatgaactacattatcctttcccaacaccagaaattgtaacaactctcaggaacattcacacttccctgtcttgtaggttctaaagcaaggatataaacttgggacaggtataatctgtgaatgttgcagtattgaggtatctgtcccaaacttagcaattgcccaagtttgatctgaggcctttcttnnnnnnnnnnnnnnnnnnnncacgttttttttttcctcttttgaggtgcagtatactccttcacaatttgaaaagcatgttggaatggggagaagacggcaaccgtaagcatcatcattatatatagaggcgtttgaaatattttttactcaaaaagggatcttggtgttttgttcataaatggaggatatttgtggtttcaggtaccgtagcatttatacttcagacggattaacacttcatgagctggcactgaaactgcaggatggtttaagttcaaatgtaaatattgatgaactccctactcttacttcaggtaacttaatggatcttttagttttctgtttatttcatccaagtggcaatgtgcccttatgctttagttatttaaaattttgcattttgagggtcattgcaataatcacgatctctgtagaattattcaataggttctttgtgaatatttgggcatgtatgtattagtgtcttcgtgtttctttgtttaaagaggggaacctatgtatatagtctttatgtttacctgtctaaaagaggggaacctactgtgataatggcattatcagttcatcactttgagcaggaagattatcatgtttttgtccacatttgatctcttgatgactcattgccttcttagttaagaacttgagactataggatcaaagaggtaagagcttgtttgctccaatatccaaggtgaagccctatgtcttaagtttctgggtgaattggatggtgcatacaataaaaatatggtgacagagccaggatatcctaagattgagattaggttgctgtagtttagaaaacaatttcaggtctcttgagcctatgtaagagccttataatgaagcattgggtgaagtagtgcatgaaacttcttaaggagcaagatagccgcattgctgaggtttagtaatagagctcatgctttttatgggcaacttagatgaaaatgggacatctatacttgatttagtacatgaagtaactactcattttctttagacaatgaatgaagtaatattttgtcaagtaaagagtgaaaaatattgaatatatttgcaagatgctgcctcgctgggaaatattcagaagatgattttatattttaattgttgtatgcgcatgagtacctaatcttctgttgctaccatgagttatgttaagctttgcatctaaaattagataagaggtagaaatttaagcttttggacaatccatttacgtgcttttgagccttagatttcttgacagaacctaatgactactttaggaccacgaggtttatatctgaaaaatagcatataactgtttcagcatggggacactggcacactagtcaactaagggtttggaaccttccctcctagcacgcaaaatggagtgacgacttagcgcacgattaattaaatattagctaaaaaaacttgaaaatggattaagatgatttttctaaagtttcatatttatttatttattttgcaaagaactcgctgtttagcagttcggtaagcgtgcgcgtggaaaatgagggggtagaggttagaaaccttcagtgctgaacacagcctaattgtggcagctgaagaatcacttcactatcttactgaggaccaactttggcatagataaattatatgcagagactatgctattcttgcaattcatgcagatctttatggagcatactcaaattttttttctccataacatggtttagaatttctttttgttgtgcagtacccctctttctttcttttttgaagagaacattatcgtttttctgttatgtgccaagattatattaccaaatcattatatattctctagactctacatcataagcctacatataagcacaaaaacataaaaagtccaaggaattaatgctgaaataataaaatatgtctgagggggtaataagcaactccctcattcttgttttatatgtgggactgttgcctgttggctaaagttatgcagaggttagggtaattgggcacagggcatgttgaacagcctgcttatattttacaaagagaacagtccgtttctgttggaatctgtcctttgaactggagaacttgtactctttctctccatgctttctgaggagtaaagaagtgaaggatggtggaatattgcaattttcagagagacattgctgtcttcaaaccatggttct

SEQ ID NO: 45979 - DNA, 4501 bp, Oryza sativa
  unsure (1)..(4501): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctcgactgtttttagaaaaaaaaaaaccgttgtatgctcaatagcatgacaggtttgttggttccagatgttctagagagcgagtcactactgtacttaccagattgtacattgatcatatgaacagtaatacagtggactatatgtaaatgtaacttctcttttctgtagtctgtcaccaatgctatggtcgaaacaggcttggaagacttggtctcggttcctttgaagaaagagcaaaaccaaaaaaataatctgatctccaattgagccggaaagatcatttacaccatgtcattggagtggcagctatgcttgatcatttacaccatgtcatcctatctaagacatttgaattacatttgtgaatataaattgcgaccaagagaagattccacgaattatgtacacatgcactgtgatcagcaagaccagaataagaactgacctgtaaatgtactgtaaagtgtaaacacctaactgctggatatcctttctgtagtatagacttctatctagttcagagcaagccatctactagaacatatgcttctctgatgggggtctctgcacgtcagatcaggtgtaagatgtgtatgcctgtactggagcaagagagcataagtacatggcaaattagagcaccaatttggcacgggcatatcataggatgtattcaaccactgtagatatggcctttggaccccctcgctcgagcaaagagagggcaagatcgcactcgtgccatttccaaagcccagacgccagcttcttcagcgtctcgagcttcacctcagggatccatgttggcgcaaagtcgaccagcaagcccacaaaacatataacataggttctccaagtgacctggccacagccaagctcaatgttaccctgcattacattggcgacaaactccaagtgcctatctacaacccgttgcctcttcgatgtgtatacggaagtataaactggggaggtttctcctactccccaggtgctggccccagaaacaaggagaacatatgccaaagcaaatccttcgaaactactgcacactggtccagcagaacccagccttgcttcaccagctgaaagcagcattgttggcagaatctgctcatacagaagacgaaccaactttattccaccagcatgacaaagcatagatgctgcaagtgatgctatctgctctacagaacatgtggcagaagatagtgtcatccgaccagacttcagaagatgaggtctactagagtcacattcatttgctaatgcacgagctctctcaatgacaaccttcaaaatctcttcacatacaaaatagttgtcaggaaacattcggcagcatcgtgtgtaaagtaatcctggcgataaagaaaaccggggacttctttcttggtgagcctgccccagcagcctattcactcctctgtcagctacaaagcaagaacgcccatcaaccaaaggcccaaggaaagatgagaagcaactcctgattagttgagcaactgcatttttatctctggtaaatggtgtctctgaacatgactggatgatataatcatgccaccgccgaactttttgtgcccagaatgcccctatgattgccatgctaggccatgaacttgatgtagcacaaatttccactcctttgtcaataattccttgtaagtgattaaattcctccatcttaacagttattgataagctgataagagttgctattggtaatggaagcattgggattggtggacctgtatgattgagtgacaagcaacagttatagtataagaagcttacatttaaagagcttacaaggaaagtcttcttaaattcaagataaattttcaatggcatagctcacaaatgaagacaaataaatgatttactatcgcctgtaaagcccctatttgacatgaatgagtaaacgtaccaacattaaagaggataatatgataacagcagtatatacctgtgacatacaaccatggaaccaccactactcctgtgttattagcaacctaatttaataagaaatgtgtttctgtccttttaaaagccaagttttttaattactaaagtaaaggtaggagtagatcctaaaataaaatttatgcaatttcttactctttaaaagagagttggggatatcgtaggtatcccactacggatctttagtggtgtcatggtcttcagctagtgggttctgtggagtcgattgaagtctatagccatggatgacaggaggatgagggcgttctgcacctcatcatcccagtgcagtggtggaggaagaagaaaacagagtggactaaattcttgcttatctcttcattatctggccaagtccctttataggagaggcatcaatcctacaaatgaagctaaactcttggaactcattaactaacagtgaagtagtgaaccaatctaataatcctgataaaaccaacttgaagataatcctcacacaatcctgatttagtcgctggcttgggtgtcgccagagttgggtgcccattataagtttatcacagtacatttactacttctgtatgcagattaaatgctagatcactaattataatttaaagcagctatttaatgtatacatgtacaacattcacacctaccattataagtttataacaaatatatctcatgatgtactccctccgtttcatattataagtcactttgggtttgtcctaagtcaaatctctttaagtttgaccaattttatagaaaaatataacaaaaaatttccaacataataaatatactataaaaatctatccaatgatggatttaataaaactaatttggtgtcgtagatgctggtatatttttctataaacttggtcaaacttgaaaaggtttgactccggacaaacccaaagtgacttataataatggagggaggatagcttaaattttgctccacagaacccagagtgaatgcataaaacaatgttcaaacatcaaatactgaggtcaacaacttataaggccactggaaatgaaataaaaaatagaaacaacggtagcttgtagtagcaaacagaaatgaatcatttgtatagaaagacataaacttacgtattcgtggagagatgttaatatgaacaccagcggatgcaagagcctcctcaatatcggactcaactgctaaaagcgttgcagcaggactgggccagtcagtcccattcagcataactggcttccataagccacgagtaatttctgccgaaaagtagctgacgataacagcaactgaagcaggcaagaagtccgcaagattcctcaagcctgtaagagtgtaacggtatgcaccagtaaatatgcaatgacaatgggaagtgaaaaatacagttgatgtctgtcaatttcgataaacgaaaacaatttgcagatagctggaaggtgagctttttatataatgctacatagagggaaaacgtccatagtgccatagacttagtagatcctacataactctaagaactacaaccagacgagttgccctaaactttgaagtacaagaccaaagtccacttaacaggatctttaacccccaagcagtggtgcagccagctcccaggctgatcaagtgtccacctgagctctgcagctggcgtcatcactatcaactaccagaaacacctataagaagtagccagcaaccaggaaatgctctttgacacctgggcttgatgacgatgcggactccgccactgctcccaaaaggtggttttacaaacaagtttctacgttgactgctcaaacaccaaaattggccaccctgaagttatctagagttctaggctactcaactagagcttaaatggggcaaatggagaatctcatctcccatttgtcaccctgtgcaatcccttctttccaattctgaccaaagttactctcatttttaatcaactccatggcagctctcaatgagttaaaatgtgaaaacaaaaatcagcctgggacaccatcttacaaggtaaaattacctttaaatgtttatgaggtcatattaaactatgacattccatttcatcctgtacacttaaaaacccagtaatctgataaaatatttagaccacttagaggaaaag

SEQ ID NO: 45980 - DNA, 12686 bp, Oryza sativa
  unsure (1)..(12686): unsure at all n locations
tttcaatacctcattggtcaaattttgaattgcttagattcccttcccaagctcctgatgattgaaaatgctttgatatccatgcactggaatcagtatcctaaaaatgcttatgttgtggtacactttttgaatcctagacatgtttatattttggaatggagtaggctcttacctacccttggtccacaaatcaagaaatcgtatcccttcaatactccttacctacccacccactaatactaatttctcatcgaggggcattttagtgttttaccctccctactaaagtttccttggaatgcgagagatccatttattttgggacaggagaagtatatccatagacagaaatatttttgcaaattaaattacataatatatgaatattgaatacacgtaagcaattttaaattcaggatgacatttatgaaagtagtactattgcacttgagttaaattgatgataataaaagctcaaagaaattttgttactgaaggcatttgattcaatctttcacagtggaaagtaactgggataacttacaggacagaactagaactaaatactactccctccatcccaaaatataacaccgtagtactagatgcgacacatgctgctactaaggatctggacagggggacatgtcatatgtagtactggttgctatattttgggacggaggagggagtatgaacttgagggaattaagaaacttcatcaaaaagatattattagtttctgaacaacactacttaaatgtaaatggaagatttagcttgttagtgtaaattgaagaccagtgttagatatgcaagtaaaatgcaggatactgaataaaaacctgtaatcaaatcacgagacgaaagcctcccatgtgcgcaggcagctaaaacagtctcaagcacaaaaggaacagcttccagcacttcccatgcagtagctggcggcccttgggagacatcatcttgtgtgcctagagatgaaccactcatactggaacttgatgttgattgggaactgacaggagggatgccactttttgacattttatggcagacaattttcagtatcttattggctacttgaaggatacttttccttttgtaagaactagaaagagtagaggctatgcaagcctgattctgaaagtaccatgcccgtagctttggaaatgagtcaatatacaccggtttttgaaacgatggatctagttgaaatatgctctttctgctaacatcatacggactattcaaagcaaaatgactgtttcgtagtagcaggagaaaatccaaactgatctctgagcaaacaaagactccatgttttgatagtgcatactccacagggggtctatgaaatttccacaagcgaagaagacacaggaaagcacatgagaatacggagtacacagaggcctcttcaaaactacaattcctatggtcagacgaaggtaatgatccaaatatttcgcataaaggcattagaatggcagctagttctggaacctgaaaagtttgtaaattatataaaatccagcatattgatatttgctttaataatttaaaatgcaactctgaaatttagcaattcattgtctttatgaaaaacatcgatttccttaccaagccatacatagagagaatatgaaccacatcaattgaagaaatcccagatatgagagcatgcagcataggcatgtgatgtatatagaacccatctgatccagagtctagggggagcaatgtagacagcaacttaagcaccatttggataacatgttcctaaaagagcacaggaaagccacattaaatcattttcaaaggcagtaatagtcaataatgacacatactatacggaacttttcaggccaaagattgtaaaatagaacaagagcattttgtatgtgccactcgttctatttgtgctccacacagaattctacctgaatgttccagccacgaagaagggatgctccacacagaatcttagacgccgccaacttttcctcatctgacccacttactgcaaaaggttgcaatttctccaactctgctaggctaaaataatcaagtaggaacggtaccattaatcaagctagtgagcaaacattaaaaaacccaaaatgctcttaaggaattgaattttacaagtccatgactcatcacctcgaagcaggtgtaaccataagtgcatccttaaggcccataaggggtgacccttccattaaggctgaccaaggggattcctcaacagcagatgcgtctttaactggaacaacatagctaggccagaaataaacagatgtatcaactaaattccttgctatacaagcttccacaataagatgtagcatatttcccgctgcaattttagaatgattatgagagaaaatgaattgtttactaataagaaatgcataagaaaaatactagatattgtaaaatcagtctgagataacctgctttaatagaggagatatctttggaataattgtgacctctctcattccgatccttcaaaacagataaagcaactaatgctttcctagctgcaatatttgctgactgcactactgctggtggaggagaaagaagaccaaaaaattgccctagaacttgaagtgaagacaataattctcctcttctaacagagaccattccaccttcaatcttgtcagactcttccttaagaatggaagcaatagacagaggtacaatagccaataacatgcacaatcgagaatgaagatgaggaaatggcccttctggaatgccacgatcctagtaaacagatacaaaattacattaaacgaacattctagcttcctcatctgttaataaagaaaaaaatgatgtttcaaaagttatcttaactcgttgtataagccgtaaagctgaaatccacagagcttgaaaggtttcttgccaggttgctcgattaagaacttgaagtgtcttagcaagttctgtgccaaccaaaggtttcaagttgataaaaaaggttatacagcagttgaatcaacaactgaaaaatatattagaacctgtcagagcttcaattgatgatatggtatcaagatgtcttccgtccattgtgttctccataaacatgtcaaaaggtatccaacaagagctctttcagcgcccaaagacactgcgtgcagcagaactgcaaggctttgtactcacaatacttcccaatagattgcctttgtgtaattgatgtcctgtagtaacaacttttcgtatattcatcatcaagctgcctagcagattatgtgcagttccaaaattctttgacttcagagcaccaataagctgaagcctctggagcaaaatattgaaattttcaggtctaccctagcacatccataaaaaaagggtttccagtcagtgtggatgccagttaagtgaaacttttaattattccagcttccatgtaggattgaaacagctaaacgcacagcaattatatatgagtgaaatgacaactgaaataaaaacccaactttgaagtatagagtcatcccaactcaaaagataagttttttcggtgatactggtggtctggcctctgtttcggagtgaactatctagccccaattaacctggtctgattctgaccattgtggagatcagaccatcagactatttacagccctaaaaacctaaagtaaaactattcttttatctataacacggattaacttcacctttggactgcagaaactagatgagatcatgaaaccaacctaataagaaatcttcagataagaagtctagatctaaagatgttgaacccttaatctacagttatctagaatttgatcaaaacttaaaacagtgacaactttcaaaccatgaggaaattatctaaaatccagaatgaatgttttgctgcagccagcagcatcaactaaatgtctaagtcagaacggatttattagatctgtcaatggctgtgaaatatgaaatcttactgcataatatctgccaaaatatcatacacttttatgttaaaaaacttcacgtttgcatttgcacatcaagcggtttcaatgtgatggcaagaaaaccagttgtttaatgaatctatgtctcaaatgaagctgaatcactaaaactgatatcagaatcagacaaggtgaaaaatggtaaatttgaaaacagtattacatgataaaagatttgagtggattttctaactaagcagtttctgccacaaaattaacatatgatataatgatgaaagatttaaattgtatacctaagtatattcaaataataaaagctaaaaactcaagtaaaacaaaactgcatcatatcatgaaaaaattgatagagagttcggatggatatataagattttatttaatctttttttcttaggcaataaagattaagaaacaaggatgcagctgcatacgtgttacgatagactagacggagaaaaacttgagtatttttgttagcagtgatcttctcaactacttctaaagtcataattgtgttcttcctcctcagacattcacggtgctcatctttcctatcaaatgagcttcccttgccatctatgttcatacttttttctgctccaatagcatatgaaatgtcatgtccatcaccatcaatagttggcaaaccacaatcttccaatatacagtcagtcaatattttgataacgcttaacacaaacaaaataactgtatgtccaaaatccactctctgaaacccatagctatctgaaagatgcaaagcatcatcaatagatttgactaacctgcaatgggaaatgaagataattaggaacattttacagaatccaacagttctgataattaattaaataaactaaaaatatgtttctttttctcgttgagtgctccctccatcccactcactaaactaatctttgactttaaatttctcatatactacaatgtttgtagcaactaaatcataatcatataaaagtaaatctaaatgataatccaatgttattattttcatcaaataaaatttaatttataataaaatatttattggtcaaatatttaaagagttgaatttaaaagtgtgcgtgcgccttagtgagtgggacggagggagtacttagtaatgaagtagctagaaaaacagatgctcctatcctgatgacatgaaagcagcaccagatgcagataagatcacatatgaaataacacaaattagatgaagcgctggaccattagatatgcacttgaggagacatgcctgctttgcataacgcattatacgtacacatttaagtatggacaaggatctaaatggagtatgccagtgttgaaaggtgtgtgacttgtatcctacccgattaggacgaacactaacaagattatgatttctacttctgtttggaagatgactagtgaacttgtatataaaagggggatggcaataaacaacccaagccatgaacaagccgcagggactcatccaaagcaagtagaagcaatttagagcacatgagtggattcttgtgtaaaacaattacgcgagggtacaaaaggtccaagagggttgtcggaaagtgtcaaccccttgtactattttgagcttgagtttaaggaatatgcaatacgattataggaataaccaaatcttcttcaatgtcatgattgtttcattgccatgttagttccctatggtattcatctactttggtcttaaagacttaataccaaacacacttgtatcatatctcacagcatctgaaggattcaggatttttgcacataagggatatcaaagcatgacagtcagactatcatcacatgaatttcgctttccaagtataatatattatacaatatatcaaacatacatgactaaaatagtgtttcatgtgcaggggttcatgtcatagtacaaaacgcggaaccagcgccctcagctgttcagcttacttgaaggaccattcatgcaattgaccaagtgaggaccagatgaaccgggcagttattgacagaaactggtggttcgtgtgcaggctaaccaagacatggacctttattaggcccaatagtctacctagtaaggctcatatacatattactccaaatatttgtgcaaaaagaggtgatatgggagtcaaaccctccagctagccaacccgcatggtgtgaccaatgaaggatatgtacacatgacataagtgtttctggtcctgcagctgaatggctgacccagcagtcggaccgttacaccagcaaaccaggagctcagatggttcggtggctggtgcggcattttttactatggttcatggcattgtttacccccatgaacccttccacatggcgtattgtttgttaatatgattggttagatgagtttagggctggcttgacacaaaagagtattcagtagcagcattcatggtagcaaagatgaataaacaagccgttctctgagagtctgaagtccaactgtagtagtctttatttagactggcagtaaagattggcaaattttggtataggacatcacgactttgcaattttagctggtgaacactgcagaagttaatctttcggggaaagcactcccaaaacatggatatttgctgctggacaccgcgtctattagaatattcatttctggctaaataatggagagaaacagcgtgaaacatccaatacccctgaccccacaggtcagttctcccatctctctcttctctttcctctctctttctacctctgcggccccacatgtcattgctggagtccttcctccccagtccccaccttttttccctcatcctctcattctctagctcgtaggggaagcttggtggaggtccggcggggcgtggtacagaggatcacggaggcgccatcactagagatggcaacgggtgcgtacccatcgggttcgcctaccccatacccacacccattgaaatgaaatgctcccgcttcattacccacacccgctcacgggtgaaaaattcccccatacccacacccgcacgggtgacgggtacccattgggtacccatacccattggagcaatcagattgagcacacaatccatccagtcaatcagcagtgcaacaccatagcaaagttttatttacaaattaggattaaaaagcacacacacaaaccatgcagccacattgcacagcccacattgcagaatcaacaaatcaactgataattcaaacagtgatataatataacaaatcaactcggcagctcggctttgctcgacgcctcgaccccggcaaaaatccctaatacctaacctagctagccacctgcctcggcccccggctagtgggtggactgcatcgggcgtcggccatagccttcgtgcacgcggcgcgggcgagcggcgttcgcgtgacggctagcttccccagccacgggatggcggcgcgcgggtgtgtactgcgtgcggcggcgcggggatggcgtgcggcgacgcgggtggcatgcggcagcgtgggaagcgagggcgagcgcggtctcggtgtgcggcggcacaggtggcgcgggcagcggccggcggccggctgggcaccctacaggtgagatgggtgtagagagggggagtgagggagaggaagtgggtgggaggcttttatacctagggttaaatttgttgttgggccttgggctgcacatgttcttttgggctgaggcctatgggtattttttacccacgggttaatgggttcgggtgggtaaagaacgttctacgacccggcccacccgatgggtgaagtttatgcccgataagagacccatgggtacattatttggaacacatttgcctcctaatagagtaaaaacccatcgggtctcgggttatgggtccccgttgccatctctagccatcaccaatgacggatgaatgaggggaggggaggggaggggaggagaaccgcatgacagtgtaaaatagcagcacatgagaaatagcagatggcctttatcccacacactattaacagcatatgtggtattatgtgaaaataagaacttgaatcaaaattccacttgaattttacagtaggttctgctactacatgcatagtattacacgttggctgcgtctgcgtatattttatttaattattgaacatattataatttgatatgtaaaaatgatattactatatttgtcctcaaaattactttcatctagttacactaccaactttttttataaatacataactaggaaaagaacaatgaaaatacatgtgcattggagatcgtgttaatgtcctaaatgacaaaaaaaaaagcacaaaggttgtactttaaaactagcatcctgaatctcatgtgggtgctgttgactactgttgtgcatacgttcatgacagcatgtagtccaggcgtacacatgacaaatcactgtacataactgttggctgtcatactcatcacagccagctgtccagccatgcatatgtcagctagtcagctacattaatttgattgttctactactattatataaataaactatgttagcctgataacaaagaggatatgtccacgtttccacaacagggtgaaagaagtaaccatccatatgaatatctttcacgaatgtccaaacaaccttggtaaagatcacaatgtggacaggtgcacaaagatcatgtaatcatgggctgcagttgtccaaacaggtttggattgaaaaaaaaaggtcattggtggtatcctgccctatgcatccttttatctcgtactacagtccaatcagacaattggaccatgggagcactttggaagtcttcaaaaccacagtgcaccaaaaaggagtgcccctctggccttgtgctatcaactttgaactttcaaaaccaagacggcacacaactaggaaattcacatcgttttcaacctaacaaaatttctccctctacacaggccccactggcgcagcgcaagcgatccctctcaaaccatcagccctaccctacaacccggaaaataatagcatcaacatcagcaacacgagcacaccgcggatttggacggaatctcgcaagcacgttgaccaattcaaaggtttgtagcacgcccataagtttgtgtggggataggggcatatgtccatgtcatcaacaaatccagagcacgagacaaaccaatgtgaagcaagcaattgagactgtagtatggagcaatcggtgcttacatggccttcgtctccacgctctccgtgcagaccggggcgaccgtgtactggccgagcagctcgaggtagagcctgtatgcctccggctgcgcctgccggttgggcaccaccctgcagaaattcccccccaacacaatctgattaatctcaacccgaggtctcaaaacccgcacggaatcgaactattcggcggtggattagggggcgaaacgagggcttgctcgggacctcggggtgagcagcgcgagggcgaggagcggggagacgaggcgggacgccatggcctggtccagcaccttccacatcgcgcccgtgttgtgcgcgaagcacaggttggacaccagcgccgcggcgagcgcggccccggccccgccatcgacggagatggaggaggaggcctcccgggcgcagcgcgcggcctcggcggcctgcaggagcggggggtcgccgcgcgccgcggacgccttcaccgccgccatcacccgccgctccagctcggcggcggcggcggcggtggcggccgccatgaacgcgattgcgccgccgcgggagggaggtttgagggggttttacggggcgagtggttttggaacgatggagaagggaagagaagagaagagaagagaaggaagcagagaaaagcgtggtggaacggaggacagaggagaggacgaggaaatgacgctcggctttattgcgcgcccgcctatgcaggaccttttacattatggcccatgtgttgtattcttgtttttgcaaatagacagctcaggatactagtaatgcaggaatggacctcggctcaggtttccgagggtattgccatataggggtgaagacggggtgggtaaggtcggatcacaacatttccatatcctaactcatattttattttaaattcaaaatcaagtacgggtagtgtccgataactttttttgaatcggattcgggaacgggtttttttatgtccaattcatggatatttaatgtaagaagacaattaaagtgctaaaaaagatacatcaaggaacaaattatataatattacatgtgagctcataaaaatagtgattaactaatcttttatcatgtttataggtgaacttataatagattttcacatatgtttcataatatggaacatatgggcggatataactattcacgtatcataacccatatttttttatggattcgggttcaaactcggataatatcggatatcccattttctctctcatattcctcccgcaagccttgggtcggtcgggcgggcgggaaatatccaccccgttttcactcctattgccattgaggtataacatttcagcatcactaatacgaaaatgatcctatccgggtgaccgatgcacacactaaatatagggcagttactccccacccacttcttatctattccctcattctcttttctctctatcccatcttctctctccacacaccccacacatgtgcctctacctcccctcatcgtcgggggagcgagaggctgctcttgctacctcgccgctggccggtgaaaacaaggaggaggattgcctgcttctcttgcgattagagctcaagtcgtaggtggccgtgcttggggacgtgctctctgcgaccaccgccatgctgatggccgagctcgtggcagagaataggagctcagtagcacggtggccatagggacgcaaccgagctcagcccaacgtcaatgatgacggtggacacacggatgcggccgagctctgcggcgtcaacaacggtggccgaggtccacggagtggacgacggcggccacgtggatgcggtcgagctcggcgcggcgtagaggacagtgagcgcacagtttgtggccgacgtagatgagttcgacgcggcatcaacaactatatcctccccgatctcgacttgattttttttttatgtttcagtcaatataacttaatgttcttttatgttgaattgaaatgttgcaatgagtttttatggtgttccataactttgtcctttgccaatatggatttcttggtatttcaatagagcaaaacttgatgttttatatgttccaccaaaatgtttcagtcataagttcaaatgtgtttcaccatctcaatagattaaaacattttctatttactcggtgaaacatttttcccaactagtaaaaaagcgtccgattttcttaaaaaaacgggcgtccgatttgtaggctcttcctcactaatattggcatagagtcctagcggctcagtctaacttgtacgccacttgaaacgatgcactagctagcctcacctagcaccaaaataatactaccagcataatattgatgagttttgccagaccaagatttcagaaacggttttttctactgattgtatactaaaattactctcctatttgtttcttaaattcctatcacatgataggttggtggtgaatttttttaaaaaaaggttttaaaggtgtccacagtgcttcaaaattaatgctttttcacatttagatcgatcttcatagaggatcccgaacgatctagacatgtgtggggacaggtgtttggctagagattagagtttaaacctagatactttgcaaatgaaaaatgaagtacccctttactctctcgttttccgcgcgcacgcttttcaaactatagattagagtttaagcctagatactttgcaaatgaaaaatgaactaaccctttactctcgttttccacgcgcacgcttttcaaactattaaacggtgtgtttttttacaaaaagtttctatacgaaagttacttaaaaaaatcatattgatccacttttttaaaaaaatagctaatatttaattaatcatacgttgatggaccactccgcttttggtgtgcactgttcacagctgggaactcagccagccgaacacagcctaagggtgcgttcgatcatccccttttctaacttctactttctctcatttttcacgcgcacacatccccgaactgctaaacggtataaatttttgccaaaaaattttctatataaaagttactttcaacaatcatattaatttattttaaaaaaatgctaatacttaattaatcatgtgctaatgagctacgtcgtttcccgtgtgggagaaatgggttacgaacccatatgttcaaacacaggattaggggctatgggagagaatttggtgtcttcttattttgggatttttaataggagccgtgctggacttcgatttttctcctttcaccctaaaaactatttgggggcttagtgttcgaattttctccttttgcctcaaaaactatttggaggtttagtgtnaggtctactaaatatattctaatgctcaacatagtctctcgtaaagttgtagttgctagttcacgtgtattatattccctcattccctaatatttgacgacgttgattttttaaacatgtttgaccgttcgtcttattcaaaa

SEQ ID NO: 45981 - DNA, 6635 bp, Oryza sativa
cggcgtcatctattaaaaaatagaggtagtagttacttatattttttaaataagacgaacggtcaaatatgtttaaaaaagtcaacggcgtcaaacatttaaacatttagagaaggagtgagtatatatggtttttaaaaaagaatcatagtaattgttttttgagtttgctcgtagtagaaaaaatgtgtcataaatacgttccagcgtggggaaaacgtacgtgacgttacaccgtaaggtaccatgaatttccacatgccgttaggacgtagtaccactagcacgttcgtagatccccgccggtcacgactcgtgggtcgtgacgttgaaaaacctagaggaggattaaggtccggaactttcccccgctttgaccctccgatcgtcgcccgcgcgcgtcacaccgggaggtggactttccacacgaacagaggcagatcgaaagcgaaactgctaattagcggtcagaccagcgccattcctccgcgcggcgtagccacgtggcgcgcgggggagaggagggcggcgggagagcgcaccagtagcctttttttttttcggttttttcctctttttctacggtttttccgataatacttgctcccgggcgaccgacgcaggggagctggatcgggcgctcccccgcgcacgcccccacgtgctgcatgcagatctgggccccaccatgtctctgctcctacatactattgcaataaatcactcacatattttggaacccctctgttaagggaatttggtttattttttgttccacaaaatatgtttcaactagtgtacttacaatgtttcactatgcatagatctaatattgcagtgaactaaaatactccattacaataaaaaacccacatattttgaaaaccccctattaagggaattcggtttatttttttttccaccaaaagtgtttcacctagtatactcacaatgtttcactatgtatagatctaatattgcagtgagctgaaatactccattgcaaaaaaaaaactcacatattttggaaagccctattaagggaatcgttttatttttgttccaccgaaaaatatttcatctagtgtacttataatgttttactatgtatggatcaaatgttacagtgaactgaaataatctttcgttatttgctgaaacattgtttttatataaggtgaaacaacacccgatttaaacgagtgaaacattttcgatctacttagtgaaacaattccgatatacctggtggaacatcgtgcaacatttaaaaataattcaataataaactaaaaaaatttcgtcagaatatatccatgtgtggtcttgttttgaagatttaattgcaacgaatttaatggtgtaatcggatcataatttggataagtaatttaagagaaaaatcaatttaaagtagtttttgcatgtaaatcggacgctgacggcatgctgacgtcagcgcccgatttttctccaaatcgatcgggcgaccgatccgtaggcgcgtccgggtttttccggttttctttcttttccctgctgttttcccccttttctcggttttttctttgggtctttttccggttttttttaatatataagtatcttcggtttttaaatctatactatataaactttgtgcatgtatatattaaaagtgtatatatctgtgtataaatacatatagtatatagtatagtagtataagggatatagtagtataaggaagagtatagtatactagtagtatatataggggataagattaaaaactgaccgcgcgactgcggccgcgcgcggtcagtcgctcatcagcatccccccgatcgagagggttacgtcagagaggagcgtgatggcaccgatgtgtgggtcctatcacacccgcgggcccatttgtaagttaccagacgtgcacccctttctaccagtattacgtgtctatgcgcgcgtaatactcgtgtcgatgtgttatacatacgtacacattttagtattatgaatcatattagatccataatagtaagtcacatctaatactatatatttttttttctttcactaaaggagtacgtgcttcgagctgctaagcacacttacgtgtccactgtcacgttggtagggtttgtaaatttcggttcgatattttttaaacttattttatcttaaatttttattttttttgaacttaattagctatatttattcaggtttggtaaaaaatatttgaattttgatttttttcagaatttcgataattttggtctccgatagatttggaccatcgcctaattaaatatccatcaggagccgcttgcgtcctgctccctccgttctataataggtgacgttttttactttttatttgtaacatttgaccattcgttttatttgaaaaattagtgcaaatataaaaaaagataagccataaagtacttttgataataaagcaaatgacaaacaaaataaataataatttcaaatttttttaataagacgaatgatcaaacattgacaaaacaaatagtaatatgtgacggaggtagtagagatgagcacctacggagtacggacgcacgtcggcagtcggctgcgtacgagagtaccccgtctgctggcgtctgctgggggatagcatttgactaataaaccagtgggaacatgttgcctgtcctggagagagatccaaagacgaatcgaggacactacttttgttttcttccaaattccatctcggtgagccggaccgacgaacaactcaacaacttatatggaatagcatgtaataagtattaaatatattattgttatcagttaaaatacattatagagatggtaaacgattactatcaggatataagcttactaccaggtataagtattttagactaggttccgcctttttcttttaattgtagcatggctcacgtttagagaattttttcaacgagtttcatcttattatccattatacatatgcacatactctctctgtactcgtaaagaaagtcgtttaggataatatttaaatcaaaacttgggaatataaatcataaataactctcaagttgttgagtttgaaaatgtaaaaattatatgaatatatttatcttgaaaaatattttcataaaagtatacatatatcacttttcaataaatatttttataggaacaagaagtcaaaattgtgttttggagaccatgtcgctatttaaaatgacttcctttattagtatggaaggagtattatgatatctctccaaccaatgacctacattgagaatgtctttatggttagtacagctacttgggctgtgggatggcagggcaacctcgataagaatactcataattatttatatcctttgaaatttgtattttaagaatacaatgtgtgttcggaaggacaggtttaggtatgcttttagcacatgtaaaacgaagatacggattagcgcataataaattaagtattagtaaaatttaaaaataaattaatatgattttcttaaagctattttctatcggaaagcatgtacatgaagaacgggcgagcataaattaagaaaatgtgaattcgaacacaccctactagacatcccatctctcctttaatttttacccactcaaaaacgctacgggacatgatcccatcccttgcattggcacggtaagcatcgcggcctccttcaccacatgagcagccatcgacgagatgcctccattcaccacgcaagcaggcatcgtcggccaacacagggcttctatgatggccatggaagccatggcagagagagagagcgcgcacgctgccgattgcgcgatttgagatgtggcaaccccgagaaaactgttaaaattataagcacataatgatttaatttattctataaataaatcatgacattgcagatctaaactagcatgaacacatcattagatctacacatataaactaaacaataaaatatgaacagatcaaatatgcgtaacatatcgaacacgtaccgaggtggcggaaagaccggttgctcggcaggaactactcgcggttgcgggcgtcgacaaaggcgcgcagcacgcgagcggagagtaaggcgagccgtcgcggacgaacagggagcagtcgcgcgaagcgcttcccaaaaaccttattgtcgccttctcccggtgcaggacgtcgaaggcagaggttccggagacctgctctcctgatcgccggtgcacgtcggcgagcgggattgagtagtctacgagcgacggcgcagcacatagtaggaggcaaaccctagattgatttcgcgtgtgttgcgtgaaggcggcggctcggtttatatagagataggtcgcttgattagggcgcccgcacgacctccattccgtgtaaccgaaccggataagtcgcgcgtaacttatccgtactccacgccattttcacgcacctgatttttcgaaatgcttccaaaacaaaacaaatccgaatttcccgcagcaaaacaaaactgcaaaagaaggctgcatctgcgcaagggtgaggagccaattttgcagaccattcgacgcgtacgtcgtgcacgcgcgccgcttgccctgggtggccaggccagcgagcgcgcgcgtgtttcccctcttctctccaccacacatgcttcaagtggctaggagggcatcctcccttttaaggaggtccccctcttctagaattagcaaggtggtactaaactccacatgcatgccatcccatgaggtgggtttttgtgattttccaaagaattaatcttcgaatgggccttagcccatctattaattccaacaatcccccaccaaatctcaaaatcccactgagatttgtcttttccaatgtactgtttatataccagcggttcgatgaagaccgattaaggttgaacatccacctaaaactccaagctacacttactcacaacttgaacaatggactacgccttgaattgcaagtcttgtgcaagcaagtttcactcagagtcttatctggtactagaccgtctatagactacccctcgggtggagcgtataagtcatactcctaagtctttagtaagcttcctagaagattcacccaaaatctccatagactgcgaccaacagtcaagctcacaaaggtgagttctttcaagaatgcactgcaggacaacatcttcgctaattaaagccaacagaactcattaaggcatagccaacctgccttgcagctcacgagagtacatgcatcttcacttagagagggtatagattggtactctcctctagtttactaatggtttgttcttcccaggttctaatctacgggatctccgatcaccgatcacattgactgggttaccaccatagtataactcacatggtctcaaacccatctccttcgatgcattgtctataacatttcgtgatagtcccttcgtgaagggatttgccaggtttctagctgtttggatgtaatccaacgttataactctggagtttctcaatttcctaacagacttcaatcgtcttttcacatgtctagacgatttcatattatccttagaactattcactttgacaattaccgtttgattgttacagttcataaggatagacggcaccggtttttcaacaataggcagatccattaatagatcacgtagccattctgcctcaatagtagcagtatccaatgccgtcagctctgcttccatggttgacctcgtcaaaatagtctgtttgcaagacctccacgaaacagcaccaccacctagtgtgaagacatatccactagtagctttgatctctgttgacgtaaaacacgaggcctgtgagatctgcttaactccagtgcatgtccaaaactcgccttcgggtgtgctagcgtgccagttgatttgatcctgcaatcaataagaaataaaaacaaagaaaccacagttaaacctataaacgatagccgatcggctaagtgccgatgacatatcatttatctttgagctgatgtcatatgtaaatcgatcggcggttgtaaatagataataaagaactaaatctattcgatcggctatagatattcacaatatataattcttatatggatatacacttaaatcaagtgattgggatagatcggtcgccatgccgagacagtataaatcacttagatcgaaatatatattaataacaggactatatatgttcatagcatagccgatctagtagatctagcatgtatcggctaatactccgatacaactctatattaagatattaaaacaagtagaacataccaaacataagctgaatatacttagatgcaataatatcttaacataaagggcagatttaacgtatcaacaaagcatatagagtaaatatagttaaatcagataagatcggctgaaactccgatgctaccctaatcggcaaccagaaggcaggctagagattgatattctaagaacgacttaatagatcaaactcaactgatgcagcattaagtatgaaaagaagaacaatatctaaacaatcaagtcgctggaagtttcatagagtggtagatatctcatataatctaagtcaacgtcgatgtctaacctaatcggctgccctctaccgatagatgttag

SEQ ID NO: 45982 - DNA, 6458 bp, Oryza sativa
gatattgccaaagattatgtaagatatatgataactcaacgaattacataaacaagattagagtgtcataaagatggaagcactaatcccgagaacgcaagccgtcataacaagttttacctcttgttgaagattgaaaccgatgcagctcaacccgaaagcaagaactcgtcgaaataaaactaaagcaaaagggtggcgatgcgccgaaattgtattgaacgtgtgtgttaattgattacatggggttcggggtctatttatacccgaaaatacaaactatgtccatatcggacacgactcttatctctaataaactctaagataccacgagtctttgtggcagacttttgcccaaacatatctctaaggaatctctttgcggtagacttctcaggactctatccatgcgcggcaatcatcttgaagcatatcaactcaacccgatgttgcacaccaagtcgtattgtcagaatcggctgtatcggcttacccagtctgattcggacccagccgatcttgatcgtagccgatccggactccaaccgattcttactctattctcgaatcgatctccacctttgattctgcttcgttcttatcctcatctccgatactgatataaccaaatttggttgttaacaatctcatccacatcagagatccagttagaatcactataaccctccagtaccgcaggatacacagtatagtgaagccccaattccatagtacctttcagacagcgcattactcgcttaagcgcacgccagtgatcatcgcctggattagaggtaaaccggctcaacttgctcacaacaaaggagatatctggcctagttgcactagccaggtacatcagcgagccaatgatttgggagtattccagttgattcgtagcaattctcttgttcttgcgaagcaacaagctaggatcataaggtgttggagaaggcttactatcaatgtagccaaagtgattcaagatcttctccacataatgggactgcaagagtgtaatcctattctcacctctaattagcttaatgtttaagataacatcagctactcccaaatccttcatatcaaaattttgagacaagaatgatttaacctcatttatcacctcaaggtttgcccaaatatcagtatgtcatcaacatacaagcacagaataactccatcacccccaccatggcgatagtacacacatttatctgcctcattgactgcaaagactgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagttgtcttaacgtccatttgatgaacgagaagaccatgtgaggctgctagagaaagtagcacacgaattgtagtaaatctagtaacaggtgagtaagtgtcaaagatatcttcgtcttctttctgagtatagcccttagcaacaagccgagccttgtacttttcaatagtaacgtcaggcctaagcttcttcttgaacacccacttgcaccccacaggtttacacccatagggttgctctgtcacctcccaagtcccgttagcgataatggaatccatttcactatggacagcctccttccagtagtctgcatcaggagatacataagcttttgaaattgacttaggagtgtcatccacaaggtacacagtgaaattatcaccaaaggacttagccgtcctttgtctcttactccttcgaggagcttcactgacatcctccttagtgacatgttcatgtgtatgttcagtttgttctggtggtgtgattgaactgggaattatttcagagggttggctcgaactactgtgtgtatcctacattgggaaaaagcacttaaagaaggtagcatcacgagactccataattgtaccaacatgcatgtcaggtacctcagatttaactattaaaaatctataggcaatgctgtgatgagcatatcccagaaagacacagtccatagttttaggtctcagtttgcgcttcttcgttattggtacattgactttcgccaatcaccctcatgtgcgcaaataagaaagtgatggtttctcccaatccatatctcatatgttattttgtccttattttttttagaaactctgtttaacacatgattcgaggtcaacaatgccccccccaccatgccttaggtagtcccgcggtgtccaacatggcattcaccaagtcagtcagtgtgcggttcttcttttcagcaatcccattagtctcgggagaatagagaggcgtcctctcatgtatgatgccatgttcctcacagaataattcaaactcatttgagaaaaactctccaccacgatcagacctaagtctttttatctttctgtcaagttgattttcaacttctgccttataaattttaaaatagtctagagcctcgtctttcgtttaaacaagtacacatagctaaatctagtagcatcatcaatcaacatcatgaaatatcgttttccacccttcatcaacaccccattcatttcacaaagatctgaatgtagtagttctagtggtgccaagtttctctcatcggcagccttgtgaggcttgcgaggttgctttgattgcacacaactatggcacttagaacctttgacaatggaaaacttaggaattaaacacatgttggaaagccgagacatcaagccaaaattaatatgacataaacgtgagtgccaaacattagtcatcatccacactgccacaaatatggttgacagacttattgcagaaatcagaaagggaaaagcggaacaggcctccgcactcataacctttaccaataaaatatccatgtttagacacgactactttattagactcaaaaaccaacttaaatccgtctctagttagacgggagccactaacaagattcctatcgatagaagggacatgctgcacgttcttcagctgcacgatctttcccaaagtaaacttcagatctactgtgccaacaccatgaacagaagcatgtgacccattccccattaggacggtggaactccgtgcgacctgataagaagaaaacaatgagatgtcagcacaaacatgtacattggccgcagtatcaacccaccaattagtagattgattaactgaaaaaacagtaggtaaattactatacccgcttccatctccagtgttgccaatggtcacattagcagacttagaagtctgccctgcaggtgccttcatacccttgcgctgtggatacttcctagccagatgaccaggttggccacacacaaagcaagtcctctcatcctgattaggattgttgttgttcttcttctgcttcttgaagttggtgttctgttgagctttgtatttccccttgctcttgttctaggccttgtgcacaacattggcactggactgcccaccatcgcccttagacgcggcgtccttttcccgagctttctcctcaacattaagagatgctaccaacccctcaacggagtattcctgtctcttgtgtttgagtgcagtaccgaaacttctcgaagatggaggtagtttcgcaataatgcacccggccacaaatttgtcgggtaagacacacttaaggagttcgagttccttagctatggtttgtatctcatgagcctgttcgactatagaacggttgtcagctatcctatagtcatgaaactgctccatgatgtatagatcattgctagcattagtagcaacgaatttagtattcagtgcatcccacaactccttagcgtcagtcatgtgcatatacacctcgaccagacgttcgccaagaacgctaagaatgcatcccacaaagagagtagtggcttcctcgaattgcttctgctgatcagcagtaagaattccttcaggtttgccagtactcacccagaagcatttcatagctgtcagccacagagtgaccctgatctaccatctcttaaagtgcacaccggtgaatttatccggcctcagtgcatcggcaaaactagccacggtaaaatcacagcgcctataataaggtttttggattgttgaaattataagcacataatgatttaatttattccacaaataaatcatgacattgcagatgtaaactagcatgaacgcatcattagatctacacatgtaaactaagaagtaaaacatgaacagatcaaatatgcgtaacatatcgaacatgtaccgaggtggcggaaagaccggttgctcggcaggaactactcacggttgcgggcgtcgatgaaggcgcgcagcacgcgagcggagaggaaggcgagccgtcgcggacgaacagggagcagtcgcgctaagcgcttcccaaaaaccttattgccgccttctccggtgcaggacgtcgaaggcagaggttccgaagacctgctctcccgatcgccggtgcacgctggcgagtgggatggagtagtctacgagcgacggcgcagcacatagtaggaggtaaaccctagattgatttcgcgtatgttgcgtgagggcggcgactcggtttatatagagataggtcgcttgatcagggcgcccgcacgatctccactccgcgtaaccgaaccggataagtcgcgcgtaacttatcgggactccacgccgttttcacgcaccggatttttcggaatgtttccaaaacaaaacaaatccgaattttccgcagcaaaacaaaactgcaaaaggaggctgcatctgcgcaagggtgaggagccaattttgcggaccattcgacgcgtacgtcgtgcacgcgcgccgcctgccctgcctggccaggccaggccagcgagtgcgcgtgtttcccctcttctctccaccacacatgtttcaagtggctaggagggcatcctcccttttaaggaggtccccctctcctggaataaacaaggtagtactaaactccacatgcatgccatctcatgaggtgggcttttgtgattttccaaagaattaatcttcgaatggttttagcccatctattaattccaacaaaagcaaccaaatagcggtggtggtttcgatgatggtgctaccgaggtaatctctgagtctcagaaaaacttaacctaaaaaagatatgactacatatggctgtatatattcttccctctatttttccaactcatcatctctcttatttttcacgcgtggtgtgtttttttaaaaatattctatatgaaagttattttataaaatcatacgaagctatttctaaaaaaatagttgatacttaattaattatataataatacatatttcattttgtgaaagcggtttaagataggatcatatatatatttattgtattagaagagaatacttctacgtcgaggttaattttttttaacggactaaatatgaccatattacgtaaattcctccacatgtctagaagatgagaactaacatatcctacatgacgtgtgtcagtgtcacattaattccttcaccattaattgaattgttttttccgctcgccaacgatctcgatctcttcgcttcttcgcttctagacgttctgactttcctgaatgttagtagcatgcatgttccaactgtttgatccatcgatcgatgtccttttcaatacgtactgcttggtataggtttcatctgcaaattaactcgtgttaatttaagagtgacaacaagtccagatttctaaacatgtgcatggcatatttctagggagatgttttctttctatgccacttaaggacatccctcttatatatatatattaaatttgtttggtgctccatggtgcccgggcaccattgttgaaattgagtatatacccaatccaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatattaaatttgtttggtgctccatggtgcccgggcaccattgttgtaattgagtatatacccaattcaaatgagcatgaaacttttcaattattgacgtattaatattaactactttactaactagttgaaagcaagtttgaactgaatttgaacttgtttttgttagattctgattcttggtatatagcatcc

SEQ ID NO: 45983 - DNA, 15672 bp, Oryza sativa
  unsure (1)..(15672): unsure at all n locations
ttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttaagtgattttgtgcatttgaaaccatggtgcccgggcaccatggtgccccatatgagtgtgctatatatatatatatatatatatatatatatatatatatatatatatatatatatatataaaagcacgagtacatttagatccactatcttgtttaagtgactcattgagctctaaaggacctctgaccaggtctgaccgccaacgtgacacgccacgcaagcaccaatttacaaacaagcccctccgcaatagtagcatcgtcgtcccgcccctgcagcagcaactgcgcctgcgcgccgctctggctccgaatgtggcgcctcgccaagcgccactgcgtcgccgcgcggatccgggagctctggctccgactgtggaggagctccgccgtgcgccgtcctcgccgtcgccggcgtatgcactcaccgagttcaccgctcgcgctcttcctcgtcgccgcgctctaccagcacctcgaggccgtgagcttggcgagctcgccggcggcgataggtggctcgtttcggggtgcgaccaaaagacaaaatgaagagcatgttactgtgattccattcctctacttttctcggttagtggacatcggagtagcgccggcggcgagtccgagcggaagacgttttcgggtggtggtgcatgtgcgcctacgaccatgtattgcttaaatgcgtgcatgcatgtggttctattatttaccaggaggctcactgaagattgactgtggcttggagaggcccgacgaggacttggcgatggatggacattggcggcggcggtaagaacctccgggatgacggtgacagctcaaacggctccaagatctagcatgacgtccacgaggttagtgaggtgacaggtatggtgtatgcgcgaggaatcggacaatggctcaccagaggaggcggaatcaacgatggtagccggcagtcagagttggagaagatgatgccgatctccgtccatgatgcttcattctccacggttcttgaggggttttggtcgtgatggtgtggggatactagtggcgtggtggctcggcttgacttggtccagaacgacgggaacggcgatgagatcacgacgacgtcgcgcagagcacgtcccaaggccggcgatgacacagtggcgttcccattgatttgctgcacgatagaggatgaaatcaaaaggagaaatcttcggaatggtgagtagaatatggaacaggaaagagataatggcgagcgcggcttgacgacaatcggcaatgcatccttctcggcggccgacgatggagtggaaggcgaggaggacacgatggagctctccctctcggtttctttggctcaggggtggagagcggcgagagaggaggcgccggcgacgtgcgcggggtgttgcacgagccgctcttccccatcgagtggacaccgccacccgcctctccgccacgcccgcctcgccgacacttccgtctctccgccatgtctgccgtcgtgcgcgccgactgttggcccgtccccgcgcgccgctacccgccttcacgtccgcctccgctgccggctacacgagcgcgccaccggcgcccgagcaagcccgcctcccccgccggccgctcgcactacctcctcctctgctctcggagcggaagggcaaagtcggcgacgccgcgcgggagggcagcggggcccgccccgtgcgccaccatctgccgcccgcccctccatgtcggcgttcgccgctcgccaccaacgcctcgccgtgcgcacctgccgacctgtgtccgagagagagagagatttaggaagacgggaagcaaaatagggggcaaaatgtaaatattttgcaacgctggaccgccacataagccagtcaacctggtcagagatcctttggtcctcaatgagtcacttaaataagattgtggatctagatgtgcaatttacaagattatagacctaagtgacacccgcactcaactttaaggaccggccgtgtattttactcatatatatatatatatataatcaaaataattttgatttttttaaatggtaacaaaaattggtatctgatatattaattccaaaaacatacaaagacaaaaaagataataattctagctagtacgcataaactcgttgatcttgatggcaaatagatttatgtttaaggtggaggagagaggagaaagaaaaaaaagtgggctatagatttggccaatcgtagaatgtgctccaataatctatatgaaaaagacgtgggatatgtattaattaataatgttgtatggaatatatatatctaaagcgatatattatatgagttcgctatagattagatgtaagtgatttattaatctttatagctagcaattaactatactgctgaacttgctcttatagcacccaaatgcatggattcctctaagggcgaagctagagcgaaatggaggggttcatgattgtaccacaagtatatcaatatatatatatatataacttcaagctaaattttcaatgcaaccgctgatcgataaatttttgacatcaacaatagagacatacatgcatcaataaaataaagaagtggaaaacattgtttttttaaaatgaagaaaaccactaataacattgataaatggctactgacccatgagcaaaagatgattcatgaagatgtaaatgtgtagagattttatcattcattcaactaaagaaatagaatgaaaattgacatgacttacatccaaattgcaccttcaattcaaattctcaaatttttcctccaatctgcaatcttactccgattctgaaggaccccaaattgaagcttggtggcctcctaatcctacaatataaaaattaacaaccaataaaaattttagggcttcgtatctaataaatcaaattgattgaaaaagaaatagatgaagcatgttttcttaccttggctctactaacgcacagtgtggttgtgtgctgatcagttggtggagatggactgatgtcgttgttggcttgtgacgctagctcctggttgcctagctgtcggcttcctgcccgcggcggtcgccaactgagaagagggcgaccggcgacggtgagatgccgagatgggcaagtgctgactgggattggctgattgagagcagcggtgtggaagccaaacagacgcgaggcggagttgtcaagactggcggcggcgcggcacacgatacaagaagtcgagaggagaaaacatcgatctggcttccaccctactggcctgctcatgggcttaccacgttaactggactgctgtttgggctgtgggtgcactatattgggctgaggggggtgcatatagggccgagatatgggggtaataactaaaagatattttttggggggttcatctgcacccacgggcttctactgggcttcatccctggattcctctaagcaccatttccaaaactgtcgacggtggatacccgtagaccggatatagagagtattggggtatgctggtacgaggatctacatagtacgacatcaagcaaacaggaaacatggattatactggttcaggccccttggtaggtaatagccctaatccagttgatatgcgattatatgatggaaaccacagattacaaagggaataatgaagctcgacgataccgacaagatcgtagttgagttgatccgactagatctcccggcgacttggcttcgataagctccggcttcgtaggctgtggtggatgtgttggctctgagattcgatgccttaggtcctctcggggggtccctttttttaccgtaggtcagctggtctctaagtaagactcagagacattggacccgacacgatataatgacgacccagttctatccgagtaggactctttccatctgtagactccatgatggacttccttaacctatgctgagaacgtccgtatacacacaaacataccatatcgatacgtgacgtatatcgaagggtagagggtataccttacccgtaaccctgacagtagcccccgacttctgcttaaatgaactcgtgaaatcgattgcgacttctgatgtcaaaattgtcgttgttctcggtgtggggaccaagagacaaggagtgatcgacaacgtcgagtgaagctcaacggtcatgagtgaatttaaattgaagtccgaaaaactgccgcgcgtaacggacctaaaaatttccggcggccatctctctcctttcctgggaattcgcaccggcggaggtgcgtctatttaagggagttttggggatcccatttgaggtcagcctattcaaaaaactctccagcttccaagcgtccctcgtcttcttcgctcctgcaaaaaaaccatagccaactcgtctcggtcctttctccggcgatctccggtggccatggatctcgacaagtctacctccaccagtgcatcactgaagaaactgcaggaggatggcgcccttcccggtcgcggggccgcggagagggaagtaggaggtactaaaccccagcctgtcctgggtcgcatggttgcggttgaggactttattctctgtggttttcttcttccgccttctgaatttctccttttggtcttgaatttctatggtctttccttgctccatttgaaccccaactccatcgccttcctgagtatttttacgcatctttgtgaggcctacattagggtggagccgtttcttgacctcttccgcttttactatgagttacgctggatggaatccaaaaaggtgtccgggtgtgttggtttccgacttcgggatggcctgaagtcgcgatacatcccctttcagtgcccctcatctcgcagcaaatggcgggggaggtggttctgtcttcagatagaggattcggatcctgtcttcattttacctgaggaacagccagacaagattccatcttggaccaccaaacccgccttgaccccgtccctccaatctttcatcgatatcgttgacgacctccgagaacgggggttgtcggggtatgaagttgctgccgacttcattggtaggcggatccaaccgcttcaggctcgagcccatcccgcctttgattattctgggccagaggacgcgacccgggtttctcctcggggtatttcctttttagttaaattgactctcttatgcgcgtgttcttcccggcttatcgggttctgttctcgatctacaggcttgaatagcgcaaccgtggagcgccgcgtcggccaactgatgatcagcggcccgacaacggcgagcaacgtccccgtccccctttgcgagaaaggggcaaccgagcacgacgctgccatcaatgtaagtgtacttagctgtccttttgcatttttcttccgggatcgcattatgactttatgaaacgtaggctctccctctgactgatatcatcgggccgctcgtggaccatcaggtggcggcgtcgctgaaggagaaggtcgccaaggaggcgtctgacgctgctgttgccgctgccacgacgagtggcggcgacgttccgaaaaaggggaggaagttctcctctgtagtcggacatcgtcggaagacacccactccctcggtaagttctcccgttatttgatcacctagtcggaaaacttccacctcacatcatatcgattgtactccaggcctcggacgcgtctctcccgcctccgcgacagcagcggcttgtgacgctcagcgagaagtaagtgaataaatttgaggtttcgtgatttcgtcgaactctgtctcaatcgtagcctttcgcagggcggtgcgagcaaaggcggcgcaagatgggtctggagggacctccagcgcatctcctgccgtggcctcgacggatgtcgtggtcgtgcccaggagccgtgaggcgacacctagtggcccagccagcgatctcgtggctggtcgtggttcgccggctgccgtcctcacctgggaggagctccaggttgagatggggcgcctctcgaggctggtgttcgcggtgttagcctccaaatcgcngaggcgaaggcggcggctgcgttgtcggcgaacgagcgcgccaatcgactggcgcgcgatctggcggaggttcgcgaggacctccagaagatgagggaactggtgcccggcaacgagcgataacggcaggggctcgagcaccgcatgtcagagcttgagaccaacttgttggaaatccgtggctcgttgcgggtcacctatactggtctgcaccagctcgccggggagtgcggtatcaagtccaccatcccggcgaatcccgatgagttctcgctgacgtcttctcttgcggagctggtgatggcgacggaggaggtcccctccaagcatgcggccaggatcggagaggagacgtctaacgggatctacaccggggcgtgccacgtccttgcgtgtgtaaggcttgcgcaccctgaactcgatctgcggaagatcttggatcagggggcggctagcgacgcgcgcaaggatgtgatggaggaggtcgacgatctgggggagtccgtcctcccgctttttgaagagtagggtcttagctctcttgtactctttagtcatgccttgtaaaacttttattggtcccaaccgccctagtgtgtgcggtcattgccttagctttgtttggcattttgatctcgagtactttgttgtcctttgtagagatgttgatgtcgaggatgtccagcagcgcgggcagcctgagttgccagtggtcgttccgttacttgcgtccgaaccatatgtgccggaaggcgatgtagatcgaagttcgcctgtggaaacgagcatggcggcgactctcttaggttggttgtctttgttaccatttcctttgcccttccgtctagatcgacttgatttgttgtgttctcgggatagaagagcagcttgacttagtcgtttccatgctgagcagatctcgagagtgcgcttgttgaccaggatcgtcgcatctagtattggaggacgaagtttgaggttgcggaactcgagaggactatgctggaggtgagaaaggaccaggccgtagagacactccggggtcgtgacgtgtggttcaactcgtatctgaagagttgctgcacattcatgtcgagagtctgtagagagctccgagtaccccgtggggatcccgaggaatcggcggccggatacatctcgtggctgaatgggggcctgcgctcagctcgaaggcatcggtcaacgtatcgacgaggccttgaagcaggagtgtcgtcgctcaagccgatatgccggggggcacgtgctggcctatatacgagatcatcgtccgcagctgtacctcgagttcctccgcgaagggttttctcgttctcggagaactcctacggagatagatggcctggcgaagtcgatggcgccgctggcggagatggttttccagtcgatggactggtgttggccttcctggtagtctccatgtcctgtgacaaatgtctttggaaaaagtgtaatatagttttggattttgatagaattgtaagaaatacttgtggaatagaaaaagaaatctatctaacttcgcgacttcgatcagtcgtttgagttatacactctccctagcccccagccttgtcatcggagaattcttctcggaagataaggctcttggacctttgacctgcctcgattgaacaagcactgatcctagcccctcagccgtgaagttggaaagtttatttccgattacatggcttggttaatatgcacggcaagaactcttacacgaccagatctgacatggtctttcgtctctacaggatctgacaaggccttatcggctctgggcgtccccagccgaagttcccttaggttcctcggaggccttgtcaagacggcgtaaagggacatgaggataggtttcaacgctaggtgtcatctgggtaagggatcatcgggaaggaacactttgattgtcgtctgtacttaaaaaataggctttattgaggctgtaagatgtcttacaagtatggatactattgacttaaacatagaatttacgtacttgatcaatgttccaggaatttgccaactcgtggccatcgccgtctgcgattttgaatgcgcctggccgcagaacttgtgtgatcgtgtacggtccttcccatttgggtgagagcttgttgcgtcctgcttggctttgaacccgtcggaggacgtagtcgccgatcgaaagcgtgcgtgcttggatgcgcttctcgtggtaacggcgaagggcttgttggtagctggctgctcgaacagcaactcgttcgcgatgttcctcgagtagattcacatcgtcgtatcgctgctcctcctgatccttatcggagtacttatgtactcgtgtactttgatgtcatagctcggtggggaggatggcctctgagccgtacacgaggaagaagggtgtctccttgttggacgttgtcggtgtagtacgcacggcccatagtactgatggaagttcctcgacccacttcttgtcgtttgacatgagcctgtcgtagacgcgggtcttgattccttgtagtactatgccgtttgccctctcgacttgtccattgctctgagggtgagaaaccgaggcgaatcagatctggactctcagcctgatgcagtaatcctggaaatcggcactgatgaactgggagccgttgtctgttatgatacggtggggcaatccgaatctgcaaaatatccctttgatgaatttgatggcgttgttggccttgatttcccccgtgggtgtcgcttcaatccacttggtgaatttgtcgatcgctacgaataggaacctgtagccgccttgtcctcgtgggaatggcccaagtatatctagcccctagcacgagaacggccaagtgagagggatagtctggagtgcttgcgctggcagctttgtgtgtttactgtggaattgataggcttcacaccgctgaaccatgtcgcaggcgtctttgagggcggttggccagaaaaacccttgtcggaaagcttttccgattaatgtctgaccggcggcatgtgacccatagatcccttcatgtatgtcgaggaggaggtgtctgccgtcgtcggacgagacgcattttaggagtaccccgtttggtgccttcttgtatagatcgttgccgatcatacagtagacttttgcttcacgggatattttctcggcttctgcgtcgtcctcggacaactcttcgctgcttatgaatttaatgagtcgggtgcgccagtcgtccgtggtctcgatatcggcaacggcgtcctctacctccgtagcccccgagctggtgtcgggggcgaccgggctatcttcgccgcttgcctctttcactgatggcctcgtcaggacatccagaaaggtgccaggttcaagtggttctcgtttggacgcacgtcatgctagatcatctggttcgatgttgtctttacggtatacatgtcagacctcgatcccatcgaaccttttttccagcttcctgacttctgcgagataattgtataactcggggctagagcacttgtaatctttatgcacctggttcgcgactagttcggaatcccctttcacgatcagtcacctgactccgagtgcagctgcagctcttatcccggcgagtagtccttcgtattcggctgtgttattggttgccctgaagttgaggtgaattgcatgcttgaattgatctcccgaaggtgatgtcaagatgaatcctgcccctgctccctggctgttgagtgcgccttcgaacgccattgtccacgtttcattgtcgatttggttgtctgacctgttatcaggcatggtccaatcggctacgaaatcgacgagtacctgggacttgatggctgttcgtggcacgaagtggatatcaaattggcttagctcgactacccatttcgcaatgcggccgacaacgtctttgtttctcatgacttcgccgagagggaaggaggagacaactgtgaccctgtgggcttgaaagtagtggcgtagctttcttgatgtcatgattactgcgtagagcagtttttggatctatggatatcttgtctttgcgtcgtggagagcttcgctaacatagtagactggtcgttgcaccttctctctctcgataacaatgacagtgctaacggaatatggcgtggcggcaatatagagaaataattctttattaggttggggggcaacaagtacaggtggatttgataggtagcgcttgagtgcaatgaatgcctctttggcctcctgtgtccatacaaatttgtcttgctttttcaatagaacgaagaaaggttgtcctcgctctcccatcctagtgacaaacctgcttagtgctgccatgcatccggttagcttctgtacttccttgagtcttctaggtgacttcatgttctcgattgccttgatcttctcgggatttgcttctattcctctggcagagacgaggaagccgagtagcttgcctgatggtactccaaacgtgcacttctctggattgagcacgaggcgatatcgtcggaggttgtcgaacgtttcccgcagatcgtcaatcaatgagtcgcttgtcttggtcttgacaacaatgtcatcaacgtaggcctcgacattgtttccgagctggtcgctaagtgcaccttggaccgtgcgctggaaagtgtttcctgcggttattagtccgaacggcatcttaacgtagcagaataccccgaacggcgtgatgaatgctgtcttctcctcgtcctcttttgctatgcttatttggtcgtaaccggagtaagcgtcgaggaagttcaacaactcgcaaccggctgttaagtccaccagttggtctattcgaggaagaggaaagtgatccttgggacacgccttgttgaggtcggtgaaatcgacacatattctccactttccgttggccttccgtaccatgactgggttggcttgccactctagatggagtacctctctgatgaaaccggctttgagaagcttgtcgagctcttctcgtatggcttgttttcgatctggtgcaaatctccacagtttttgctttactggcttggcattgggtcgcaccatgagtttgtgctcaatcacttccctgggtactcccggcatgttggacggctgccaagcgaacacgtcagcattgttgcggaggaaggtgatgagcgcgagttcctatttctcgcttagtgatgccccgatcttgacggtcttgtcggggttagcactggagagtggaacgatcttgattgcgccgtctggtttcggcgtcttgtttgtcttgctcactttcttgggtggctctgctgtggtaggcgggctgggcgtgttctcgaccatgtcgaggctccgcttgtcgcattgtactgccagcttagcgttcccttgaatagtgattgttcccttcggtcctggcatcttgagcacttgatacgcatagtgagatgcggctataaacttcgcgagtgcagttctcccaatgatggcattatatgctgtatcgaattcagcgacatcaaaggtgatctgttccattcggaagttgtttgcttggccgaaagtcataggcaacgtaattttgcccaattgtttggacgataactaaggagtgattccatggaagggttgatcggtgggtgtcaactcgcttcatgggatccccatcgcgtccaaggcgctggtgaagagaaggttgattgagctgccgccgtcgatcagtactcgggcgaccttgatattacaaatagtgggttcgaccacgatcggatatcgccctgggatgacagcagtcttggggtcgtcctcttctgagaattctatcttctgctcggaccacttcatcttgggtgcagccccctgccacgttgaacagacttcacgttccactttcttgtattctcactttgaggagtatgccgtggaacctccgaagatgtgtgagacatggagatcggaatctgggtatgctgggtccaattcctgagtaggcgcctcagcatctttctcaaccacgcgtactcgcttgcctttttccgatgccatgtgttttgcgagcgactttttgaagacgaggcaatcttctagagaatgtttgtccgtcttgtgtatagggcaccatgctttcttcgtgtcgctgccttgtgggtctgggtgcttgggagggtccgcgtattctgttgcgagaacttctgattgagctttccttttcccactcttgcgatttttctttttgcttgacttaggtgcgtccttggctggtttcttctctcctccggtcttcggtttgtcgttcttgcgtctcaatgcgtcatccgcatgagcgcatcagtcgacaattttgaataatctccgagtagtcgtgatgcgcctcgttgccaactcttgagtagtatagcaatctctgacatcggatttgaaagcgcgaattatagaagcattggtgatctcggggattgtgtttctgcactcgttaaagcgccgaacataatccttcaaggattcgcccgggttctgtgtcaacgcatgtaggtcgtcttcgatcgcgtggcgtttgtaagttccttggaagttggctacgaattgctgccacaagtctgcccacgaagagattgagtagggggggaagatgcatcagccatgaacgtgtagagcctttcaatgcggttggcaagtaattcgccaacgcgttgtcgtccgctccggcagcgtagagtaccgtggagtaaacctgaaggaactcttctgggtcggtgctcccatcgcatttctctattgctccaggtcagaatctttcgggccatcggacatcccgaagtgaacgaccgaaagctctacacccagcgctgggagcggtgggttgtcggcgatcatgcgtccttcgtggatgtctatccgatgatgaagatgacgaggatgattgtcacgaccggaaataacccaacgggcgttccttacgtgcgtgtattattccttgtcccaggaggcaaggtacaccaaaagttgatacaattcagagtttaacaagcggaagcgtaaatagataatttattacatgggcaacgaaggcccagcacacacaaagacaaacgagaaacagcggaagactagggcgacgaccacaggcgcttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttataatataaagggttagggttgcagtaaatagcatttaaagacacttagttgcgcaaagctattttggaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatatttacccacaagacacatcttcctcacgtgtaaccacgtgccacataccaccacggtatacggacggaagacgtgacatagtttccaacccatcctagccatagacaagagtaccgacccaatcccacctacggccggaacccccgggacaggcaggcaggactgagcccctagcagcaggacaccagccctgtgccatgacatctcgattaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaataaccaaaccattccatagtgtccaggtgatatgaatattcccaaagtcaagagttgaaaaaccacctaatgttacctaattaaaatagcgaagcatctacctaaaatcatactagtggtaccatgagtagagtgtccactagttggggttttgtttattctagggtgaacaaggagataataacaataacaataataaggtcataacaaaggtaaataggcatggctagataaaacagtgataacgcgggaatttaaataaagcgataatgcaataatttaaagcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatggatttattgcgtcagccgaggggaggggcgtgcggaccgggtccacgggggtggggcccacgcggcagcctcacggtccacggtggaccgggcgcacccaggctcgcaccggccggcgccgtgggtcccacgcgtcagccgcacctaagggcgcgggcggctgacagccgggccccacgcggcagccgcggggcgcgcccgaaggcggccacgccggcacagccgacgggaggcggcgcgcccgcgcccctatggtcgccggcggcggccataggtacggcggagcggcggccgagagaggggagggaagggggaaacgaatcggcggtccacggctcaccccgggtcgacggcgacgacgggaacggcgaccggagcggaggaaggcggcggcgcggctcgggtggacggggtcgacggtgctccggcggtcagcgagcgaaacggaggggtggacgaggtcggcgaggatgcggcgaagccgaaggaggcggcgccgaggcgggagatggtccggggcgacgacggcggcggaccggagctcggcggcgacggcggagagagaga

SEQ ID NO: 45984 - DNA, 2586 bp, Oryza sativa
aggcgggcgggcccgcccgtcagcggcacgcgcgcggggaggaggccggatgggccgcgggggagagcagagagagggagagagatgggccgagccggcccaagagggggagggggggagaaaagactttttagagcttttctttttataaaaccattttaactttgtttatttcttcttaattattatttgtgctctgaaaattccactaaaatttatttacgcattttaggcttttaggaaataaacaaaaatcctccaagccttatttgacttttaactttgcacattttaattgttggaggctttcacatggattttacttattctatgcataatttagaggatgtattttagagtcgttttgggacgcgacaatgatgacgatgacgatgggtcgcttggttccggcgtatgattacggggacgtcggccgggttctcgagaatcatgtcgtcgtctcccgctgttgtctcggcgccgatctccatcatcgtcgtcattattgcgacgtcctcgaccagtatcgcccagcaaccgccgttcgcgatcgtcgtgatcgtggcggttgtggcggttatcacggtctcggtcttcgcttgaacggcctccttgatgttcgttatcgtgacgccgtgaagagatatgacgccgggaatggttctcgttgtctcgtgtgcgtcgtgcctctcggcggccattcaagtgatcgcggagatcaccggtgccgcgaggtggcagggtcgctcgatgaggcgattcccgccgttcagggttttcaccatttgcatcgccagttggtggctgttccgggtgcgctgcagcagcggcctcttcgaacgcgttgctgaggttggtcactgattcccgtagtcgttctgtccaatgtgcgagatcgtcgttcagaacgggatcgtagggggtttcccttagtattgcgttgacggctctgatgtgctgggccggagtagtcacttgattctccgcttccgcattggtgcgcgctgacgtgccgacatcgtcgatagccaatacctcacgcggcgtactcgttgtcgatgatccatagtcttcgagtaggtgcaagactgatggttcatggggatcgatgtcgattaccccaacaaattgatctgaaatcggcgtcactccttgttccttgtcctcatctctgatggggatgtgtgactgctggaccttaggaggtggcgtcttcatggcggtgagaaagaccttgcagctcgagaggtcgtgattctttgtcttgtgaataggacaatagacatcacgagttggagaggtacgctgaattccacgctctttgtaggcacgaatttcagcatggacgttgagaaagacccagcaggcttgcagggtgtgtttcttggttttgtggataggacaccaggaccttgtcacctcggaagttatcctcgtcggctcgtgattcctgtcggaaagacaaggcttggccgcactaggatccttctcgggttcggatgtcgtcgacgttccgatctctgcttcggcgggaggatccttcgacatggagtcgccccgggttgtagccactgcgttctcgtttccggccattggcggaccagttgagatcggcattgtggtgtaaaccggaaagacgatttcactgacttgagtccacaccagtgttgttgaagtaggaactccttggttgaggttggtgttgacgctgttgtcaacgaagctggatgtcatagtagtagaaccttgagcaccaagtcccccacctggcgcgccactgtcgacggtggatacccgtagaccggatatagagggtattgggatacgctggtacgaggatctacgtagtacgacatcaagcaaacaggaaacagggattatactggttcaggccccttggtaggtaatagccctaatccagttgatgtgggattatatgatggaaaccacagattataaagggaataataaagctcgacgataccgacaagatcgtagtcgagttgatccgactagatctcccggcgacttggtttcgataagctccggcttcgtaggctgtggtggatgtgttggctctgagattcgatgccttaggtcctcccgggggtcccttttatactgtaggtcaactggtctccaagtaagactcggagacatcgaacccgacacgatataatgacgacccagttctatccgagtaggactctttccatctgtagactccatgatggacttccttaacctatgctgagaacatccatatacacgcaaacataccatatcgatacgtgacgtatatcgaatggtcgagggtatactttacccgtaaccctgacaaaaacattggtggagatcagtggcgccgaacgtaggtttacacatggggctggttcaagcaaggagctagccctagccagctgctggctaggacaatgatgtatggctctggcaccgcacatagtaagccacagtcactggctcatatcactagcacaacggcaaacattgagcgagttaacaactgctccctccgtcccaaaaaaaaccaacctactattagatggaacatttcctagtacaatg

SEQ ID NO: 45985 - DNA, 6578 bp, Oryza sativa
ttcaaactgttaaacggtgcattttttgcaaaaagtttatatacgaaagttgcttaaaaaatcatattgatccatttttgaaaaaaaaattaataaatacttaattaatcacatgctaatggaccgcttcgttttctgtgagcactgtgcgtgttgggatccagtgatggcgaacccagcctgcctgctttagttcccaaattttttcccctaaacatcgcatcgaatctttggacacatgcacagagtattgaatctttacctattataaaattttaagatgtttttgccgtagtctcggtacgtcgtccgattcgctcgctgccattatcctattgcaattccactgcacaccacgtctgggccgtgcgacagccctggcggatgtacgtttgcccttccagttcacgtgttgtgtttccgttcaatttggctgttccagacggacagaaaacaagaccgttttgattcttctattcatacacaactttaattccatagatatacacaattttttcaagcgaaacggactctgaaacaggaaaatttagggttcggttgtgtaggataagactcgatttcatgcgcgatatgatacggttttgctccgattcttgggaaaacggaaaaaggaggagataagaatcaaaacccctcgatcaattttgaattacctccaaggattcggttggatttcacggaggagggagcttcaggcgttctctgtcagcgatgggagtccggccggaggtagatgacgacactgcagcgctgggacccacgcgacagtgagagggggagcaggggatgatcattagacatgttgcttgatgggcctgatgcgcgattgtggggcggaagtggaggggaggaggagggaggttaacaggccggctcggctgcggataatgggctcaaaatagcccagggagaaaggaagctttttaataaatacgaaaatgatgtttatattattaaaattagcaatgaagatctgaaaattctaaaaacatttcacatagtgtaatttatcatgtagaatttaataaaaattaaatccaatcatattttatttggaaaattttatttcccacatttaccttgattttcatgagcctttcttttattcaacatcgtatacatgtgtaattgtgattttatattttaattaattacataatgtaaatctttcttaattttttcttaaatttctcatgttttcttcccgttgcaacgcacgcgtattttttctagtatagataaaaacaaaaactaattatacagtttgcatggaaatcgcgagacgtatcttttgagcctaattagtccatgattagccataagtgctacagtaacacacatgtgctaatgacggcttaattaggctcaaaagattcgtctcgcggtttccaggtgagttataaaattagttttttcatttgtgtgcgaaaaccacttccgacatctggtcaaacatccgatgtgacacccaaaaattttcatttcgcgaactaaacagggcctaaaatagacttttgaacaaatatcaataaacatttgaatgaatatcagcgtctgatgtgtaaggtggtgagcgtggtcacgcagacaagacgactatggatgccttatgcttggattagggatgaaaatggcaaaaaacaacattgtttattaaagacaacttacgtcggttgggaattttcatatttaacagtctaactatttagtgagaactacaatatgatgctaaaagaaaacataaaaaaattcaaatttttatatagccaaatcggaaatggtaaaaaatggcactatttatagagaaataatatatattcagttggtcgggaatttcagtcaccattttcattcctacttgaaatgcttgattgatttaataggttgatggtggattgctggctaatgggttagacctaggactaagtgggaggtctaggggtttggttgtggcgtgaactatagctgggttagttgacccaccctgcataatggagggtcaaggattcctatttggtgtagttgcaatcccagtcaacagagccgctcgtcatcagccatcgatcttcacctgtctctggccacaatcctcgtccctgtccttcgttcccgtccgtcctctatcttccccatcttcctctccatctctggctcaactcctcgggccatgccacgcccccatgccctagctcttaaactctagccaccgagggcagcggtgtggccaccagccatcgcgcggggattccgccgtcaccaatccaccacgtgcaggagtagcaacactaggcacaactacatggtcatacctgtggtcatgaccgggaaaatgatggccattgcgaaagaagaagatagattttgagtattatgaaggatcgaatcataataactaagccatccagagaggggtgaatggttggtatacccaaaaaccgaaaacttttagcggaaataaaagttatcctcgaattcaacggatcgcggtctgaccgaagtgaatgcgccggtctgaccgcctggaatacgtcggtctgaccgagatcgaacttcggtcgaaccgccgagatcgccagccgcgcctgttgtcgacgccggtctgaccgcctcgctcccgccggtctgaccgccaccttgccgccggtctgaccgccggtgagtcgtcggttagaccgccgaaacccagtgaaacacaaatcgatgaactcttaaagtggatgatgactttattgattctctctgtgtttacaaacagcaccaacatcacttcttacaaaaatttcgactaaattcgaaaccctaactcaaaactcaactcaattgctttcaaaagcgataccgggaagcctcacactccccctctatttatacccgaggtaggcaacctaaagccacgaaccaaactcatactaggagtcttaaacaccttaggaaaccctctagtataagaaacaaactttacataaccaatcatactaaatttggactccttccaaattcgactccgcatcccatacgcatacaatacctccatcgtatgccatatggaatctccatcaaccacgtgcatcaactctagcctaagtatcccgtatgatctctgaccaccacagacgttatcttatccccaagccgactcccggtccatcaccgcaaatactctcccgaggcatcgagtcacctacatatgaaataaacaaagaaaccatattccgagaccaagctatctccaacttgactcattagtagtaaacaacagtattacatatgtatagtatccatctagaagccataacaatgaaacaatcacggatatccaaacaaacaacctgaaaccgaaaccgacacagcgttagccagtcagaccgcgggctgcgccggtctgaccgcgcatataccgctggtctgatcggcaacacctgcccggtctgaccggacccaatccagcagtacctgtagattcacctgtgaaatccaatcatctccaaaactacttcgtgaataaattccaaatatcaaaaccaataatctccgatgccaattgttcgttacagaataataatcaaaaacctttattttacatattacatgaaagtttttggatttttcaatcgtaagtttttgtgattttgagatgaaagttttagatttgaattgaaagtttttgcgattattgagatgaaaatttcagatttaaattgaaaattttgtgattaattttgagataaatgttttcttatattttaaatgaaagttttgtgattttttaaaataccacgtgaagctgaaccaaaaccggcaagggatgcatggtggtgtgcgacttgcttcgctagtgtagctgcaccaactagtaacccttgggatggtcctccaatggtggagaaggtcatgggaaataaactaaaataggatctttcgtgccacaaaatttcaaattttacatatgaacctatccactaatccacagcaagaaggaaaaaggacgcgattatatttactaaccaggtgttatcagtaaaaataatgtttatgatagcttaaacaacacatgcttacataaacataagcttacataaattgatatgatttaaatttaaatagtatataaaatgatgatttaaatgtaaaagtaagatgatgtggctttacgagagaacaaaagaaggaatataatttagatcatacatataaggtctaaaaaaattgagatgatatggcttagtgaaagaataaaataagagagataatttgaaccatagattaatcatgtaaagactaaaaaacaatcgatgtgatatgactgaacgagataaaagagaaataacattaactaagtgaagatggactatataagtatataggatattataaaaaaaaagatggagagatatattcaaatattatgtgggataatttaacatgtttgcattttgaatatctaaaatttaataaattataaaattgtagataatatagtgtgcttgcatgatgcttaaatgtaataattgtttgtgaataatgatgtgatatcttttgcatgttaaactctagaattgagttataactttattatagtaagagaggataggattgttcattttcattcttctcccatgtggagaatgaattcagttctgaaacttgttttctgtttgcaaaatttcataaagataaacatggctgcacttgcgtcgtccatagacttgttttcaagacaaattttgcaaaacctagttagtttaagaaaaaaaagtctaacaacttgacatttagatcttagcaatgttcacatatttgagcacaaatgtttgcaggccatcctcattccattaccttaataagttaataggccagccttgtatagaaatgtaactgggccttttctggcagagagttgagtttaatcagcccagttgacataaggccctagtgttaatctcgagttgttgtttcctacccattttgagggaaaaaaaaaaaaactagcagaacacttggagtggtctagtggattcctccaacggcgttcatcagtgtaatgaaatatcgtgtggttcaagcgcgccacatttgagattctccttcacctcggtgtcgatcatggcccctcgaggccattcgtccctccgcgaggaaccgagaacctcatcagaaattgtcaggtcgtagggtgaagaactagaatattagcaacttttctatagaccgtttagtagttcgcatgtggaaagaaagtaagggagtagaagttggaaaagtatatataaacaacgtagcctaattcaagaacatttttgcatggcatactcacgtgagcgaaccactctttcttttttttacaccacatttttttttcttttctgacaaattatacaccaaaactttacttgttcaattgagatttgaatatttgtatattaaaaattgagtgaattacatattgggccagtttttattaccatggttgcatattggactaggattaaactataatttttactttagactagttatctttgcataacgtttcagtttaggcccgttctactccaactctcatgtctttcgtctccaagagccaacagacgatctgggcagggtgactgtgacacagagcaaatcgagctcattactagctggaaacaaaaatagaaaaggagatgtctctgtctttgcttgttcactgtaggctggaagcaaaaattggaaaaggagagatctttgtgctttgctcattaacctgggggcttttgctcattcacctggggaatttggatggtctcaccaatgccaggagaacataagctcattggccaatggagaagctgcaggagcagccttgaatcaggtacaaggactagaggaggatgaagatgcaaggactaaattattggggtgtggacctactagtccaaggtgcaaagcttggtaacaagatatggtctaaaatgaaaagatttgatatcacctagtccaatatacaaattaggtaataaatgtaggtccaaagtgcaaatcgccactataacaaaaaccttatatagaggctctcttgaacagacaattttcaaaatgactctaagttttaaagctctatagtctagagatattttttagaggcactttcaaaatcgcctaaaatatttttactctagagacactttagagacattttcagcatattttattaaatttatcttgtagagacatcttttcggcactttaaaatttgcctcatatgtaaaggtattttcttaaggcattttaaacaatataaagatatttttccaaatattaatatatatcaagtaactagatataagtaacacaaatcacatatttacatgtaattaaatgaggttgagatggttagtgcattgaagataaaaaatgtcaactcaagatgtctcaagttcaaggattggtaagagataatgtttttctttttttttcatattgatttgctatagttgtcataacatattaatgtctctacgaagtgtctttatttgcatagagacatctttataaatgcctcttagttcgtagagaca

SEQ ID NO: 45986 - DNA, 8256 bp, Oryza sativa
atacaccaaaaggcacttatgagacactcttcaaaatatctctataacactgtaaaggcattttaaaaatgcctctatagtattaggaaaatgtctctaccaggtatatttcaggtatatttgtgctcttaaaaattttgggcctacatatataaagtttatacattaaagctttcggagatacatcttaggtcatatacacggcaacgaccaaaagaattcacgcttgagccgcataccggatgctttctttttgatcattccacaaaactgaaatagcacaaaactgttcggtttatgccaatgtggggttaaggatttcataaagaaatcatgggggagcatgaccaagagatacttaaaaatctcttccctaaaactttttgttgggattctccatttaggattaaaaataaattaccatccaatagataggataaatttaacttcctaaggtacttctttcccttcccttgtttcaaatacttcatatagtatccttgaacccggaattagtttgatggatggagtaaataattatttcttgttacaatataggaccatctttcctgaaggcccaaagtgcatcattcagtccggatcaacgtactaccctctgaaccatacgagagatgaatttctgcctcgtacagctcgggccaaagaccagggaagctgaagacctgttatcattttctattggaggattctaaatggatagatctaaagacttcaaacctccccccggctgctcgcccctctgatttttgcgcgggcgttgctgctgctgggtcgcggcatgtcagcgcgcgcctgagggcaggttgatttcgcgagcctatcgtgcgtccgcgtcatcgctggttcttttgcagggaggtcctcttctttatggctatcttgttatgcgtccccgccgtgcttttttgggctcaggaatatttgcgtttagtgtgatgcggaggagacagagatgggaaaaaggcccacgccacgccctggattgttgacagggaaaacgactcaaaaaccaacttaacttaaattcgtctctagtcagacggaagccactaacaagattcctatcgatagtagggacatgctgtacgttcttcagctgcacgatctttcccgaagtaaacttcagatctaccgtgccaacaccatgaacagaagcatgtgacccattctccattaggacggtggaaccctgtgcgacctgataagaagaaaataatgagatgtcagcacaaacatgtatattggccccagtattaacccaccagttaatagactgattaactgaaaaaacagtaggtaaataccatacccgctttcatctacagtgttgccaatagtcatatttgtagacttagaagtctgccctgcaggtgccttcatccccttgcgttgtggacacttcttcgccagatgaccaggtaggccacacacaaagcaagtcatcttatcctggttaggattgttgtttatattcttcttcttgaagttggtggtctgctgagctttgtattttcctttgctcttgttttgggccttgtgcacaacattggcactggactgcccaccatcgcccttagacgcggcatccttttcccgagctttctcctcaacatcaagagacgctatcaacccctcaacggagtattccagtatcttgtgtttgagtgcagtaccgaaacctctccaagatggaggtagtttcacaataatgcacccggctacaaatttgtcgggtaagacacacttaaggagttcgagttccttagccatagtctgtatctcatgagcctgctcaactacaaaaaggttgtcagccatcctttagtcatgaaactgatccatgatgtacagatcattgctagcatcagtagcaccgaatttagtattcagtgcatcctacaactccttagcgtcggtcatatgcatatacaccttgaccagacgatcgccaaggacgctaagaatgcatcccacaaagagagtagtagcctcatcgaattctttctactggtcagcagcaagaactaccataggtttgctagcactcatccataagcatttcatagttgtcagccacagagtgaccctgatctgccatctcttaaagtgcacaccggcgaatttatccgacctcaatgcatcggcaaaaccagccatagtaaaaccacagtgcctataataagatttttggattgttgaaattataagcacataatgatttaatttatcccataaataaatcacgacatcgcatatgtgttggacaaaaaaatcgaacacactggcctgggagatctgcttagctcctgtgcaggtctaaatcttgatgagatgcgggcgtgccagtcagtttgatcctgcaactgacaagatatgcaaatagtagatcaaaacagccgatcggatgacaagccgatggagtagttcccgccgatagccgataatagccgatgccgataccagccgatagcgatagggtttaagcaatcggctatatgtccaatgtagataatgatataaaggcaattggctgatgatgatgtaataaaataacaatataatccagtataaaccaatcggcaaataatgatatgataaataagcatagatccgaaggttaaagcacacatcggctggaggtctgatgtcatgaaatccacaagattagattaaacagtgaaacctttgttgtcatcggctaaatccaacttatatgtatatgcaatccttataagccgatgcaacgtccagataactcaccggctgaaaccccgatgaaacccttattggcaatcaagaattaggctagagattatggttctaagcacgacttagtagatcaaacttaactgatgcaacattaagtatgaaaagaaacataatatctagacaatcaagctgttgactgaattttcagggtggtagatgtcgaagctaatctaatctagcaacgcgatttagccgataccggcagaaaccctaaaacgagaagcagccgatagagctaaattgatatgctaagactagattaacagagacatatgataaataggtaggcaaatatatcatccaaaccagagcaatccaacatgtcgaatgtactgatgcagccttgaacgacgccgacgtaaacgatacaattgcctaggccggtggaatattggacttaccccttagccggagatcgaacaccgatgcaagaatccgacaactgacgacttgacaactctcatcggctaatctcaggacttcgaagccgatgctgactctaagccgatgactactccgagcttaccaaatttcactgttaacaagatgtaaactagcatgaacgcatcaatagatctacacttgtaaacaacacaatataacatgaatagatcaaatatgcgtaacatattgagcacttactgaggttgctgaaagaccggttgctcagcaggaattactcgccgttccgggcgttgacgaaagcacgcagcacgcgagcgaacaggaatacaagctgtcgtggacgaacagggagcagtcgcacgaagcgcttcctaaaaaccttattgccgccttctcccggtgcaggacgtcgaaggtagaggttccggagacctgctctcccgatcgccggtgcacgccgacaagcgggatggagtagtctacgagtgacagcgcagcacagagtaggaggcaaaccctagattgattttgtgtgtgttgcgtgaaggcggcggcttggtttatatagagataggtcgcttgatcaaggcgcccgcacgatctccactccgcgtaaccaaaccggataagtcgcgtgtaacttatccggactccacgccgttttcacgcaccggatttttcggaatgtttccaaaacaaaacaaatccgaatttccgcagcaaaacaaaactgcaatttctgcagcaaaacaaaactgcatctgcgcaagggtgaggaaccaattttttagaccattcgacgcgtacgtcgtgcatgcccaccgcctgccaggcgaggcaagcgagcgcgcgtatgttcccccacttctctccacctcacatgcttcaattggctagaaggacaccctcccttttaaggaggtccctctctcctagaataagcaaggtggtactaaactccccatgcatgtcatcccatgagatgtacttttgtgatttttcaaagaattaatctttgaatgggctaaggcccatctattaattccaacaatataaacttgtacgcgaataaaactgggtcgtacgtaggattatcatagaagtagtcttggtataatctcaaatgacgtgcttatctgttgtgatcaattacttcatgtcccgtgaaagacccgccatgttttgatgcattggcaatgtgaatagctatgcatgatttgtgctgcggcaaaaaaaaaatcgtcatcatcgttggatgatgattcatccagaagctgttgaaataaggagcgaggataactcattacagatcggatcaactgccaaaccattattcatcacaatataataattttttccctaacgacattgtcagatcaaattaaaaagtagaacgtgattgatatgagaaatttctaacatgacggtcacctagcatattacctgatttatgacattttcgtgtagaggatcagctaggccttctgtttctccacatattagagccttagaggcgaggtcttccaataccaccgtgcttcggcgagggtttctctggcggtaacagaagccggttagtaaaaatattttttttttggaacgaatgaatgattccaatccgtaggttttaggaactaacttttgaagttttgagtctctctcgaagatgctaataaaacttcagtattgagaaaggtatgagagaactgttgtccacaaggaggttagggttatgattttgtgaaatttcataatattagacttatggatcccctccaacaaataagttttagcggttcgggctctgccactgttcacactcattcccgcttggacactcggccaccttgcaagaaaccactctacacgcacacgcgtgccatggccgccgccgccgcctcctcctcctcctcctccgccacgctctgcaagcaccacggaccacccaccgcgtcccgccgccgcctccgcgtctgcgtagccatctccgtcacggcgctcctcctcgccgccgtcgtcgccgctgccgtgctggccgtcgccgcggcccgcccgcgcccggccgacgcgacagtcaccgcgctccgcctcgcctcgctgtccgtctcgcccggaggctccgtcaacgccaccctcgacgccgtcctcgccatccgcaaccccagccccgtcgccgcgttcgcgcacgacgccggccgcgccgaggtctactaccgcggcgcgctcgccgcggacgccgacgtgccgcccgggcgcgtcgcgccgcgcggctcggaggcgctggccgtcaggctcaccgtgctcgccgaccgcctcgccgggcgcgcgccggagctgtacggcgacgtggtcggcgccgccggggacgtgtcgctcaccgtgcggacgaccgtgccgggcacggtcaccgtccttggcgtgttcaggcgccacgcggtggtgatcacggcgtgcgacgtcgcgctcagcgtgcgccggccgggcgcgcacagctcgtcctgtcgggttctcaccaaactctagccatatgttggatttttttaccattttcagtagagttgcaaaatttaaatgtctagtgttatctgaatccattcaagtttttaaggttcttaatgtgtgttaatcgctgctagtaacttgaaattcagaagaatatgtccaaatcaattcattcacctccaagttaatgagcacatcaagcatgagcaacacacaagtgaagtatgtgcattgatcacagaacaagcatgcaacagtcagttatcaacagaaaggaccaaaatgaattaatctgctaattagtatggtcttcagcattcagaatacctcaaataatacatgcaaataataatcatagtaaattgtgtgtcatatgtatcttgtgaccaaacagaagctcaaaaatatgaactgaaagttactggaacataagcaactactccatgtgaccgtctacagtgttctccgtactagtgctccaaaaaaaaacccggttttcggatgctcgagaatcaaaaccatttctatctgatgtcatcccaaatattgctataagatgacagaggaaacccaaatagactactttggtgatgtgctgagctgaagatgaaacatgcaaattaaggggctttggtcttcaaagcatcagtttagtgctgtttcttctcagctaacattgggatctttgagagaagcttgtgatcaagcactgcatattgcttcttgagctcgattagggccttctcgcccacgacatcgacttcatcttcgtatttctcatacagcattggcagtgtgtatgccatcaggaaaactgcaaacatgcatcaaattgagtgtctcaaacgacgatgagcgatagagatacaaattgttatctattgatctgcatttctgatcataattttcagattcaggcttttcagtttccaggtcatccaaagagaagagatagaagtgtaagatcatagcttttcaacattacctagtactaacaggttaaataattcaatatcctaccgtaatgaatttttttatcgaaattactatttgactgacctgcgtggagacactttccctaaacgtgcatggaagaaacaaaactcagagtagtaattttctatcatgtaacaaattcaaaagtgagaaggtattgttatatattcgatctgatgcgaatgcgagtagacatcagaacacaatattgtgcattcccatgtgtttgttttttccccaaacagtaaccaatgcaaattcagatattcgtgaataaatccatcaattttgttttgcaatcaacataattttcataatttggtaagggtgagtaaaattatagaaattaatgtacatactttatcacacagtttttctatatgcaaaggggaaacctttgagttttacttcaattttttgtcaatagatatgggagcatatttcacaattctttcagaacacacctcaaaaaactactactccctccgtttcacaatgtaagtcattctagcattttctacattcatattgatgttaatgaatctagacatatatatctatttagattcattatgtggggaatgctagaatgacttacattgtgaaacggaggaagtagtaatttgcagtgaaatctgagaaagtaaacaatgtgcttactggtgtaagacaaagtcaagaagctgaagcagctcccaattatagaaacgaaccagaggcctgcaactgtctggaagaagaagaagatgctccagtatcacattgcgcgtcaattacatgaaaagggaattaataaaattaaaaaaaaattaccataagatatgttgtgaggtcttttccggaggcgacatggcgtaatgttaagaaggcctcattgatttctttcctcagaatatgagcaatcttcaggcattggacttcagacagaattgcatctgggaactttggaggacccctgaaatttctaatatgttatatcagcctccacaaagcatgaatttgttgttctactcctctccatccattacttggtaacaagggccgaaatctctttcaaaattgttctcttttaaaactgtacatgtataggttttgttcgaagaaataaaaagagttcaacgtatacagttgagcagtgcagttgtacattgaatatatagaaaactatatactgtaatagaaatgaattcttcagaataaacagctagctaggcaaaagcaactagagccaacaaagattagaccaacatgaatagcaccaagatgacagagaaatgacatgagtaaactgatcaaatccagatatatattcgtgcttttattttttttcagttacttctaagatagctccgaaattaaccattctattaaatcaatattcatctatcaagccacaaatagatttttgtaggaggaccagttttcgattcttctgacaagaacaaaacgaagctaaattgttagtagaagaagcgagaatgaactaatcatgggggtgacctgttgatgaaggaggcggcattggcccagacgaagcagacggtgaggaagaccatgagcgag

SEQ ID NO: 45987 - DNA, 34906 bp, Oryza sativa
  unsure (1)..(34906): unsure at all n locations
ttatctgaggaactaagttcctaatttgaaaagactcgaaatttccactataggagcgaattttagattggatggttaagaggctaagtttccaatttaaaaatagtgcatatatttagttagatgtagagccgggcctgggtaaaaaatatccttctataaaaaatatgaaacggcgatgaacttagaaaagaaaattcagacattccaggatcgattcttacgctggaaatgttcaaaacatccatccaatttaagtagaatttgttcattaaccgatcggattccgaatcatcagagaaacaagcattttcaggctagagatgtatatgtatgtacctttgcctcctcctaggacgtgatgtagcgggttcgtccggccgaagagccgcttcttcttggacttggacttgtggtggtgcttcttgtcgtcgtcggagtccgaggacgaggatgacgacgatcccttcttgaactcatggatcttgtcgttgatcttctccagcagcgacccgtgctcctcgccttcggacatcattccctcccccctgatttgatttggtacacaatggcaaacgaaacatcaaatcgaggactgaaatctttttccacacacgttaatttattcttcagagaaaaaacaacaacaacaacagaagaagaacaatacaatttgtctaaatccaacgccaggtgttgcattgcattcacaaagaaattatcaacaacgcaatggtcaaagatcatggacacttacagtgagacacaacggtttattaccctctctcgctcttcacctctatctctgtgtgtgttcttccttgaaacgaaggaaagcctgtgtttattctggggggttttgttcacctctcatgtctctctatgtagcaatgacactgtttttttttctttttcttacgtctgggtggcgtttcttggatctgcggggaggaaaccgaaatggcggtcgggaggcaaaggcggggggtggtgcgttatctgacgccgggaccgttaggatccacgtggacggttaggatttcgccacgtgggtgctatggacggccgggattgcggttcatgggcggatcgatcgatggccggtacggcgtctcacggggcgccgcgagtatcggcctgcagagcgtgtggccctccacgtaacaaggaggaaaggagggaaggtctaaggttgaaaacggtatgaaacttgtaaagtgttggctactgttttcgtcctgtggcggaacgttatattttgattatggattgttcgaaaatagaatggaaatgttatggcgatttttttctggtcattttaatggtatactgttttcatatgaaatttttcagaaattaccgtaatccttacatcttgtcaatgttggtatacccccctccgtccaaatatgattagtgcgtaagggagaaaaatattccgagtttgatcgtcgttttttcatgaatgctcgtagtgtctctagcgagaggtgaaatgtcagagacgggataagcatatccaatggagacataggtaataggaaacacaacatgtgtggaaacaaatcgacattgcatgcagctcctgatatgacgagtataatgttagttattgtatatgtgggggcattaactctttcttggtcttcgtgacaaacatatgccctatcatatttggatggagcaagcataatattactatgaactattaagtatttattaattatttttggctatgaattctaacttgatctacctacaaaacaagggagaatttactacttgctatcctccaaaataaacatgcccaaatgctactttctaaaattttcatgttctttttgctacccgggtctcaaccttcttcactttttggtgacgggcactataccagatcagtccatctgccatgaacctaaggctgtattcttctccctattttctcaacccacctctctcgttttccgcacgcatgctttttaaactgctaaatggtttgatttataaaaaactttctatatgaaagttaattaaaaaaatcatattaattcatttttcaaaaaaaactagttaatacttaattaatcatacaataaaacaaacttcgatttgcatggaggggaggtggggttcccaaccacctcctccgatgatctcatatgtgaaacctcgagatacacaatggattttctattatctttttacatcctactacaaggagagcctatacaggattgaaaccacagtttgcacgatgtatttgaacaggagtgtttgatcgatatgagacgagaaaatccaatcgctagctacgtacacgtccgaattaattaccagcggccatcatggccttgaattcctcgtagtcgacacggccgtcgctgtcccggtcggcggcggcgatcatgtcgcgcacccgcgccatgcacgcggcctccgggagccccatccgcgacagcacggcctgcagctccgccgcggagatgtacccgtcgccgtcctcgtcgaacaccccgaacgcctccctcatgtccgcctccttctcctcctccgcctccgccgccgccaccgcctgacgaccacccaggccggcaagctcggcgtggagcgcctcgaattcggcgaagcggagccccgccatccccggggcaatgtacgccgcgacgaccgcgtcgagcgcggcggccgcgggcggcgcctccccgcgcgcgccgagccggcacagcgcgcccgacagctcggccggcgtgatcacgccgtcgccgtcgcggtcgaacatctcgaacacgcgccgcagccgcagcgtctccgccctccgccggtgggccgcctgccgctgtggctgcactaccgacgccggcgcccgagatgctgcggcgctggccgtgagaacggacgagggcggcggaggacgcagcatgttaatggagcgctacttggttttcaccaatgtgtgcacgtgtgtacggaagcctagtttgcttgccttgttgggtcatctaatgaaagagcatcatgtgcgttctcgcgtggtttattttatagagcaagtaaaaatgtaaaatggaacagggcaacgacgacgacacgtcgagggtactactggagtagcacgttgttaacttttttttataaatatttgaccatttattttattaaaaacttttgtacaaaatataaaataaattaagtcatatctaacatttaaaaataaatcaagtcacaataaaataaataataattatataatttttttaaataattaaatgtatcttaaaaacgttatatattaaaaaaatgaagggagtagtttgtttgttcggatatatatatgtgccaaagagtggtacgccaggtacgcatgcgcttgaaaaattcttttttgttttgggttatgttttttatatttatcgtcttaatttttaacagttagtggagacaggccgcggtcagtggctaaaatattttatattccttctaattcatattattaatcgttttgatatttttcatagtgaaatcttagtaagtttgacaaatttattttttttattaaaaaatttagcaacatataaaatatttatatccattagttttattagatttaatattaaatatattttgataatatatttgtcttatgttgaaaataccactgtattgtttttataaatttgatcaaacacaaaaaaaaataactaagaaataaaattaaaatgactaataatataaaactgaaggacaacttgacacgtacaactagctagagtacgtagtacggtatggaaaaacagcggctgtatctatccaaaatattcagctgctgcttctgtacgatttttactacttctggaggaacactgtttaatatattttttatatagcagggccggtcaaatgattagttgaccgaattctattaagctaataaacctgcacaaagagggacataaagtaatagtattttattttattattccgaattttataatttaccacttgatatggactcttgatattttatagtattttacatggggacttattatattttttattccgaattttactgaaaattttattttattttggagttttgtattgcgaccaaattacttattttattttatttttattacgaattttaattaatccatattattttatttaatatgtttttttgagaaaatttcttcaataggttggaatttgtatgtgaccatattattatgcggcgcacttaagagtgtattgacgtgtaagcatacgtgtaaaaaaaaagagagtaacatactaacatattaaaaataacgaacacaagaagcgtgagccgacaacctactgctccattaaacataaaaacctaaaacatgacaccttcacctcgattttttttgatatatattgagagaaaaaaaaatccaaaaatatcattaacaaacgtccaagttcaacacatatcatcgatgagtacgagttttaaaaaataccacccgtacaagtgactttgtcatagaaatatcatcgtcgtttcgtcgttagggttacatacatcctgctccgttaaatgcacttttttatcctatagcatctaacataaggctgcaaatgaaatcctaacaacgatgatatttctaggataaatttacgtgtacatttcatacaacttgtagatatttattagagcttggtaattttttttttggattttctcatgtattaaagccagggaagtttccgtttcactactatagagattgactttggtgccgattatggccttaggtgccggattctcaaaccggcaccaacatgcggcacaaacgaggaatcttatacatgcatgtcaatacaccagtacatcttaggactaggagtatataaagacgtacgtacttgtgcatggaaattaacctagcaattcatataccatcacatttaatttccttgttctagaggaaaaaacaagagagaagagaatgacgacgacgacgaacacaaacgcgtctccttttgtaattttcgtaggaaacgcaagcaaagctcgttgttggctgcatgctgaataaaataaatagctttgctcaagtcgttatctatcagtctaccatttccatgctgtgatatcttatgtatatataatatatttggtcgacgcggcctacacacggttcaaccgcgttggaagaaataaattaaaatggaaagatcgacacggatagggacataggaagcttcgctgaagacgatgatccaagagctaggtagcttggctttggaggaaatccatatattatcaacaaaagtgtatatattgtaatatgcaacttttgttatagcattaacttacaaatgtggtttggatacacattcagcttttgttatagtattaacttaattaaaaagtgtatcctaaaacttagttcttttcttcaactccttttttattagcttttcaaactgtcaaatggtgtgtttttaaaaaagtttctatatgcaagttgtttaaaaaaagcaaataaatccatttttcaaatttataatagttaatacttaattaatcatatactaatgaggtttctcgtttcgcgtccgcaaaaaatttaccttctttttgaagcatcgaacggggccttggaaactttagttatatatagtattaacttaaaaatgtggttcgaatacactttcaacagtgattttggtgggtcaagagttttcatctctttgagcatgtattcattaattggtgtgtacccgtggtgtggtgtgcatgtgtagtggagaccatgcgcgtctataataaaaaaaaacagttatgctatatatatatatatatatatatatatgttggcacacaatttcaagaaatgaatagttttggaactgatgcaatgcttcatatattgtacagctttggtggattaagatatacttgtatttttataaagattatctggcacaactatttcatgttcgcatgatcaaagatgttttagggtagtcctaaccctccacatctaccaatgtccacagaatttatggctatcatataaacaaaaatttgatgtgacaaggaaattaggggtgagagagagagaagagaaacagtatgtctcatgcatgaaacgggctcggcgtacacaccaaggcccaagaaacaagagaaatcagcgttgggggcaactcatcgtttcttccacacacccggattttactcgagctcccaatccactgttcttgtctccgtcccacacgccagcttcttctaccgtgcaccgaatcctcacgaaattttggcatgttcccaagcctcttggtgccaacatcttgctcaccttctctctatctgtctcgccgcctccattttcccccaatcacccatcttttccaatctctctctgcttgatagctaaaatcggacaaaataatcctcaatcactcatccctaagaaataagttgtcctaagccatgtgcaaggatgaatacaacagaatgaattaaagaagtgccaatccaaatccaatcatgccgccagtgaatactcgcccctgttctagatgttgccggtgctccagacacaactactcttgctagtggtgctttacgagctagtggtccagtcgtcggttttcctgcggcacatgctcatgccactagtgcatggtggccagaatagtctcctggcaagtcagaatggtatggtgcaaattttcctcccaaagacataggttaatcaatgttgttagttaattaatgggttatattagaatgacattttttttcacttcaatgaactcctgctagtttatttcttatcatatatacctatgttgagctcacttagttactagcaatttcctacttcgaggttgagtgatgtcaccatttattttcatccattggatccttctgctcaacgtagcagattgctccctcaaggctttctctcttgctctgtgagcctaacgtaattccccacatggtccagccagccagtcaacaaccttttccccttcccctcccccctagcatcgcaggcggtgcattcccttccgttcgttgcgcatcaccaggagaccttcgcattgtgcgttgccaagtccctccccttaggatttggatcgtttgccttcatagcatgaaggcacgagcatgcagttagcccatcatccacagttcaagcaatccaacagttcacgttgcatgtggacttaacaacatctaaattgatatcggtctatcaagcaatcgaacaactcactttggattacttgaacggttgtgggggggttgactgcaagctcctgccttcacccccacgaaggtagacgatcaaaaccttctcctcattgattcgcctcttcctccatcaaaaaccgtcatattgtttctcttctaccatcccaagaggtatatcaaaaaagagtaaagtttagttttatatttatccaccaaatatgtcttagttccaccaaatattccacacccacatcttgcatgatcttgatcagaagtatgttttgctatcttctttggtcaagatttttgacttagtaataaatgtgaatacaagtgtgccttacttgatccctaccaaactccacatatttgaccttagagtagggacaatggcaatatcttggtgaggaatacaattatacaccactgagggactgagagaatcatttgaggaacttgttttttttattggaaaaaatcatttgagaaaatctccggaataaaagttagacgagaaatgggtgagtagtgctttactaactgttctgtctctcaaccgcccaagacaaggtgaagcatgatgcctcacagtttaggcgtatgggtaagacaccatgctgactggcatgattctggtaagagaacccatactatgcatttttaacattctagatatatagcattgcagcaactcctgatttgtttgtttcatttcgtcctttactcgggacgagcaaagattaaagctttgggggggggggggttgttgacggtcgttatcgaccaatttcgaccgtcagtattacccagttaatgaagactagctatgcttgcaatgcataatttccaattaaaatatctacttccactatgtgctatgatactaacatatatgcaggataagcatttataaatggaggagaatcgacggaacataaccgaacaattaaatgaaatccatcgagaacagacttatgggtggataggcctctaaacccattaaaataatatcaattgggaccaagcactacactactgagccgaggaatcaacaaggagtgcacttgccgagttgtgggctgttgggacaggctagggttcggccgaaccagcagctagcccaatcagcccagtttttcaccaactggtagttatcaacgtcccaaggcggttgtgaccgtttctacctgaagaaaccgtcgctggacacttggcgcaaggaggtgaagcaagagggaatatgctcattggataccttgagcatctccacactcccaaggcacctcatggcctataaatacccctcctctcattccattcacacacactcaagaagaagatcaaagagctctctcaagtttagtagtgttctagtgctagtggagtaggagatataataattttcttagtcctcgagtctttagtagggtatggctctagcagcttttctatcttcctttataagacttattaaattaatataatattcttctttatatatcttcggtattttatcccctttatattatttgagtaccgactttattttatacttgtatcgatatagttgtttagctagcttaccagagatgtgcattggtgtgggtcatggttgttaagtcaaacgaataatcgtgctcagatcgattaagtcgggtgattttgacagtgatggtttgttggcccatacattgggtgggcactgggccatatattgactagctcattaaggggatactatagcaaaaagagaaggaaaccctagtcccactcccacagccgccgcaaggcaatcagcagaaaaagaatagggacccgatacgagcgctggctacacaggcttgtgcgctggcgcctccagccaactcctccttcccttttgctttcatcctctctatctctggcttttctcttctcccatcccaaatcactggtgttgaatgcaactggtgggcaactgcaattgagttcatccattaggaatcaacctcgaggttagtttcaacttctctccttttccctaaaggtttctatggtctcatgctatgctttgcttactctttcttgctggttgctttgctagttctcttctctcactatctcatactctgctgtccaatttattggcctgatgcaagttgttgcctgctctagtgctctgctagatgccatatgccctgcatagtatatgtttgttggtctagtagggatgcccatgtgtgcttgctgcaagcctacaatgttgcttttgctagtgttgtgtggaccactggactagtggacctgctacttttgctagtgctttgtactatctagtgttattatattggcaagtagccaagtgttgttgctttgctgtttgttttattcatttatcttggatggcttttagtgatttgtcgtttgtgccatgcttgtgctgtggttttgtacttctgttagtaacttggtcttagcaagttagcatactatattgtcaatttgtgagctaacatctagcacaaatataataatttacaggtagcatggcagtgacaacgatggatcaagctaacggcgttcaaggccagaatgggagcaatgagctgccctatgatccaaagaaggaccctaaatggaaggccaactcgaaggacccgggatggaagtatacattttatccggatttggaacataaaaaaaaatattgcgatgtgtactttgtgacaagaatatggtttgtggaatatcaaggttaaagcgtcacattcaaggaggtcatccagaagtagaaaaatgtctgaattcaacttaagaagtgaggaatgagcttggtgaccacttggcatctcattctaggaagggcaaggtcattcatgttgatatgatgatggtgatgaagatggacaggttgctgcagaccatgaggaagaagtggctgtgcaagtcaagccacaagtaaagaaaggtttagctacaatagctgttgctactatgttaaagatatcagagccacccaaaggtggtanatctgtgcttcaatggttcggaaaagcccaaaagaagttgtagaaagaaggcatatgaggggtccttctcaaagaaccatagcatcacaaagaagatggagaagatgagagttgatgaacatgtgctgatttttggtatgaatgtggcattccatttaattgtatcaagtcaagaagttgggagattttgtgtgggtctattggacaatatggtcctagatacatatcagcctcttatcatgaccttcaggtgccattgcttgaaaaggcaaagaagaagacaaattcaataagagaaaagcatgaattggcttggcaagaatatggttgttctctcatgtcagatgggtggatagacaaaagaaaacgtcacttagtcaatttccttgtcaatagtctagcagggacattcttcttggagtctattgatatattacacctagcagctgatgcacaattgattgcaaatctattggagaagcaaattgatattatccgaagaaattatgtggttcggattgtaagtgacaatggttcaaattataaggcagcaggtagacttctaatggaaaggattccaactttgtattggaccccatgtgctgcccactgcttggatctcatgttggaggacattatgaaaattcctatgttgagcccttctattgcaaaagccaagaaagttactacatttatctatagtcacagtaggcttcttgatgctatgaggaagaagacaaatggagccgacattgtgaggcctgcagctacacggtttgctactgcttttctcacattgcaatctatgtggaagcattgcactgctttgaaaggtctttttgtggatgaatgttggactagttccagcttggctagaaaggaggcagggaaaaaggtttcttcatatgtgctgacaactgttttttggaatggggttgaaaattgcatgagagcatctcaggcgctgctcattgtgctaaggctagttgatggtgatgagagggcagctttggctaaggttagttatgctatggaagtcgctaagaagaagatctagagcattctttgtctctcaaggcaaaattacttgagaaggtgatgggtattgtgagcaaccgatgggattcccaaagggatcagaagttatatggggctgcatacttcttgaatccaaaaaggttctttgaacttaagagtgaccttgccaatagaatgttgtgtactaagctgaggcatatgttcaatgaggtgttatggaaaatggtccctgatgaggcgaaacaaagcaaaataagctcgcaatctgatgattatgtgagagaggagggtgaatgcttctcttctaagttggctcaagctgacaagacaaagaaaaatccacgtaagcatcctctttttttgtttgttttttgtttcaatctggctaggtgtaagtgtatcaacttgccttttcttgctgttctttggtggtcagcttatggaggccttgcttttgagctccaaactttagcaaagcatattgttagcctttgttgctcaacatcaggatgtgagcgtaattggatgccactactcgtgatcatactatgtaaaaacaacttcaatcagatctgattgagcatatctagcaaaagtttgggaattcaaaccaattaggtgactattcatcatttgaagtttaatttacaatctctatgttacatagagatagtatgcttcatataaagttgcaaactcgactacattttaccctagcagtaccaattcagttaaatatgttctctcttttttttttgatgtgaagcttccgcattattttgatattgacttgtctattactctttttttttaagattaggtcctgctattttggtggtgttgtgctgttgtatgaaatactcatgactactgaaattttttttccttatgttctgcattgagtccattatagtgtcggtgtgtgtggcagacttgtggctacatatgtttctttattttggtgttgcggtgcatctggacgaactactaatatcatagagactaccaatttgatgaaccctgagctccactcgagacactcaaggctgttgttggcccgatctttcggtgagttgatgataactacgattttggagaaacgttgacgacccgactacaaccatacgagacgttgttgtgttgcgccttagcgatcgatacacctctccgtgggttgttgatcttgccggtgcagatcaaccttattcctacaagcaaatctaagaaacaagcaagaacaagataaaagcaatctgaattgcagataggaattgaatacaaatgataggttggggttccgtaacgagtaaaccggtgatctaaccgatcacaggattacacggcaaagtagcaaagttaaactttaatctaaacaaaactcgagaaaccctgaaggggtacctaactatattanagaggtaggaggacgaccaaggggactctagggtcgtgctccactttgttggggtgcaccccacatgggccctccttgggccggggttccagacgaagttacaagcccataggcccattataggtgatgcaacaccttgttactttaattgcggctcactaagatggaatttcgcaatgaagctggatccgttggaaagaggactccgagatctttccatcaagtactcacgggctgaaaacagagctcatatggagatttcgcggccgtttgaaatcagcagtgcagcaggtggccgaattggattccagcacttggaggccttgaccttaatgtcttcttgtccatccatgatgtgagcaatggttgtatccgtagtagctatggtcacatcatactccccttcttcatggaaaaccgtcctcggtttttccatatggtgctcttcacatagtccattcaaaataacatgtttcatccaatcaagactagagaaactcgaagtagtgtgattaggaataacatgtttctctaaatccgaacaaatgaaaactctatgcaccaaatatatttttctatcattatattcatcaaagatatgaaaaatagcattagttggacatggcaaatcagacttagcaaataatttctcctccaaattattgagctcacaaaaatcatcaaactgaacatagcccaaagtatttaaagaagttatcaatttacgttcctcaacatcattagcaatgtgaacaacatgcttaaaatcagcacacaatgaaacactagaaatagcaggttcattcactagttgtggcatggatttaagtgaagcattatcacacaactcttctttatcacaagaaacagcaagtaaatcaacttgtaacaaaggcaaatcagaagtagtttccaccaaaatttgctctagattagcatggatagtggacaaatgtgactcatcagaagcacactcaccttgactaatattagcaccatttaatttaccttttatgccctcttcagataatataggtgcatcagtcttttcttcttccttcgtgagcgatggagatggcatctcgagcatattgctcttctcctcatggtgaatgttctgagctccctgcaaaatgtcagtaataggaagcacaagcataacctgtttctcccttgggttctttaaaatattgctctcaacactgcaagcaagcatgaacaagtggcctatatgattatatgtcacgttaataagcccaacgtgaatatcggaattaagccctctaaaaaatctagtcattatgttctcattgctttcttttaaaccactataagtgagacaaattttaaagttatgaaagtactcccgcacagttttgtcaccttgttttagatgttctaatttctcaaggagtatgaaaacacaaaagttttcctcatcattgttttgcattcatcccaagtttcaagcttattgccaacagtataccaccaagaagatgcagaaccggtacacttattactagcaaccttaatcatttgagcattagagaaatcatactcatcaaattgtttgtctaccgctagctcccaattaacataagcggtggaatcatacttaccatcaaaaactggcaaattagattctacccttgcaagatcattatcatgtacctcatatgctatgcgtgaagaagtcgttatatctcgttgatcgtgaagaagtcgatgttgagcatgaccatctcgtttccccttgtgcaatcctgtcatggttagtagcaaacaagaaacatacacaagaatatgcacgctcctatcaactacttggtagtggaagctccaatatcacacacactcaagcttttttaccaagctcttacaagttcttaccaaagcaggcataatggtgacgtacactgactcaaccaagcaccccaatggaggttcgatgtatcgaggccttggcaaacacctgctgtatggctgcaatcaaatctgtggagctctgggtaggcttaaatatgtagcaaaggaatagcaaatgttcaaatcagagaatgcaaagttgaataattgttcaaagtcaagtaccgtactggtcctaggctagaacgtaccagagacgcgagcctacacacaaacggtaccacaaaatagcactaggaacaacttaagcacactgatatatccaagcgatccagaagataacaagtgattttctcttttccttccttcttctctttttctttctttctttcttcttcttttttttctcttttttttgtcggtgcggctttttcttttctctctttttttttccacctttctgcctttttttttcttttttttaacaaaaactgactcaaggacatcaatgtaaggtcatagggacccaaatgtaaatatgaaaattacatggactcaactgtaaaagtcaaaaccaaaattataaatcatacaaaaatggaatgctgaatttatactggttccgtttttccaaacagatctcgaaaccgacaccaaacaaaaattcaccaaggtgtctagcaactcaaattgaagggagcgagtcggactctctctagtcacggtggtgatgggtacggtaggtcgaagggttcggcctgcccccccacaagtggaaccgaatccaataaaaaaaaactttccttttcttttctttcccttttttttcctttccttccaccccaccgaatccaaacagatctgctatattcctttcttcttcctcgcacacacatgcacgacacaccaccaaatagaagctatgcaacttgagaattcaaaaattaaccgacagaaacttttgaaaactacaaaaatagaaccgtggcagtgagccgattccgttttcgtaggtcccgacgacaacagagacacggaggcgacgatgactgtggtccaaaacgtgactagaactcaaaactctaaacaaactagacgctatgatcagcaacacgacgtgacgacgcaacacaaaactcaacaacgcaaaaactaaaaagaacaatgcaatggcacaaagatggctaggtacatgatgcaatttttttaggcaattttctggttataggtagataaaaactcaccgagcaacgaaagctctgataccacctgatgacccctgagctccactcgagacacttaaggctgttgttggcccgtctttcggtgagttgatgataactacgatttgggagaaacgttgacgacctgactacaaccgtacgacacgttgttgtgttacggctgagcgatcgatacacctctccgtgggttgttgatcttgccgatgcagatcaaccttattcctgcaagcaaatcgaagaaacaagcaagaacaagataaaagcaatctgaattgcagataggaattgaatacaaatgataggttggcgttccgtaacgagtaaaccggcaatctaaccgatcacgggattacacggcaaagtagcacagctaaactttaatctaaacaaaactcgagaaaccctgaaggggtacctaactatattaaagaggtaggaggacgatcaaggggactctagggtcgtgctccacctggttggggcgcaccccacatgggccccacttgggccggggtcccagatgaagttacaagcccatatgcccattacaggtgacgcagcaccttgttgcttcaattgtggctcattgagatgaaatttcgcaatgaggctggatccgttggaaagaggactcctagagctttccatcaagtactcatgggccaaaaacagagctcgtatggagatttcgcggccgtttgaaatcagcagtgcagcaggtggccgaatcggattccgacacttggaggccttgaccttgatgccttcttgttcatccatgatatgagcaatggttgtatccgtagtaactatggtcacatcaacctatgtttctttttacctgtgtttgcgttctatcattttggctatcaatgtctctcttttattgtactgagatgtatgaacatggaaatttgtgttgatatatatctactagtttctactcgtatatgcactgatatgtgttagtttcttctcatttactcagattagcactgatatatgctcatatgttgatagtttgacacatacagtacaatgtagctactgattttgatctttggatgtatgtgatgcatgtcacagttgatccttctccatttacatgacatgtaaagagttattaaattttcttctctacagaaattgctatggacactatgcgttgggagatagtgtcaacatatatattattatgctttctctcctctagacactacccatcaatggtgggttgggattgcccttagggttgaatagggatttttaaactaagaacaacaattagatcctagttgcaatttatataagagatagcctagtgtatctaggttgactactgtgactatcttgcaaaattaaacaagtttttacaacctagggtcaatcctagtttggaatgtcaatactaggatgtatattgtgataggtggaaaactgcaaatagagtagagagagaagttgacgacgcatgccgagttcttctttgaggtttcgaatatttggcaatttttgctagttcatattggagcactctacaaaaacaatattatgccatcatatatggtgtgtgctctttagtggtagcatttctcacttcggatagactagctccaaacccttgatatattgcttggatttcctacaatcaccaacaaggaagatcattgggtcctttgatttgtagaaaaaaaacatagaaatattgaaggaaaatttcatatgaaggcctttgaaacaaaggatttaattatattctatcctttgaaattcctatatatggaatggacaatcccataaagattttagagaaaaacttagcaagagctccaactttttgaaaaaaatttcctttgagtctatctttctcatctgattcctgtgttttttctgcaatccaatcaaacggtcatttttgtgtcttctgacatgttgcaatcctctgtattgcacttacttactttcttgttagaatctcgtgcttttccattcctacgattcaaagggccctcaattataactacaagaatttataggcatgtactaaaatgctaagagtaaccagacaaattttcactttactaacatgaagtctcttaaatttatggatgcatataatgcttataactagaacttagcctcattagcgtatgattaattaagtatcagctataaaaatttgaaaactggattaattttttcaaatcaacttttctacagattatttttttaaaaaaacacatggtttagcagtttggaaagtgtgctcatggaaaatgaaggggatgaagataggaagagggactgccaagcacggcctaagtttttcttccgttatatgcctcggagttgcaattgattgagatcagcattacttccttatataaaaaaagacatgataagaaaatttatgatcccagtcataaatttttgataagctactagtttaagagaaacaaacctaccttctactatatagttggtactcactaactcctaaatcttaacatgcaaatttgtcacatcatcacccactagcaattattatctagagtatcttaaatctcatgcaaacaagatacatcatttacaattttgttgtagttttcaaactcaacatgcaatctccacatcattttcacattatgtaaacatatacatctatcatttttataaagtataatatgcattcatctacatattcgagagcaaagcgtgaggtatcaaccagtgaagtaaacaagttaatacgtaacatgttgtagtgggacggttgggtatacactaaggactttcgaaagaggtacacactgaaaacaatgaaaaaaacacagatgtttagtactcgtacttagctctagcataatactagttaagtgaacaagttaattaatacataacatgttgcagtgcgacgattgggtatccagtaaggactttgaaaagaggtacacactaaaaacacagatgtttagtactcgtacttagctctagaataattttttcttagtacatcaaattactaactacaatatttagaacaagaactgcttatggttggccagttttaccttttcttgtttttgtcttgaaacaaatattgattaggacataatccattgatgatgagttaggtagatatttaaacatgggagaacattgttaaatattgtcggtatcatcataatcgcataagtatttcagtgatacgatttcgagctacaacaatatgaatatcaaaaaaatgatgtactcgaatagtttaaccgtttaacctgtgtggaccatagttggttagataaaatgatacatgcatgagaagctaagctattattaaggtaagggaaaagtttgaattaccccctgacaattgcgttagtccgaattacccctcgaaactgcaaatccagacatttaacacctcaaaattttcaaaccatacgaattgccctcctaatcgattttaacccggtattgcttttatgtggtggacacgtggcaatctagctaaccaaaaaaaagttaaagaagatgtgggtcccacgtgtcagccttatcaactcctcttcctccccttcctcctttctttctctctcatctgccgctgaggcgttgtgctccagctcggagagtcggtgaggcagcttccaaccgggtggtgagtgtgatcgtgtcggggcacacgacagcgacagaaatgaagtcggagggtacgctaagcccgtcattaggaagagctccaacctgtgcgggcgcagccacgggcgcttgcctgagccaccgggcgagaaaatggagggaggaggaggcgatcgagatcaggtggagggagaaggcagcctggcgatgatgctcaacgacggagagttgtggcgagccgtgtaatacgcgatgcggcaggagacgacatgggtgagatctccttgggagagctcgtggtcctatgatgaatcgtcgagccatcaccttcgcggacctccagcacggcagcaccccctccattccccaaccatgcaggctgccgcaaggccccttcacaacgcctcctgccccaagctagctgattgctcttctcctctccctccttggatctgccctcatcgccttctgcactctagaggcctccgtcggcaccgtcttcctccgcctgctcgtggaggccaccgctgccgcctccctctatcagttctagaggctggcactggtgtcgccttcctctgcctgctcatggaggctgttgatatttcttaacgacataagtagaaaaataattcccagcaatgacgtagaaatatttatggcatacttatggttacagatatgatccgcaagcgcacggatataccattgtagcatttcacccgggagtattccaaggtatcgtatttatttaatcccaagggaagatatgataagagagtactatgctaatagtttatatattacttgtatacatcaaggtcttatgcagaggttaagcaattcaaagggtaggtgacacacataagaaagaactatgatactctcactaaaatataatctaagctaagtggaggaagaataagaaaagaattcattcctatacttcggatatacatacacatttagtctacacttgttagtatactgtcatgcaaccaataccccctaacagtgccctcctagtgtttcgagagaccatcccgggttgacgagttccttacgataacctgtcatggtcgtccaatcggagctaaatacggaggagtaccctccccaggaatttgtcttatgaatatatactaacctggaggaatacccgtactgagctgtcaccatcagcggcccacctctactgtcccgcagcatatatgcccagatagtgatacttaataatctagacaccacgtctacattattaaatattactctatatcccccgagatgacataaagcaaccgagcaattggacactaaacccacaccattgcacctctctggtaggctagctatacaactatattgatacaagtataaaatgaagtcggtactcagataatataaatggtaaaaatattgaagatgtataaagaaaaatattctattaattcaataagtcttacaaaagaagagaggaaagctactagagccataccagaattctcctgaagacccgaggactaagaatactattctgattcctactccactagcactagggtactactaaacttgggagagtgagagagctcttcttcttgagtgtgtgttgagaatgagtgaggtgatgtccatttataggctggtaatgacggttgccgatgcaaattgtcggaattaccccgcaacctccattgagggaggtatcctggatgtccacgtggagggccgaggtgaggcacctccggccgaacctgggccggcccacctggcccccagttttggcaggtggccttcttaacttctcccttatctagaaggtctattggatcatgtcaattctatgtttttggcccatttatccataagtctggatttcgacagcgtctaactgattgctcgtttattttctgtcaattcttctccatttatatgtgcttctcctgcatacatgttagtagcatagtacatagtggaagtagatattttatttggaaattatgcattgcaagcatagctagtcttcattaattgggtaatattgacggtcgaaattggtcgataacgaccatcaacagaggccaccgaaggcttcttcatgcctcatctggagggcacagtgctgccgtcagctcctccttgcctgctgtcctgttgggtgtcgagagagaggagaaggtggaaggtagaagggtatgcatatgatatgtgggaccacccgatgttataatatttttttaattgaaatattgctgactaggctgccacgtgggtaacatgtcagactaaaacctccttctcgattgagggggttatttcgctggtttgaaaacttgagggtgttaaacgtctagttttacagtttagagggataattcggagtgacacaaataatttaggagggtaattcgaactcttccttaagtaataaatagaaagaattaaaggacgtcagttcttcggctacacaacgagataaacaattatctctctcctagacaatcgaatgaatgttttaatttacatgtgcattataagaacaatccgatggtcatgatttaaattatggtatgattaatacatattgagtttctttcatttatatagaatagaaaaaacttggtaaacctaagtacccatcttccctataattcaccaactgcactcctatatacaaacctcattcatgaaatccaacgatccaaaatgaacgaatccaatggctcgcatcgtcccacggaccccctcacctccctgcaccgcacacaccccctctctcccctcctctctctctctctcacctggaaatcactcgtgcatcccacaccaaccgcgacgccccaccattgccctccctccctcaaagtgctcctggctccctcataccccttgtcgccgcatgccctccacactgccgctggcactccccaccgtgcgccgcccccggccttccctgctacaaaggcttgcccctcctctccggcatcattcatcatctccaccttagccgcccagctaccggtcatcgagcagaatgatagcttttttatgagagacacaaaagaatgggcgtttctcagttaactcaatgtacaaagcaatcatgtatagggaagtcgtttctaaaaaggacatgatttagaaactcagaatacaattttcttgtggtacttaaagagtggagtaattttagcaaaggataatttagccaaaaggaagtagaagggtagtgttaagcgttgtttttgtgattctaacgaatcaattcagcgccttttctttgattgtattttggcaagattcatgtggaatgcagtctatatatcttttggaattcacccgcctaggaatgttgctagaatgttcgggaattggcagaagggggttcggcccaagttaagggctcaaatccttgtggggatgggaactttgtgttgggtggtttggttatgccggaatgatgtagtctttgatggctccaatactaatttttttgttgcaggtgattttcaggggggccttttggacaagacaatggtctttcctacttaaggaggaagatggccaaaaagtgagagaaggttgcttgatgctggagaagagagtttttggcttttctgcaatgaagggattgaacttaagaaaaagattaggatattaatactatcttgttttcttatgtggtacggttgaaactttgtattaactttttaagaattgttgtttctagagactaagtggttgaaactttgtattaactttttaagaattgttgtttctagagcctaagtgctcgggtctagttgcttcagatggtgttaaaccttttgtaagggtgtgagtctatatactctttgtatgtttcgttgagactgtgtagaggccggtttaatccattataaaaaaaaaagaagccggtcgtgatctgcagccgctgggccgcgggtcgcgatctgaacagatcagtccgaccgcaatcgctgtttcttttgctgcagaacctgaaaaggtcaggatagcaccgatatgcactagattttgacctatatatacttgcctgcccttttctgctcactagggatcatgatatacgataggcatttcagaccaatacttgccactgttttaattctcttttctgtttccatgatcatcatgtcaagaggggcaaacctgacagaaaaatctcaactgaaatcatttgcgaaaccagtgcaacactgcaacgatgagagtgagaattagtctggcaaatgaaaaaaattacaaattatgggttccactcatatatatctcagtcaatcacagtagtatcttggggaatttcaactgaattctattttgcacaaccacaaacctattcacaaacatgattggtacttttgagagaaaaactggtgagaaatctatcttcttgaaagtttagctaaagagtattcttaatcaaaacactaatataagaattagatttactggacaattgagcagctgtgaatggttgtttaatgctatattaaattactaattgaattgcaatgtcaattggctgaattaattttcttctataagattggaccaatctagaagggaatacacttgcctaaacttttctgctaattgaggtataactggtaccacgcctcatatgcaatgaaatgcaaatattattagctgtatcaataggacaagcagaagaatctaagatgcaaaaaggaaatgcagtatatatctaagctgaaaaatgtttgttatttctcaactgtgtatgtatacattgaagtcatttgacttgtgctatatcatggaataaaaatatatgacagtatatctctattcatcaaggaaagactcccccgcgtcgctctcatgggggcggctcagggtggggggggggaccctagccgcccgcgccgccacaccctcttccccctcctccacctcaccgccaccggagctcgccggcggcaaagccggcggtgagccaggaatgcggcggcaaggcccatacggctcggcggaaccgccctctgcatgaggaggacggagatggccgacgatggcgcgcccggaggtggagtcggccgtttggcttggggcagctggtctggcgcccttgtggccagatctggtcccctacctgtaggccaacgcggtgggcgacatgacggagccggagtggggcagcgagtggcggcgagggaggacacgggtcccggccggcgaggcagctgcgaggcggtggtggccctcagcccggtgatggggcagccggatcaagtgccccttggccagatccgccgccctcctagccgaatgacgacggcgagctgcctaggcgaggtggggactggtgtgccctcgccagcgcagggaaggctgtgggaggccggcgacggaggacggagccgggcgacgagcgcgtgacggaggcggggggctggtgctgcgatggaggcggggggagggtgcgcccactggcggttgcgggtggcccttgtgtgcggaggcagtggcggccaccagctgcgcccaccggcgtcttggcagcgacgcagcggggcgctcatggtgccgatggctagccgagcctcgacagccggtcccatggccgcatcggccggtggtcggtgcagcagtggatggcggcggcttggcggacttgtgagcctgcctgagctatgggtggtgggctaggcttggcggctaaagggacgatgtggcggtccggcgacgttcgttgtgtggatgggttgtgtggttttggatgacgctggcgaaagcctgtgctggcctttggttggcttgacgacggcggcaccattaggtttcgttcccctctttggaggcgttgttatggcatctccctcactaccaagaacctttcccatgcatggatggtcgttcgtggacccccgcgtcgaagctctgtaagcctagcttttcggcgaggccttcgtctcctaggttcggttcttgatgtgatgagtgtccaactttcttcgttttcttctaagtgaagtcggagctgctttgttggggtgcgatgaagctaggcaacgataacacgttgtagttttcgaggggtgttggtgttagctgtgtacaagaagtggtgctctggtaacttgggctgatgttcaaagtggacaatcaatgtgttgcttgttttctgtgatgcctttggcaatgatgatgtgatagcggtggagtcggagctgctatgtcgctaggcgacaagcccggtaacgataacatttgcctcacgaagtcgaagcctttgtgtcgcttacaacaagctctttatcgatagttgttttgggctccaacatttttcctttttccacggtgttggtagcttaagttagagtgttgtggtttttgcgcagttttcccctagttaactgtgcattgtaaggtttggtctcgttttctccttaaaatgagacacattcttttttatataaaacgtcggtaacggcctgactgttcgaaaaaaaaatatgacagtacaaatatctattgcaacgaaacaatctcactatatatgcttttgaatctattgcaggtgtatatctcaacaattcaacaaggatgatataactgcttatgaaatttcttgcttcctgcatcctgtctctgatattcagttgtttattctgtcaatttttcggcaggaattatcaattcatcttagtgctttgcattgtcaaatggcaggtgtccaaaagcatctcagataaaatctttcagtcttgaatttttaatttgtttttaagagcttggccatattatgttattctcttacctttgcctgcagcgataaggaagcctatagttacttggtcttggacagcggatgatcaatgcaatagtggccagtgcagggtaatctttcaatgaatataattgctggaaacaaacaatatatttgtcaatattcgtactgttgccttagtgtctgtatgcatgtttgtacattgctaaaagaccgatgagaggataattagagggattgagaataatcagtaaatacacttctcagtttcgtgtttctcccggatagatatgggagcaagacaacaggtgatgatgagaactggaacacaagctaagctacatgttcaaggatactcaggtacctcgctctgccaacaagtatgttcaatccttgcctagaaatttcgattgataaattttgtttatttttaaataagtgctaatgatgtatgcaggtttctgatctccgtgtttcagcttactactgaaatggacaataccgttggaacgtcatgaaaagattaagtggcaagaaaagaacaagcaatggacaatctccattaattccgcatacacttggggaggccgggcgcctggccgcttgcaaaaactggtgtctgtcactggtattcagagtaaaaaacttcactttccgattgcttgatagaaaactgaaaaacttaagttcatgttaatatatgaacccttaatgacgataataagagttggatttttttttaattttctgccaaacacgcacaccactcagatcgatatggctcgattcatacttcatcttttggtaggttttcagttggtactgtttttcatgttttacatgaaatttatgtactaagctagcattccattgatcgattttactgccctggaactccttcctcataacttctatcaaaacatctcattttacaggatagattcatgcatttcgaataggaaaaggtacgaattaccccctgaactatcacggtcgaccgaattaccctcttgaaccacaaaaccggatattcttcacccccaactttgcaaaccagacaaataacccccctggcttaatccgcggtggttttgatcctacgtggtattccagtcagaattcatttataaaaaaaaaggtgggccccacctgtcagtttctctctcttttatctctttcccaatctctcactctctctctctcttctccatcagcgttccatcagaggccgcacctgtcagggccgacgctgccgccgacgtccagaccggctgccgcaccatgctcggcctcatagtcaccgggatcgccggcggtgccctcgcgcaggcggcgctcgccgaggccgccaagcccatcaagctcggccccccgccaccgccctccggtgaaggagaggttctacctgcagccgctgccgccggtgggaggcggcggcgagggcgaaggaggtgaggtggcagcgggcgcgagcagctggcggcgcacgatgagccgaggtcggcagctagcgggcatgggcggcgagcgggagcggaggcagctgcaggtggcgggtgaggaaccgacgacggcagccgggcgggcggaggcgggcgtggcggcgggcgaggagccgaggacagcagcagggatggctacgagcggcaggcgggcaaggagtggacgccgacgggcggccggtggtgggcgaggcaagcggctcttctacggtcacgccgccgtgaggcgcctaccaatcccggacgccaatgacgagcacgtcggactccgtcgatgacgacgacgagaagctctgcctgggggagtggtgctcgttgcggttgtacctctacttgacactggcgacggtgcccacggcgagcatgaggtctagctccgccgcttcctgtcacaccctgaagttcttctcccaagcctaaattaattaataaatggtctcaacaaattatctgtgtattggcaagagagaaaccctattttaataaatgcaaataataatcagaaatggcacgtgcaatttttcttgggttctacatgtcataatatgctaacaagatttttagagctctataaataattttaaccaatttaaaatgagcacaagcaattattaaatccctggaaatcccttttttcctttttttttctttttcccctttttccttcgaatgggccatcggcccattctcctctccccacccctccccgcgcgctagctgggccggcccgaggccgaggcccagcgagcggccaccgcgccccctctctccgggccactgacaggtggggcccacctgtcgggcccaacccctacctgcggccggcgccgcctcgcgccgctgccgcccgcctctcccgcgcctcccgtgccatgtcgcccacttctcgcactcgccccgcacgtcccgcaaccgccaccccctctcccgcccgcacgcccgcgccgagatggccgggattcaatttttgaatcccgcctttctctccaacccacctcccccacgtcgccggccgattcgcgcccctcccggccacgtctctccccctcgcgcctatataaagcacccctgtcccctcctccacctttttcctgttcttgccgagctctcccgtgtactccaccgccctagcgccgcgcaccacccaccgccaccactttagcaacctccggccgccgctcgccgccgttagagccgccaagcctcgccgtcgcctctgtcggctccgcaagcccacaggccacgtcgtccactccttccccgtcgaaatatgccaccgggagccgtcctccgtcgcgcgccggtgaacccctccattgccgctgccttcggccgtcgttcccgccccttttcgcaccatctcgccctttctaaattggcccattttgttccctaggtttccccggagcccgtcccgccgtcgccgtcgccttccaccactcgccgtcatcgatcgtcgtcagtgaggcccctcccccttttcccctctctctcccgcgccgcctagcattgccgcttagccgcctagccgccaacgctagcgccgcgcccggccgcgtgccgcctccgccgtcggatctaccctcagatagatcggggccgtccgttaccgcccgcgtggcaagcccacgtggccgccacgtcggcgccacgtgtgcgccacgtggcgatcccctctcccgataccgtggactcggtccaccgtggaccggcgtccccgagccgatgacatgtggggcccgcatgtaggcgcccccttgtgctgacatcgctagggttaattattgcgcaataaatcaattaatgttttcctttttatagtaaaagcacagtgaatcttctaaaattcatagaaaattcatccgtgctctgtttaagcccattcaagtatcagtaagtcaagaaaaatgcaaataatccattaaaaatggttttgttctttgtttcagttgtcttttagcctatttgcattgtttgctttgtatgtcgcatagattccagctctcccgacgctccggtgtacttcgagatagtcgtcgaagttcctccggccatagagcaaggcaagtcatgcttgtcacttgaacatattgatcccatattgcaaatgctttttaaatattgcattgttttataatgctaccatgggatgtctacctactggatcgcttagccatgcttagatcaactagtacacaatgggggaattacattaatgcatagacttaagattctagtattgatgttggattagtgccaccgctttggtgttggttaattaaaatatattaaatggtgggctgtgggtacatggttctgttggtcgcgcccatggcaattaaggaccggttcgcgggaaaccctggaagaattcctcgtacttaccacaagccagcatgggcaactgctgggcttgtagtgtagctttcctctagctgacgcatccaggcaagggtgggcgtgatggagcgggatgggccctgcgacagcctttgtcgcttccagattcacctaggcacaagaggggactgcccgctgccttgcgaggagtgggggtgaaacctgaggtgtggtgtgcttggttagagggggttatctgaagggtcctatcacggcctctttccagtatgtcatagtggcatgtcagtgcacgggaacgtgtcgtggggctgtgtcttgtgggtacagttgtacacctctgatcagagtaaaactattcgaatagccgtgcctgtggttatgggcggtcaaccagattcatcatgattagtctcacctctagcttagcttaatggaactgattagttcagttgatggtttgggcctgtctcaacgtggtgtagcgttgagcagtgattggtttaatactggttaattactataactgttttactactttcaactactgtttataaatgctagctttacgcaaatgaaccccctttagcctcctttgattatatcctgcatcataccctccgttctggtatgacttgctgagtacagtgggtagtactgagtcttgctctatctcccaaccctcagagttcaagtacgcttccgatggtggtttctccgaggagtaggcttcgtctgtgctgtcgaggatgcctgtggagtggtgttcccgctgcaatccaagtcaaggcttagctccagttatcttttaattttcgctgcatttatgtaagacttttataatgtttgtaagacgtggatctgtatgtcaactttatcgtttgtgtacactggccggacctagacaggggttttaatgcacgtttttcttgaaattctattcgggaatttcagggcgtgacaccgcctcctcctcgtcgtcgatgtcctccgcgaactcctcctcggggctctgtgtgtacttgaccgccggcacgagacacgggccacgggcagaccgcgagccacgggccgctgcttccggcgatgccgcctcgcctcgcgcctccgccccgtccacccccgtgcaccgccgcccaccgcccccaggcaccgccgccctccacccgtccgccgccgctcgccgccagccgtgcccgccgcccacatcctcccctgcaccgccccatgaccatgagagagagagagagtgaagagagaggaagaggggaagggcacgtggtttccacattttttaaaaatagaaaatgctgactgggttgccacatgtatgccacgtaggacaaaaccgctcagaattggatcgagaggggtaagtcgtctggtattgaaagttcagggtgaacaatatctggttttcgggttcaggggtgtaattcagtcgaccgcgatagttcaggggggtaattcgtacttttttctttcgaatatgtacaagtcatagatccatgtaaatataaatgtcaattttcatgttgcaggggtggctcatcaccagttgcattagattttatgttgtacataacactctaaaatgatggatccttttctttgtgatgctgatcagggatagcttagatcagagggagggaagcatgaggagaatgctttcatggcttcggcagctgtttggagtagtgcaattcttctctcaccgcacgacgacaatactcctgtttgaaatacatgaatttattaagggcatcaataattatatggtttcaaaagataaaaaagttgcagtgttatgttagacgcgtggctatgtaattaacaatataattattctatattcttttttcatcaatcttaaatatatcttataattcttgattgtaaatcatgtattttttttatttggtttaacactaaatactaaatattgtcgtagcgttagcacggatatattactagtatttagaagtacaagatttatctaagtagtactccctccgtcaaaaaaaaaaactcaatttctagaatttgaattttgtaaaaaaaaataaacttctaccatcctacctacccttagcacataaaacgagaagttttatcccttaaatattctttacctacctatcaccattactatattttctaataagggtcattttagttatttttacttctcattaaatttgtattaggatgctaggaatgctctttttatgggacggagggagtacatcatagactgcgttcggcaagaggagctgggaacccactctctctttttccatgcgccatgctttttaaactattaaatggtgtattttttgaaaaaaaattctatatgaaagttgctccaaaaatcatatggatctatttttaaaaacaaattagccaatacttaattaagcatgcgctaatgaaccgttccgttttctgtgcgggagggattaagttctcatccttactaccgaaagcaacctaaagaacttggccgtgttcattgcgggaggttcacaaccggaaccggaataatacacacgaaaaacggaacggtccatcagtgcatgattaattaagtattagcttttttttaaaatatggatcaatatgattttttaaataactttttacagaaatttttaaaaatgtatcatttagtagtttaaaaaaatgcacgtggaaaaagagaggaggggagttgggaacaggggaaaccaacgcagcattaggaaaccgggtagtaagaccctatttagatgggactaaaacttttaagtccctatcacatcggatgtttagacactaattataaatattaaacatagactattaataaaacccatccataatcttggactaattcgcgagacgaatctattaagtctaattaatccatgattagtctatgtgatgctacagtaaatattctctaattatggattaattacgcttaaaaatttgtctcgcaaattagctttcatttatgtaattagttttgtaagtagtttatatttaatactctaaattagtatctaaatacatagacattagtatcaaatacatagactaaagttaagtcactcgatccaaacaccacctaagcctctagctgaccagcagcaataaaacagcaataaaggtcgatgattgccgagcctgtcccttgtttcaaaatataaaagaaattttatttaaattggagtgcaatacaagcatttatgtaatgatggtacacaatacaagcatttatatgcactaattgccttgattcccaccacttcgatgattccagagcaaatcagattcttctcaagaaaatcaattcaaaaattaacaactgaagtaaaaaaaaaacagatttgaaggaagagatgtctcactaactttttttaagaaaaaattataaacgtattggaattgaatataggtccatggagttgaaacccacaccccttgtcactacactaaatgcatctcacaactgaagtgactaaaaacatttttttaacgtgctaaacaacttagatgtctatgggttcacttatgcgtatgcttatcaagcaaatgctataaaataaatcatgataagaaacacaaaatcaatatcaaaattcaatttaaaaatcaaattttggctataaaataactcacaatgagaaatcataaatcaacataaaatttaaattttgtttttcaagtataagcatcagtggaatgctgggaccgttagaaatttttatttatattatttttttggaaaagagagtaggatattgtgcctagcacttatctattactttatgtgggacccacttttatgggacctaaatatcagtgatggtggtggtgaggcagactcaccaccgccagatggaacatttacggcctcatattttcgcttatgcatgtgctaatcagccaaaatttaaattttcaactttaaaattgatgccgaatttaaggtttttccatcaaaatttattttttaccctttgcttttagatcactaaaaacacatatataaaagttttattcacaaattacttttcgtttgcaaatataacgtttggcttcttacacgaataagcgaatcgataaggctattaaagaagtaaagatgtagtatattacttcctcctccatccgtccaaaataagttgcttttgtacataaatttaatttagacctagcatatgttcaaattcgagtattttttttgaacgactcgcacgagacggtgtgaagttctattgatagagtaggaaaaaattacaagattacaatcctgaagggtcataaccaggagaaagaaaaaaatataccaccacccacacaccggtagcgccaacacacacgaccaggagaaggttagcaccggaccggccaccgctagaccaacaaaggaacacagacgagatcaccctacaacaaggggatgccaaaacgacgtcttcaagaaaaaaagtgacggaaaaccgccgccgccgtccatcagggctcaaaggagccaagactgggctttcgcccggcaatcacccttgaggggtgagacagcacgacaacgccctcaggagggggaattaaccatcgttgtcggtccggccaagaccgggctaggttttcacccgccactcaccacctgcgaatctacggctgatgcaccgatgctccaccaccactcaaactctgccgacatatggggcccctgcaccgacgcccccccgccggccaaccttcgtgcgtcgaagaccgcgccacacccaccggcagctccaccacgcaccgaggtcgcctcttccaccgc

SEQ ID NO: 45988 - DNA, 19841 bp, Oryza sativa
  unsure (1)..(19841): unsure at all n locations
ccgttgccaagctctccgctgccgtcgcgaccaccaccagctgccgcgaccgcccccagccgcctaggcgaggctgtggatctggccgccgatgccagtctcgccgccagatccggcctccgtcgccagcctcgccgctatctccaaccccgccgccgacgcccccaacaagagaagcagcatgccgccagcacgcatgccatccccgtcgccgtcgccgtctcccccgccaccgtcgtcgccttccccggcgccagccgccaccaactgccgccgccaccccgccaccttcaacccccaccgccaccaccaccaaatgccgccgccacctcacactgacccgccgccggcggcctctcctccagatccggccgcggcggcccggatctgggcggtcttcgccgtcccgcacgcggtcgccgtcccgcacgcggccccccaccgcgacgggagagggagacaaagacgagggtgaagccccggcaccgccgtccttgcggccgcgcggctttgccggcagccgctcgggcgatggcgaggcggcggagggaggaggggggaggagcgggcgatgccggtggtttccgcctcccgtgtcgcccgtggggaggacgacgcgggggcttgactcatacactgaataaattcgagtataaaagtgaacttattttaggatggatataacactaagttattgagtggtgtacttattttctgttctaagctacaacttcattgtttttgcttaacacgaagtttctttaaaagtcaaataaatctatttatcatgttctcaataattgataattaattaataatgtgctaacggtttaacttgtttaacgtgcttaaaaaaatccaagtgatgcctctgtcccaacgcctgtgtttaattcgaacccacgaaataataaaaaaaatatagtattctatttatcctgaaatatactactacactgttccataaaaagataaacactagctacgaatctctacacacatatgtctaaattcgtagctaggatcgaactttttttacggagggtactacctcagtaaaaaaaattaagatgggacctaacctggtactgatgtttttcagagaacataattctagaacggacatctaggggtgggcgttcggtggggaccgaacattcggtccggtctattcggtcttttaaaagttcggactttcaaatgcacaaactgaatttatccccagagaaatagagaccggagatttggttaaccgaaagttcggtttcggtcttggggcaaaccgaaggcaaaagagacgtgagtaggcaggcttcgtctccaacaatggcaggcaactggtagtgtcaaaacaaagatttcggtaatacttaaaaggggtggctatcaagctaaaaaagtggatgggtttaaagacaaggaattttatacatgtttaggccttcttattcaagaagtaataccctactcctgtccggggatgattccgccgagtgtattattgatcgtatgatctggggaaaaaaggtcgtcccgagaggagcccggacccctccttatataggggaaggggtccgtattacaaaatacagtccatattcctaatggaatatgtgattacagataaaatacaatcgtaaccgactaggatctcgggtatttccttgacatacaagttagaaactaacccgagtcctcgtaaagatattctatctatatttggtaccatgtatccaactaaactataactgccgtgtagatatgggatatccatatctccacagtagcccccgagaccattgcagtcgacgaaatagctttcttagaagaaaaagcaataatccgagtgcttcaattcttcctgctctggcctgccgagcactaaaatcaaagactgtgaagggcgaaaataaaacatggtgcatcgagaagatgcacctaataggtgtagcccccaactatatggttagttaaaaaaactaaacatgtagttaagaaccaagtggttttacaaccaaacgtcatataacaaagcacgcatggtattcagtaaaatacccagccgactgcttctcagctttaatatatcaagaataaaaattatgaaaaggcccgagtgacaaacactcaaaaggtccacaaaaatacatgtttgactagaatccgagtatgaaactcttaaaatgatccaccaaatatgataaaaatcatggtaattaagaagtttaatagcctagactataactcttaccataatcaaaataagcatataacatgccaagaaaatgactcttaataaactagtcatctcgaatcaacccaaacagcttttgcagcctaataaagcttgcaaaaatagtataacacctttctgtcgggcacctttttatttgcatcgtggtaattccaaagaattatcaaactgcgttaaaaatgattttaacagcatcgggtcacatcattgtgagcacatattgccaaagcaaaacgcgcctaagtccctagggatcaacgggccacgctggtaataatattgggctaaagtactgtacaggcctaggcccattagcactcccgataccctaacaaaacacagaagtccaagcgacacttcgtcttccccgccgaaactctcgccatttccccactccttgctacagtacaaagctgcgccgacgaagctagggttcatcaatccgccccaatccgttctcagaaatccacgaaacttctccacgcgcctaccgcaccgattccccattcctctccagctatttctcggaccaaatcagatcattcgactcgcatccatggcggaagagagagaaagtttcgagagtcagtgggcgccctctgacgtgacggaggagaatctgaaggaaatggtggcgcacggcgttcttccggcgaaggagatcatcgggtggcgaccggcattcggcgaagcattcccaaccccggatacacacgaggtcgtggtattttctcacttcttttatggtggattttctcttccaacttcaagattcttccgtggaattctgagcttctatggaattagcctgcatcacctgaatccaaactccatagtgcacattgccaatttcattcatgcctgcgaagcttttttgggcatcaggcctcatttcgccttattccgccgaatcttcttcctcaaaccccaaccgaacaggagcaaacaatgcgtggttgggcgctggcttccaactcagaggaacactaagccaaaagtatttctccatgcccttcaagacctcaaacaaaggctggcatgcaaactggttttacgttcaaaatcctgaacccgcactctccgagtactcctgtcttcctccagtttaccaggacacatggaattcattgcctatgggagatgaagctgctcagacggtggaattgatggaacgcatgctaaagctgaaggaacaaggtttgcagggagaacaaatcactcgacacttcatcaaaagtcggttagccccaattaaagagagatcccgcacggcttttgaatttgacggcaaacatgatccaaatcgggaagacccagattcccttgactttaaggtcatgaaagaaagaatgtacaagatcttctcaaatgctattgtcatcagctattcacatctgttgccagtcatgccattcaatgcattcaaccctcctccaccggtatgtactaaaacacttcaaccttcctcaaaatatgatctcgtctttttgttaaatcaattgacagtggaagatattatgtctaggaatttgctctgatgaagtcggatcccccaatcgctcagcgccgatcacctcgccgtcaaactggtcaggggagcgggggaccaaagatccggtccgaagcccagcccaacacctctaatccagccggccagtcagattcccataagaggaagttagtgctgagtgacgacgaaggcgacgacgctgaaaagcctggagatagagaaacaaccagaaaactaccgaagcaggctattccaaagaagaaaacatctagtcgtcctacgccaaagatcaggaagtcttccaggtacaaatcatataatgatcttccttgtattgatgcacacccagcatggaaataatactgataacaaaaacttgtaggaaaccatctgatatagatccttctagaaaggactctgattcggctaatatggaaacaagttcttccaaagaaactgggccgactaccgtggatcacccgagtgacaatcagccggcaaccgataatgtagaaatcggtgatcaacccccgactagaaaccaatcggccgaagctgaagccggagctaatcaggagcccccgactggaaaccagtcggacacagggccaagccaagagattccaaaagttggagcccaagcagacagccctcgcggtcaagacgctagcagtggaccgaaggtctggatctccttcaaaggcatctgagtccacttgtcctcatccagaaatcatcacgggtaaacactttgcctgaaaccacgttgatctaactgactctatttgattgtttgaccgttatccatggatgcattaggaccaatgattggtgatgaagaggaaattctccggatacaagcggccgaagattcacgccctcccattctggtcaagtggtaggatgacgacttgcaaccccaaggaattgtgataaaccggcgaaaaaagacgaagaggtatgcctactggaaaaggcactcggctaggcgactcgcattgtaaatgtaagttctttgacgcctgacctcaaccatcttgttcgccatttagctcgagcgctaataaaattgttttgcagaggattcaccttaggaatgaagtgaaaaccacaaccctagagaaattagttcctcatcttggaacccttgaagccgtcagagatcaactgcacgaggcaaaagagcttgccaagaaagctgagcacggtctaagagatcggattgcccagctccaggagtctaacttcgaactgagtggctcgtcaaaaggtatacacaaaatctgtctaactaacttgcactgtcatctttgtaacttcaattaatcggagtcaatgtagtgcaagccgccaagatatctcaattggagaaacgaattcagactctggaaaacgataaagcagagctggcgagtcagagggactcagctttaaaggacgttgaaggtaccatcaattgatactccaaaagccattgccttctgtatgctgactcgttaatataaatctgttgatgcagactgcaagatcaagtcgcaagcccaattcgacgtcctggtcggcaaaatcaaaagacttgaaggggccgactgtgataacgacgcaacccttgcaagtatcgggccgactgaattaaggctgcttcgcgggcctcttccagccggtgtaggtcatccactaggtcgtctccgtagcgctcttcgcgaaaattgcgaaaacgcaaagattcaaattctacttcactaggcaacattgcttccgctccataaactaggaagaatggcaactggcccgtagcccgactgggggtggtgcgcaaggaccaaagtacatatggcagctattccacccatttgccggcacagggattcagttggtcaaaaactcgtgcatttattccttggagtaccatgccattggctcgttcaacctgcccatagctcataggatgcgctacggaggcatagcaaattttgatgccgaagtcttcacaaaaatctttaaatactccgccagtgaattgagtgccattatcagtaataatccaacaaggtaccccaaaacgatacacaatgttgatgaaaaaaatctctagctttgtccgtcgtgatcgtgatgaccggtttagcttcaatccgcttggagaatttgtcgatagccacaaaaagatgtgtgtaaccgccgactgcctttttgaacgggccgaccatgtcaagcccccaaaccgcgaatggccaagacaacgggatggtttgcaactcctgagccggtagatgagtttgtcgggcgaaaaattgacaaccctcacatgttcgcacaattttgtcggcgtcggacacaactgtgggccagaaaaaaccctgccgataagccttgccaacgatggttcatgcagcagcgtgattactacaaatgcctgaatgtatgacctttcgcaattgccttccctcctccaaagacacacagcgttgcagaattcccgatggacttttcttgtacagctcggtctcatgaataatataaagcctgctacgcctggaaatccgctcagcttcgtctttatcttgagggagttcttgggaggtcagaaatcgtataaggggctctctccagtcggtttcgaccatagctatgtcttgagtgcccgcggcttcagctgtttctctcttgggtacggttggctcatagagatgttcgacgaacacatcagaaggggccgcttcgcgtttggatccaaaattcgctagtctgtcggctgcttcattattgtgccgaagaacgtgagtaagttcgagtccatcgaacttatcttccaacttttgtacctcctgtcgataagcaatcatattgtcgtcgaggcaggaccactctttcataacttggttaacaactaactgtgaatctccgcgaactgtcagacgcctgattcccaaagagattgcgatccgtagcccgtgaaggagcgcctcatattctgccactttgtgagatgcgaaaaaatgtatccacagcacatagctcagtctttatccagttggggaaattaaaacaactccggccccagtgcctgaaagtctctttgacccgtcaaaatgcatagtccaatactccatcttttcctctgacgtgtcctcttggcactcgatccactcggcgacaaagtcggctaaagcttgggatttgatcgaagttcgcgacttgaacgatatatccaaggacatcagttctaaggcccattttgcgattcgcccgtttgcttcgcgattatggagtatatcgccgagtggaaacgatgtaaccaccgtgactgagtggccttggaagtagtgggataatttcctgacggtgattagaacaccgtacaacagcttctaaacctgaggatatctcgtcttggagtcggccaaaacctcactaacgaagtagatcgatcgttggactttctaaacatggccttcttcctcacgctcgacaaccaggaccacgctcacaacctgagaggtagccgatacgtatagtaataacggctcttgtgggtgtggtgaggccaaaactggtagagtagtgagaagtttcttgaaatcttcaaaggctttctgtgcttcgggtccccactggaaattgtctgttttctttaacagtttgaagaagggcatcccccgctcgccgagtcgtgaaacaaaccggctgagcgccgccatgcatccggtcagtttttgaatgtctttttgggaactcggcggcttcatgttgaggatggcgttgactttctccgggttggcctgtatgcctctgtgagacaccataaatccaagcagattccctgacggtactccgaaggtgcattttttagggtttagtttcatcctgaaagcgcggatgctcgcaaaggtttcttccagatccgtaatcaaatcatccttctgcttggtcttgacgaccacatcatccacataggcttcaacattgcgaccaatttgagtcgagaaacatctctggatcatgcgttgataagttgctcccgcgttcttcaatccgataggcatggtgatatagcaataggctccaaagggcgtgatgaacgaagtcttcaagcagtcggattccttcaatcggatctgatgatatcccgagtagcaatccaaaaaactgagcagctcgcagccggcggtcgagtcgactacctggtcaatgcgaggcagcccgaaaggatctttggggcaggacttgttgaggtcggtgtaatcgaaacacatgcaccattgcccagtctttttccgaactaggacggggttagccagccagtcgggatgaaggacttctttgatgaagcctactgctaacagcttggtcaattcctccttgattacgtccttcctgtcttgtgcaaagcgacggagtcgttgtttgatgggtttagcgtcttccttaacgtgcaaagagtgctcaatcacctctctaggaataccaggcatatcagatggtttccacgcaaagatatctttattgttttgaagaaaggtgatgagcgcgctttcctatttacaatctaactcggcgcctattatagcagttttagtaggatcagaaggatctagggaattttcttggtcttggcttcgctttctccactctttgagatcttggccataggcacttctccttcgcttgtcgtggttgcagccagtcggatgtcttctcgagcaatcgcgatctcgcgggtttgagccatctcgcaactttccttgtcacatgtgacggcttgcttgatgtcgctccgtagggatatgactccccgaggaccaggcatcttcatcatcatgtaggtgtagtgcgggacggccatgaatttggctaacgccgggcgtccgagtatggcgtgatacgctgtctcgaaatcagcgacttcgaagcagatgttctctgtgcggaagttctcccgagtaccaaaagtgaccggaagagtgatctggccgagtggtgttgccgatagccctgggatgactccgtggaagggtgcattactcggctttaactcggtgcgcgggatctgcatgtcatccagggttttggcgaagaggatattgagtgcgctgccaccatcgatgagagatctgcgaagcttgacgttgcgaaccactgggtctagtaccagggggtaccgccccgggtggaccactcggtcaggatgatccgagtggtcaaacttgattgttatctccgaccaccgaagatattggggcatatcgggctgaacagcattgatctccctttcagtcagattttgctttcttttagattcgtaagctagagggccgccaaagatatggttgagctccttgcggtgatcttgaaaatctgtcggggcgtcatcatcatcatccttctttttcgacgtgctttgttctccgtcaggggtcttccgtgcattcttggcatattgctctgcaaactgcttgtagacgaagcaatctttagctacgtggttggagttgggatgatgcggacattgggagttcatgatcttgtcaaaagtgttgacgcgcgaacgttgtcaggaggagtgtgtagtagtcgcgatgagttcctcgggcttacgcttgcggtccttgtgattgttacttccaccccctcccgtagtcggcgcgtctttctttggcttccaagtaggacccgactgcttggatgcgataatggcgtcttcggctttggcatactcgttggttttttcaaacatctgtttgactgtcttgggaggcttgcgcccgaacttgccgactagatcttcgtggcgaattcctttggtgaaagcggcgatgatgacgtcgtcggtaatgttggagatcttgttgcgctgttcagagaagcgtcggatgtaatctcgaagggattctccaaacttatgaatgacgttgtagagatcaaactgtgtgccggggcgttcaaaggtgacctggaagttggcgatgaagtggtcatgaagttctgtccatgatccaatcatgccacggggtaatccatggagccaggaccgggcagaatcagctagggccacaggtaagtagtttgccatggtcttgctgtctcctcctgctgcacggattgcgagaccgtagacggtaagccaagactccagattagtggtgccgtcatacttctcgattccagtcggcttgaagccggctggccaatccactcgacgcaggtcattagtaaaggcagctactccatccatgtcgtcgtcgtagcgatctggtgaatggcggtgacctcgtgctgcacggcgctggttaatcttatcgcgaagatcgacaggacactggcaaggtggggagcaaggccgttcaactcggcgctccctgtgtcgctcaggaggtgagtgaacagatcgctcgtcgtggcccctgctcctgcgattggatcctatgccggcgatgctgaggcttggctggtggtaatcatgagatcggagatggggagcccggctgccagtcggcgtgcggatgcttccgaagttaaccgggaccgaagcggcgatcatggtcttggtctggttcaagatgttgacgacgtgatcagcttgattgagtgcgtcttccttgaggagggtgtcgagaagggtgatcgcagcgacagcgttctgttgaggggtgcgaaagaccgctgtcccctcgacgtcttgctgcccgatgagatctcgcgctcgtcgccctgcgtccaaggctcgttgtcgtcggtcctcggcctcctttgcagcccgttcgcgttcttgttgctctcgccgcagccgttcttgctcttgtgcttggcgctcctcttccagtcggcgtcactcggcttcctgctgtacgcgtcgtgcctctgtttctcgggcttggcattgttcttccgtctcgttgtcggccatgaagacgccgaagtagagaggggtgtaattgtcttcaaagctttcgtcgaagtcgtcgaggtcgcagctgtcgtagcggtagccgaattcgtcgtactccacgatctctgttggtcgtgagtcgatgccgggggagctgaggtagccttccagttgatccgtcgaaatcgtgccgagtggctggagtatgatgccgacttccctggagctaggcatgatcggtgttgaagccaacttccgcctaggcctacggggagaagacgcccttgtagtgaagactgcagccaaatcgtcggggagtttcatcatgattggcgggtaggccccatcatcttgatctggtggtgtcggagtagatgggatctcgtccaagtggtttgaagccgactcgagcgagataagcttggagtagatcttggccgagttcggaataccgaacggggctgagacctggttctttcccgactggtttggatctgagtcgaggagagagatcttaccgaagtcgttggtgatgaagttgaggctgccgaaccgaaacgcctgcccgggagggaagacgaagttgtcgatgccggagacggaacccatcgcactgatcggcgagaaacttgacgcaacccctacctggcgcgccaactgtcaaaacaagatttcggcaatacttaaagggggtggctatcaagctagaaaagtggatgggtttgaagataaggaattttatacaggttcaggccttcttattcaagaagtaataccctactcctgtccggggatgattccgccgagtgtattattgatcgtatgatctggggaaaaaaggtcgtcccgagaggagcccggacccctccttatataggggaaggggtccgtattacaaaatacagtccatatccctaatggaatatgtgattacagataaaatataatcgtaaccgactaggatctcgggtattttcttgacatataagttagaaactaacccgagtcctcataaagatattctatctatatctagtaccatgtatccaactaaactataactgccgtctagatatggaatatccataatccccacatgtagcaagcgacagcgcggcgatgcccgacgcagcccctcgtgcggagccgagatggaggtgtggatgtgtagcgtggacggcagccagggagaagtggaggcaagccgcaagcaggccgaggtcggcggcgcggcgtggcgcgaaggaggcaggcggcgccacggcggcgcgtcgcacgtggcgcgaaggaggcaggcggcggcgcgacgcggaggaagggctggcccctccggtggccgggacgaggtcccgtgcgagtcgaggctggggagcatgtgccgtcgtcgtcgaggagttgccgagttgaggataactgaataagatcgagactcccctttttcctttcttttgttcacccggacatgtggtggggaactggagattagtcatgtgggcccaatcgaaatggacggtgggctactagggcagccaatgggctggaggcctggagcaacatggaagttgatactttcggtcttcggtttcttcaatttgtagccggtactgagagcaagtacagtaagtcacctataacgatatatcaagaagaaaaaaagaaagagaagtaagtgggctataaatttaattgccagtaacaacacggacttcaacacgttgtatgtatgaggtgggaccggatattaattgtgtaggatatttgtgtaaataactattgtatgaataggctattagattagttatagatgatttggagctaacatttggctatactattaaacttgctctaaccgaaccggtctctcccatcgtgcaaccgagcaaacgaccgaagaccgctactttggttttttcggtttcggtgtcgattttttaggtacggtattcggttctcggtttttatgctcacccctaatcgtacgtacgctaaccgctgctagagcatcaccaacacatcttaaaattttattcccaaatttttagttatggggatgcaaaaacataatttgaggtgttaaaaattttctcactccaagagattaggtaaaattggtttcctaaaaattaaaagggtgggccacgataaaacctccacgaaaaaaaatatgttttgcgctccttcctcccgtcagatcacgtgtgcatctcttccccgcacgtgaagcgccgtgattaggagccaaaacaagacaacacatggatatattccgacgaaaaaaaaatttagcttattatttaattttttttaaatgttgcacgatgttacaccaggtatatcgaaattgtttcactaagtagatcgaaaatgtttcactcgtttaaatcaggtgttgtttcaccttataaaaaaacaatgtttcagcaaatagcgaaagaatgtttcagttcactgcaacatttgatccatacatagtgaaacattgtgtacactaggtgaaacattttttttgtggaacaaaaaataaaccaaattcccttaatagggggtttccaaaatatgtgagttttttttttgcaatggaatatttcgttcactacaacattagatttatacatagtgaaacattgtgagtacactaggtgtaacatttttatggaacaaaaaataaaccaaattcccttaatagagagtttccaaaatatgtgagtttttttgttgcaaaagaatattttaattcactgcaacattagaaatagtgaaacattataagtaaattaggtgaaacatcttttgtagaaaaatgagagaggaaagtgggtgggccgaggtacacacgtggggatggttgtggaaaaatgggagagggtagtaggtgggccgaggtacacacgtggggaggggcgcgggggagcgtccgatctggctcccccgcgccggtcacccggctacaagtattttcggaattttgggaatgagattagatttggctcccatcggttgccattttacccaaaatggcttatttggcttattagaaaattaaaattaatttataagtaaaacttttgtagatttgttcgtagcgacttaaaagccaacattaacaaaaattacgttaaaagcatttcaaaatcaacttcaaaatcaagttcaaaaattcaaattttggcttattctttggctgtttaggccaaacgatggggctatctgataagatcaatttttttcaaaaaatatcttcagattattggatagagaataataaaccgattctgttgcactgttggtgatgctctgaatccccgccccgagtcctccttgactatccaaaagcaccgcccgccgccgtcgccgngacgccgcctagaaaaaatggacgcgctcgtggtgcggcggctcggggaccccacgctggcccccggcggcgaggcctccccgttcgcgccggtcaccggggaccacccggcgccggcgctcgcgtcgccgacgtccgtgcgggtgcgcgtggcggccaccagcctcaacttcgccacctacctgcaggtacagggcaagtaccaggagcgccccgcgctaccgttcgtcccgggctccgactacgcggggttcgtcgacgccgtcggccccgccgtgcggaggttccgccccggggaccgcgtctgcggcctcgccgccgtcggctccttcgcggatctcatcgtcgccgacgagaagcagctgtgagttcggtttttcgcctctcgctgcctcgtatggtgatctccgtttggaagattagcttactccaagtggctctctctttggaaatccccatttttgggttaatttatcagtacatgccttaattagtgggatacagcatcacgagttatatttggttttctctttcaattgtcggatgcattttcttgtatgtagtcgattagttgttgaagcatttctacatcggcttatatctgttcgctcttctcatgtccgatcgtagagttaaactttctgctagttcggtaggtgctatgcagattttatagcttatgagaagggttgtttgcttttgggagtaaatgtttctttttaaaaactatttattctatgatatgtctaaatatggggatgtgggagtgggagagactatgctggttttcgatgaaaaagatgagaatgttgctgtctgtctctctatagatagttaagccttgatcccctaataaagaggtggaatctttcaattgtcgggatgccttaaaaaaggcgatgttaatgttgtagtgaggactggattgtattttgttttgttatttcagcttgatttcactagcaaacaaagcgcacagtatgtctcctgtttgtttatcttagcaatatgcaatgtataaatcaactaatacaatagctgcacttgtggtggttgcagttgcagagtaaaacagttagcactgttgtgaaataaaataaaggaagcaaatgttggttagatacttgtatatatgtgaatttctgaatttttgtatatgaggggctatctgtagttaccagaatttttttgtaagtataacatgcattttaaatcgttggatcagaatcataatcagacaggcgcacatctcaaagctaatgctttgtgcaggtctgcaggaaaaaaatgaattgtacttggccaataatcagggaacttacacaatagagaaacatcttatttattctggtatgttctattgaatcagtgctatgttctttcgaatcagattttcggtgcctgatggatgtgaccttgttgctgctggagcattgcctgttgcatttggtacatcgcatttggcccttgtacacagagctgaactaaaggctggccaggtgcacccctgtgttaatctctttgtttataaaatgcctataagatatccatttggtacttgtgcattgttcatgttattgttatggacattcatcatggatacggcacaaatctcctttggaatggccatccacattctcggagcactgcattgagtaaatcagcatctctctgctgctgctccacatctctatatccataattactgttagtgtgttaagttatgtggcagtggcatcagtgtcttaccttcgtttgtgacatatcatgtacacacaatattatgagctagaccgcattacctcaaatggctcattttgatggccattattggtcaaacataggccttgtattttatatttatgaaatttattatgtcaattttctatataacttaaattctacagtttctatcatagaggtgaacttctgcaacagtacccaaacatccacaccgttctgataaggtcaaaatgttatggatgcttattcgtggataaggaagggtccacagattgggataaaggtccacagataggataccacttaactattccctatccttgaaaactaaaatcatctaggggcatatttctaatgctacagtgtacaggcactgttcatctgcagtaccgttaccatagcaccattttgttggtgtctccaattaaaacccttccatttaggacccaccatctgatgatctgatacaggggttttgattattttattctcacattaatgaaatctgtcagtactgttctgttttttaatggtactgtagcagtaggactagggaagcatttgccttccaaaataagaatatctatactatattgattaattaattagcttcctggcatagagaataattgtttgtatcctatctatttgagatatggtttattccgaaggtcaggattctaagcttgtttggttggtgacctgggcgtcatgcctgagaaaaatatgtgcctgagtgttgcatgaggtgggagtggttcatgcctgagagaaacttgtttggttggtgacctgtgcctgagaacacttaaaactaatattatctggcatttttctctttttaagcttggagtttaatcataaatccaatatagatacttaagagatttaacaaatatttttttttacatagtctcataacatatctttagctaatcaagtggagagcagttcagcacgtttgccaatcacaagatagtgcatgcaaaagaaagcaaccagctgcagcgtgagagaattactttaattcagcagttagtagagaagtacttcggctaatcaagtggcctggctctgcatgcaactgaggtcaccaaatttggtctcctgactcaggttggttgagctgccggagagcccaggcctggaaaggtatggagcgcaggagtggctcaggcactaaccaaacaaggtgtattttttctcaggcttgtctctggctaggcagatttgtctcagggtggcaaccaaacagcctaaggctgtgtttggcaccgcatgttcccaactcctctcccttctattccgcgcgcacgcttttcaaactgctaaacggtgcatttttggcaaaaactttttataggaaagttgcttaaaaaaatcatattgatccatttttgaaaaaaaaaagctaaatacttaattaatcatgtgctaatataccgctccgttttccatgcacaggagattggttcccatctcttccaaacgaattcagcctaaatcttctaatgggtgaagttactattcactcaaacctgttcagtaatataccaaatcatccctatgaaagggatgcatgcacctctattatgattaagcaataagaagaaataagttaggtctagtttgatcagaaattcagaatccctcagcaatccagcttggcaccaatgagtgcgatcccatctttgtgcaggtcttcattctccatcggtaaatcaatgtccattacagtttcccttctttgattaagagtcagctaccaaagctcctagtaacgatatacatattaagatttctagtgagtgatgcttgtcttagtattgtaatgcaaaacatagttaagacacatgcatatagctttagcaaacataaaggttataatgctcggatgtgctcccagtacattgtcggatattgttaataaaggttgtgattgcaggtgctacttgttctgggtgctgctggtggtgtcggggcatctgctgtacaaataggaaaagtttgtggtgctgttgttattgcagttgctaggtgattggtgtgatgagataattgttgtacggttgctattgcatttcaccaatttgtgttctcttcctaaatatcccctttttttttcttgactttaggggaactgagaaattgcagtatctcaagactataggagctgaccatgtaattgactcaagcaaggaaagtattatggaaagtgccaaatcttttttaaaagccaaaggcctcaaaggtgttgatgtcttatatgatcctgttggaggcaaattaacacaagatagcctaaaacttctcaattggggtgcacatattctgataattggatttgccagtggagatgtaccaattattcgagcaaacatcgctcttgttaaggtaaaccaattttttttgtggaatttccagaatttttacttttcaacacacagctctatgccttatttgtatgcactccattgtagaatcagaatgatttaatcactgctgacttttattcatttctcttaagagcatcatagggaactggattcactgtcatgtaccttgtttttgtgcaccgtataactattttagacaagcttccatttgcttaagaggtgggactggtcctttctcaataagcgagagtctgatatgaattctgatgaattattgattgggcaaggttagcctgaattcattctcattgaaactaatttgaggattaagaatcctatgaattaagaaatacttgaagcagacaacagtagtgtaaagattgcatcagtggaatcagaaaaaataatatgatcaaccaatctaaagttgaatttttagaagactttgaatttgcacgatagctttccagctagaatgtaaaatggaattgctggggaattcagaatatttgattgcagataaaatgtcttcatacataacttttttttaaaaaaaagaaaacgagtaactaattgctgctgtgctgtttcagaattggacaattcatggtttgtactggggaagctacttcactcatcggccacctgtactcattgactccctcaatgaactcttttcatggctttcaaaggggttgataaaaatccagatttcccacacttacaggctccctgaggtaagcgacaacattttaacaaaccttattataattacagttcttgtaacactaaccacatgtcacatgaaacgtcgcatggcccaatcaatcttgaagacgacacataagtcttgaatgcaaaaaacttacataaatttcattagagacagctctgcacaatatttatatataactcccatgttctgaatggatctttcatttgtaatgtgagcttttcatcagctaggatagcttaaagttgcttggcactttttgcatcatttggctgccatattggtttttgagattacgatccaatcttgttgatacttataaagtcaaagtagttccagtatactaaaatgtacttatgaagcaactaggcgtgactgcctgagcatgtcaacacggacacacgtggtaatatatgccagtggtgcatcttatctaagaaaatggtactgattttagtcaatttctggctttgtatgctgatcaactgcccagattatactgtactgtcagccagtcagaataaggaccaactacgtgggttttttaccatttgtaactactgttcatatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45989 - DNA, 1164 bp, Oryza sativa
atattatggcaggagcagcgtggagtcaaagccctactccgtagagggctcgaggctgcgcggatcgcttcctctctttgaacacagctggggtgtgcgacatggctgtggtggaggatctgcccccacccaggtgaaccctcactttagactgtagattgcaacagctatatgtaaattacaataacgatttctctattaatgaacctgcagtttaatctgaaaatttaggcaaaatgtaaccgttgcagtcctttgttttctttctcaaacacaccattccagtcttttggaatgacccttagggcctgtttggcacagctacagctccagagctcagccaaacagtttcagctgcaccaaaactgggagtggagatgggtggagctctctcacaaaataaactagagttgtggagcgttgtttaggaagctccacaactccacgccagacccaactcttgaagctaaatttaggagttggagctgtacgaaacaagccctaaagctgaccaatcacttgtgaagaatccctctactttgcagagcagaagcgttacttggcatatatactttgcagaagcagaaacacaacttggcggtggctggtttatttagcaatctctacttggctttgatggccagtgtggtaattaatttcagaaatctccgattcttgttgacaaaatttcttttgcaggttgaacatggtgatttcagacatttatcaatgatggattatctgcttgcctattctttctgttacatcagttgtgggatgtttttctgttaaattaatctaggttgctctcttgatctggtctagacagatcctaagcaaaggttgcaataaggaaaacaaaaggaaaaggtgagagaggggcttagtatacctgttgactgtagctgtgtcaattttagttcaaatgtttattggttttgtcatgtatactgcactgtggttcatgaagaacacgaagaatttgtatttggtctacttaattgatctaaattatgtagaacttcatgatttccttcagtgcaaaatatttattaaaaactgccaaatgtagttttttttcttttttttttatccctataaagaactgctagaaccttttttaccacgtgcaaaataacatttgcaatttttttaacaaagaag

SEQ ID NO: 45990 - DNA, 18578 bp, Oryza sativa
gggcgcacgcgcgggcgtggccgacgtggcccggaagacgcgggagcgagggcgcggcggcggttccggggcacggaggtggcggctggaggttgggggaggacccgacaggtgggccccacctgtcggcgaccccaggagagaggaggggctcgggcggccggctcagctgggcctcggccttcggccggcccagcgggaaggggagggaggagagaatgggccggcggcccatttcgaaaagaaaagagggaaaaagaaagaaaaagaaggaaaagaatttccagggaattaaatattgcttgtgctcatttttaattgattaaaattatttctagagctctgaaaattccactaaaaatcttgttagcgtatttcgacatgtagaactcaagaaaaatcgcacatgccagttccgattattatttgcattaattattttagggtttctctcttgcttttgcaccggtattttcttgagaccatttataaattcaatttaggcttgggagaagaacttcagggtgtgacaaacctaccccccttaaacggaatctcgaccccgagattcggaagagccggtgaagaggtgcggatgggcggccttcaactcatcttccctttcccaggttgcttcttcttctgagtggtggctccattgaacccggcagaacctagtgaccttgtttctggttcttctttcactggtctcaagaatacaaactggcttttccacataggttagatcttcttgaatgtcgatgtgctcctccgaatcggcttgttcttcgggtaccctcaaacacttctttaactgggacacatggaacacgtcatggatactgatcattttgggtggaagttctagctgataagcaacttctcctcttcgttccaagattttgtatggtcccacgaagcgtggtgccaacttgcctttcgtttggaaacggtgtactccccggagcggagtaacacgaaagtacacgtaatcccctgcttcaaaagtgagctcccttcggcggttgtccgcatagctcttctgtcgagactgggcaattctcagcctctctctgacggttctgactttctcttctgcttccgttaacacttctgttccgaacagttgactttcgcctatttgatcccagaagagaggtgtgcggcacttccggccatacaacgcttcgaacggtgccatttgtagactggcctgatagctgttgttgtaggagaactccgcatacggcaagcttttgtcccatgctccactaaaatcaagcgcacaagcccttaacatatcctccaatatttgattgacccgctcggtctgaccatcggtctgcggatggtaggctgtgctgaagttcagccgggttcccaattcctcttgcaatttctgccagaactttgaagtgaattggctccctcgatcagatactatctttttgggtactccatgcagacacatgattctcgagagatagagctctgccaaccttttgcctgtatatgtagtatgcacaggaatgaaatgagcaactttggtaagtcgatccacgaccacccagattgaatcgtggcccgatgatgtcctgggcagacctgttatgaaatctatcccaatttcttcccatttccattccgggatctgaagaggttgtaacaatcctgcgggcctctgatgttctgctttaactcgctgacaaacatcgcagagcgcgacgaattcagctatttccctcctcatgctggcccaccaaaaattttctttgagatcttggtacatcttggtactaccccgatgaatggagtattgagtttgatgagcctcagtgagtatcagatcttttagctctttgtcatcaggcacacacaatctttctcccatgcagattgtgccatgttcatcttcaaggaaatcccgggcttttccaacccacatattctttttcagttcagctatctcaggatcatttacttgagctgctctgacttgatccacgagcgtaggacgtgcctctagagcagctacgaacccgtgttctacgattcccatgttgagacgttcaagctcttgctgcaattccttacacatgccttcggtgcataaagcattgtagtagctcttcctgcttaatgcatctgccaccacattggctttgcctggatggtagtgaatgctcatgtcataatctttgattaactccaaccatcttcgctgtcggagatttagatcaggttgggtgaagatatatttcagactcttgtgatctatatatacttcgcagtggttgccaatcagatattgcctccagattttcaaagcatgaaccaccgctgccaattccaggtcatgtgttggatagttcccttcatgtggacgcaactgccgcgaggcataagcgaccactctgccgtcttgcattagaacacatccaagcccgtggcgggacgcgtcgcaatagacttggaagtcctttgtttggtcgggcagaatcagaactggagcagacactaatctcttcttgagctcctcaaaactcttgtcacactcggccgtccatttaaatttctcatctttcttaagcaactgagtcatgggtctagcgatcctggagaaattttcaatgaaccgacggtaataacctgcaagtcgaagaaaactccgaatctatgacacggtcttaggtggggtccatttggtaactgactccacattcggtggatcgactgccacgccctgagctgtaatgacgtgacccagaaatttgacttccgacaaccagaagtcacacttactgaacttggcatataactggtgctccttcaacttctcgagtactagaaggagatgttgctcatgttcttcttcagactttgaatagataagtatgtcgtcaatgaataccacaacaaacttatcgagaaattccatgaacactttgttcatcaggttcatgaagaatgcaggtgcattggtaagtccaaaagatataaccgtgcactcatacaacccataccaagtggtaaaggctgacttgggaatatcctcttcccaaatcctcaactggttgtagcctgatcgcaggtctattatggaaaacaccttggctcctttcagctgattgaacagatcatcaatccgcggcaacgggtatttgttcttgaaagtgacctcattgagtgtgcgataatcgacacacattctcttcgtcttgtccttcttctccacaaaaatgactggagcaccccaaagtgaagtactcggtcgaatgtaccctttctgcagctgctcatcaacctgcttcttgacctctgctagctcgttggctgccattctgtacggtcttatgtaaattggagcagttcccggtgccaaatcaatccggaattcaatctctctcttgggtggcatggtagtgaggtcctcggggaacacttctggatacttgcagactatggggatatcttccaacttcctcgaactcttctcctcggtgaccactggaatttccacctcaatctgattcaaggagaccccctgctttggtgagactggagatttgtacactactgtttctcccttctcattggtcaaggtgactgtgcgattcacacaatcaatgacacccttgaacttggttagccaatccatcccaagattgatatctaggtctttggattcgagaagaatgaggttggctagaaatggtgatctttggatttctattgttatagaagggctgaattgaaccgaagtggagctattccctagggtatgaacccgcattggtgtactaagttcttcccttattaacccatgtatcccaacaaacttctttccaatgaacgaatgcgttgcaccagaatcgaaaagtactgttgtagggattgagttaacaggaaacgtacccagtacgacctctggtgctacttgcgcctcttctgcggacgcgtggttgacacgagcctgggcaaaccttggcccggcacgccttggcttcgggcatttgtcagcaaagtggccatgctcgccacagttgaagcaggatcctggctttgctccagtctccttcttggcttgggctgatggagctgactgtgctggtgccaatggtgggcgtggagctgcactgcggttgggctgacctccctggtggttctggctgccactagcgccctggtggaagctgctcgagttgaaagggcgatgttggcggacgatcatggtggtaggtgtttacacccaaatttggcacctaggattaaaataggaaagattgccgaaaattggaagtctaccggtttcctccgagtgggccggtctgacagccatgtcttggccggtcagaccgccggttgagagccggtcagaccggcggtgtgtggccggtctgaccggcaggtctgagttcgactgtgtttcgtcaggtctcgaggtttgcttgctcgggaaggcatgttttgggtttcctttggtttctaacccgagttggatgtggaggagggcctgtagagggcaagtgatgtgaccatggctactatggatacaaccattgctcacatcatggatgaacaagataatatccagatcaagtcctccaagtgctggaatcagattcggccacctgctacactgctgacttcaaatggccgccgaatctgcatacgacctccttttcggcccatgagtacttgatggaaagctctcggagtcctctttccaacggatttggcatcatcgccaaattccatcgaagtcatccacagatgaagaaacaaggtgctgcgtcacctgtcatgaacctgtgggcttgtaacttcttcatttgggaccccggtccaggtggggcccatgtggggtgcgccccaagctggtggagtacgaccctaggcacccctaggtcgtcctcccacccctatatatagctagttaccccttcagggttttgatgcaagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttctatttgcttgcaggtatagggttgatctgcaccggcaagatcaacaacccacagagaggtgtatcgatcgctaaggcgcaacacaacgtctcgtacggttgtagtcggattgtcaacgtttctcccaaatcgtagttatcacaactcaccaaaagatcgggccaacaacagccttgagtgtcgagaggaactcagggttcatcagcaagaccaacccctatataagggacatggccggttcattgtaaaaaatcgatctacaatcaatcagttgaatcgtttttcatattgcttttaattttctcttagtttgtccatctttgtcggtttgcgccgtaaaccgtctgccgccgctgcgagtgtgcgacacctctttgtaggtttgtcctgaaaaccttccgttttgcccacgagacgggtagttatctagaaatcggctccgctagccggtttagttaccaaaacccatctaggtttagctctttgctagatcgaggtggttagcgactctaggatcaccgcaaggctttaggtgctgcgatcgtgcttgtcaacttgtcacaaaaagttgccaacacgatttttggcgactccactgggaaggagatccgttcatcgtcaactcaacttcgacttcaccatgacgaagccgccatccaagacggaggtggagccatctaatgtgataccggtcacattggaggattccgaaggagaggaccgcaaagctatggaggagtacatcaacgagctcacacgggaggcgttgatgagggcaagcactaggactcgtcaaggcgtgattattaagcccgggccacgtcctaagctcgcccccgacttggtaagtaatgatgaggtaacacaatctatccaacaacaagtagcatctacaatagattcatctatgattgcttttaaagataagttagatgcaacttttgagggtaaatttgatgagtttttaagggttaaattcggccctcttatggccgattacatgtcaaaggataaagcctctaccactgctaaccaacctcctatagatcaaacgggtagtaaaaccgatggagcggcgcacacggccggtctgaccgggcctgacggccggtcaaaccacgacttagccgtcggtctgaccggccaaacggccgatcagaacggcacaattataccgatacaggggatcgatccgatgactaatgctagttatttgtatcatcttagaacatttgatcctcctatatctactgctgcaaataatctccaagttcccccacatgttcctaatgcttataatgatgttgctagggggtatcctcccgatactagacaaggccaatataatcatattgcggaacaaacacaacctattaggccaccaaatccaccgccaaatcaacatgggcttaataatatggaggacataattagtgagattattaggaatagattcgggattgaaactgggtattgtgctagggtttacaaaaagccgtatcctgattattatgataatgtgccgtttccccgtaattatagagttcccgaatttaccaagtttagtggtgaggatagtaagaccacatgggagcatgtaggtcaattttttggtgcaatgtggtgaggctaatagtgatacttttaatctgcgcttgttttctttatctttgtccggtaatgcttttacatggtttacttctttaccagcaaattctattcatacttgggctcaattagaagaaaaatttcatgattatttctatactggagaaactgagcttaggttatgtgatttaacatcggttaagcaaaaatataatgaatctgtcattgattatattaagagatttagagatgttagaaaccgatgttataccttgaatataactaatagagatttggctgatcttgcttttaatggtttaattgctcctcttagagaaagactagatggccaacaatttcttgatgttagtcaactcatgcaaagggctctggctcaagaaagccgagttaaggataataaaaaacttgtcagatcttatgacaaaaagcctaatgttaatgtgattgattaccctgaggctagtgatagtgaggaggagggtgatcatgatatatatgttgctgaatggtcatggactaacaaaaacaagccttttgtttgctccaacctaatgccgactcctcgcaaagatcggcaaagtgaggttaaatatagttttgatgtggccaagtgtgataagatttttgattatcttttacaagaaaaacaaattagattacctaaaggccatgtcataccatctcaagaagagtttaaacgccgagcatattgtaaatggcatgattctcattctcattctactaatgattgcaatgtgtttcgacgacaggttcaatcggccatagatgaaggacgattgaagttcactgatggctccaagatgaagcttgatcatgatcctttttcggtgaatacaattaatttcaatgataaaaaggtgttaattcggccggagcaagcagaatctactaaaggaaaaggagtggtcattggcgagccaaggcctaagatgatagtgacaaagaaaccggaagttagtgtttggaaggagaataagagtggcgcttcaacttctaaagcccctaggaagaccaaagtgacttttggtatgcttttggagaagtatgagaagcaaggtggtgagagggttcacaacaaggggaaaagaccaagatcacctcctagggagcgatttggtcattcaccaagacggtcgcattcacctccatatcatcatccacaagacatgtcatggggttcttatcgaatgtcgccgccgggttatccttatccttacttcatgccatggggggcaacgccgcaaattttcaatcatatgcctccaatgcaatttaaccaaggatggggaggaccgaggaggccaattcatgagcgtttctcttcaccaaacaataggcggttttatggtaagaatcgggctaataatgaaaagagggaaggaaagcgcgtcaaggtggaggcaaggacttcagaagtaattaccatcaaagtggggtctcatgatgtgccaataccttctggagatggagttggagtatcctcaaacaaaaaatccgaagccaaaaccaactcctcgcagtcggccggtctgaccaggccttctggccggtctgaccgcagccatgcggccggtctgaccgggtcatcaggtcagtctgaccgccgacccgacagtggtccgaccgatgcctcgggccggtctgaccgtgcgtcaagtgtcggtctgaccggcatgtctggccggtctgaccggtggtctacgtccggtctgatcaggctccagcgccggtttgacaggggaattgcaaagggcgatatgaaggcttcatcgtcttcaaacaagattaataggggacattatttacctcctagaacagagccgaatcctaggtggatgcctaaggatttgacggctactcaaaagagaaggttgcaacgtcttcgggctcaagagataagagagaaaaaagctgaagaacaaagagataaaaggttcaatgagttgcgaccgccactggtatggaggcgtaaatccatagagaaggaaaagccagttgttgtagaggagagggaggagcaatcggttgataaaggtgaatcatctccaaaagaagacatggatatcaacatggtatgtatgttgcctatggagttttgtgctatggatgaagccgaggttgctcaattctcattaggtcctaaagacgcggtttttgagaagcccgatgagtcaaaccgtcacatgaagcctctctatctcaaaggccatgttggtgggaagccggtctctacgatgctagtggatagaggtgccgccgtgaacttgatgccgtattcattgttcaagaagttggggcgtgaggatgatgagttgaagaagaccaacatgattctcaatggcttcaatggtgaaccaacagaggcaaagggtatcttttcgggaattcaccgtgggaaacaagacgctccaaccgctttcttcatcgtcgatgtgcaaggtaactacaatgttattttgggtcgttgtttgattcatgccaattgttgtgtgccttctaccttgcatcaatgtttaattcaatgggacggcgatgatgttgaaattgttcaagcggatacatcggccgaggttgcaatggccgatgctacttttgagtggcgtcatgggaatatccaatgcttatcagggagggaactttctagctatgattttattagtatctccgatggcaaatttgtacctatttctgtaaagccggctagtgtagcacggctaagccatataaatttgtataatgagtaaagaggctaatttagagtggttacaaaagagggtgcaagaatatcggtctacaaagaacgatattggcgaaaccattgaagattttgatgaagtagagaagcttggacaagggtttacatcggccgatccattggaggaagtggacataggtgatggaaccaaaccaaggctgacttttgtaaacaaaaatatgagccgattataaggttaagataatcgagctacttaaagagtatgttgattgctttgcatgggaatatcatgagatgccaggtcttagccgtgagctcgttgagcatcggcttccaattaaaccaggttttaggccttataagcaaccacctcgtcgttttaatcctttgctatatgaccgagtcaaagaggagattgatcggttgttgaaggcagggtttattaggccatgtcgttatgtggagtgggtctctagcagagtcctagtggagaagaaggggagtggtaagattggagtttgcatatattttagagatctaaataaagctactcccaaagatgagtatcctatgcctatagccgacatgatgattaatgatgcctcgggtcataaggtgattagctttctagatggtaatgccggctacaatcaaatctttatggcggaagaggatatgtacaagatggcttttaggtgcccaggatttgttggtttatttgagtgggttgtcatgacttttgggttgaagaatgccggtgcaacatatcaaaggacaatgaatttaatctttcatgatttattaggtattatcctagagatctatattgatgatattgttgtcaaatcggatggtatggaaggacacatggccgatttgaggttagcttttgagaggatgcgccggtatggtttgaagatgaacccacttaaatgtgcttttggtgtgtcggcggggaagttcttaggattcatggtgtatgagagaggagttgagattgatcctaagaagatagagaagattcgtgatttcaaagcgccgacatgcaagaaggaggcccaaaagttgctaggtaaagtgaattatttgagaaggtttatttctaacctagcgggtaaaatcgatgcttttgttcctatacttcgcttgaaaaaagaagccgatgttacttgggggcaaaacaacaagaggcgtgtgaagagttgaagagatatttgtctactccacccgttgtacgagcgcctaaagctggaaagccttttcggttatatattgcctccgaagacaaagttattggtgccgttttgacacaagaggaagatggcaaggaatatatcattacatatttgagccgccgtcttttagatgccaaaacgaggtatgtttttatagagagactttgtctatgcttatactatgcttgtaccaaattgaggcattatttgttatatagtacatgcatagttacttgtcaagccgatgttattaaacacatgttgcaaaggccaattctaagtgggagaattggcaagtgggcatatgttttgatagaatatgatttggcttatgaaccattgaaatctatgaaaggccaaattgtatgtggttttatagtagaccatcatacagatattgcttatgagggagaggtttgcttagttgaagttataccttggaagatttattttgatggttcttcttgcaaagaaggtcaaggcataggggtagttttcttttcacctaatggcatgtgttatgaagcatctgttcgtttggagtattattgtacaaataagcaagtcgaatacaatgctttattgtttggcttacaagttatggtgatggttggagctaaatacatggaagcttttggtgattcggaattggtggtgcaacaagtcaccggagtctacaaatgcttggacggatcactaaataggtacctcaattcatgtttagatattattgccaattttgataatttttctattagatatattgttaggcatgataattctagagcaaatgacttggcacaacaagcatctggctataatgtgaagaagggattatttctgatattagaagagccggtgcttgattttaaatctttgtgcgaaattggcaaaactggagaccagggatggtctgaccggcattgcactgccggtctgaccggtaaccaggggcggtctgaccggccgcatgctgccggtctgaccggcgacccagagcggtctgaccggccctgcgtggtcggtctgaccggttctgggcagaatgctggggggcacgtttcaatcaatttagaggctgaattaactgtgaattcagacatttgtgcccagggaacagaagaatattggagaattcctttgattcgatatttgaaagatcctacgcaaaattcgatatttgaaggttgatcgcaaaattcggcggcaagcattcaaatatacattgcttgatggagatttgtatcgccgaaatatagatggtgtcttgttgaagtgcttagatgaagatcaatctaaagtggctatgggagaggtacatgaaggaatttgtggaactcatcaatcggcccacaagatgaattggttgcttaggagagctgggttctattggccgaagatgattgataattgcttcaaatattatagaggacgcgaggcttgtcaacggttcggcaatgttcaattggcgcccgccgccgtgttgaatcccataatcaaaccatggtcattccgaggatgggctttggatttcattggtcaaatttatccttcgtcatcaaaggggcataggtttctgctagttgctacggattacttcaccaagtgggcttcgtgcctttgaagaatatgactcatacagaggtaattgactttattttgaagcatattatccatagattcggtattccacaaacattaactacggaccaaggtgcttcttctatgtctaaggaagtgaagagttttaccgaatcttatggtattaaattgttgagttcttctccttactacgctcaggctaatggacaagccgagtcgagtaataagacattgttgaagttagtgaagaagaagattgaggaacacccaaagaggtggcatgagatgctttccgaagcattgtgggcgcataggatttctaaacatggtgccactaaagtcactccttttgagttggtttatggtcaagaagccgttttaccggtggaggtaaatcttggttctcttcgttatatcaagcaagatgatttgtcaaatgaagattacaagacgttgatgggagacaatcttgatgaagtcatcgacaaccgcttgaaagcattggaataaatagagaaagagaagaagagagtggccaaggcgtaaaacaaaagggtgaaagcaaagttgtttcaagttggagacttggtttggaagacaattttgccattgggtactcgatccaaggagttcagttagtggtctcctagttgggagggtccttatcaagtatgcggcattgttcgagggaacgcatattttttggagacacttcaaggggagcgttttcagcgagcaatcaacgggaaatacttgaagaaatacttcccgagcgtttggcaagacgcttaggaggtactatggctggtaattgatttatcgtcctaagaccaaaacatgttctatgcttttagattcacgttgttcatcaaaaaggcaggggggcatatgtttacacccaaatttggcacctaggattaaaataggaaagattgccaaaatttggaagtctaccggtttcctccgagtgggccggtctgaccgccgtgtcttggccggtcagaccgccggttgagagccggtcagaccggcggtgtgtggccggtctgaccggcaggttcgagtccgactgtgtttcgtcgggtctcaaggtttccttgctcgggaaggcatgttttgggtttcctttggtttctaccccgagttggacgtggaggagggcctgtagagggcaagaccaacacctatataagggacatggccggttcattgtaaaaaatcaatctacaatcaatcaatcgaatcgtttttcatattgcttttaattttctcttagtttgtccatctttgtcggtttgcgccgtaaaccgtccaccgccgctgcgagagtgcgacacctctttgtaggtttgtcctgaaaaccttccgttttgcccacaagatgggtagttatctagaaatcggctccgctagccggtttagttatcaaaacccatctaggtttagctctttgctagatcgaggtggttggcgactctaggatcaccgcaaggctttaggtgctgcgatcgtgcttgtcaacttgtcacaaaaagttgccaacagtaggtccaccctgctgtcctggagtgaagcgcgatcgctggtggtttccttggttggaccggaactacgctgcctttctgttcctgtccattttgttgcgctgatcctcctgacggattgccttgtcaacctagttctcaaagttggcgtagtctctagagatcaactggttggtcagctcgtcatccaggcctgctaggaacttctcctgcttctctacgtcagtgcggacatcctccggtgcatatcgcgctagatgattgaactcatggagatactcagacactgtcctgttgccctggtggagggctcggaattctctcttcttttgtgccacgatctaccatgagttcagcccaatgttcaattcacaaagactagggtgacaaggaatcatgggcaatcaataattatcaaaggtaggataataataacaattaggtcacgctacccatcgatggtttataaacaaaacaatgcatgtattcaaaacaaaacatttcacaaatgggttcaatatgttcaaagagtgcacttgccttgatcctagtactgtccttgcacagcgtcttctgaagcaaactgctcttccgctccaacgtctacacgattgcaaacgaaaaacaaataaacacaaagaaaaaataactaaataacatcaaatgaaataaccaattaaatcaggaggtaaagctcgattttagaagaatttaggaggaagaatggatcgaatcggagttcaaacggaaaagttatggcctcctgaagtttgaattcggggaaaatccgaggataaaagaaaaaggaatattccaagaatattctctggatatttaatttcggaaattgaattaattttggataggaaaaaatatatgtgggcccactgtcattggcatagtgtatgggtggactcggtgtatgtggactcgatgacgtggaacgacacgtggcgacacaaggcgatgaggtggcactgacatggatggatatagggctgacgtggcgaaagaagggattatgtagatccaactgctgggatttgatctagggatttggacggcttagatttatttgaggattttggatggcaggtcccacacgtcggtgtcacaggggagaaggcaagcagcagctgctccatcacacggcctgggcgtgctctggccatggcaggaccggcggctccagcgcggcggcatcggcggctttcgtcggcgatggcgcatggcggctgcagcaaatagtggtggaggcagaggaggtggaggccaacgcggtggcgtagcaccgagctccgggacggcgtggagatggcgcacggcgatgagaggcggacgccggagttgaggtggagagagaaacggcggctcgaaagggagagagggctcagcctcggggctttaccagcggcggcggcacgggaaggagatggtgacgacgacggcgcggctcccgacggcggcacgaagcaacggtggcggcggctgctcacggtggagatggcggcggctttggaaaaagggggaaaaaggggcggtggccgatggtatttataggggagggagtagctagggttagggcgcacggtgcaagctttggaaaagcggcggctccgaatttggtggcgcggcttgcgggatttggcgtcggccgtgtgggcttgcggcgcggccggcgcgggctcggtcggcggcggcttgggccggcgacatagagaggaggaggaggccgggccgcggcggcacgtgggctcggggcttggcctccccgggcctgcagctcaagaaggagagagagagctggaggtagaagaaggtgggggaaaaagaaaaagaaagaagaataagggcagaatagagaaacagagaggaaggaaaaagggaaaaagacagggacttctctggaaaattccaaatataaagtatttgaaatttttgggaaggatttaggatttgaaaaggaatattggatttggatggaatttgaattagggattgagctccacttccgaaatacaaattaaatccaactaactccaattaagaatcacaaagcgaacaacataattaattaattaatcactttaaaaccgtttgatttaacgaaattttcattaagctattttagacgaataaaccaaatgtgaaatttcgcaaataggcgagaagaacagaaagcgaaaaatcaggacgtgacagaatttaaactgcaattgttttgatctgaattaaaacacttaaaacagcaagcaaatccttattaagacagccatatcataggcacatgatatcgactgtcgactgacccacaagcgaacaatcctaaacacacaaactaacaggcaattactaaacagtcgataaactaagggaaaatgagcctaatgctcgaacggctcctgcagtcggtggagtcgaaggcgtcctcctgctcgtcgccaggcccctctgagcggctcctggagtctggcagatacgtctcaccgctgcccagctctgagccactggaactgctgctgctatggtcgcggctgccactaggagtagtaggcaaccaacctccgttgccactggctggacccctggcggctgacgctggagcgaaggagagagcggacgcgggagctgacactggcacaggagctggggctggagctggagctacgggtgctgcgggaggagctgcgggaagaggtgggttcctgggtgcaagctgaatgcgcacgggagcagtcgtagacttgcggggcgtggtgcggatccgaactcctcctggcgctggaagacccttcaattgagcgttctccttcttcaggcgtgctatctcatcctttagagctatgatcctcacaagcttcccatcattcaaggccttggatgccttgtgcaggtcagagtgcatcctgtccattcccctcatcacggcgcacatgtggccgaaggtggtgttgttctcgccggctgtcgggcggaaggtgctggcgtcgtcgccacttgctcggcgagggtggaagcggtacgccgtgttgtagaagatgtagttgtggcgatcacgaagtctagccatcatcagatatgctgcctcctgacaagcgtgatctgcggagcctccagatgcctcaaccaccgtattagcgaggcaggtgcccacatagccatgaacctccagacgaaaatggtggggaagctcgccactgagtggaggaacggtcgagtactccggcacgttggggtagtgttgagagaaaacacgaggcctgggagatctgcttaactccagtgcaggtccaaagctcgccttcgggtgtactagcatgccagttgattttatcctgtaattaacaagaaataaaggcaaagaaaccgcggttaaatctataaatgatagccgatcggctaggtgccgatgacatatcatttatctttgagccgatgtcatatgtgaattgatcggcagttgtaaatagacaataaagaaccaaatctattcgatcggctgtagatatttccaatatatagttcttatatcgatatatacttaaatcaagtgattgggatagatcggccgccatgccaagacattataaatcacttagatcgaagtatatattaataacagggctatatatgtttatagcatagccgatcagatagatctagcatgtatcggctaatactctgatactactctatatcaggatattaaaacaggtataatatatcaaacaaaggcctaagatacttagatacagcaatatcttgacataatgggcagatttaacatgtcaatgaagcatatagagcaaatatagttaaatcagataaggtcgactgaaactccgatgctaccctaatcggcaaccagaaggcaggctagagattgatattctaagcacgacttaatagatcaaactcaactgatgcagcattaagtatgaaaagaagaacaatatctagacaatcaagccgctagaagtttcatagagtggtagataccttatacaatctaagtcaacatcgatatctaacctaatcggctgccttctacagacagatgttagccgattgtagattagatagcagtattgccggagattatgtaagatatatgataactcgacgaattacataaacgagatcagagtatcataaagatggaagcactaatcccgagaacacaagtcgtcataacaagttttacctcttgttgaagatcgaaaccgatgcagctttatgatactctgaattacaagatatgtacataacggacacgactactatctctagcaaactctaagatagcataagtctttgtggcagacttttgcccaatcgtatctctaaggagattacataaaacaccctaattaatagatacaattgccttctcaggactctatccatgtgcggcaatcaccttgaagcacctcaatccaacccgatatcatacatcaagctgcattgtcggaatcagctgtatcggcttacctagtctgactcagacccagccgatcctaatcgtagccgatttggactccagcgattcctgccctgtttccgaactcgatctccgcctccaattttgcttcgatctaatcttctttcatgatgctgatgttaccaaattcggttgttaacaggtagcccaccaccagggtcatgcgagccaactctgccacaaaatcatccatgccttctccgtggtggttgggtgggtggtcggccatct

SEQ ID NO: 45991 - DNA, 12743 bp, Oryza sativa
agctcatcaggacttacatagcgataaaataatgagaaattagatacatactaataataataataagagcattaataccttgcaacccatattcctgagttaggacctaatgcattcctcccatcaaaccctagactgacctaatttgacaaatctcacttaaacgagcgaccaagatttttcccttgaaccacaagaacagatcccaattttcccggaacaaatccaattgcaaagaacatatgcaatgaaaaggattcagagggctcttaggttttttcccatttggcttgtcctacggtcaaggttggctctgataccaagttgtcacgcccagaaattcccgaatagaattccaagcagaatgtgcattaaaatccccatccaggaccggccggggggtacacaaacgacaaagttgacatacagatccacgtcttacaaaaattataaaagtcttacataaatgtagcggaaaaataaaagataactggagctaagccttgacttggactgcagcgggaacaccagtccacaggcatcctcgacggcacgaacgaagcctattcctcggagaaaccaccatctaacgcatactcaaactctggggtttggggaaaatagagcaagactgagtataaccaccacactcagcaagtcataccggaacagggggtatgatgcaggatattaccaaaggatagctagagaggttcttttgcgtaaaacgagcatttataaacagtagttgaaagcaggaaatcaggtgtaataattaatcaatattagccatccactgtccaacgctacaccacgttgcaacaggcccaaccaaccacctgaactaatcagttccatcatattaaactagggtgagactaatcacggtgaatctggttgaccgcccataaccgcgggcaaggctattcaaatagttttactctgatcagaggtgtacaactgtacccacaaaacacagccccacgacacgtttccgtgcgccgacatgccaccacgacataccggaaagaggccgtgacaggactcttcgcataaccccctctagccaagcacactacacctcaggtttcacccccgtccccagtgggcaacgggcagtcccctctcgtgcctaggtgaatctggaagcgacaaaggccgtcgcagggcccgccctgctccatcacacccacccttgcctggatgcgtcaactagaggaaagctacactacaagcccagccgttgcccacgctggcttgtggtaagtacgataagttcttccagggcatcccgcgaaccggtccttaaatgccatgggcgcgaccaacaaaaccatgcacccacagcccaccatttggtatattttaattaaccaacaccggggcggtggcattaaccaacgtcattactagaatctgatatctatgcattaatgtgatttcccccattgtgtgctagttgaactaagcatggctaagcaatccctagtccaatctctagtcatgtttatatcccaagctaacaaaggagcatggtacagaaatagcatggctgtaacagtaggtaaacatcccatagtatcattatgaaacaatgcaatatttgaaggaaaacaatagaacatttgcaatataggatcaacatcttcaagtgacaagcatgacttgccttgctctgctgctggaggaacctcggcgactatttcaaagtacaccggagcgtcgggagagccggaatctaagcgacatacaaagcaaacaatacaaacaggctataagactactgaaacagagaacaaaaccattttgaatggattctacacatttttcttgatttactgagacttgaatgggcttaaacggagctcggatgaattagatatgaattttagaagattcacagaaaaatccttaattgatttattgcacaataaataaaccctaggagagagggggcagcgccgacatgcgggccccacatggcagtgactccggtggcggtccgcggtggaccgagtccacggaccggggaagggggcggcgcaccacgtggcactgacgtggcgccgacgtggcgcacacgtggcggccacatggcacgccacgcgggtggccgaaccgacgtccccgatctacccgagagtagatcggacggcggcggggagcacgcggtcggcacacacgagcggcccaagccggcccgatggccacggtgcacagcggcgctaccgcagggcggcggcggcagacagcggtgaccgacggcaagcggcggcggcgcgacggcgcgggtgatgctagcggcggctaagcagctaggcggcagcgcggcgactaagcggcgtgggagagagagggaggaaggggaggaggtgtctcaccgacggcgattgatgacggcgagcgacggagggcgatgacggcaacgggacgagctctggaaccacctagcgaacacgatgaaaggggttagagagagaggaagatggaagagggcgaggacgccggccgaaggcggtggccatggcggtgctcaccggcgcaaggcgcggagtgggttccggaggcggaatccgacgggagaggggcggacggggtgacctgcacgacggcgaacgtgacggcgtcgacgacgcggctcggcgcagcggctagcggcggctagcagcgaccggagcggtggcggcggcggcggaaaggagggcgacagcgctagggcgatagagggcacgggagagctcgcgaaatggagaaaaagagagaggggagagtggggatgcttaaataggggagagggagctcgaacgtggctaggagaggcgggaatcgccagccgacgtggggtagtgggagaggagagagaggcgggatttgaaaatcgaatcctggccgtctcgagcgcgggcgcgggcgggagagagagggagtgggcgcgggagacgtgggcgcacgcgcgggcaaggccgacgtggcccggaagacgcgggagtgagggtgcggcggcggctggaggttgggggaggactcgacaggtgggccccacctatcggcgaccccgggagagaggaggggctcgggcggccagcccagcgggaaggggagggaggagagaatgggccggcggaccattccgaaaagaaaagagggaaaaagaaagaaaaataaggaaaagaatttctagggaattaaatattgcttgtggtcatttttaattgattaaaattatttctagagctcttaaaattccactaaaatcttgttagcgtatttcgacatgtagaactcaggaaaaaatcccacatgccagttccgattattatttgcatcaattattttagggtttctctcttgcttttgcagcggtattttgttgagaccatttataaattcaatttaggcttgggagaaaaatctcagggtgtgacactcacccaagatactccaatatgtccaaaaatcttgttttggtgctttttgaactttttcattccggtgaaaaacatcgcacccacgtgtgccaacataggccaatattggcattaatttacaaaagttcgccgcgcgattcacggagtgatttttcgacacggacacacccaattctctacaagtatgtccaaaaacatgttttggtgctttctgaacgttttcattccggtaaaatacatcgcacccacgtatgctaatataggccaatattggcattaagtgacaaaagttcgttgcgcgaatcacggagtgaattttcgacactgatgcacctagtaaactccaataagtcctaaaatcatgttttggtgctttttgaactttttcattccgggaaaaaacagcgcacccacgtgtgcgaatataggccaatattggcattaattgacaaaacttcaccgcgcgagtcacagagtgatttttcgagacggacgcaccctgtacactccaatatgtccaaaaatcatgtttttggtgctttttgaactttttcattccggtgaaaaacaactcacccacgtctggcaatataggccaatactggcattaattgacaaaagttcgccgcgcgagttacggagttatttttcgacacggactcacccaacatactccaatatgtccaaaaatcacgttttggtgctttttcaagtttttcattccggtgaaaaacatcacacccacgtgtgccaacataggccaattttggtattaattgacaaaacttcgccgcgtgagtcacggagtaatttttcgtcacggactaacccaacatactccaatttgcccaaaaatcatattttggtgctttttgaagtctttcatttcggtgaaaaacatcgcacccacgtgtgccaatatgggccagtattggcattaattgacaaaagttcaccgcgcgagtcacggagtgatttttcgatacagactcacccaacagactccaatatgtccaagaatcattttttggtgctttttcaagtttttcattccggtgaaaaacattgcacccacgtgtgccagtatatatctatattggcattaattgacaaaagttcgccgcgcgagtcacggagtgatttttcgacgcggacgcacccaatacactccaatatgtcgaaaaatcatgttttggtgctttttgatctttttcattacggtgaaacccacgtgtggcaatattggcatcaattgataaaagttcgccgcgcgagtgacaaattgatttttctactcggacgcacccaatatactccaatatgtccaaaaatcatgttttggtgctttttgaaatttttcattccggtgaaaaacattgcacccacgtgtgccaatagatgtctatattggcaataattgacaaaagttcgccgcgcgagttacggagtgatttttcgacacggactcacccaacatactccaatatgtccaaaaatcatgttttggtgcttttggaagtttttctttccggtgaaaaacattgcacccacgtgtgccaatataggccaatatcggtattaattgacaaaagttcgccgcgcgagtcacagagtgatttttcgacacggacgcaccctgtacactccaatatgtccaaaaatcatgttttggttttttttttaactttttcattccggtgaaaaagaactcacccacgtgtgccaatataggccaatagtggcactaattgacaaaagttcgccacgcgagtcacggagtgatttttcgacacggactaacccaacatactccaatatgtccaaaaaatcacgttttcgtgctttttcaagtttttcattccggtgaaaaacatcgcacccacgtgtccaacataggccaatattggtattagttgacaaaacttcgccgcgtgagtcatggagtaatttttcgacacggacacacccaattatctacagtatgtccaaaaacatgtttgtgtgctttctgaactttttcattccggtgaaaaacatcgcacccacgtgtgccaatataggccaatattggcgttatttgacaaaagttcgtcgcgcgagtcacggagcgatttttcaacaccaactcacccaacatactcaaatatgtccaaagatattggcattagttgataaaagttcgccgcgcgagtcacaaattaatttttctacacggacgcacccaatatactccaataagtccaaaaatcatgttttggtgctttttgaagtttttcattccggtgaaaaacattgcacctacgtgtgccaatatatatctatattagcattaattgacaaaagttcgccgcgcgagtcacggagtgatttttcgacacggactcacccagcatattccaatatgtccaaaaatcatgttttggtgctttttgaagttattctttccggtgtaaaactccgcacccacgtgtgccaacataggccaatattggcattaattgacaaaactttgccgcgcgagtcacggagtgatttttcgacacggacgcacccaattctctacagtatgtccaaaaacatgttttggtgctttctgaacttttttattccgctaaaattcatcgcacccatgtatgctaatataggccaatattggcattaagtgacaaaagttcgctgcgcgaatcacggagtgaattttcgacacggacgcacccagtacactccatgtggagaatatggatatcccatatctacatgacagttataatttagtcggatatacggtaccaaatatagatagaatatctttatgaagactcgggtttgttttttacttgtatgtcaaggaaatacccgagatcttagtcggttaggattgtattttatctataatcccatattccgttaggatatggactgtattttgtaaagcggactccttcccctatataaggagggtccgtgtgcctctcggggcgcaattcttttttccaatatatacaatcaataacatactcggcggaatcatccccggacaggagtagggtattacttcttgaataagaaggcctgaacctgtataaaattccttgtctccaaacccatccactttcctagcttgatagccacccccttttattattgccgaaatcttgtttcgacagttggcgcgccaggtaggggcagcgtcaagtttttgccgactaagtgcgatgggttccatttctggcatcgacgacttcgccttccctcccgggcaggcgttccggttcggcagcctcaacttcatcaccaacgacttcagcaagatctctctccttgactcggattcgaaccagtcagggagagaccaggtccccgtgccgttcggtattccgaactcggccgaggcctactccaagatcatatcttccgagtcggcttcaaaccactcggacgagatccaatctactcctccgcgaccagatcaagacgacgggtcctatccttcaatcttgatgaaacttcctgatgacttggacgccgtcttcacagtcaaaacatctcccactcagagatctaggcgagctccggcatcggccctgatccagtctagatccagggaggttggcgttatactccaacttcttgggacagtctcgacggaagatttggatggctacctcagctcccccggcgtcagttctcgaccaaccgagatcctcgactacgacgaccacgacgacctcgacaacttcgacgacagctatgaggataactacacgcccctcttcttcggtgtattcatggctgacaacgaaacggaggaacagcgccgagcccgagaagcggaccaagatcgcgcacggcaagaagctgaacgtcgccgactggaggaagagcgacagcgacaggagcgagaacgactatagcgtgagcaacaagatcgcgaacggattgcaaaggaggctgaagatcgacggcaacgcaccttggaatccgggaggcgagcgagagagctcattgggcaacaagacgtcgacggaacagcggtctttcgcaccccccagcagaacgcggttgcagcaatcactctcctcgacaccctcctcaaggaagacgcactcaaccaagctgatcatgttgtcaacatcttgaaccagacgaagaccatgatcgcttcctcgggtccagccaactccgcaagcacccgcaccttgactggtagccgagtccctcatcttcgatctcaagactatcaccagccatgcctcagcattgccagtgccggatctagtcacaggagcagaggacatgatgaacggtctgttcgttcacctcccgaacggtatagggagcgtcgagttgaacgaccacactccccacatcgaaggcgccccatcgatcttcgcgacaccatcaactagcgccgtccagcaagaggccaccattcaccagatcgttacgacaacgatgtggacggagttgctgccttcacaagcgatctgcgtcgagtggattggccagccggctttaagccgactggaattgagaaatatgatggcaccaccaaccctgagtcttggctcaccgtctatggtctcgcaatccgcgcagcaggaggagacagcaaggccatggcaaactatctgcctgtggctctagcggattccgcccgatcctggctccacggactaccccgtggcacaatcggatcatgggcagaacttcgtgatcacttcatcgccaacttccagggcacctttgaacgccccggcacacagtttgatctctacaacgtcgttcagaagtctagaggatcccttcaagattacatccggcgcttctccgagcaacgcaacaagatctccgacatcaccgacgacgtcatcattgctgcctttactaaaggcattcgccacgaggacctagtcggcaagttcggatgcaaacctcccaagacggtcaagcaaatgtttgaaaaagccaacgagtatgccaaagccgaagatgctattacagcgtccaagcagtcgggcaccacttggaagccaaagaaggacacgccgaccgcaggagggagtggaagtaacaaccgcaaggatcgcaagcgtaagcccgaagaacttgtggcaacaacctctccatcttcccgacaacgtccccgcgtcaacacattcgacaagataatgaactcccaatgtccgcatcatcctaactccaaccacgtggccaaagactgcttcgtctacaaacaatttgcggagcaatacgtcaagaatgcacgtaagccttcagacggagagcaaggcacatcaaagaagaaagacgatgaagacgatgcctcgactggttttcaagatcatcgcaaagaactcaatcacatcttcggcggacctctggcttatgaatctaagagaaagcagaagctaacagaacgggagatcaatgcggttcagcccaacacgccccaataccttcggtggtcagaaatagcaatcaagtttgaccgctcggatcatcccgaccgagtggtccacccggggcggtaccccctagtactatacctagtggttcgcaatgtcaagctccgaagaactctcattgatggtggcagtgcactcaacatccttttcgctaagaccctggacgatatgcagattcctcgcacggaattaaagccgagcaatgcacccttccacggtgttatccctggattatcagctacaccactcggctagatcactcttccggtcactttcggcactcgggagaattttcgcacagaaaatgtttgtttcgaagtcgctgatttcgagacagcataccatgctatacttggacgaccggccctagccaaattcatggccgtcccacactacacctacatgatgatgaagatgcttggtcctcgaggagtcatatcactacgaagcaacatcaagaaagccgtcacatgtgacaaagaaagttgcgagatggcccagacccgcgagattacactcgaccgagaagagatccgactggctgcgaccatggcaagcgaaggagaagtgcccgcaaccaagatgctcaaaagcggagaaagcaatggtaagacgaaaaagattcccttagatccctctgatcctgataagattgctgtaataggcgctgagttagattgtaaataggaaagcgcgctcatcacctttcttcaaaataataaagatatctttgcatggaaaccatccgatatgcctggtattcctagagaggtgattgagcactctttacatgttaaggaagacgccaaacccatcaagcaacgactccaccgttttgcacaggacaggaaggatgcaatcaaggaggaattaaccaagctgttagcagcgggcttcatcaaggaagtccttcatccagactggctggctaacccagtcctagttcggaaaaagacggggcaatggcacatgtgtgttgattacaccgacctcaacaagtcttgccccaaagacccttttgggttacctcgcattgaccaggtggttgactcaacggccggctgcgagttactcagtttcttggactgctactcgggatatcatcagatccgactgaaagaatccgactgcttgaagatctcgtttattacacccttcggggcctactgctacatcaccatgccctttggatggaagaacgcaggagtaacctatcaacgcatgattcagagatgtttctcgactcagatcggccgcaatgttgaagcttacgttgatgatgtagttgtcaagaccaagcagaaggatgacctgatcacagatttagaggaaacttttacaagcattcgtgctttcaggatgaaactaaaccctgaaaagtgcatcttcggagtaccgtcagggaagttgctcggatttatggtatctcaaagaggcatacaggccaacccggagaaaatcaacgccatcctcaacatgaaaccgccaagctcccaaaaagacgtccaaaagctgactggttgtatggcggcgctcagccggttcgtctcatgactcggcgagcgggggatgccctttttcaagctgctgaagaagactgacaattttcagtggggacccgaagcacaaaaagcctttgaagacttcaagagacttctcaccactccaccagttttggcctcgccgcatctacaagagccgctactgttatatatgacggcgacctcccaggttgtgagcacggtcctggttgttgagcgtgaagaggaaggccatattcaaaaagtccaacgaccaatttattttgtcagtgaggttttagccgactccaagacaaggtatcctcaggttcaaaagttattatatggtgtcttaattaccgtcatgaaattatctcactactttcaaagtcactcggtcacggtggtcacatcgtttccactcggggatatacatcataatcgcgaagcaaacggacggattgcgaagtgggccttagaattgatgtctttggacatatcgttcaaaccacgaacttcgatcaagtcacaagctttagctgatttccttgccgagtggaccgagtgccaagaagacatgccagaggaaaagagggaatattggactatgcattttgatgggtcgaagaggcttacaggcactggagctggggttgttttaatctcccgacttgagaaagattgagctacgtattgtggatacatttttctgcgtcccataacgtggcggaatacgaggcgctactccatggattaaggattgccatctctctaggcattcgccgattaattgtccgaggggactctcagttggttgttaatcaagtcatgaaagagtggtcctatctagatgatactatgactgcttatcgacaagaggtacgcatgttggaagacaaattcgatggactcgagctcacccatgttctccgacataacaatgaggcagccgacaggctggccaattttggttcaaaacaggaagctgctccttcagatgtgttcgttgaacatctttacgaaccaaccgtgcccagaaaagagacaattgaagccatggatactcaaggcgtaagcatgatcgaagccgactggagagaaccgttcataaaatttttgagcaaacaagaacttcctcaagacaaaaatgaagccgagcagatttcccggcgcagcagactttacattattcatgaaactgatatgtacaagaaaaatccatcaggaatactgcaacgctgtgtgtctttggaagaaggaagacaattgttgaaggatatacattctggtatttgtggtaaccatgccgctgcatggactattgtcggcaaagcttaccggcaaggttttttctggcctacagctgtatctgatgctgacaagattgtgcggacgtgcgagggttgtcaattttttgccagacaaattcacataccagcccaagagttgcaaaccatcccattgtcctgaccgtttgcggtctgggggcttgacatggtcagcctgtttaaaagggcagtcgggggttacacgcatctctttatggctattgacaaattctccaaatggattgaggctaaaccggtcatcacgattacggcagataaagctagagattttttcattaacattgtgcatcggtttggggtacctaatcggatcatcactgataatggcactcaattcactggcggagcatttaaagacttttgtgaagacttcggtataaaaatttgctatgcctccgtggcacaccccatgagtaacggacaagtcgagcgtgctaatggcatgatacttcaagggataaaagcacgagttttcgaccgactacatccctatgctggcaagtgggtcaatcagctgccgtccgtactttagtctttacacactactcccagtcgggctaccggccagtcgccgttctttttggtttatggtgcagaagcaatgttgccagtgaagtggaatttgaatcactacgatttcggaacttcaacgaggagcgttatgaagagggccaagtagacgacatcaatcgattagaagaagcccgtgaagcagctttaattcagtcgactcggtatttgcaagggttgcgccgttatcataatcggaatgttcgatcgtgagcctttttagtcggcgacctggttctgaggaaaattcaaaccacacaggatcggcataaattatctcccttatgggcaggaccgttcataattgctgaagtcacttggccaggttcttatcgactcaagcgcgaagatggtactctcatcaacaattcttggaatattgaacaccttcgtcgattttatgcttag

SEQ ID NO: 45992 - DNA, 3785 bp, Oryza sativa
attatcaaaatcattgttatatcaatcagtatcagttttttcatcatcagacttatcagacccagtcggccgaaggtcgacttcttggaatctttcaaccacatcacagcaatcttgtcagcggctttctgcgcatcgttaatgaggtcaagagcagcttcttcgctcgtcccatctgcaaagccatcaatggcatccatatcaacccttggataaagggatttggtcatcgccaacgccagacttgctcccatacttccagcttctttgatgttcttgaaataagtatctggagcgactctcagcttgtcgaagattttggcagcatcaagtgtactcgaaccggcgttattgaagaacatggcccggatgagtggagtagcatcattagcgactttatccctggctccttcaagcttgttgatcttgtcaactaagacatcaaactgtgcttgagacttgatcttgcggtctgcatcaacagattcacattaatgaatcagcatatagaagataatggcttttgaggtattgattattggtaccttcaacctcctttaaagctgaatccctctatcttgccagctctgccttgtcattttccatagtttggatcttcttctctagttcagatatcttggcagcttgcagtacattaacttcggttaatcaagattacagagataacagcccaaatcagttgggcagagtttgcgcgaacctttggatgagccactcagtttataattggattcctggagctcagcaatccaatccctcaaatcgtgttcattctttctggcaagttctctggcctcgtgcagttgactcctggtggtttcgagggttccaagatgaggaactagtttctcaagggttgcggttttcgcctcgttcctaagatgaatcctctgcagagcagtttaatcagcgctcgagccagacggcaaacaagatggctgaggtcaggcatcaaggaacttacatttacaatgcgagtcgcttggttgagtgccttcttcattaggcagacctcttcgtcttctttttgccggtttattataattccttgaggttgcaagttgtcatcccaccacttgaccagaatgggagggcacgaatcttcggctgcttgtatacggggaatttcttcttcatcaccaatcattggtcctaatgtatctactgacaaaggttagacgattgatcagagttatttgggtcgacatggtttcagacaaagtgtttacccgtaatgatttctggacgaggacgagtggattcagatgcctttaaagtagatccagatctccggtcattgctggcgtcttgtccgcgagggttgtctgcttgggtttcaacttctggaatctcttggcttggccctgcgtccgacaggtttccagtcgggggctcctgattaactccagcttcggcttcggccgactggtttccagtcaggggttcgtcgctgggttctacattgtcgctggcctgcagattatcactcgggagatcttttgcagtcggcccggtttcttttgaggaacccgcctccatgttggtcgggtcagagtcttttctagatagatctatatcagatggtttcctgcaagtttgattgtcagtactattatcgcaatgggtgcgcatcaatgcaacggagatcgtaatatgagttgcacctagagttcttcctgatttttggcacaggacgactggatgttttcttccttggagtagcctgcttcggcagtttattggttgcctctcggtctccaagctttctagcagtgtcgcctttgtcgtcacttagaaccagcttcacataaagctagagattatcttccgtcacatcggagggcgcctactggctctcgaagctttctctctcttccgccatgaatgtggactggatggtttgatttggtctgagatacggctggaaaggaatggggaattggagtggtggatgccggcagaaattttgtggagtgtttgaggatggattggagcggattgctgaaccctagcttggccggcgcagtttgtactgtagcaggaaatggggaaaatggcgagagtctcggcggggatgacgaagagacgtttttcacttcggtgatattagggtatcgggagtgctagcaggcctgggccggcacagtacttcagcccaattttatttccagcgtggcccattgtgatccttagggacttaggcactttttgctttggcaatttgtgctcacaatgatgtggtccaatgctgttaaaaccctttttaatgcggtttgataattctttggaattaaaacgatgcaaacaaaaggtgcccgacagaaaggtgttataccgtttttgtaagccttataagctgcaaaagctgtttgggttgatttgagatgactggtttactaatagccattcttttagcatgtatatgcttattttggctatggaaagggtcacagcctaggctattagactcattaattaccgtgattttttatcatgtttggtgaatcattttaagagtttcttactcggattcctatcaaatatgtctatttttggatcttttgagtgtttatcacttggccctttcatgttttttatccttgatatgttcaaggagtgttgataaaaccactcggttcttgactacgtgtttagtttttcaactaatcacatagtcgggcgctacacctaattaggtgcatctactcgatgcaccatgttttattttcgcccttcgcagtctttgattttagcactcggcaaactggagcaagttgaattgaagcactcggattgctgttttttgtttcgagaaggctattttgtcaactgcgaaggtctcgggactactgtggagaatatggatatcccatatctacatgacagttataatttagtcggatatatggtaccaaatatagatagaatatctttatgaagactcgagttagttttttacttgtatgtcaaggaaatacccgagatcttagtcggttaggattgtattttatctataatcccatattccgttaggatatggactgtattttgtaaagcggactccttcccctatataaggagggtccgtgtgcctctcggggcgcaattcttttctccaatatatataatcaataacatactcggtggaatcatccccggacaggagtagggtattacttcttgaataagaagacctgaacctgtataaaattccttgtctccaaacccatccactttgctagcttgatagccacccccttttattattgccgaaatcttgtttcgacactccaatatgtctaaaaatcatgttttggtgctttttgaactttttcattccggtgaaaaacaacacacccacgtgtgccaatataggccaatattggcattaattgacaaaacttcaccgcgcgagtcacgagtgatttttcgacacggacgaacccaattctctatagtatgtccaaaaacatgtttgtgtgctttctgaactttttcattccggtgaaaaacatcgcacccacgtgtgccaatataggccaatattggcattatttgacaaaagttcgttgcgcgagtcacggagtgatttttcgacatgaacacacccaacatagttcaataagtccaaaaatcatgttttcgagctttttgaaatttttcattccggtgaaaaacatcgcacccacgtgtcgcaatatatgccaatattggcatcaatagacaaaagttcgtcgtgcgagtcatggagttatttttcgaca

SEQ ID NO: 45993 - DNA, 14536 bp, Oryza sativa
  unsure (1)..(14536): unsure at all n locations
ttttttgacacgnacgcacccaatacactccagtatgtccaaaaatcatgttttggtgctttttgaaatttttcattccggtaaaaaacatcgcacccacgtgggccaatataagccaactttggcattaattgacaaaagctggctgcgcgagtcacggagtgatttttcgacacggacgcatccaatacacttctatatgtccaaaaatcatgtttcggtgctttttgaactctttcattctagtgaaaaacatcacacccacgtgtggcaatatatgccaactttggcattaaatgacaaaagctggctgcgcgagttacggagtgttttttcgacacggactcatccaattctctacagtatgtccaaaaacatgtttcggtgctttctaaactttttcattccggtgaaatacatcgcacccacgtgtgctaatataggccaatattggcattaattgacaaaagttcgatgcgcgagtcacggagtgatttttcgacacggatgcaccgaatacactccagtttgtccaaaaatcatttttttgggtgctttttcaactttttcattccggtgaaaaatatcgcacccacttgtgccaatataggccaatattggcattaaatgacaaaagttcaccgcgcgaggcacggagtgatttttcgacacggacgcacccaatacactccaatatgttcaaaaattatgttttggtgcattttgaactttttcattcaagtgaaaaacatcgcacccacgtgtgccaatataggccaatattggcattaattgacaaaagttcaccgcgcgagtcacggtgtgagttttcgacacggattcacccaacatactccaatatgtccaaaaatcaagttttggtgatttttgaactttttcatttcggtgaaaaacatcgcacccacgtgtgccaatatttgcattaattgagaaaaataagccgcgcgaatcacggagtgatttttcgacacagactcacccaacatactccaatatgtccaaaaatcatgttttggtgatttttgaagtttttctcgcacacacgtgtaccaatataggccaatattgtcaccgcgcgagttacgtagtaatttttcgacatggacgcacccaataatctacagtatgtccaaaaaccatgttttggtgctttccgaacttttcattccggtgaaataaatcgcacccacgtgtgctaatataggccaatattggcattaattgacaaaagttcgctgcacgagtatcagagtgatttttcgacacggacgcacccaatacactccattatgtccaaaaatcattttttggtgctttttgaactttttcattctagtgaaaaacatcgcacccacgtgtgccaatatagactaatattggaattaattgacaaaactttgccgcgtgagtcacggagtgatttttcgacacggactcatccaatacactccaatatgttcaaaaattatgttttggtgctttttgaactttttcattcctatgaaaaacaacgcacccatgtgtggcaatacatgccaatattggcattaattgataaatgttcgccacgcgagtcacgcagtgacttttcgagatggacgcacccaatactctacagtatgtcgaaaaatcatgttttgatgctttttaatctttttcattctggtgaaaaacatcgcacccacgtgtgccaatataggcctggcattaattgacaaaagttcaccgcatgagtcacagagtgatttttcgacacagacgtatccaatatactccaatgtgtccaaaaatcatgttttggtggtttttgaactttttcattccggtgagaaaaattgcacccacgtgtggtaatataagccaatattggcactaattgtcaaaagttcgccgcgcgtgtcacaaactgatttttcgacacagacgcacccaatacactccaatatatctaaaaattatgttttgttgctttttggacttttcattccggtgaataacattaaaacattatatttgtaatattttttaaagaaaagacacttactgatctttatttcatgaaccatgcagacgactgaccacactttacctacacttttatgcaaactccgactactgactgactcactctatccttactagactcactggaccactcgacctcacaaaaggaaagagcagatgagaaaatcatagggctcttagtgtttccacttggcttatcctacgatcaaggccggctctaataccaacttgtcacgcccagaaattcgttaacccgaattttaagtagaatgtgtattaaatctccgtccaggaccagccagagtacacaaacaacaatttgatagacagatccacgtcttacaaaaataacaaaataaaactaacatacgcagcggaaaaacaaataaactagacttaatcttcacgaccaacgtgaagcttcctccatgttggcggctgttaaacaccgattctataccaccaacatctgcataaagttcagacaataaaacatccaacatagtgataggtgcttaatgtcacatattccacaagtgttggtgtatatttgtatgcaggtgtcaaaccccgaagttggagggaaatctagactaaagtgaggggaaaatttatctatacaaggatgggttgtgaacttcatcaaaatatcaaagacttagcccaaaactccgagaaatggataaaggaggacaaggggaggagatgggccgaaggccaggccaggtgggcccagcacaggtttgcccgaaccccttggttcggccgaaccaaaatctcagccattcaggctggggtttggcgtggacagtcctgatcatctcctgatgatggttgcggggcatttccgacaattcgcattgtgtaaccatcatacctacctctatataaggagcttcactccttcactctcacacacacttccaagcttgagctgaattataagaggctctattgtactatattgtatactagaataggaagagagtagagtagaagaagtcggaagaattctggagttgtcactaatcttctctcatttcttgtattctgttcattactctgatttcaatataatattcttcttgagtaacttagatttatcttataagaattaacctaaatagcatacgggattattgttcactataatcaactgaaatatagtgattgctttggtgagttataaacactgaagtagatattaattgcttagacgtggtgtttaggtaattgttatccagtaattgctgcgtatcccattgtacgtttgaggtaggtgtagaggtggtgacagccctcgagatcacttaagtcctccctgttcgggtacgtaatagagcgacatctgggaacagtgagttaccagtgcctgaagtattgctttaggattaaacttaagctttccctagacactgtttcttaccagtgaatcctctctatcctagcctatcctttgcttggtgtccttggatgaaccggaagaagaactgaccacacatgttcccttggatttgataccctttggaatactccgtaggggaagtgctacatcggtatatccgtgtgcttgcggattttatctgtgatcgtaagaattaccaacactccataaaacacaggcaatcctcgacgcccagaacaagctcggtcctcaaagaactcaccacccgaaccaatctctgcttcgaagggggtggggaggaaataaagcaagactgagtaccaaccaccataaaaatagcattggatatttgcggtaaaagcagcatttataaatcatattttgaaatagtaaaaacaatatataattaagcagtattaaatcatcactatctaacgctaaatccacggtgcaacacgcccaaccaaaaccacctaaacaactccagttctataagtcaaattattattgtgggactaatcacaatgagctggttgaccgcccaataactgcgggcatggctattccaatagttggggggcatgtgttaacgaccaaatttggtaatgccatgagccggattcaaagctagagtcaaagccgatttggcgagattccatttgagaaggtagaatacgcattggctaagaacagcatcagctgccacatgatcggctacaggcaatattggctgcgcatattggctagcgccaaatccgcggaatcaagccgatgcaaccagtctcgaaaatgatggtcccacgttggtcatcagggttagccaaagcacttcatagccattgccacacaaggattggagtcctaaaaaggggcaattgtatctattaattaggatattttttcagtttccttagagatatgtttggtaagagcccacctaggggactcattcgtattttaaattatattagagacaagaggcgtgtccggcaaggacacattatgtacttcgggtattaatatgacctgacaccatgtaatcaagggatgacagttcaataatactttggtgcatcaccacccttttctgttgttattgtttcgacgagtttttgctttcaagttgggctacatcaggttcgatcttcgacgaaaaggtaaagcttgttatgacagtctgcgttgttgggattagtgcttacatcgctatgacactctaatcctgtctacgtgaatcgctgaattatcatatataccgcataatctagattgatctcgtcatctaaccccatcggccagcctctatcatcgaaaacggccgataggtttagatgtcgatgtcagcctagattatgcggtgtatctaccatcttgaatgagttttcatctatttgcttagatcttatgtttcttttcacgcttaacacggcatcggttaggttcgacctgttaagtattgtcttgaaatgtgttatctagctctttctttgaatgctaatatagatagcatcagggtttcagccgatcttacctgatttagccgtcttgttcccctacttggttctggatcgtctaaatctgccctttatatcaagatctcatccgtttaaagtatattaagcttcctatcagtctgctagtttccctgcttggtagattgatctcggttttgtatatttcacctgtgctaatatctaggtataaggtggtatcggactactagctgatacatgttaggtttgccctatcggctatgctgcgagcatacataatccctactgtggggcacatttagatactgagtgatttatactgtctcggcataatgtccgatctatcccaatcactcgatctaagcacgttccattggatggattacgtatcatctacagccgatcgagtaggcctaataatctctaagttttatctacctttgctgatctgatgcaagttatatcagcttgcctttgctgatctatcgttgatggatttaactctttgtcttttttctatcttgttggttgcaggatcaaaccagctggcacgctcagaacccaaaggcaatctctttggacctgcactagagttaagcagatctcttaggccagtgcgtgttttttgcgtcaacagaggtgtacaactttacccacaagacacgattccacacatgttaccatgccctgaagtaccgccacgatactacaaaggtggaaatcgtgacaaaacccgccgtacaaccctccctaaccaaacatacccacctcaggtttcaccccctccttgtgccaagttgggcagtcccttctcgcgcctaggtaaatccagctacagcagagaccaatatcaaggtccgaactgcaccatcgcctctacctttgccatggtatgtcagctaggttaagttatactgtagatttagcctggagtcaacatatggtaacggtcggaaaacgtcaagtgcgattttcactcggagtcgacatatggcaaatccgaaacattaccaaatatttcagaattggggggcatatgttaacaaccaaatttggtaatatcagtgttgggaaataagattagatcaaagcggaatccaagacgaagatcgttacggaaacagagcaagaatcggctatgatccaaattggctacagacaggattggcagagttcgagtcgaacagggttagccgatacagccgattctaacaatatggctcggtatacgtcatcaggttgaattaatgtgcttcatatggattgccacacgtggattgagtcctaagaaggcaattgtatctattaattaggatattttatgtaatttccttagagataagtgtgggcaaaagtctgccgcaaagacttatggtatcttagagtttgttagagatgagagtcgtgtccgacaaggacatattttgtaatctcgggtataaatagaccccgagccctatgtaatcaattaacacacgttcaaatacaatctcggcgcatcgccaccttttactttcgttttgtttcgacgagttcttgctttcgagttgagctgcatcggtttcgatcttcaactagaggtacgacttgttatggcggcttgcgttcttgggattagtgcttgcatcattatgacactctaatcttgtgcatgtaagttgtcgagttatcatatattctatataatctccggcaacattgttacctaacctctaataggctaacatctgttactgggaggcagccgatcaggttaattaccgatgttgatctagattatatagaatatccaccactctacgaaacttccaatggcttgattgtctagatattgtgtttcttttcatacttatggctgcatcagttaggtttgacctcataagtcgtgcttagaactataatctctagcctgcttcttggttgtcgattagagtagtatcggggttttagccgatcttacctgatttagccttatatttcatgtgcttaattgatatgctaaatctgccctttatattgagatcttattgctttttttagatatgttaagctttttgtttgatatattttactcgctttaatatcttaatatagagtggtatcggtgtattagccgatacgcgctagatctatctaatcggttatgctgtgaacatctataatctcattgttaatatatatttcgatctaagtgatttatactgtctcggcatggcgaccgatctatcccaatcacttgatttaagtatatatcgacataaaaattatgcattgttaacgtctatacccgatcgagtagatttagttttaattacttatttataactgccgatcgattcacatatgacatcggctcgaagataaatgatatgtcatcggcggctggctaatcggctatcattatggatttaactactgtttctttgtctttatttcttgttcagccgaactggcccctagtattattgttccaatcacattggataaattgacgactgagcaaagggatgagctcgagcagatgatgagcaatgtaaaggatcagttcatgaattctttccaagaaacccgcagaggaaccatcgtccagaagtacaagctgaaggtagttgcagccgatgaagctggttcgggttcatctcaaggtgacaaaggtgatgttcctcaagatggcactgttgaagattttggtgcagatggcaaccaagagccgttgcagtttaacaattttcaggataggatcgactatgccgtgcaacatgccttgattaaccaatctggagtgttagttaataccttaaccaacatggtgaagactgttgtcgatggttcgatagccgagcactagcctcaggaccagtttatctaccaggaggtatttttccaaattatagacctttggtcacagctaatcagctgaacgcctccaatgcactgccagctcagcccacggctccagtctcaactactgtacaagctacatcatcaccaccaagacagatggttaaccccagattgttgaccagagaacagccacaacatcctgggcaaaatgtcaatcggctgactcaggagcaagttgctgcgatgtttttgccaaatccgacaatagccgatccaacacagccccaaccgactcagcaagtacaaccgaggcagtagacagttcagccgactcagcaacagaacgtgcagcatccgtcgacaaggttgagaacacctgacaatcggctagtgcaacatacggtgcaccaagtaattcctaaacacttggttcatcacgcacaggccgatcaatcagttatgcctcagattatccctgaacatttggtgcataatatccagccgaatatctagaattatcaaggaggaaatctaggttatcaatatcagcctccgtcacctcatgttcagtatcagcagacaggatcgcctcagcctcagcacgctcctcaatttaatcagtttgagccgatgcagcaacaaatgcaaggagtaccttagcaaacgtcatgggctgatatgctcgcagatgtaatgagggaaccatttgtatcggcatccttatcctgagtggtttgagaggtttccattgcctagccatacaaagtacccgacttctcaaaattctcagggcaggatgatgtttcaacttatgaacatgttagccgattcttggctcagtatggtgaggcatcggctgctgacgccttgagagttaggttgtttcctttgtcttcgtcaggatcagcatttacatggttttcttccttgccatataattctgttaatagttgagctgatttggagaagcaatttcatagctatttttatagtggaattcatgagatgaaaatgtttgatttaacagcaattagacaaaggcatgatgagtccgtacaagattacattcaaagattcagggagatgtgaaactgatgctatagtttatctttgacagattctcagctagccgatttagcttttcaggggttgatagcaccgatcaaagaaaagttttcggctcaagattttgagagtttatcacatctcacacaaaaggtgactcttcatgagcagaggtttgctaaggccaagaagaacttcaaaaagattaatcatgtatatccttacatgtatggttctgatgatgaagacgatgattccgaggtggcggcagccgaatgggtcaagagcaagaaagtaataccatgccaatgggtgaaaagttctggaaaagaggaaaaatttgacttcgacatcaccaaggatgacaagattttcgacctattgcttcgagaaaaacaaattcagcttccggctggtcatgtgatcccatcagccgaagagctgggcaaaagaaggtattgcaagtggcataattctagttcccattcaactaataattgcaaggtttttaggcagcaaatccaggcagccattgaagggggaaagatcaaatttgatgattcaaagaagcagatgaaggttgatggtaatcctttccctattaataaggtgcatacatctagaaggacagccgatggggggatgaatagaaattttcacatgaattcgactaggattatcaacaaataccaaagaaagtatgataaacagcatgagaaatatcatgaaaaagatgatggttttgaccctcattgggattgtgagtttttcagattttgctggaatgaaggtatgaggttgccatcgattgagaattgccctggatgcagtgaagatacagggagttcaagccgatcctataatagaggtaatcggccaaatcagaagagagtacctgttcatcaaaggctgggcctggtaaatcaagatcattatcaagataaagatgaaaataggaatacacagtggtgtacctacaggcattttcaccaagaatcaaaagagaagggttcaaaggttgaggaacagggagcaatttcagagggtgcatcaagagattaatcatcggctgaggaaaacaaagactaagcaagaatggcgtgttaaaagtacagttgtatcagccgatgaggtcgaagccgaaaaggcaaaaagggtgctcaaaggcaaggctcttgcatcggcatcagtaaatatggtttttatgctaccggccgaatttgaagctaggcaagccgatgttgatgatgttgaggaagcttcagctaagttagttttgtcaccagagcaggcggtctttgagaagccagaggggatagaaaattggcatctcaagccattgtatatcaatgggtttgtcaatgggaagccaatttctaaaatgatggtcgatggaggagctgctgtgaatttgatgccatatgccacactcaggaagttgggcagaaatccagatgatctcatcaagactaatatgattctcaaggattttggtggcaatccatcggaaaccaaaggagttttaaatgtggagctgacagtcggcagtaaaactgttcctacaacattttttgtcatcgatgggaagggtttctataacctgttgctcggaaaggattagattcatgctaattgttgtattccttcaaccatgcattagtgtttgattgaatggcaaggtgacaaaattaaaattgtaccagctgacaggtcagttaatgttgctaatgccgatttagctctttgggatatggacggtattgattgcttgtctggataagtttgggatggagattttctaaaagtgtccgattctgatatacagccgattgaagatgcagagcccaaattgttattttgagggcgtcgtggagggttcaaatgtctacaccaaggatgcagtagatgatctcgatgacaaacaagggcaaggttttatgtcggctgatgatttggaggaaattgacataggtccaggagatcgaccaaggccaacatttatcagtaagaatttatcttccggatttagaaccaagttaatagaacttttgaaagaatacagagatttctttgcttgggaatatcatgagatgccaagactcagccgatcgattgttgaacatcggctacctataaagctcggggttaggccatatcagcagccaccaaggagatgtaaagccgatatgcttgtggctgttaaggctgaagttgcacgcttgtatgatgctgggtttattcgtccatgtcgatatgctgagtggatttctaatatagttccagtcatcaagaaaaacgacaaagttagggtgtgcattgatttccgggatttaaataaagctaccccaaaggatgagtacccgatgccagtagccgatcagttggttgatgccgcttcaggacacaagattttgagttttatggatggcaatgcaggttacaatcggatcttcattaccgaagaagacattcataagacagccttccgatgtcctggtgcaatcggcttgtttgagtgggttgtgatgactttcggcttgaagagtgctggagctacgtatcagcgagctatgaattacatattccatgatctgatcggctggttagttgaggtttatattgatgacgtggttgtcaagtcacgggaagtagagaaccacatagccgatttgaggaaggtttttgagaggactagaaagtatggcttaaaaatgaacccgacaaagtgtgcctttggcatatcggctggtcagtttttgggatttcttgttcatgagagggggattgtggtgactcaaatgagtattaatgcgatcaagaatattcagcctctggaagataagacaaagttgcaggagctgatcggcaaaaataaattttgttagaaggtttatttctaacctatcagggagattagagccttttacgcctttgttgagattaaaagtcgatcagaagttcacttggggtgtagaacaacagaaagctttggatagtatcaaggaatatcttagttctccaccagttcttattcctccacaaaagggggtgcctttcagattatatctattggctggtgataagtagattggttcagttttgattcaggagtttgaagggaaagagagagttgttttttatttaagtcgacggctcttggatgcagaaacgaggtattctcctgtggaaaagttgtgcttgtgtttatatttctcttgtaccaagttaaggcactatctattgtcaaatgaatgcattgtgatatgtaaggccgatgtggtgaaatacatgctatcggctctgattttcaaaggaagggttggcaagtggatatttgctttgacagaatttgatcttcgatatgagtcaccaaaggcgattaagggacaagctatagccgattttattgtggatcatcgagatgactcaatcgactcggtagaaattgtgccatggactttattctttgatggattggtatgcactcatggttgtggtattggcttggtcataatttctcctcgaggggcaagttttgagtttgcctgcactattaaaccttatgcgactaacaatcaggctgagtatgaagctgttctcaaaggattgcaattgcttaaggaagttgaagccgacgctatcgaaatcatgggtgattccttattggtaatcagtcaattggcaggagaatatgaatccaagaatgatacattgatggtttacaatgagaagtgccgagaattaatgagtggatttcggctggtaactttgaaacatgtgtcaagagagcaaaacattgaagctaatgatttggctcaaggggcatcgggatataagccgatgttgagagatgttgagatagaggttgctacgattacagccgatgattggagatatgatgtatttcagtatttgcgaaatccgtctcaattggcttcaagaaaattacgaaataaagctttgaaatacaccctgttggatgatgagttgtattaccggatgattgatggggtgttactcaagtgtttgagtgccgatcaagccaaggctgcaatcggcgaagtacatgaaggaatctgtggaactcatcaatcagctcacaagatgaagtggttacttcggcgtgtggggtatttttggccaacaatgttggaagattatttcagatattataaaaggtgtcaagattgtcaaaagtttagggcaattcagagggcaccagcatcagctatgaatcctattattaagccatggccatttagaggatggggtatggatatgatcggccaaatcaatccaccttcaagcaaggggcataagttcatactcgttgcgaccgattatttcaccaagtgggtagaggctattccattgaagaaagttgattcaggggatgctattcagtttgttaaggaacatatcatctaccgatttggcattcctcagacgattacaactgatcaaggttcgatatttgtgtctgatgagtttgttcggtttgccgatagcatgggtatcaagttttcttctccatattatgcacaagccaatgggcaagccgaagcatctaacaaaagtttgatcaagttgattaaaagaaagatttctgattatcctcggcaatggcatactcgattggctgaagcattatggtcttatcggatggcttgtcatggatcgattcaagtttctccctataagcttgtttatgggcatgaagctgttttaccatgggaagtgagaatcggctcaagaagaacagatttacaggatggattgacagtcgatgagtattacaatctcatggtcgatgaacgggaggacctggttcaatcaagattgcgggctcttgaaaaagttacttaggataaagagagggttgctcgacattataacaagaaggtggtgcctaaatatttttcagaaggagagcttgtttggaagttgatcttgccgataggaacttgtgataataaattcggcaagtggtcgccaaattgggaaggactgtttcaaatccacaatgttgtgtccaagggagcttatatgttgcaaagacttgatggggaagtttatggacgggcccttaatggcaaatacttgaagaaatattacccaagtgtatgggttaattcatgatcggctgaatttgccgatgcatgtagagccgatgtgtttgcatcgccttgagatggccgatatagtaatatcgcccttagctgttttatcttcataatcggctgtgttttgccggtgtatgatggccgatatggttatatcgcccacagactaatttataattttatcaatgtcttcgtcattacaaaattagggggggcatatatatatacaaagttggatatttttgaaatttttgaggcaaattcagaagttatgttaatcggcataaaggattatcaaagcagttacttagttggtgaagtaccaaaatatcttagccaattacaagaattttctaagccctattacatggatagtcattgagacaaatattactgaatagccgatatagccctttgcctaatttgctttacttcttctatggcttgggcgtcttgagcatcggttccagggatgactttgagggacttagtcatatcggcaatattcctgatagccgatttcagcctcaacttctgctcttcaatagcctttggtaggt

SEQ ID NO: 45994 - DNA, 889 bp, Oryza sativa
ggtatgacttgctgagtacggtggttgtactcaggcttgctctattttccccaaaccccagagtttgagtatgcgtcagatggtggtttctccgaggaataggcttcgttcgtgccgtcgaggatgcctgtggagtggtgttcccgctgcagtccaagtcaaggtttagctctagttatcttttatttttccgttgcatttatgtaaaacttttataatgtttgtaagacgtagatttgtatgtcaactttgtcgtttgtgtaccccggccggtcctggacggggattttaatgcacattctgcttggaattctattcgggaatttctgggcgtgacaatgagtccgtgtcgaaaaatcactccgtgactcgcgcggtgaacttttgtcaattaatgccaatattagcctatattggcacacgtgggtgcgatatatttcaccgaaatgaaaaagtttagaaagcaccaaaacatgtttttggacatactgtagagaattgggtgcgtccgtgtcgaaaaattactccgtgactcaagcggcgaagttttgttaattaatgccaatattggcctatgttggcacacgtgggtgcgatgtttttcaccggaatgaagaacttcaaaaagcagcaaaacatgatttttggacatattggagtatggtgggtgagtccgtgtcgaaaaatcactccgtgactcgcgcgacgaacttttgtcaattaatgccaacattggcttatattggcacacgtgggtgagttgtttttcatcggaatgaaaaagttcaaaaagtactgatttttggacatattggagtgtcttgggtgcgtccgtgtcgaaaaatcactctgtgactcgcgcagtgaacttttatcactgaatgccaat

SEQ ID NO: 45995 - DNA, 2751 bp, Oryza sativa
attgaagtttcttgggtgcgtccgtgtcgaaaattcactctgtgactcgcgcagtgaacttttatcacttaatgccaatattggcctatattagcacacgcggctgcgatatatttcaccggaatgaaaaggttcagaaagcaccaaaacatatttttgggcatactgtagagaattaggtgcgtccgtgtcaaaaaattactccgtgactcacgcggcgaagttttgacaattaatgtcaatattggcctatgttggcacacgtgggtgcaatgtttttcaccggaaaaaaaaacttcaaaaagcagcaaaacatgatttttggacatattggagtatgttgggtgagtccgtgttgaaaaatcactccgtgactcgcgcggcgaacttttgtcaattaatgccagtattggcatatattgccacacgtgggtgcgatgtttttcaccggaatgaagaacttcaaaaagcaccaaaacatgatttttggacatattggagtatgttgggtgagtccgtgtcgaaaaatcactccgtgactcgcgcggcgaacttttgtcaattaatgccaatattggcctatattgggacgcgtgggtgcgatgttttgcaccggaatgaaaaacttcaaaagccaccaaaacacgagttttggacatattggagtatggtgggagagtccgtgtcgaaaaatcactccgtgactcgcgcgacgaacttttgtcaattaatgccaacattggcttatattgacacacgtgggtgagttgtttttcaccggaatgaaaaagttcaaaaagaactgatttttggacatattggagtgtcttgggtgagtccgtgtcgaaaaatcactccgtgactcgcgcagtgaacttttatcacttaatgccaatattggcctatattagcacacgcgggtgcaatgtttttcaccggaatgaagaactttaaaaagcagcaaaacatgatttttggacatattggagtatgttgggtgagtccgtgtcgaaaaatcactccgtgactcgcgcggcgaacttttgtcaattaatgccaatattggcctatgttgggacacgtgggtgcgatgttttgcaccggaatgaaaaagttcaaaaagcaccaaaacactagttttggacatattggagtatggtaggtgagtccatgtcgaaaaattactccgtaactcgcgcagcgaacttttgtcacttaatgccaaattgtcctatattagcacacgtggttgcgatgtatttcaccggaatgaaaaagttcagaaagcaccgaaacataattttggacatactgtagagaattgggtgcgtccgtgtcgaaaaattactccgtgactcacgcggcgaacttttgtaaattaatgccagtattgggatatattgctacacatgggtgcgatgtttttcaccggaatgaagaacttcaaaaagcagcaaaacatgtttttggacatattggagtatgttgggtgagtccgtgtcgaaaaatcactccgtgactcgcacggcgaacttttgtcaattaatgccaacattggcctatattggcatacgtgggtgagttgtttttcaccggaatgaaaaatttcataaagcattgatttttggacatattggagtgtactgggtgcgtccgtgtcgaaaaatcactccgtgactcacgcggcgaagttttgtcacttaatgccaatattggcctatattagcagacgtgggtgcgatgtatttcatcggaatgaaaatgtttagaaagcaccaaaacatgtttttggacatactgaagagaattgggtgcgtctatgtcgaaaaattcctcagtgactcacgcggcgaagttttgtcaattaatgccaatattggcatatattagcacacgtgggtgcgatgtttttcaccggaatgaaaaacttcaaaaagcaccaaaacgtgatttttggacatattggagtatgttgggtcagtccgtgtcaaaaaatcactccgtgactcgcgcgacgaactgtcaaaaatgaatgccaatattggcatatattgccacacgtgggtgcgatgtatttcaccggaacgaaaaagcaccaaaacatggtttttgtacgtactgtagagcattgggagcgtccgtatccaaaaatcactctgtgactcgcacggcgaacttttgtcaattaatccaaatattggcctatattggcacacgtgggtgttttcaccgaaatgaaaatcttcacaaagcagcaaaacatgatttttggacatattggcgtatgttgggtgagttcgtgtcgaaaaatcacttcgtgactcgagaggcgaaaacttttgtcaattaatgccaaattggcctatattggcacacgtgggtgcgatgtttttcaccggaatgaaaaagttcaaaaagcaccaagacatgatttttagatatattggagtgtatgggtgcgcccgtgtcaaaaaatcactccgtgactcgcgctgcgaaattttgtcaattaataccaaagttggcctatattggccaacgtgggtgcgatgtttttcaccggaatgaaagagttcaaaaattaccaaaacacgactttggacagaaggagtgtattgggtgcgtccgtatcgaaaaatcactgcgtgacttgcgcggcgaacttttgtcttgccaaagttggcgtatattggcacacgttggtgcgatgtttttccccgtaatgaaaatgttcaaaaagcagcaaaacat

SEQ ID NO: 45996 - DNA, 15574 bp, Oryza sativa
  unsure (1)..(15574): unsure at all n locations
agttcaaaaagcagcaaaaaatgattttttttgacatattggagtgtattgggtgcatccgtatcgaaaaatcactccatgactcgcgcggcaaacttttgtcagttaatgccaatattgtcctatatgggcacacgtgggtgcgatgtttttcaccggaatgaaaaacttcaaaaagcaccaaacttgattttttgacatattggagtgtattgggtgcgtccgtgtcgaaaaatcactccgtgactcgcgtggcgaacttttgttaattaacgccaatactgtcctatattggcacacgttggtgcgatgtttttcaccggaattaaaaagttcaaaaagcagcaaaacatgattttttgacatattggagtgtattggcttcgtccgtgtcaaaaaatcactacgtgactcgcgcggtgaacttttgtcaattaatgccaatattggcatatattgacacacgtggatgcgttgtttttgaccggaatgaataagttcaaaagcaccaaaacatgatttttggacatatttgagtgtattgggtgcgtccgtgtcgataaatcactccgtgattcgcgcggcgaacttttgtcaattaatgccaatattgtcctgtattggcacaggtgggtgtgatgtttttgacgggaatgaaaatgttcaaaaagcaccaaaacatgatttttggatatattggagtgtattgggtgcgttcgtggcaaaacaatcacttcgtgattcgcgcgccaatattggcaaacttgggtgcgatgtttttgaccagaatgaaaaagttcataaagcaccaaaacatgatttttggacatattggagtatatcgggtgcgttcgtggcaaaaacatcacttcgtgattcgcgcaccaatattggcacacgtgggtgcgatgtttttgaccagaataaaaagttcaaaaatcatcaaaacatgattttgggacatatttgagtgtattggttgcgtgattttgggaaatattcgaaaaatcactctgtgactcgtgcggcgaacttttgtcaattaatgccaatattgtcctagattggcccacgtgggtgcgatgtttttgaccggaatgaaaaattcaaaaagcaccaaaatatgattttaggaaatattggagcgtattgggtgcgttcgttgcataaaatcactctgtgactcgcgcgacgaacttttgtcaattaatgtcaatattcgcctatattggcacacgtgggtgcgatgttttcgaccgaaagacaaagttcgaaaatcaccgaatcaagatttttggacatattggagtgtattgggtgcgttggtggcgaaaaaaaacttcgtgattcgcgtggcgaacttttgtcaattaatgccaaaattggcacatgtgggtgtgatgtttttcactggaatgaaaaagttaaaaaagcacccaaacatgagttttggacatattggagtgtgttgggtgcgtgcgtgtcgaaaaaccactccgggactcacacggcgatcttttgtcaactaatgccaatattgtcctgcattagctgtaacaccctgaaaattcaagacaagaaaaatcactaaaattttgaactttttaaaacttttgcatcatgttggatgttgtggttgcttttacttgccgagctataaattgtcacaatggaaaatttaactaaagttatacaactgagtaataattataacaataagatatttatcatgaaccctataaatatttacgcacaagaaagcaaagtcagacaaaaggaaggttaattactaatttaacttatggatcaaatattaaataccgaaccatgtgatgcgtgccatgaaatataaacacttaggaaattataatcgttcagatcaatggaactctatctatagaatagatttactgggaaaaattaatctgatattatataatttgaattgaatcacgaatgctaaattatagaaatccatgtggtggtaaaaaccaatcaaaaagataaaccaatatgtgtgaaaacggataaataccaaaatcccaaatataggaaaacaggaaaaattagaaaaatacataataaaaataaaatgtgggcaatattaagtttgaatacaaatttacatttgaataacttagattttgtgtgaaacacattgtgacaaaataggtggcaatagtccattttctaaattagaaaaacatctaataaaatccaataaatcagttaacactgttcattgccccctaggtgcttgaccctgtcccatcgccgcgcctagccctgcccctactctgccgcgccacgcctagccctgctgcgccactgccttgtgccccgcgccgccgcacgccgtcatgtcgccgtcgccccgacgcgctgtgcgccatcggttcgcactgcgcgcgccgctgccgtgccccctcgcgtcccgtcgtgccgcgcgccgtcgccgtcgttggtcgcatcgtctcgagccccactcctccgcgcgtgccttcaccgtcgcgtcatcatcatcgtcgcgtgtcgccatcacctcgagccccgcgccgctcgtgtcgccgtcgcccgtgccgcgccgagccccgcgccgctgccgcgccgtcgtcgtcgcccgtcgcgtcgcccttgagccccgcgcccccataccaccgagtcatgcgcgtgcgccgcacgaacgtcgcgtcaccgtggtagtcgtgctgcaatcgccatcgcgccgatgcatcgccgcctgtcgccctagcgactgcgcaccaccgcatcgcccatcccgtcgccgtgcatccgttgccgcgccccctagagtcccgtcgcgccacgcgcagtcgctgtcgccgttgcgtcggctccactgccgcaccgcgcgccatcgccatcagcgcctcgagacccacacgcgctgcgcactgtcgctgtcatcattaggcaccgcccaacccctccgcctatataaacccccccgggcgcccattgcttcccacaccaccctcaccacctcccctccctttcccctctctttcccgtccccggcatcgccgcctctttggaagccaccgccgccgctgagccgacatgccccgccgccgcgctgtgcctcgtcgccacgccgtgctccaacgtcgacccctccgctgcgtctccgttgaccccgccgtcagtccggtgagccttcccctcccccaccgcttgacgtcgcgccgcgccgcccgccggttccagccgagccgcgagagagagaggaagcaaagaggttgcgcagagagagagaagagaaaggagaggagagaggttagagtgggccccacgtgattagtaaatagtaatccccttcttaatctttataagttaagtctattacatgtgggtccgagtggttaaaaatctagttatggagggtttataattttgagtctatgacaagcgggccctaccaggtttaatggccggtttgaccctagtcaaaggagtcgggcccacctgtcatttgcccatatggattcctttagaaagaaaaataaaataaaagaaaagaaaataggaagaccgcacctgtcaggcactatagcttgtggataaggttgtattaaaaataaatgaattaggaacagtacaatttcgcaattattagatttaattcaaatttgaatctttacactagcataacttattcattttagctccgatttgagtgaaacttgaatctaaattcatctaaattcataagctttccaatggtatataattcactatttgataaaatatatttataattattaaataattaatatcaagatgatgcataatagttaacttaaaaatgtgccaataaataaaattgatattgtactgtaaagtagatgtcaaataattgtctttaacacgctttctcactgtaaaacctatgtaaactaatgaggagcattgtttcaaattaattaaagcataggaaatactagtgccatttgttaatatatgtcaatatataattatactcatgacgtccaaattgtataaataatgtttagcctcatactttgtgactaaaattttaacacacgtagatgagtctttaacttatttatgagagataataacagagctagtgtgactaaaatcacccgcacgaaattaattaacggcatttcctatacagtagtatatgtttaggttggaaatcgacccttaagttgtatagacggtaactcactcataaatccacttaaaatcacatgtactgtgtagcttgtagtaaatagcaactattcaaataaatgattcaatattaagatattgtgcacacacctatactgtacatcccattatagctatacggtataatattaatttgcttgttgcatatattaaattagagggactatatgacaaacatgaatattagataaatactagttataaatcttgacctcatataattatagttcaattgtaaattaggattattcattgtaaaattatgtgatgggataatctgtaaccataatatgattatcctaaacaactctaacatacaaagcatggataattattaaccttttataatttattgtgacaagtaaaatattttcataattaaagaaaagcctccatcaataaaataataatacaaatggttccctgtgattaattgcttgatcccaaatccatccgacgacaacagaacctctagtatatatatgaccattttatttagatagatgcatgtgtagccataatccttccatagccattagctagactaaaccacatattagccaaatgtgtatctcatttatactatgtcggctagctccccataaaccaccatgacaacagaaagattaagaaactttagcccttagcatgattggaatcccctagcaaacaataatagtacgagcaaccctaggtacgaccaacaagtacattttgttgtgcatatttgattgttgtttgaatattggtttttctcgtgtattgtagacattgtatatcggttagtcgtgaggcaatgtatgcaacttctaggaggtgaaggttgatcaagattgtatcaagaataaggactatcctgagcaggcaagtcatcactattccttgaacatgttgatcccaattgcaaaattgttttgtttacaaataaaattgcaagcaatgataaacatcctacttgtgattacgccatgccttgattattgtttacccttaaaatccttgtaaccacgattacgtatgagtccctagtcaattatgacaattgcttagaaatgctattctagaatcatgcatactcatatttatcaaatgctatatgcttgggcaattacctttgggaaggtaattgagatgcggcatgtggagacatgagcaccacattgccatgatattgatgacatgatttgtgaaaggagaaataaaactaaacaacagttttcgactggggcggacggaggatttgggtggtatcttgaaaaggctagtaccgtcccctgtcaattaaggactgagccatgaagttaagcttgaaacgacccccgtacaaccgtacttctcgaatgggtatagacctagcggattagatagccgagtggaggcagtatcccttcatagatggttcacccctgagtgaggcaggtgcggtacggtggggcagccgttgaggtagggccgcaaggcgtgccctacatcagtgtcgccatttgtaggactaccatgagagtgtgagagagaacttaatgtgtgtgtgagacttcttccccgggagcgccagaactcctctcactgctagaaacatggatgcctgagtgcatgaggaagtaagttcgtggagcgggtactgccaatgcgaggttatcgaaaggctttgccgtgacgcgtctcatgtgttgggacgaggctcatgtgttgggcagtcgctgagtgcgggtaaagtgtacatccactgcagtgtgagtaaaccaaatctattcgaatagccgtgctcgcggttattgagcaccgggacgtgtattacacttggctagactctaaattcttaacttgtgtgggatgggatattgcataatgatttttatgctgatggagccacttcctgagaagagtgaaggtggtcgtcctcagaaaaccatgacgactcaatggcgggaagctatccttgggatcacaatggatggtagacagaaccgtcgttgtttaatgagaacattggtactaaaatttgatcagtctatgctagatcttaggcttgtgaaaagatttgcaaaacttgctttacgcaaaagaacctgaagccgttccttgaaataccctctatcatatgcattgttgctgtggtggcttgctgagtacggttggtactcacccttgctatttatatatcttttaggagagtgttaaagagaatcccttgtcggtacgcttgcgtatccaacaagatgattggagtgcggtcttgttctaggtctcgttccccagtcgactacctgtagcatgttaaccgggcccttatattattttgtcttccgttgttgttctctgatatttgttggcctacttggccctaattgttaacaaccaaatttggtaacctcagtatcggaaatgaagattggatcgaaacagaatcaaatacgagtatcatttcggaaacagagcaagaatcggatggagtccaaatcggctatgaccagatcggctgagtccgaatcagatagggttagccgatacagccgattccggcaatatgacttggtttacatcatcaggctgagttaatgtgcttcgtgtggattgccacacatggatagagtcctaagaaggcaattgtatctattaattaggatattttatgtaatttccttagagataagtgtgggcaaaagtctgccgcaaagacttatggtatcttagaattttgtagagataagagtcgtgtccgacaaggacatattttgtaatcttgggtataactagaccccgagccccatgtaataagggagacagacgttcanatacaatctcggcgcatcgcccatcgccaccctttgctttcgttttatttcgacgagttcttgctttcgaggtgagctgcatcggtttcgatcttcactagagggtatgacttgctatgcagcttgcgtttctcgggattagtgcttccatcattatgatactctaatcttgtctatgtaagttgtcgagttatcatatatcctatataatctctgacaatatcgctttctaacctccaattggctaatatctatcgctagggagcagccgattaggttaaatatcgatgttggcttagattatataagatattcaccactctatgaagctcccaatagcttgattgtctagatattgtatttcttttcgtacttatggctgcatcagttgagtttgatctgatgagtcatgcttagaactataatctcgagcctgcttcttggttgtcgattagagtagtatcggggtttcagccgatcttaactgatttagctctatatttatttcatgtgctcaagtgaaacgatagatctgccctttatattaagatcttattgcttttagatatgttaagcttcttgtttgatatattttactcgctttaatatcttagtttagagtggtatcggagtattagctgatacatgctagatctatcttatcggctatgctgtgaacatatataatctcattattaatataagtttagatctaagtgatttatactatctcggcatggcgaccgatctatcccaatcacttgatttaagtatatattgacataaggattatatattgttaatgactacagccgatcgaatagatttagaccttccttatttattcatgactgtcgatcgatgcaaagatgacatgggcccaaagataaatgatacgtcatcggcgattggccgatcggctatcatttatggattaactacggtttctttgtctttatttcttgttgattacaggatcaaatcaactggcacactcacgaacctaaaaaggtgagattttggaccttcactggagttaagcagatctcccaggccggtgtgttcgattttttcgtcaacacgctcttggcacgcccggtgggacccgagttttcaacgacttcatcacgatggctgaaaaaccaccaccgtcaccggggacaggagtcaaacctcctgtaaataaaacaggagccaaaaatccatcagctgaagtggacccaaccaacattgttccaatcatattggataggctgacggctgagtagagggatgaacttgaacagatgatgagcaacgtgaagagcaagttcatggattcttttcaggatcgcagaggaaccattgtacagaagtacaagctgaaggtggttgcagccgatgaggtcggcttgagttcatctcagggtgacaaaggtactacaactggctcaggtgataaaagtggcgttcctcaagatggtgcagttgaagaccttggtatagatggcaaccaagagccgttgcagttcaataattttcaagataggatcgactatgccgtgcaacatgccttgatgaatcaatctggagtattagttaataccttaaccaacatggtgaaaactgttgttgatggttcgatagccgagcaccaagcctcaggtccagtctatctaccaggaggtgtttttgccaaattatagatctgtggttacggcaaatcagcagaatacctctaatacactgccggctcggccgacggctccagctactgcacaagctacatcgtcagcaccaagacagatggttaacaccagattgttgaccagggaacaaccacaacatcttgggaaaaatgccaatcggctgactcaggagcaagttgctgcaacgtttttgccaaatccatcgatagccgatccaacacagccgttgccgacccagcaagcacaaccgagacagcagacggttcagccgactcagcatcagaatttgcagcatgcatcggcaaggttaagaacacctgacaatcggccagtacagcatacagtaaaccaagtgattcctgaacacttggtccatcacgtataggccgatcaatcagttgtgcctcaaattatacctgaacatttggtgcataatatttagccgaatcttcagaactatcaaggaggaaatctaggttatcaatatcagcctccgtcacctcatgttcagtatcagcagacagggtcgccccagcctcagtacgctcctcaattcaatcagtttgagccgatgcaacaacaaatgcaaggagtacctcagcatgcgtcattggctgatatgatcgcagatgtaatgagtgaacagtttgggctcaaaccaaaagacaatggaaatttgtatcggcatccttatcctgagtggtttgagagggttcaattgcctagccaatacaaagtacctgacttctccaaattctcagggcaggataatgtttcaacttatgaacatgtcagccgattcatagctcaatgtggtgtggcatcggctacaaatgccttgagagttagattgtttcctttatctctgtcaggatcagcatttacatggttttcttccttgacatataattctgttaatagttgggccgatttggaaaagcagtttcatagttatttttacagtggagttcacgagatgaaactgtccgatttgacagcaattaaacaaaggcacgatgagtctgtgcaagattacattcaaagatttagggagatgagaaacatgtgttacagtttatctttgacagattctcagctagccgatttggcttttcaggggttgatagcaccaatcaaagaaaagttttcggctcaagattttgagagtttgtcacatcttgcacaaaaggtgactctacatgagcaaaggtttattgaggccaagaagaacttcaagaaaatcaatcatgtatatccttacatgtatgattctgatgatgaggatgatgattccgaagtagcagcaaccgaatgggtcaagagcaagaaagtcataccatgccaatgggtgaggagctctggaaaagaggaaagatttgacttcgacatcactaaggctgacaagatttttgatttattacttcgggaaaaacagattcaacttcctgctggtcatcagccgaagagttaggcaaaagaaggtattgcaagtggcataattctggttctcattctaccaacgattgcaaagtgtttcggcagcagatccaggcggccatcaaggggggaaagatcaaatttgatgattcaaagaagctgatgaaggttgatggtaatcccttccctgttaatatggtgcatacgtctggaaggacagccgatggtgggaagaacagaaattttcagatgaattcggctaggattatcaacaagtaccaaagaaagtatgataaacagtaggagaaatatcatgaaagagatggtggttttgatcctcattggaattgtgaatttttaagattctgttggaatgaaggtatgaggctaccatcgattgaggattgccctggatgcaatgaagatgcagggaattcaagccgatccaataatagaggtaatcggctgagccagaagagagtatctgttcatcagaggttgggcccggtcaatcaagatggtgattatgatgaagatgaagataggaagacacaatggtgtcctacaggcattttcaccaagaatcagaagagaagggtgcaaaggttgaggaacagggagcgttttcaggaggtgcagcaagaaattaatcatcggctagggaaaacaaaaaccaggcaagaatggcgtgttaagcgcataattacaacagccgatgaagttgaggccgacaaagcaaaaagggtgctcaagggtaaggctgttgcatctgcatcggtgaacatggttttcatgctgccagccgaatttgaagccaagcaagtcgaagttattgacgttgaagaggcttcggctaagttagttttgtcaccagagcaagcaatctttgagaaaccggaagggacacaaaatcggcatctcaagccattgtatatcaatgggtttgtcaatgggaagctgatgtctaagatgattgttgatggaggagctgctgtgaatttgatgccatatgctacattcaggaagttgggcagaaatccacatgatctaatcaagaccaacatggttctcaaggattttggtggcaatccatcagagaccaaaggagttttgaatgtagagctaacagtcggcagtaaaactgttcctacaacgttttttgtcatcgatgggaagggttcctatagcctgttgctcggaagggattggattcatgctacttgttgtattccttcaaccatgcatcggtgcttgattcaatggcagggtgacaagattgagatcgtgccagctgacaggtcagttaacgttgctagtgctgatttagctatttgggagatggatggtattgattgcttgtctggaaaagtttgggaacagtcgattgaagatcgagagcccaaattattattttgagggcgttgtggagggttcaaacgtctacaacaaggacacggtagatgatctcgatgacaaacaaggacaaggtttcatgtcggccgatgatttggaagaaattgacataggtccatgagatcgaccatggccgacatttatcagtaaaaacttatcttcataatttagaaccaagttgatagagcttttaaaagagtacagggattgctttgtttgggaatattatgagatgccttgactcagtcgatcgactgttgaacatcagcttcctattaatcctgggattcggccatactatcagccaccaaggaggtgtaaagccgatatgcttgaagctattaaggctgaggtaaagcatttgtatgatgctggttttattcgtccatgccgatatgctgaatgggtttcaaatatagttccagtcatcaagaagaatagcaaagttagggtgtgcattgattttcgaaatctaaacaaggctacgccaaaggacgagtacccaatgccaatagtcgatcagttggttgatgctgcttcaggatataagattttgagttttatggatggcaatgcaggttacaatcaaatttttatggccgaagaagacattcataagacagcttttagatgtcctggtgcaatcggcttgtttgagtgggttgtgatgactttccgcttgaaaagtgctagggccacatatcaaagagccatgaatcggctggttggttgaagtttatattgatgatgtggttgtcaagtcaaaggaaatagaagaccacatagccgatttgagaaaagttttaagagaactcgaaagtatggcttgaagatgaacccgacaaaatgtgcttttggcgtatcggctggccagtttttgggatttcttgttcatgagagggggattgaagtgactcaaaggggcattaatgcaattcagaagattcaacctctagaggacaagacaaagttgcaggagctgatcggcaaggtaaattttgttaggagatttatatctaatttgtttggaagattagagccttttacacctttgttgagattgaaagctgatcaggagttcacttggggggcagaacaacagaaagctttggataatattaagaaatattttagttccccaccagttttaatttctccacaaaaaggaatacctttcagattgtacctatcggctggtgataagtcgatcggctcagtgttgattcaggagcttgaaggaaaagaaagggctatattttacttaagtcacagactattggatgcagagacaaggtattctccagtggaaaagttgtgcttatgtttgtatttttcttgcaccaagttaaggcattatctattgtccaatgaatgcactgtgatatgtaaagccgatatagtcaaatacatgttgtcggctccaattttgaaaggaagggttggaaagtggattttttctatagctgattaagggacaagctatagctgattttattgtggatcatcgtgatgactcaatcggttcagttgatattgtgccgtggactttattttttgatggatcagtgtgcactcatgattgtggtatccgcttggttatcatttcacctcgggggccaagtttcgagtttgcctatactattaagccctatgcaactaataatcaagctgaatatgaggcagttctcaaggggttgcaattgttgagagaagttgaagccgatgctatcgaaattatgggtgattccttactggttattagtcaattggcaggagaatatgaatgcaagaacgctacgttgatggtctataatgagaagtgccgaaggttaatggaaggatttcggctaataactttgaagcatgttcctcacgagaagaatatagaagctaatgatttggctcaaggggcatcaggatataagccgatgtggaaggatgttgagatcggagttgctacgatcacagccgatgattggagatatgatttgtttcaatatttgcacaatccatctcagtcggcttcgcggaaagtacgttataaggccttacaatacacctggttggataatgaactatattattggacgatcgatggggtgttgcttaagtgtttgagcgttgatcaagcaaaagttgcgataggtgaagtacatgaagggatttatggtactcatcaatcggctcacaagatgaagtggttgcttcggcgtgcaggatatttttggccgacaatgttggaagattgcttcaaatactataaaggatgccaagattgtcaaaagtttggggcaattcagagagcaccagcatcggctatgaatcctattatcaagccatggctgtttagaggatggggtatggacatgatcggccagattaatccatcttcaagtaagggacatacgtttatattggttgcgactgattatttcaccaagtgggtagaggctattcctttgaaaaaggttgattcaggagatgctatccaatttgttaaggaacacataatcaatcgatttggtattccgcagaccattacaaccgatcaaggctctatatttgtatctgatgaatttgttcaatttgccgatagcatcggtatcaggttgttgaattcctctccttactatgcacaagccaatggacaagccgaggcttctaacaagagtttgatcaagttgattaagagatagatttctgattatcctcggcaatggcacattaggttagccgaagcattgtggtcttatcggatggcttgtcatgggtcgattcaagttcctccctacaagcttgtttatgggcatgaggcagttttaccatgggaagttagaatcggctcgagaagaacaaatttgcagaatgaattgacagccgatgaatattacaatctcatggccgatgaaagagaagatctggttcagtcaaggctgcgagctcttgcacaagttactaaggataaggaaagggttgctcggcattataacaacaaggtggtgcctaaatctttttatgaaggagagcttgtttggaagttgatcttgccgattgggactcgttataataaattcggcaaatggtcaccaactagggaaggaccatttcaaatacataacgttgtgtccaaaggagcttatatgttccaaggacttgatggagaagtttatggacgaccgcttaatggaatatacttgaagaaatattaccgcttaatggaatatacttgaagaaatattatccaagtgtttggcacaggtggatgcgatgttttagaccggaatgaaaaagttcaaaaagcaacaaaacatgattttcggacatattggagtgtattggctgtgttcgtggcaaaaaatcactacgtgattcgcgcggcgaacttctgtcaattaatgctaatatttgcatatattggcacacgtgggtgcgatgttttacaccggaatgaaaaagttcaaaaagcaccaaaacatgatttttggacatatttgagtgttttgggtgcattcgtgggaaaagatcacttcgcgattcgcgcgacgaactttcatcaattactgccaatattggcacacgtgggtgcgatgttttagaccggaatgaaaaagttcaaaaagcaccaaaacaagatttttggacatattggagtgtattgggtgcgttcatggcaaaaaatcacttcgtgattcgcacggcgaaattttgtcaattactgccaatattggcacaggtgggtgcgatgtttttcaccggaattaaaaagttcaaaaagcactaaaacatgatttttggacatattcgagtgtgttgggtgcattcgtggcaaaaaatcacatcgtgattcgcgcggcgatcttttatcaattactgccaatattggcacacgtgggtgcgatgttttagaccagaatgaaaaagttcaaaatgcaccaaaacatgatttttggacatattggagtgtattgggtgcgttcgtggcaaaaaataacttcgtgattcgcgcggcgaacttttgtc

SEQ ID NO: 45997 - DNA, 769 bp, Oryza sativa
aaaaagttcaaaaatcaccaaaacatgatttttgaacatattggagtgcgttgggtgctttcgcggctaaaaatcacttcgtgattcgcgcggcgaacttttgtcaattgatgccaacattggcatatattggcacacgtgggtgcgatgttttagaccggaatgaaaaagtttaaaaagcaccaaaacaagatttttggacatattggagtgtattgggtgcgttcatggcaaaaaatcacttcgtgattcgcacggcgaaattttgtcaattactgccaatattggcacaggtgggtgcgatgtttttcaccgaaattaaaaagttcaaaaggcactaaaacatgatttttggacatattggagtgtgttgggtgcattcgtggcaaaaaatcacatcgtgattcgcgcggcgaacttttatcatttactgccaattggcacacgtgggtgcgatgttttagaccagaatgaaaaagttcaaaatgcaccaaaacatgatttttggacatattggagtgtattgggtgcgttcgtggcaaaaaataacttcgtgattcgcgcagcgaacttttgtcaactaatgctaatattggcatatattggcacaggtttgtgcgatgttttagaccggaatgaaaatgttcaaaaagcaccaaaacatgaattttggacatatttgagtgttctgggtgcattcgtgggaaaaaataacttcgtgattcacgcgacgaacttttatcaattactaccaatattggcacacgtg

SEQ ID NO: 45998 - DNA, 1927 bp, Oryza sativa
caccaaaacatgatttttggacatattggagtttactgggtgcgtttgtggtaaaaaatcacttcgtgattcgcgcggcgaacttttgtcaattaatgccaatattggcacaggtgggtgcgatgtttttcaccggaatgaaaaagttcaaaaaccaccaaaacatgatttttggacatatttgagtgttttgggtgcattcgtgggaaaaaattacttcgtgattcgcgcgacgaactttcatcaatttctgccaatattggcacacgtgggtgcgatgttttagaccggaatgaaaaagttcaaaaagaaccaaaacatgatttttggacatattggagtgtattaggtgcgttcgtgacaaaaaatcagttcgttattcgcacggcgaaattttgtcaattactgccaatattggcacaggtgggtgcgatatttttcaccggaattaaaaagttctaaaagtactaaaacatgatttttggacatattggagtgtgttgggtgcattcgtggcaaaaaatcacatcgtgattcgcgcggcgaacttttatcaattactgccaatattggcacatgtgggtgcgatgttttagacaagaatgaaaaagctcaaaatgcaccaaaacatgatttttggacatattggagtgtattgggtgcgttcgtggccaaaaataacttcgtgattcacgcggcgaacttttgtcaattaatgctaatattggcatatattggaacaggtttgtgcgatgttttagaccggaatgaaaatgttcaaaaagcaccaaaacatgaattttggacatatttgagtgttttgggtgttttcgtggcaaaaaatcacttcgtgattcgtgcggcgaacttttgtcaactaatgccactattggcatataattgcacaggtgggtgcgatgtttttgacaagaatgaaaaagttcaaaaagcaccaaaacatgatttttggacatatttcagtgttttggttgctttcgtggcaaaaaatcacttcgtgattcgtgcggcgaacttttgtcaactaatgccactattggcatataattgcacagatgggtgcgatgtttttgacaagaatgaaaaagttcaaaaatcaccaaaacatgatttttgaacatattggagtgcgttgggtgctttcgcagctaaaaatcacttcgtgattcgcgcggcgaacttttgtcaattgatgccaacattggcatatattggcacacgtgggtgcgatgttttacaccgcaatgaatgccaatattggcacacgtgggtgcaatgttttagaccggaattaaaaagttcaaaaagcaccaaaacatgatttttggatatattggagtgtgttgggtgcattcgtggcaaaacatcacttcgtgattcacgcggcgaacttttatcaattactgccaatattggctcacgtgggtccgatgttttagaccgcaatgaaaaagttcaaaaagcaccaaaacatgatttttgaacatattggagtgtgtttggtgcattcgcggctaaaaatcatttcgtgattcgcgcggcgaacttttgtcaattaatgccaatattggcatatattggcacacgtgggtgcgattttctacaccgcaatgaaaaagttcaaaaagcaccaaaacatgatttttggacatattggagtttactgggtgcgtttgtggtaaaaaatcacttcgtgattcgcgcggcgaacttttgtcaattaatgccaatattggcacaggtgggtgcgatgtttttcaccggaatgaaaaagttcaaaaaccaccaaaacatgatttttggacatatttgagtgttttgggtgcattcgtgggaaaaaattacttcgtgattcgcgcgacgaactttcatcaatttctggcaatattggcacacgtgggtgcgatgt

SEQ ID NO: 45999 - DNA, 7255 bp, Oryza sativa
caatattggcacaggtgggtgcgatgtttttcaccggaatgaaaaagttccaaaagcaccaaaacatgatttttggacatatctgagtgttttgggtgctttcgtggcaaaaaatcacttcgtgattcgcgcggcggacttttgtcaattaatgctagtattggcatatattggcacatgtcggtgcgatgtttcagactggaatgaaaatgttcaaaaagcaccaaaacatgatttttggacatatttgagtgttttgggtgcattcgtggcaaaaaatcacttcgtgattcgtgcggcgaacttttgtcaattaatggattcttttgtcaattcgaaaaatctctcaattcatcttcctctactcatgttaatggattcttttgctgtgtccttcggttcggccaatgagtacgaaccatggaatcatgttcttgccatgttcctaggcttggccatcatgagtacaagccaaaggaatttttcctctttgttgtgtcctttgtctcagccagcgcgtatgagacaaggaagttcgtttcatttgatggcttttaacatgatttcacacttttttctatggtccggccagatgagtacgggcctaggagtggtttccatgcaaactcttttcatgtcatcctaccataccctctgatttggtcccgttagcggatacaagcccaggcgagattctcgctctcaggttcagtcctctacgagcggatacaaatcacggatacaaacacaaattttgcataattcaccataaattaaacaagcacttgctttggtcacgcttcatggcttcaagccgtgctagtagtgataaaggcatagtgataaataaaattaattgagcatactaattagcacacttatttgctagttttgacatatgttcagccatatttctctaacaagaattaaaataaaatggcgttcattttctttccgtggtcagagctaggaaatagatgtacgcatgcatatattttctccttccatctgttcatctacaaaatgatggataaatcatgaactgcgccgagttatgatggtcggccataaaattaaccaacactcacttcggttacgcttcacggcttcgagccatgctagtagtaatacaagtggagtgaaaattataatctcaaaatcatccgcatacatatatttgcttaaaacaatgtatactcgctacaccatatataaagtgcagtataaaaaaatctgatatacgcacatgcatgcatccatatactctggctgtgcattcgctatcacgtatagtttcttcccaatagcaaattaatccatatatgcatagcaagcgacaacatcatgataatcgaccataaatcaaacaaatgcccacttcgattacacttgatggtatagtgccgcgctagtagtaatacaggtggggtggaaattaaaataggcaatgcaaattcgccgtaccaaaatcccatgccgcgtcgataatattggcgctaaagcaaatactcgcctggctatgcctcgcgaatgctcaagaaaattctgcaatttctatatgtgcgctacgtataaaaaaataaagtcacaatgccaaaaaaagaagctatgtataaatttgctaccatacacgcagtgatattaaaaccaacaaattagtgggcatctataatacgcccaaaatgaaataaacatataaatggaaatctacagaagattctacggctgcgacatctggagctttaggatagatttttctttttagccttttagcagtcatgtaattttattttctttcatgttggaatccctaatcaggggttttctctacggagatgtaattaacagaatttctatataaatgtatgaattctggaagtaatggactcgcaatttctgatttttatttatttattgcatttaaattaaattgtctctaacgatttgcggataacgaacctactattacaaccatcccggttttcccggcgtcagattctggcacgcccagtgggacctacttctcccctcctctctgagttccaacatgtagaccgcgaatatgaaaaaaaaaggagataaatgcacatatccttagtggaaaaattcacgtattcaagtgcttcatccaaagcgctctatgaaattaatatatgcatgctatggtcttacaggaccagatgaaacgtctgtttatatatatggtcgagaaaactaacatatggttttctttattttgcaaggatgtctaaacaagttcaaccattcgtcacgctgcgctttggctcactgtgggtggacgttcccataggtccattccaggtcgccaacagtggcagctcccttcagaccactgctgcatcgccagctccggcggactatgaacaggaagtgagctcggcgccacagggcgggtacattcctgttctatccaaagctgccaagaggaggagggcagcagttaaggcaagacaggctgcctcacaagagcacttcatcaaggtgcgtgaggccgcttccaacgactcgatgcctcctgggtttaccagggctgcaccagccatgaccagggtggcacccgtcaagaccaggagctacgaagcatatccaaggttccgtcgcacaacactcgggcgagtggactgttcgtgagatacggacgggtccgtccaaggcagcgccgcgtcgccgagcgtcccctgagccaaaagggattgcttcttctatgccaaagaagagtgcactgggggctaatgcatccccggcctgcgtggcggggtcttcatcgactcccgtggcagtgccactcaacattgcccctgagatgctaggggtagtgtctcccaagaattccctaagcatattaggggctgcaccttcaatgtccacagcagcggcaccatcatctgcatcaacaggtgtcgcgctgaaccgccctcaccgcctgcacccacttgataaagggacggctgtgatggaggatgaaacgcaccatgagctgccctcaagcaagaagaagggtgtagtagttctgcaaagtgtccctacacaacagcaaagctcgtcgccgtcatcaagcaagctccgagctgatgccccagagttcatcccatcatcaatcaaaaaatcaagggcatcccggcgcagggcgaagaagaagcgtacgctccaatgggaaggagtgtacgtttcacttggtgacgtcaggatgggtcatgtcgacccaaccgtggtgccttctgacacggtatcgactgttactcccactcaacgcccttccatgcaaggatctttttcaccatccaagaaccgacgtcggcgacgcaatgcttgtcgcacttgggttgacttcccagttgcaactgaagccaaggagacaaggcatcagcgtgagaaagtgtacaatgacatgatgaacaaaaggatcagagaaagccgcagaggtcaagctgaaaggtttgaagattgggctacatttatggaagcaaccatctgccataccatgaaagaaatgttgccgggcgtttcaacgtccgacaatggcatgggcggcgccattatgaggcgcgccgaggcactggccagatggccagagtatcaaaggcttgttgatcaagagctgtggcgacaaacctatgtcaaccatgctaagcgcgtgtgtgctaagcgagcagcgcataagcagggagaattggcagcatgtcacgcccggaaattcactagtaatttccgaacttatttatgcataaaaccctcatccaggaatcagccgaggtacacaaactgacaatttaatatataaatccatcataaacatacttacagaagaaaagaaaacagcagcggaattaacggtctagcgatggcttcagctccactcccataggcagctcaactggggtataagccaaacgtcttctccttctggatcttttttcttcaactgaggttgattgattattgtaaggtgagcatatgacatactccgcaagccacacagcaaatgtgcaattgcacaaggataccaaaggatggcataatataggctcatttgcaaaagcagcatttagcaaacatttaagagaagtaaaacagtagagtaattaatcagaaattttaatcaacactgaatagcacacccatgctgctcaggcccaaccatcctgaacaaccatacccggctgtacagatctaactccaaactacgagctaaacaaattattaccagttatagcatcaataattattgtgagaggtgtgagactaatcacgaaaaacattgctcaacccgcccataaccgcgggcacggctattcgaatagttttactctggccagaggtgtaccattgtacccacaagacacgattccacacatattgccatgccccgaagtaccaccacggcactgctaaggggaaaatcgtgacaatacccttcgcacaacacaactcaccacagtgcaccattcctggatcataatctcccccctcaaaaccagaggcaatggactccccagcgacccccacggacttctcaccgcttctcagtctggcaccccgtaatgaaccatgctatacaaaaggtaaagccgttgcccacgctggctagtggttggcatggttaatgtctcacaacagtagctcgcaaatcggtccttaattgtcatgagcacaaccatcaaaaccatatgctcacaacccacctttaatcaggttttaattatcaattaattatcttaacacgattaaccatcgtgagctaccattgaatataatcataaataataatgtagtgtgattcatccccttaatgagctaatgtttctaagcatggctaagcaattatacatatagcatctagctgaaccaatccaataataaggtccacgctaatcaaattataacccataggaaaataaagtcatcttcggccattaattaattgggaaaggctcaccacccgatgacattcgaaaataatgcataagttgaaataaaacattagctttaaaagggttcaacatgctcaaagggttgtttgggatctgtgtgacttgccttgagcttccgcaaacgcttccgaacgtttctcaacgaaaacgctctcctccggaacgtcgaaaactaaagtaaaagaacaaaatcaacaaaacagtacaaaaacaagcataaacagtacatgtggatatttttaacatgtatatcttgattttagaaaaatttagcaacttgaaccactcgaatccgagttacgatgatttagttatgaatttccgaagtttaatcgattttcaactaatagagaaaactaagaaaaaaggattaatgacgtcatcgctgacatcatcgccggccatggcacggcttccacgcgaccaccggcaaaagagggctcgattgggctaaccgaggacaccaacgcgaagaggacgacaacgcgaactcaccggtgcaaagaacaacgacggacgacgacgaacgacggccggcgacgaggttcgacggcggctcggctctgctcaacgacggcgacggtgctccagtggtcttcggcggctgcgaaggggcggccgaggtactcctcctccgcgcgcacccgacggcggcgacggacggcaacggcgacggctaccgcggcggcgcgacgcggctggaacgtcgacgcgacagcggcggctagggcgacgcggcggcggcgcgacgggccacgagggagctcgggacttggggcaaacggaagaggacgtcaaggggatgctttatataggcttggactagagagatccgactccatacgagaggatttgagccggaaaatccgagggttagtttggagagataaactcgaaaacgaatttgattcggtttatccgggcaaaattaatctccgagaatttaagggaaagggagaggataaggtggagatgatttcccctcaactaattttgcaaacggagcacgggatgcggtggatttggtggaggaagcggcgtcggctaaagggcacaggacggcagctcgggctctgtccaagtttgaagacgacactgtagcagggacgcgaattagactttgactgcgcttcttttctctagcccgattgaaagagggtcatgaaatggacttcgggaaagagagggagatgggctgacgatgacagatagacttttccagtttcagcccgaaaagcaaaaggggaattttaattacttttccaattaaattaatcactgaaatgatctttgatttgttaaaaatacttccaatgctcaaataatttcaagaaaaatcctgaaaatacttggacactataagtatttaacaagattataataagaccatttaatgattaatttaatatgtggataattactgaaatattctttgtatgattaaaattaagaattgagctcctaattcccgagagtataattaaccacggagaatttaataaaaattaaatccttccatgctttatattaaggaaattttatttcccacatttaacttctcttgtaaattaatgaacatttaatataaattctaataataatttattaaataatttataaatcctgaaacgaaaatcaggatgtgacacatcacgagcaagctccacgtgcagcaagatacagtgggtacctatgtcctcatcaagccatggtcaatgagtgtatgaggtgggatcgacatcacgcacaccgaagaaaggttgtagccgacttatagtctattattgtacatgctattagctttttatatttgaacttggaatgtagtatccaaaataactttgggggtgtgtagatccaggagtgtaaagtttttgcgttccacatcgggtattatatagggtgtcgcatggggtgttcgggcactaataaaaaaactaattgtagtatccgtcagtaaaccgcgagactaatttattaaacctaattaatccgtcattaacagatgtttattgtagcaccacattatcaaaatcatggagcaattaggcttaaaagattcgtctcgcaaattagtcgcaatctgtgcaattagttatttttttagcttatatttaatacttcaaacgttcgatgttgtcgagggaagaccctcgatcgcgcggagtcgcgtgacccccctttcgtgagttcggccgggggcagagactcgtctctccgaagtcgcgtgtccgtccctccgatccccggttagctagcacacaaatggattacccaggttcaggctgctctggagcgtaata

SEQ ID NO: 46000 - DNA, 22711 bp, Oryza sativa
aggctctccccttcgccctagtgactcacgaggtatgtgggtgggaccagctcgcagagccgcgtggctggaaagggaagtagctctcctttactccacatacccccaggcccatatctccgacagtagcccccggcgccatgtcagacgcgggcttcctgggaccggtctgacatggtgcctcacgacctccccagctgggattgtggacccggcggggagtttaaaggagtattgccgagcggccagattggcgggctagccatagcggcggttcggtcgcctttgatcgcgctaaagacgaggatgcttgggacgcgataatcggggaattggttagaccacgcctcgattacttcgcccgctattcctacggcggttgtggtgacggttcactcagcttgtgctcataaccgttgcgcattccacctcgagtgcgctgctgataggcgcactaaaggtgggacgcggacacgacgggcgacatggtgaacgggcgcgggaaacggagagacaactgcggacgtgggggcaattttgagggcacgaaacgaggaggcgagcgcggatgaggcgaggattaaaagggagtggaggcagggacctctcctccttcctttcgccaaccgccgactcgtcctctcgcttctcgaaccctaacactctcgccactccacgcagctttgcgcgccacgccttccgccactgccccgccggccaccatggctcaagacaaaagcgacacagtgctgccttcttcccgcatctcggcagacagacaccttagcctcccccgcaaaatcatgccggacggcgccgtcgtgagggcgggggagtcatggccgcggccgcgatatccggagcggtccgtgcacctcttgtccttcgccatggcgggattgattccgcctttctcccgatttttccacgaggttctggatttctacgaaatccatgccttgcatctcgcgcccaacgccgtgatgacactgagcatctttgcgcacctgtgcgagatgttcatcggggtgcgatcgacaatgcggttgttccaggccttcttcgtcccgcagctgctacagggtgcggtggtggggggatgttacttccagccccgaccaggcacggcggggcagtacatcgagagccacctccgcaagaaatgggaggactggaagaaagactggttctacaccgcgctgccggatcacccacgacttcgagttcccgccggtcctcccgagagatccgccgcatggctggcggcttcggagctgggcgaggaatatgacgcggtgtgggatcgtctcaggggcctgcgaagctggggcctcacaggggcaatggtcttcggcgactactttcgccgccgtatcgcccctctccaggaacgatcccgtggcgcgtgggagtacaccggccccaacgaccccatgcgcacgcatgcgggcgagcgctgggactggggcgaggaggacgccaagatggtgattcggcgggtgctgggcctggactccgccgagcaaacactgatcccggatgggatcctccccctctgctgcgaccgcgaccgggagagcatcttggccgtaatgtcggtcgtcggcgccggcaggggccggcctggccgagggggcgctagcggtggtggcgactcacgggcgcccggctcgggccgcaaacccggagacgacccggcaagtgacccgaaggggaagcggaaggcggccgaatcttggccgccctctcccccgcgtggaggaggcgccgagcgcgcgacagaccttccaccggcgggtcacaagcgacctgccgggcccgaggccggtcggaagaagaaacggctccggaagatagggcaaacggagccgtgccgagggagctacatcgagcccccgaagtggaccttcaaccgtcctccccgcaggtacaaacgctggcgcccacttcggtgctcttacctagctcggcctcttgttccctccctttctttttcttttgttaacgcgatctgggttcccttgtagcgatattccttctcaggggacctcggggtcggacccctcgcggaggacgaaatccgcacaaccggagcagtccgggcctggccaatccaaggccgcggggtcttcgcaacctcgcggtggggtccacaggacacgtaccgggcctgatcccgagcgacccttagccgggactcgacctaccgtgggtggcggtggcgtcgacgcccctcccgggggcagctccgagactggggtccgtgcggagcgccgcccaggatcggttggtgcggacggtcgcgagcccgaggttgaggtcgaggctgggggcggtcctgagctcgaggccgaggccgaatccacccgaggactggaagcgggggacgaaaagaacagccgctcccccttgcgtttggggcgccctcggggctggcctcgcagaaggggggccgagagcagccccccgtctcgcggggggtccagcagcactccgtcgtcccgggggcgaaccgcgggcttttcttccccatccctggtgagcatggagccacttctgcaggtgctcgccgccaccgactccactgtccgggaggggctcaatacccaagttcaagccctggcggaagaacggacggccctggatgccgaatgggctcagcttgtggcggaccgcgcgcgagtcgatgaggggtgccgtgccgtggaggacatggtgagggtggggcgcaaaaagcaccaagcccacctagccaaaatccaggcgcgcgaggaggtgctggactctgtcatgcgggagacggaggaggagcggcatgcggcgctgatcgcctcgagcgccctggacgaagcgctgggcgatatccgccttcagtacgaggcccatgtcgaggacctggcggagagggtcaggaatgcacgtggcaccctcgacgcagccgctgcccacgagcggcgagcagcggaggccgacgcctcgttgccggcccggactgcggcactcgaggctgaacgcaaggccttggacgaagaaagcgggagcgggggtgacgatagcgatgaagactgggacaacatcgtcagcggcgccggcctcggagggccgggcaccccgtgactatccgcgccttcaattccctcttgttgtgcgcccgtagcgggcacttcttgtatttaagccgtcgcgccatcctgccttgttttgcaattgaaacttccttagctccttttcccctttcgcttcttctattcattgctccttccactgaatgtctttgaaacagagagaacaaaaaaccaggggaaaacgggataatcagtccgtgatcgagatgccgctttgaccccatccccccctcgggcttgttctagcgagatggtgaatccgcgtttggtccagggcacctaagtggtgatgggcaaacccactgctccgagggagccgcctagcgggactggccagaccgaggccgcgtcgaccgggggtcggggacggccgtgtgtaggcccttccgatcctccggggttcgacgcaacccggggcatggcccgcgttcgtgctccctttcggggtttccaggccgcctcacagcacttaggattcagagcaaacgcagattaccccttaaaccaggacaagccagaggaagggaaaaaaacggtctttgggtaaaagtacacaagaattcattgcttgtaagaggaaaaaaggatacacagtggtagcccccggccaggcgcgcacaaaccgaggggttgtgcgggggctggcccgagctccaagaaagcaaaaaagtctcgatattatggatagaagcgacggaggtgttcgatattccaggggttaggcaattctgtgccgtcctccatggttaaccgaacggagcctggccggggcacgcagatcactttgtatggtccttcccacgttggcgagagcttgctcagccctaggcgcgactgaacgcggcgtaggacgaggtcgccaacttgcagtgatcgggcccggacgtggcgctgatggtagcgtcgcaggctctgctggtagcgggcggcacgcaaggccgctcgccttctccgttcttcgagataatcgagatcatcgcggcgaaggtcatcctggttggtctcgctgtacagtgtgacgcgaggcgaccccagggagagctcggagggtaggaccgcttcggcgccgtacaccagaaaaaacggcgtttccccggtggcgcggcttggggtggtccgatttgcccacaacacggcgggcaactcctcgagccatgagtccccgtgcctcttcaagacgttgtatgtcttggtttttaggcctttgaggatttcggcattggctcgctcgacttggccgttgctcttggggtgggcgggcgaggcaaagcataacttgatgcccatgtcgtcacagtaatcgccgaacagctcactggtgaactgggtgccgttgtctgtgataatgcggttgggcactccgaaccgagaggtgatgcccctgatgaatttgagggcagaatgcttgtcgatcttgacgacagggtaagcctcgggccacttggtgaacttgtcgatggcgacgtacaggtgctgatacccgcctcgagccgctttgaaaggtccaaggatgtctagcccccagaccgcaaaaggccaagagagggggatgacctgcaaggcttgggccggctggtggttctgcttggcgtggaactggcacgctttacaccgccggacccattcttgggcatcttgtaatgcagtcggccaataaaagccttgccgaaaggctttcccgactaaagttcgcgaggccgaatgggccccgcactcgccctgatgggtgtcggctatgagctcgatgccctgctctcgagaaacacacttcaagagtatcccgttggcggcacgccggtagagggtcccttctacaaggacgtaccgcttagagatgcgcgcaagcttttcagcttctgcgcggtcctcaggaagagtattgtcgtcgagatacgcccggacattagtcatccatgcgacttggcgaggggggtcggggtcgaccccctcgggccccgggggcgcggaggggggtcggggtcgaccccctcgggctccaaggggcgcgagttggaaggaatcggggcggagggcatgtcgttggagcccctcgaggggttcggtcgtgctgatggttggacaagcctttcttcaaaggtccccgggggaagtggggctcgcgccgacgcaacacgcggcagctcatcagcgagtgtgttgtcgcgccggggcacgtgccggagctcgattccgtcgaagtggcgttccatgcgccgtacttcgcggacatatgcatccatttgagggtcggtgcattggtactctttggatacttgatttacgaccagctgggagtcacctaggaccaggagacggcggatgcccattccggctgccgccctcaatcctgcgaggagcccttcgtattctgccatgttgttcgtggctcggaagtcgagccgaacgacgtatttgaggacgtctccgcttggcgaggttagtgtgactccagcacccgcgccttgaagggtgagggagccgtcgagatgcataatccagtgtccgccacgaatgtcggcgtttgggtcctctttctcttcgggggagggagggggttcggacggaacagggtcgtccactggggcccattccgcgatgaagtcagccaggacttgacttttgatcgcgtgccgcggttcgaagtgcaggtcgaactcagccagctcgatggcccattttaccacccgtccggtgccctctcggttgtgcaagatttggccgagagggtacgatgttaccacggaaacccgatgtgcttggaagtaatggcgcaacttcctcgaggccatcaatacggcgtaaagcattttctgggcctgcgggtaccgggttttcacatcccgaagcgcctcgctgacaaagtagatgggccgctgcaccgttcgggcgggccggttcgtgttgtcaggggcggatgatccggagcgcgcctgctcgggggcccccgggggattccggattatcttgggatcacagggctcggggcctcctgccaaagcctcgccttctcctccgggggcctcagggtcctcccgggggctgggggctttgggggacgaggggccatcacgagccggagggacctcctgctcggtctcctcgcgttcaactactagggtggcactcaccacgtggggggtcgcagccaagtagagtagcaatggctcctccggccccggggccaccaggatagggggagaagtgaggtaagctttcagctgattgagggcttgctcagcttcctccgtccatacaaacggcctggggcgcttgaggagcttgaataggggcagcgctctctcgcccaatcttgatataaatcgactcagggcggccatgcatccagcgacacattgcacatccctgagcttgctggggggcgcatcctctctatcacgcgtattttctcgggatttgcttctatgcctcgggaagagactagaaaaccgagaagcttgcccgccggcacgccgaacacacacttatcggggttcagctttacacgtgtggacctaagactatcgaaagtctcggccaggtgttgcagcaacgtgtcctggcggcgcgtttttaccactaggtcatcgacatacgcctctacattgcgccctatctgattacttaaagtaattcgagtcatgcgctgaaaggtagggccggcattttttaacccaaaaggcatagttgtataacaaaaggtgcctacaggagtaatgaaggcagttttttcttcatcttccctagccatgcgaatctgatggtacccagagtatgcatctaggaaacacaaaaggtcgcaccccgcagtggagtcgactatctgatctatacgtggtagagggaagggatctttagggcataccttattgaggtctgtgtagtcgatgcacatccgcagcttgctgttggccttcgggacgaccaccgggttcgccagccactccggatgaatcacctcgcggatgaaatcagcctccaggagccgcgccacctcctccctgatgaaggtttgtcgctccggggcttgacgccgcactttttgccggacaggtcgcgcatccggtcgcacggcaaggcggtgctcaatcacctccctagggaccccgggcatatccgacggcttccatgcgaaaacgtcagaattcgcccgcaggaaggagatgagcgcgccttcctatttggcgtccaaggtttcgccaatcttagcggttttggacggatcgtcgccaaggggaatctccttgacgggcacctcgtcggccaaggtgaggcgcttcttgggggcgcgggacgcgggggcctccggggcctgcggccccgtggccgccgccaggttgtccgcgcgctgttctgcacaggcgagggcgactttgacatcactaaagatggtgatgggaccggcaggacccggcatcttcatctggaggtaggcgtaatgggtggcggccatgaactttaccaacgcgggtctgcccaggaccgcgttgtagggcagattgagatccgccacatcgaagtcgatccgctcggtgcggaaattggtggagtcgccgaaggttactaggagctcgacgtgaccaagcggccacgtgtgtcccggagtaacgccaatgattggcagcgacggttggagcttcatccccggggccttgagcgcgtcaaaggcagccggggagatgatgttcagactggccccgccgtccaccagcacacgcttcatcttgacgttgtggatagtcggggagaccaccagggccaacttccctccccgagcgagtaccgtcggatggtcgctctggtcaaaggtgagctttacctccgaccagcacgccttccggatcgcctcatgggtgggaacagcggccagaagttcccgcctcatagccttgaaccctcgacgagaagtgcgagcgcaagcccccccatcgaatgtggcgacggtcccttggggtatctagaaatccagatcctcaccacctccgccatcgtcagcgggggccttgttcttggcctcctctcgctggtcactggttgaggtcatgggagccttgccctcccgtcgaccctgccgcttttcctcatcggcctttcggaaccactcggccaagttcttgaccgagcggcagtcggtgagactgtggcggtaagtgttgtgccccgaacaccacttgtccgccgaccggcctccgccggagggggtggtggagctcggcttatcgccggtaatctttcctttgcgcggggcccacgtgggccctctgccgcaaggacatggccctcgtcatcggaacgggccggtttcctcttgcctctcctatctcgccgcttagagcgaggggcagactcgggggcagccgcagccgccgcaccggtgccaggagagttccaggcccacgcctcctccttccgggccaccttgtccgccagctcgaagagctcggcggtggtcttgggctccttggaggcgatcttctccagcatgcggttatgccgcacgccgttccggaatgcatacactactgcgtgggctggaatgcacggtatggtgtggcggacctggcagaagcgctgtatatacgaacggagggactcgtcgtccttccgccgcacagcatgcaggtccgcttcttcccccgggcagggatatgtcccctagaggtttgtgacgaactgctggcatagatcctcccaggagtgaatggagtcggggagctgggccatcaaccagccacgcgcctgacccttaagggccatgggaaagtagttcgccataacccggtcgtcaccccctgccgccacgatgatcgtggtgtagatttggaggaactcggaggggttgatgctgccatcatacttctccgtgagattggggcgaaacttcgggggccaccagacattctggagactcgcaacgaaagccctacaacctgcccctcccaggggtgagcgtggggggagggccgcctcgcgaagaagagcgcggcactccagatgaggaggcaccttcccccatgcgggtagcccggcgctcgtccaggcgtcgctcgatgttgacccgagcatcctgcgccccgtagaggtcatcatgacgcctccgccttcccgagacctccgatgtcgttggagccgtggatcgcctcaaggttgtggccgatcgacgggcccttctcctcgccgacgaggaaagggtagccggggtactcgatgtacctgtggcggtggattggccacccgtggccaactgccgctgggcagcggtgaccaagttggccacgtcgtccagccagcgccgcacgggggtctccggctccgggttcacctggggatgccgcagaagggcgcccaccacctgaagcgcgccttggggcgaaccaccgtctccgtagtcgagacggcgacgtgctccgacgcgtcgcgacctccctcctcctgggggcggggagagggccgtaccgcttgaacgggttggatcctccctccgcgaaggctcgcggcggggaggactttgagagccatggcgatggtgacgagggtcacggttttcgcccgaatccccactcccagacggggtgggggtaggcgccaccgcttcctctgcttccaggacctcgaccatggcggtctagggcctggtccgacctgggacggaaggaagcgacttcttctcaaacgcgcaactgccccctacttggcgtgccagctgtcgagggaagacccccgatcgcggggagtcgcgtgacccccctttcgtgagttcggccgggggcagagactcgtctctccgaagtcgcgtgttcgtccctccgatccccgattagctagcacacaaatggattacctaggttcaggccgctctggagcgtaataccctactcctacgtttgggattatcagtgaattttaaaaggtttccctcgctccccctctttttggtgggcaaggtcctccttttatagcttaaggggataccatatgcgccgtctctaccctccccctccatcggagggaggggagggggcccttctccctactgcgaccgggtttcaacccgtgccttttgttggaagctaagcatcggtcggtccttgagtggggcccagcgccgtctcccgcctgacacggggggcagccctgtcattccctcataaacgagggaagacttgcggcagccctgcatcaaacgccgtccggatgtgatggggcgtacctaccgccactccgcggagacagaggcgacgtgggggcacgaccgcccgtccaatcggccgtgaccggcaatagactggtcacagaccggtcgcatccgactgacaggggtcggtcgggcgcgccgcacgtctgcccccgccgcattgaatgcagcgagggacggttggggcgctgcacatttatggccgcccagcctggactcccctctcacacttccccccgagggagggcctcggggtaaaacgacgggagagcccgagggggtgacgtcacccccgaggggatgtcgtcgacccccgaggctctccccttcgccctagtgactcacgaggtatgtgggtgggaccagctcgcggagccgtgtggctggaaagggaagtagctctcctttactccacatacccccgggcctatatctccgacagatgtgatagggtgtaacatttttgtgcaggaaacatgacctttgtttttaagaccggatggagcactttgttaggcggtttgggagtttggaacttgtgcaaaacggtgtgttttaaaaattaaaaccattgctctcgtacataccagatatttataactaacggtcgagaagttcaaaatgtgtccaaaggttgagaagtttaaaatgtatccaaatcaacatattttcaatatttgagggagtaacgtgatataagaccatatatttataactaatggccgataagtttaaaatgtgtccaacggtcgaaaagtttaaaacaggtccgaagtccgaacctcgtgtttcaggatatctacaacgaatgcttgggtcgggacgtaaggttaagggcttgtttggttggtgccctcagctgcatgcctgaagaaaaagtgctgcttgaaatctccctgagatcttgatgtgttcggcctgatcaggcaagcctgagattactctgtttggttgcaggtctgaggtcaagcgtgcctgagctgaaaacacaaccattgaatgacgtttattatgtgaacaaagcgtaaaaatataatacgtattcattttacaaaagtaatctctcatctatatacactagcagtccatctaattgcacgatgatcacaagtatcgcttgcatctagttgacattgaagcttcgagcagcaacaattgaacggaggattgggcaaggggttggtgcggcatctggggtgtcggctactcggctgcgcaggccagcaggatggattacagcgctaattatcggtggctgttgcggcctggagttctggcgaccaaaatgggtcacctggctcaggctaaccgcaagtcagaaggaatcaggccaggcaaggggtagttgatctcaggatagcaaccaaaacaaggttcaaactaacctcaggcttgtcttcactcaggcaagttcttctcagggcatcaaccaaacagcccctaaacctctcttagttgtgccaaaggaaattatggaaatttttaacacggctataatggcacaatattgacaatgaaaaatacccatataaacacaattttgcctaattgtgttacctactatagaaaacttgcgactgtagtttcacacgaataacgttctcgtgcaggtgggtgggccaccggtccatgcaacagtagccgtgccggcccgacacggcccaacacttccttgggccgttctgcccaagacctggcacggcacggcccggcccattacagttgccgtgccatcagcgggcccgagctatgctgggccgggccgcccatttggcctgctacacataatgggtaacatagtaaatctgagctaaaggtggagtactcgagtatctcttcccccttcccttcgcgtaaaagagaaaaaaaaatctcccgtctcgtcgtctcatccgcttctttcgccattcgcggctgaacaggggaggggagggggagggtcgccgatctccatccggcgagcaaggggatcctggtgagcatccgcatcctctttctgatgattcatctctctctctctcaccggggatgcttctgtcttggaatttgcttgcgtaaaccctagcttctcttgtagatctggaagaagctcttctcttagttccagagcctttaaccttaatacaagtaacagtttgagtttgtttgttgttcccccaaaagtttggggggttcaactgaacccccatgtcccaagttggatccgccccctgttatttcactcatttcactaatttgtttacatacagtggaataatgtagcatttatttttgttatgcaccgttgtagatctgatgagaattcctaatgcttaaaattgcctgaatagatataacgattaattcttgttttcaaggaagtttcaccatctatggtgataatgtcattctgttattacagaggtcaatgtgttgtagataataagtgacataggttgtatcatttatttcttctatgctcaaggtcctgaactgttgtgcatgtttcatttgttgccccccgagtcatattatttggcgcgggatacttcagtactttggatcaaataatcgtgatgggaaggagtacatagccaaatgctcttttcccattgtaatgcacgggcaactaactagggtatggacattatctcatgtttgtggtcatgatcaaatcgctcataaaacatgtgcatcttagattataggcagaaatgtattccaataatgttatttggagtgaaattcatccctcaacagaaaaaaattctgctaaatactctattaaccttttctgtgtgatactcatgggtatgtatgcattgattgctaaacattttcacatgtgcatttgacagctcaggtggcagcaaacaggaagctttctccattagaaggaatcaaaccgatcgagaaggatcaaaccaagaagagaaaggatcctacatagtatcttgatactggttaccttggctaagaggaccgatcggactattggagaggaggggctaagtcgtctccacaacagtgaactgtctccgagccaaaacagaacgaacgcccaaacaggcaaaccacgaactcgaaccctagaaaccctgaccatggactcgggaggcggaggaggggcattgcacaaggcagcgtcgggctccgcaccctcgggggcggcggccgcgaaccccacggcgatgctctccgccctgatgagcaagcgcgccaagctccaggaggagctccgctccatagagcgccaggttaggtcttacacactgttccctgtctcttttgcgcctctctctctctctctctcttggaattagggttttgtataggagaccatggatttgttgcatatatgtacagatggcaagggcttgccattgctcaacatgcgaatgagtggtgcgaatttacatcgctgcggatggttgtaaaattggagttgtggatacctgtagtagcctgaatttattgttcaatatttcttaatgccttgggaatgatagaaatatgaacctatttggaaccaatatgctggaccagtgaccactgattgtcatttcacagagaggatcagttgtgacgaacaatttggatagaattaggaggaagggaagaaagtatcaatttgatattcttgtcgaatatgaccattctatttcttgtatgttgttctttgtgcctgagaacactttgttattctaaggtaaaaaagaaaatcagttagctacaacctgaaaattccatctgttcttctatcctcgagttaaaatgtggagtttctactgtgtcttagtcagaaattattcgcagcaagtatcaaatgagctacttctattcatagtatttcaaagttacactatgtggtccaaattccaatatatgtttgtgatggtgaatcttggtgtgtcatccaaaatcattaaataagaggagcgtttggtttagtagaaaccataatcctaaaaagggaggaaagtgctattgctctcatatcaagtattttaatggcactaatatgtgtgttttttttagaaagaacaaaacagtcgctctttaataccaggaacaacacatgatctataatgtcaaccatctttgcttgactttaaggggaagttttgtatatgatattaaacactcataatttaacaaaatatctattcatgcttttaacagaattgttcttatacaacctgcaaatgatgtttatgtccatatgttgcaggtttatgaaatggagacaacctacctacaagagtctaatcaattcggaagtgtgctaaagggttttgaatcattcttatcatcgtcaaagaacacttccaagtaagaaatctttattttcttagactgctacgccctttactatttggaggtcttcattcattttcttttgacatcccactgtatacttaccagttcgaaaccttcagaattcatgccacattctttgcttactttcaactgttgattgaatgacctactgtccttcccttgaactttctaccagcctctgatcacatataatttagctaatattcggatgaataatttatagttatagatattgaacaaaagatcctctgatcacatataatttactaatgatcagatgaatgatgttgaacaaaagatcctctgatcacatataatttactaatgatcagatgaacaaaagatcctctgatcactatagtggcagtggcaggtattatacaacagattcataacccaaaatatgctatgatagtgttatgtcagtttattggccaattgcaggggtgctctatatgcactatctagcatcaccaagggagggttggatttatgattaccattggcataatgttgcgtgttcattattctgcacaagcaaatgttttatcatttctgttctgctaatagatcacacagaattagttatgacagtttctatcttattattttcagtctcaagcgctccaggaagttccaggctgatgagaggctgttctccctgtcatcggttacatctccagcggtatgactaatgatcctaaatcctaatgcactgaaaagcccgtgccccttttttaatcttttggtttgctttgattgatgattgttattccccctgtgctatactgatatttgtgagtttgctaatacataccattattttctattcattccaggtcgatgaacatatggctggacgagatggtaagttctctttcttgttttcattaagctgaaaccaggaacaattgagactctgggctcaatactagctgcatcctggcagatggaagagaatatggatcaggtcgttcgaaaggtgcaaccactcctgcaaacgggcagtaagtgctcagattacctttgtggcaaaaaatgtgctatccttatcagctttacatacatccttgcaaggggcagtgtttgtctaacacttctttatattaaaaaaaacagtgtttctaggaacaacccttttagcccttgtttagttccaaactttttcttcaaacttccaacttttccatcacatcaaaactttcctacacgcacaaacttccaacttttccgtcacattgttccaatttcaaccaaacttccaattttagcgtgaactaaacacacccttagtagaattgcctagttctgacccctcgtgtgtttggacagaggaaaaccaaagaagggaggtcgccctggagggagagacggcaagagaatacggccatcaaatgatccagatctggacgacgaagaggacttctaactcgacatgttgtaggcctagctcagtgatgatttaaccttgctagactcatgcttcgaatcattctttctgtattgtaatttttttttaatcttgtgttgcaatccatggcaagcaaagccttttccccagggagtagccttgctcatctagtcatcttatcgtcggcatttgcctgtgcttgcattttcttccttttcaacccaccccggcgttgtctgattgtctcccgttttgtaaagcagtagcaagttaattagacggtgataatttctgttaactctactgtaaacaacgttgctatagattccagactccagtgagacgaggatgagactccagcgagacgagaatctggattggccgattcttagtaccagaaaaaaatgtctcatccgattataggtttttatattttggaacgtgtagttgctagcacaccgccgcgtttgccagggccaaggtggagttgaatctgtgagttcacctgttgcattgcaagacaagctggaacttgtaatctcaacaattagattgcagggtgcctgaggttaatttgtgtacacttttttttagtgtagctagcaaagactacaagtaatgctttttatattagtataggtgattaattagctctaagtacaatatgatgatgcaacacgcaggcatgcatgtctaaacagctgtgcttagcttcaagtatggaaatagcttgagcatcacttcttcaacaggttgcattgacaaatactccctccgtcccaaaataagtgcagttttgcactatttatcttcaatgtttgattatgtttgatttttcgtcttatttaaaaaaaattatgattactatttttattgttattagatgataaaacatgaatagtactttatgtgtgactacttttaaaaaataattcataaatttttcaaataaaacggacggtcaaacattggacactttaggatggacgtagtatttttcattttcagaatcttaaatgcatttgtccatgaaaacatctttcgtggaaaagatgtcagaagcttttatctaagaatctcgctgaatcatcatgtttaagtcgatcacatcagctgcatatatctgtcaacagaagaacagaacaggttgaaaaaaaaaaagctgaagttgatactacctccgtttctaaatatttgacaccgttaacgttttagcatatgtttgaccgttcgtcttattcaaaaacttttatgaaatatttaaaactatatatatacatataagtatatttaacaatgaatgaaaaaaactaataattacttaaattttttgaataagacgaacggtcaaacatatttaaaaaagtcaacagcgtcaaatatttagaatcggagagagtattttttactagaaacatcaagaacactagtagcacttattcagaatgagcactgttgaaaatgtggtgctcttattgagaatttcacaagagcaacacgaacagagactctatcatacatcaacctaggagacgcccaggttggcagctaatatcaaacaagatgtttaaagctttgctgcaggactccgatgtacaaagtactgaaaaccatggatcatctaggtacagggaaaagaagatagaagaaagcacatcagtaccataaaagttaccacacacagcagaagcatcgatctatctacactcagccaaaccacctgaaagaacagggggggcaagcagcatgccttgcatcaagcttatctgaacggtctacggcacaacctggcataggtgcctctggaggaagaattcagtcagcaactgtaactaatccttggtttatttttctagttcagcatgttgagtcgcgaaagaattcggtcggtattgagggtgggcagggcttcttcgccacaaatttgtactgcagaaacaaaggtacaggaggcagcattaggaacagtacagataactgaagaaatggggaggatatgcagtttataccttatgttgggtatacttctccctgattgcaggaaggttactcccaggaccaacacagaaaaggcggtgcaatgccttaacgcagtcgcttaactctgacgacttgtattgtgtgtagtgagcaagggtggaattctgcttccaatttacaatgagaagcatatgttagctcttgtatttttttatttgaatgttgatataaaagatgtatggaaagttcaatatgatgatgccaccacgtacccaagggtgctttgctggctgcagtatgaatttggccaggaaaatagctgatgccgctactagtgaaggagggtaagaaagtagattgtactccagcagtgatagctcagcaacataattggctaggaactcaagatgcaatgctggatcctgcacgatgaaaagctgttaatgcaatgcagcatataaatagtatgaaattgcagcaagcaggagatgattaagagagcagcacctcatcagatacttgtgcaacacggacaaatctcctgttgtaggcaagaagatagttattagagttcgattcattccagcattatagacatcgatgagatgaaagagaatagaacctcaaaaagcattttgctgtaggtgcagtcatttcaaacttcaggtaattcaggacagaagcttccatttccaaaacctgacaatctatgtgttagtcatggagataaacatagaaatgttcacagatatgcaaaacaaacctcatctctgaagtatgtgttgtcagttatatagcagaattcttctacttgaggtgcacatatctccttgtattttctgatataggaacaagccaaaatcagtacacaaaactcagatgcaaactgagaaacacatttaaaaaaattgctaatcagatcttacgcagcaataagcatacaagcaactccaagtaattgcagtctttgacgattgatctcattgccagaaagataacggtcaatgtagttaactgtcaggtataatgtatcaggaacaagacgatattcttcagcgacctgcacaaaggaaaagcacaaatagagtggtaagtaacgattgtggtctttaggctccaatcaactaaaaaaatttgttcggtataaaagcttacttccacaagccagtctatcaggatcgctctcatgcttgggtttacatccttttggagtgtttccataaaatcggttgatggatgtttcctggtctgcttcaagtcaaatagaaaatcacaatgtaaatatgaaattcaacctagatttgaaaccactgtgctcaggtcagattaattgtcatttgatcaaactgactgcagtagtgcagtccatgtcacagcaaaaataatgagcaattgaaaaatacttcaagagcattgattacaacaattgaaatgtatcaattcatcggttcagtcaatgctttaagaagataactccattacaatttctccatattatactgtgcttctactggttctatagggaatttcaatatgatggccattaaatggaacccactattcagaaaaaaaaaagtattcaagaatgttttatgtaaggtgtttacataatatgcagaacaaaactactgaaaattgatggtcacaaagcatgtctggtagatgataaggtgcaccaacaaagcgaaaagcagaaaagaacggattgtggtgaaatgtgaaaaatatcctgataaattacattggaataatgccttatatcagtgatgtgcacttattctcttcttaatttatggtctcatcaaagtaaactttttttacttgtgtttcatatggatgcaatcaagtctcaaatcatgaggaagcaaaacaaagccttcctatgaaaacatactacaataaggtgctcaagggaaatgttttcagagaaataaggtttagtcaagaatgtattacctcggcctcgcgcaagtgcatgtagatatcagaagcaagagtagcacacaactgcggatcctcgtagttattgtcaacatcacaaatttggtcgatttccattggggaaggagcatccttcttccacttagtttctgcgaaacaaacaagggaaaagatcaatcaaccattccaatagaatgcaccatatagcacaaatttttctagctataactgtgcatttcagcaaccaaaacacaccttcaacatctctatcctctgagatacgcaggttctcgtttgctcttcgctgcaaggaacctagaactgaggaggaatccccattatcaatatactcaaagtctgggcttttcattgagtcgcacgtcgacatcgtctcatcaaccgaaactgaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggacttaagttaagtccctggaagtaaacaccacctgaatctcctgaatgcataggggagacgaagctgctgcagggtacagtgacaggtgcaggtgcagcagttggaacaattctaagcactttaggaggaagaactgactccttctgtggggcgctctcatggcgggatatggccgaagctggcttggtggaagctgatttcaccgccgagacccgattcgtgcccacattgcggccactggccaaagatcccttcttcacaggtgcagcccaggtagctgaattaaatttctgcaggaggattgaagacaagaaatcaatttagaacttatatttcaatctgttcatttgggattccagaccacaagcatgaaaaggaacaaatatttattagaaacattagcagcacgcaagtatcatattaccaatagaagattccaaagcaagcaaacatacaaaacacttagcgaataccaagaaagcttttattttgaacttctgaaggtgccaataaaccctcaagtgaatttagcctgttgacctggatgctccccaagaaatcaatcaatcaattaaccatgaaaagaaaccagaaaatcagcaagaaaaatcttgtggattggaataggagaatcctcaaaatcagcaaggaagaatgtggcagaggtccaaatttgaatgtgaagagcactgaaaaaccaaaaggcaagaatatattggggatggaagaggagaatcgtttgtaggctaaccaaggagaaattgaagaaatgaaaatcttgttgttggctgaaagaaagaactcaagaagacgaattcaagaaacactatttatatttgcttgaaaccaacagatcgaggagtatgtcctccacaaacaagatggaaaaaaaccaaaaaagaaaaaaatcatcacagatcgcttcggccatttccgcatcaacagcgactcacttgtgccccaagaggaaccaagaagcaaaaaaaaaaaaaaaaaaagccacccccaaaccattccaaccacctcacacaccaaaagatctccacccaaaccgcgcaaagcaaagaacaaatcttggagagaaaaaaaaaggaaaaaagaagaagaagaagcagcagcaagcgatccttcacgtaccgcattgttggcggcggcggcaacgttggtgatgttaccgagcgcgacgcgcttcttggccgccgcggcgcccgcggccgccttccctcctccctcccccgccgcgggccgcttcgccgccgacgacgacgacgagcggcgggaggctaggctgctcgacatcggccgacggcaaccaccacctgaaccctcctcctcctgctgctgctgcgagggttgcgagggcggcggcggccggcggggatcagaggcggagcagggcgagggcttggatccttcccttcccgacagaggaggggagagccggagaggagaggactcagaggagcggaggaggagaagagagaaaatggcgacgactctttcgattatttccagtttttggggaaaatattctaatccctcgaggatgttccctcgtttgctcaaaaaccatctaaacggttatgaaaaatactgaaaaaatttgacaacattcatacaacacatatatacaactctacaaaatcttaattccaaactcaactcacacgtcgagatataaaaagacaaattcagcgtatgaatagtagcgtactgtttatatctaaatttgtcttcttttgtttctcgatgtgtagatcgaatttgaacatgaattttggtggactagtaggtatcattatactctacattgttaatttttttcagaatttttcataactatttgtatcgaatttggaagaaaaaggtatacgaggggatatccctcgagggattagaatccactccccagtttttgggccgttacagttgttcaaatttcaaatagtagtaacaagttgttttagttattcgaccgttttatctgtctttctttttttcatgtcgtcgtggttgggttattacgttttc

SEQ ID NO: 46001 - DNA, 1431 bp, Oryza sativa
ttcggttgcaaagaaacctggaaatgcaagtgatgtgtcaaccaagcgcaaccacacggatccttctgcaagagcaggcaaggcagcactcactgattcctcgtttgcattgaaacagatgtacaggtcgcctctgaccgaatctgccgccatttcatctacctctgcatttatgtgcatgcaaagaaagttgctggtaggatcatcccaacctggctcacatagatcgctcccataccaatgtatattctcaagttttaggaattcccttctctgaaagatatcgcctcgccgactcctgagtgcagttagaaatgaaatgaatccggtcacttccttaacaaatgttgtcttcatgcctctccagttcagaggccctctatccttgtatgatactgaaccagcagcagagtgcccacattcatctcccatgttcagaacaggaacaccaagtgatacaaatagaataaataagaagttgcgtatctgccttagccttgtctgaaggacagcactgttctctgatggaccttcttcaccacaattccagctcgactcagaaagaagatcatcattgctgaaactcaccagatcaacaagagaaagccctgaattcctggatacatgattgaatgaaaatgcaggccctctggttgagaacaggtccccactgccgcacaggcgtgtagcaagatcactaataagtgcttctctcttcaaaaatttgcgcacatcaatagagaatcttgtgttcacctcagcccatcttttccaatgagggaatgggaattgcacgttagatatgtcaagtggagaccaaggatctgcaatgatctttgtcatggaaagaaccgggtcaaaagttatcgcctcaagaaggggaggtcgagataaatattcaccaccaggacctctcacaaggaaaggggcattgatgaagcaaaacccatcaacatggaagtcaagcacccaatggcggaggctgtccaaaatcagcttctgagtcaccggatggttgcaattcagtatgctcgctttgcatcctgcgatcccattggcaatgtaatacgaggaattatcaatgccacgcattgatatcgtctgacactctgattctccctcagcagtatgtgtaaaaaccacctccaagaggacctctattccatttctatgcattaccctgaccatatccttcatggacttgatggctgaaacactcaaacctttgctgctatacaagttcatcggtgaaaagaaatggtacgggaaataaggtcctttcacctgatgaaatgggaacactggttccagcaaaattgcattgacaccaaggctcctgaagtgctctaccttagcagaaagcccggtgaaagtgccggcagcgtcatccgggagcccgctcgacctgtcctttgtggacaaagccacatt

SEQ ID NO: 46002 - DNA, 1537 bp, Oryza sativa
ggttggtttgttcatttgcgtcgcaggtgacgccgtcgcgcagcggcaccgttggtgtcgctgtcaccgcacagtgcaggtgcgagtgcacacaggctcgctcggcgcggcggggtggtgcggccgcatccgtccgtttcgcgtgggtgtcccatgtacagcagctgttcgcgcgcactgggccccgtccccgtcacgatgtggagtggagatgtgatcgtggcgtcgtcctgctgtccggtggcgtagaccgctgcaagtagcacatgtactcgctacgtgatcacgtggtgtggtgtatggtggtttccaaaagtgacaagatccaagaaacgggtggagatttatcgtccgcccaatgtgccgctcgagcctgcacgttgcacggatctctttgatcgatcagtttccagctgcaaattctgccgttcgcgaacataacaggtcaacagccagcagttctctcagctgattttcgctatttgtctacggtctactggatttctgggctgggctgaccgttgtcgatccatttcatcaacaggctgggccattgcaaagatttttggaataagttcagaaatcgtccctcaacttttcatcgagttgtatgacatccataatctttacccctaaactatataaaaccgtataatttaggtcttatagcagtatgtatatctggttttgctaacgtagcatcctagtcagcaaaataaaaattaaatttttatggggcccacatataagtgagtaaagtggagactgcatctcttctttcttttctttttctcctctcatctcttttcttttctttcttctctactcttcttcagcgagctaggaggcctgcgagcccagccgagctccgccgcctcgagctcgtggagggcgccgccaacgccgtcttcggtgcgctcgtgaagatcttggccgcgcggatgagcgacgccgtcgtgctccgtgagctcgcctccgccggcgaccgccacaccctagaggccatctagagagcccacaacatgtgtggcgcacttgttggcctcgtcacgagccctgtctcctcgcaagtcaccaaggcctccctgttcatgcacctcctatgtgccctagaagaacctgtccttctgccgttgctctggccctcccagtgccaccatggcgcccaaccaccaccacccccaccgcaacaataacagcaacaacagatcaaatcaagaccctcacagtcgctatctctcacctcataaatcctgcggacacaatcttgcacacgcaaaaaccgaagggatctcaccgacgacggatcgatgagctgtgcaaggcaagaaaaggcggcgttttcttggggggttttgggtgcctcctccgcccaacccgcctctgtcctctgtgtcaagctaccctcaccgccccgtcagtgaccgccgtggggaagtcattggtgaagaggagtcggtcagtcggggagcttgtccgtcacagactcatggaggcgtgcgctgacactccccaccatcgtcgatgacccctctgc

SEQ ID NO: 46003 - DNA, 2908 bp, Oryza sativa
  unsure (1)..(2908): unsure at all n locations
ccacaggaggcccgaagtcacccgcgtctcggccctctccgtcctcgttgctttcgacgccggaggccgagagacaggcgacgcgcacgtctgtttgcgccgttgccgcagatcagcctgacgaggtaatcgtgcgcgtgcgcctgcgcctcgatcgatcgaccattcctgccctactcctcgatttgttcgcagtcgaattggattgcgatgtgctctcttcctcctcggttttcatcgatcgcttccttctttttgggcgcgttacttcttgaataaatccttttcattttctcaaactgtcaaacaccttgaacaatatttgccgttatctcgattcaccattcatacccttcttactttgtgatgatcatcacctaggtttattcgacttcaccaatagtctgtcacgtttattgtgttacaactgagaattaacaaattctttctgaccatttttccaattcattgcagataccagctctaccaacaactcccgttacttctctgtatgatgcctgttctgaactgagtcttcatagatagagagaaatgggttctctcacagatatcggcgtcgccgcaggaataaacatactgtccgcattgggttttcttctcgcatttgcggttctcaggatacagcctatcaacgacagggtctactttcccaaatggtacctcaaagggacaagaagcagcccaagaagcatgggaacggttttctcaaagtttgtcaatgctgatctctcgacgtatatccgcttcctgaattggatgcctgcagcgctgcaaatgcctgagcccgagttgattgagcacgcaggcctcgactccgcggtatatgtccgcatatatcttcttgggtgagcatgctgttcgtgtttcgcaattggtctttttttttgtctttaaagtttccgaaaaggttgaattcaactgataaatgtgactatatgatttggattggatgtcagaacatattcggtgtattatgcttactgcatagttctcttgctatgcaggttaaaaatatttgtgccgattgctgtgctggcattcattgtccttgttcctatcaactgggctagtggaactttggagaaggaaaagagtctaagttatgatcaaattgacaagctttcaatatctaaccttggaaaaggatcgaaaaggtataattctctgtgcttcatgtgtgtgtcctaatgcttgccgcaccaccatggatcgtgcctttgtttctttgaatgattacctgtgtagcgtataatgttaccgctagtctttacttctattccggtatatgcaacctcatatccttcgaacaagataatgacatagaaggtttcctttcctatctgtactttgaaaaaatggcggtcagacattttggaattttgtgaatatgtttgcagtttttcaatatcggtgcactattagatactttccattaatttagtacaaaaatatttatgcagtgataacctatgcttaacctaaaattgtaacaattaatggagactggtgtgactaataatccaaactggacctcttcgaaattgatgcatgttctaactttttcacataaatctgctctattaatacagaagtggcaaaccttctgccctttcttcaaaaagaaaaaaaagcttttcacataaatgaatgcaaaggctttgcctccaaataatttcccaattatcgatgattattctagcatttagtcatcatcacttttatcaaatcagtttttatgatgctctagcactagaatttgatcaggctcttgcggtatttttctaaccaacacaaatgcctactaattagttttttttcgttgtcaatttcactagtgagagtttagccgaatttatatcttgtgttcgatatcctgataggctgataatttctctaatgaatttatgttttttccctgtcaatagattttgggcacacatagtgatggcctatgtatttacgttttggacgtttttcgtgttgtatcgtgaatacaaggttgtaacaactatgagattgcgctttcttgctattcagaatcgtcgagctgatcagtttacggtgagagatctttcccgtaacactcagatcaacgaatttaaacttctttactagattatttcaactttgcaacttattatatagttatgcttctttttttttttgaatttacggcggtgaaaattttcttatttatctaggtcctggtgagaaatgtaccacctgacccagatgaaacagttagtgagcatgttgagcacttctttgctgtcaatcatcgtgatcattatctcagtcaccaggtaataaattttgctatcttcaatccgctgtggacttcagcattgctttttgtggaaaaactagataattaagttgtaaggaaatccaaataagaaacgactcattgtatttccttttgttctgttctcctgaattaccgacagttctttactcttagcacataacaaatagtccagctcaaatgtgtgctcctcatttggagtaatttcttttttatcatatgaccaacagaccgtatacaatgcaaacacccttgccggtttggttgagcagaagaaaggcttgcaaaactggctggtctactacgaaaaccagcatgctaaaaaccctgcaaaaaaaccaactatgaaggtacgggttgtctgttgcagatttattctcatggacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46004 - DNA, 9178 bp, Oryza sativa
  unsure (1)..(9178): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatacagtaggtttgttcatcttaaattagaatgaacccgttggaaaactaaccataggcgccttgcgagcttgcccgatcaacttatacaatcaaatgctaataatgggttagaatacaataaatgagctttcctgaatggtggtatcttcacaaccacttgagatccgtaatgacatgatctgcaacacagagagttatattgtcttggagattctaaattaagtgcttaccgtctgacctagtacatttgtaaatacgattactacttcctctgtttgatatatattcgtctttttttctttaaaaagtacagacgcagacgctcataatacacggacacttatccttatgagcataaacacatgtatcttaatcttaagattgataaaatcatcacagacgcctagctattgacggtatgtcaccaaccactgttggaataattaattgtaaatatgagcacccctgtcaagcctagtatttaacctgatgggtaggttccaccacaattaatctaaccagttgagagctatgtccacttcacactgaacgtgtagagatgtagcctagagggggggtgaataggctttcctgaaattttctcaacaattacagcggttaaattaacagggcccgaaacctcctggtgatgaacaccggaacttccgggcaggatgagtagcccgaaacttctggagttattgagccaggaacttccgggcagctgagataaattaaaactgagatgaaaaacatgtcctagcaagggaagtttaggcacacagaggaacaagatgaagatcgcagaatatcagcagattcatacaaagatcatacacaagagagacaaagacgatttttttcccgaagttcggattacacgaatcctactctccgttgaggtgctccaaagagccgggtctcgattaaccccttgcctcacttatgaaaagatcccagaagaggtccacagccttcaactcaacacttctaggtcattttctagaattgagtgaccaccaagatccaactcaaaatttcttctagaaaagaccacaagtgcaagttgctctacctaggacaacctctgaaaactcagcacaagaatctttactcacttaccttgtttccttgtggaggtgaggaaaaccttcccaaactttcccgggacatccacaagatctttggaagctcacgggcaacacctaaccgtctaggagaagatctccaaaagtaataagcccaagtgacagcccacaagatatccaaagtgctcaatcaaacctaatcttcaagccatctccaaaacactcctacactctcatctaatctcataatctcacaagatatgctctagatttgagtggaggaagcaaatgaagcttgggggtggctagaaaaccctagaacatgaatgaacagaagtggaatcgccaaaaggtgacctggggatgaaatccatatatataacggctaggtgacgccatctagctgttactcacaagtttgaactggaaacctgctaggaggttccggataaaagtgccaggaacttccgggcagcacttaggaaatttttgcaaataaacggtgcccggaagttccggccagaacctccgggtagccctctctgtcccggggagaaaaacatttttcaaaaatgattccaaaaatcttttgactcatggataagactaagagcactttgtataccctagaaccacacttgaaacccctcttaatagtacggtttttcctaaactcaatttcgaaagtgaaaaacctagtctaatcaccttcgatgatttttgcacttaggaacattcgaattggggggtctccttgcattcttagccatcacaactcgctttgggactaaactcctgtgaataaacttgataaacacgttagtcccctttaaccaccttgtcattaatcaccaaaacccactagggggtttaagtgcatctccacacacatgttcgcttttgaactactatatcattttgcctgccttgcctttttttttcttttccataaatataatgggagtatctataaaacattcaacattttttaatgaatgttttaattataactatattataattggggtataattacattgtatctataatatagttacaacttaacttatatatgcacaaatataattggataaaacaaatggtgtggacgattagcaagcaagcattcagccatcctgtaattcgactcttggcttcagcatgcgtgtgtaatttttcccatcctgtgcaaatctcgaggcgatcagaggatcagaaaattcaaaagttttgagcagaaaaaaccgtccaatgtttttttaagccattccgaattacaattagcagagacacattgtaagatgaattagttacagtcagcatataacaggcaattctatacataaatcagttctatacatatcacagtatcactatttttagcctcaataccattgccgatcgcacgctagcagcttagccgcacggcgcttcatcttgccaaataagcaaccatctcactcctcctaaccgtttttcccaatttcccactagctttactactccacaaatctgcgtgacagcgaccgtacgtgcacgttacacttccgtggcgcgactcggcccgcccccgccgccgccgctgcacaccctgcaccgcggccgctcggtccaaacctaagcacaactctgtcgagactcgagagggaacgggtgaatcgatctgaacgggtcgcatcgcatcccgcgatgtacgctggcgacgcgcaccatactccatcccactccgccgcccgcacggctgcttctccccctcccgtgcgcgaccgcgaccgcgagagcccaagaaaggaatagctagcgcgcgccaggtagtttgccgcgcggggtggaaatgcttggatttctccgtgcggtttccttttcccccccgaggggtgggacggatcgggaatagtattatcgtacgtcgccgcccacccaccacgcgtgcgtgcgtgcgtgagcctgcgtacatgctctccacgaacgcaggggatatcgcgagagacgtggaggagatcgagtagtaaggagaccgaatcgatgggagagatcggtaatcggaggaggaggacagaataattaaccggtgtgtgctagagattatggagtccgacacagattagcactccactgctaactaagaaaaagaaatgattgattattgagagtggatgaatgggcaggcagggatagattattatacaagtattttgttggccgaactagaggggaactaggtggtgtttggattaagcactaaactgtagtcactataacatcggatgtttaacgctaattcaaaatattaaatatagactaattacaaaactaattgataaatgagagctaattcgttagataaattttttaagcttaattaatctataattagcataggtttactctaacatcatatagactaatcatgaattaattaggtttaataaatccatctcgtaaattagtctagagttatgaaataggttttatcgttagtttacgtttaatatttttaattagtatataaatatccgacgtcatagttttagtccctagtggtcttagattcttggggtcggagtcggagggttagtgagtggaaatgacgccattagctggtcgaaaataatagtggaaaaacgccgcccgtgccggcgttgtcataggtttcgtgtatagcgcccgggggaattattttcttcttcttttcgttcaggaccgcttggttttgtttcttctgatgaggatcggagttcgtgtgcatcgctccttctggagagatgtcgtgagctatccggcctgtgtgtttccagagaacacatggttcaatgacaacatgacaacagcacggggtgaaatcgcggtgaagtcatggtcctgtacgccggtgggctgtatgtgtaaaacatggaaaagttctccagaaaaaatgaaaacgtcggtgacgtctacgcagacttaactctgcagggcagtacggtgctgctgctgctgctacggaagctgtggatctcctagttacgccagccaccgttgccatcatccacagtgctagtggtacattttgtactctctcctcgtagtagtagcatgcagcagcaatagccacgggtactgcacgcggcgtcacggacggtggatcgaatcgaccgagcggctggtggtggcgggggcacggaaactactgcagcgacgcagggggaagcagtaaatggtccgaagcttaggtaggaatgaaaaaaaatagaaatagaaaaaacaaagtgtaaaacagataattgtaaaacacggaaaaaatcatcagattggaccgaaaaaaaaacacaagaatcagatgagagatatactcaaagaaattttttcaagaggttggttctcttggtaaattttctttaaaacttacgttcaataagctattacagataaattttatagaatttagaaaacttcattcctttaaatcaaatgaccaaatataaaaaatgtcacgccccgaactagtcccgaccggaactagcccgtgacgctccaaattaacctgttaatcgataccagtcccaggaaacagtgctggtatcacaggaagacagaatatcacagcaacagaggtctctttattatagagtaggagtacagtcatgttgggccgcggacagatcccgagctcacaaaagggaagcggaagccaagacttggaccaaacatcacaggcgcgacttgggaactaggccgaaaccctaaaactcatcgtagccggcttgctcctggaagaactcctcgtcagcgggatccgcttcatcttcttcagcaagggtgagtacaggagtactcagcaagccatgggaaataagtgtttaatgcaggcttcaaagaaaggccgttgtttttgcgattgattttatttaaactcttttttgaaacaactaagggagtgcttctcaaacgacacggatgagacagtgcgtctcgtccggtcggagtatgtgcaatgtttcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactatgctaggaatcacctcacatccgcccatgaccgtgggcacggctgctcgaacagttttaataacctctgcagagggggcacactttacccacacgacattactaacccggatcatccagcccgtgcagaacggccacgactagagaccttaaggctttcatgacaaagaatttcaaaagccgacacaggttcaccatatgccaacgagaggggtcccagaccaacaccagattaggtcccagaccatactgtgccaggaagccaaggggtcctccccgacaccaccccggcgaatccacatgtctcttagcatcatggctcccccgataagctagttactcagccagaggtgtcccattccacccatgtggtcgtacttgtcttatattcggatgaaattccaaggaaacggtccttaagtgcaagagcgggaaaccgtacacccggtacgttcctcggtccgcggttttggaaattcatttagttcgcaagcaccgacccaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaatgtggcttgccttgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaattttggaagttgaacggagtcaatcggacttacggttgggaagatattgaatttctaagattattggatttttggtctaaaggaaaaggatttatttaaatcctttttgaaaaagaaaagaaaagaaaagaaggaggcagggaaattagactttcctcgggcggctagggcgcggcccgagagaatggggcggctcggccgagcttaatgggccggtcggcccaagaaggcggcccaaagcgcgcgcgggggcggggaggggagagagagagccggtgggccgggtccatcccgcgtggtcccgggtgggacccgcttgtcggcgactcggctcaccgtgagcgaggtgcacgtggggcatgctagggtttggggagggaggcgcggcgcatgcgcgcggttcgtggaggacgcggtgcggcgggcccacgcgcagcctcacggctcgcggtggaccgcgtgcgcgagggggctgtcggtgacatgggaccgggagtatcatgactagaggcttgggcagccgcgatcacccacgtggcctgaccccctcgggggggggtcgggcccgagggtgatgtggccgcccctcgccgnttgtctccccgaggggtcggaccattcccgtttcggccccgagggccggggcgccccgaccccctgtgggtttggcaccacgtatatgggttaggtgagcacagcggggctcacctaaccgcatttattgcgggttggatgagcgcgtcacgccgcatgtaatgccgcgcagcgagctcgcttatccggtccgtgaccaggcgcagcgtgtgaccggtcagatcgcgggttaggtggtggcaggtggcctgttacacgcctcgccccgtcccgtcggaatgatgagagcctccaggcacttatccctagccggagccggcgtgccaactcctggggttggcacgtcagccccggccagatacatgccaggcttcatcccaaccattacaaggaagtaattgtatgaagaagggcagacgtgcggcatgctaaactgacacatggtggacaagaatgaccggtctgtgactggtctgacaccggtcacgtcatcggcaaacaaactgtgctcccacattgcgtctgcagccggcggagtggaggtaggtatgacccgtcccatcgaagggtcattcggacaacagccattgcaaatctctgcccattaatgaaggattgacaaggtgatcccctgtgtcaggcgagtgtcggcgctgggtctcactcaaagacaagctatgacttagcttctaggagaggtggtgcatgtggtatccccttgagatataaaaggaggaccttgcccaccggaaagaaaaaaaaaggagagaaaggagaagacgatagctgatagaaaacaaagagtagggagagggtctctagagttcaaacgctcttgctctccacctctttataatttcttcatacacagatccaccagaacacaggagtagggtattacgcttcccagcggcccgaacctgtctagatcgcccgtgtcttgtgcatttgctctctcgcgaaccattccacatatcgagggcttagaaccttactcagcgcccccggccgaaccggcaaaggggggcctgcgcggtctcccggtgaggagccccacgctccatcaggggcggagggaagcggcggaccggggtctgcttgacccggtcgcggccgaggtggcaccgacgtggcgcctacgtggctgccacgtgggccggcgggaggtagacgacgacgccggtcgaaacggacggcggacgacagcggcgagcggcggagcgaaccatggcgatacaggcgaaggcgagcacactgggatgttgcacaggacgaggggagacgagccaatggctcggattcgccgggggatgctcgacggcggcggattgcggcggcggcaaccgacggcgggagaagggggaaacagcgatgaggtcacaaggggccgattcccggcggtgagagcatctacgcggctacgggaatccgttgctagcgtcggattgggcggagctacgccgagcgaggccggcgacgagcgggcgctacggagcacgggcggcgacggcggcgagcacacagcgagcagcggcaacgatcggggcggcgccagctagctacgggaaggctacacatgctactaccgaaaactaaggggaggagatggatcgaggagggagaacgggggaatgcactaccgagatgaggcggggcgctgtgacgagaggccgacggcacgggagtgatctctccggcctcgggccggggaagaggaagaaggcgagcgcccggagtccccttccgtgtcctcgctcgtgccggctcctccgacacgtgcgacggcgaacggcgacagcgaacagagcacgggaggcggcgacaatggagtggaggcgaatgggagaggaaaggaaaggggggggaagcttgggtttatatgggcgacaatgtcggtttgggagaggggaaccgactttggacggtcaagccagcgagctggcgctctggctagcagccaaatcggcgacagggagtaggggaatgactccggcagaggaagaaaaaggaaaaaggaaggaagaaagggggcttgccccttgccactttgggaaaaggaggaggggagggggcgacgcggcagagggaggaggagctctgcctccgtcccttggaggctagcgcgcggagtgtccggggcc

SEQ ID NO: 46005 - DNA, 5792 bp, Oryza sativa
  unsure (1)..(5792): unsure at all n locations
agagagagagagagccggggagggagggggagatgggccgagagggattcggcccatcgaacccgagggaggcaaaatagacttttgcggagggatttgatttgggaaggatttggattcgggattgaactcgacgatagatcggggatttgagatctgagatggcacggacactagacaataagcaaagaaacggatttcgcaaatagggtttttaagagatagtttttccgctaggcgccacgacggaacgggcgctacagaatttctataaaattcttctactaaattcttttgattcaaatggccacaggaatcagataagagatatactcaaacaaattttcctaagaggttagtccttttgctaaattttctttaaaacctagattaaattagccattgcagataaattttataggatttgaaaactccaatcctttaaataaaatgatcaaatagaaaaaatttctataaaattcttctactaaattcttttgattgaaagggtcttaggccattctcaacccaacacactagacatagtttccataagctccacatcatcaaaaaaactagtactagacactactcttacaatgcaaaaaccattattccatacttaaatttagtgctacttatctcacatgatgtcttggatattgtgtagaaccatgtctcatgcaaaacatggtttcctttgctttcctcatttattcatttgccacgtcacttttcatcttaggtagtaacttatttaatgctatagacaccattcttgtcattgggttgggaatggcattaggagtagtacgtccgctgtacgctgcacgagccggggagcccaacggttggtggctgcctgccttcgccaatttatttcgccgcaggccgcacagccgatcgatctgcagagcagcagtaaaaacgctcgtaacgacggggtgttttggaccggaggaatggcaggttccagatcgatgcaaattcgcggtgaattcttcttctgctactgctactgctgctgccgctgcgttatattagctgtgatctgggctgtgaagtcgctcgggggatagaaaaaaaaattgctcgtggctgtcaatgtgaatgtttgttggtgcagataggtcgttaggtacttgcatgatggtgagggttttgggggcggcttcggatgcaagggattgggttacttctagcacggttggtgttactacgtacgtacgtgcatgcgtgcgaatgattatattctagcttcaagtgcacactatctgatcccagatcaagtcgtggtagggttcatacactgggttgtcgatatatcagttacaccttacgagaaagatatggtgaatgcctgttttcagacaaaatatcttttttttttagaaacacaggccaataaatctatgggtatatctatacctttgaattctaaggttgtgtttgtttctaatggttgggaacctttctcctctagcacgtaaaatgaaacgacggtgttaacacacgattacttaagtattnctaaaaactttaaaaatagatttatataatttttaaaggaactttcctttataattttttttgaaaaaatacaccattcagtagattgtgaagcatatgcgtggtaaaagagagagtagagattggaaaagtgtatgattaattaagaagagaattggagaacattaaaaagataagaaaaacgagatgaaacattatagtatacgattaattaaatattaattattttaaacttaagaaacagattaattaatactacctccatattttaatgtatgatgccgttgacttttttttcaacgtttgaccattcatcttattaaaaaaatatataattataatttattttattgtgatttgattcgtcatcaaatattctttaagcatgacataaatattttcatatttgcacacaaaatttgaataaaacgaatggtcaaatgctagttaaaaagtcaatggcgtcatacattaaaatacggatggagtatgattttctaaagcaattttcgcatagaagtttttttataagaagaaacacaccgcgcagcactttgataggcgtgcaggcggaaaatgaaaaattttcctctcagaccctgtttagatcaatttgatgtggcaattttttttagaaaaagttttggtggcaaaagatttggtattgaagttttgctagttggtgtttagatgcatggtaaagttttaccattttactagtaaagacagagagagcacggttcccaacatacttttttggtaaattttgctactctaaactttcaaatgacaaataccaaattgccaaccttttctaccagtgtttagattcattttagcaaaagtactctaaaacagcaaaaaaaaatttgttattttggagaaactaaacaggacctcagccatcttgtgccgaacacagctaattaattggataattccaaaggcgctccgatgtaaaccaaaaatcttacacattgatttcatgtattattgcgaccatagatactgttgagagtttgtaataaataaatcacgtaactggaaatagtgtgcactctactttactaattttgaaatttgtaattaataaatatgatatcgtaatcatttcgaactctcagttagtttagtgatatgtaaaattaattataatattccaatttactactctgctatgttccataatatagtaaccgagaataagacgagagtacaacaaataatctagatagacgtatccagattcgttatattatgaaatatgtttcatccaattataggctgctataattacccataactagttagggctaatgacttatctgtcgtttttagtctttcatgggtaggctcatggggggcgctgatccgcggctactcgcgcagccgtgcatgcgcaatcagctacacccctctagtagatgtatatacagatgtatatacgtatgtataacatgcatatgtataaattttgtatactaaggctgtgtttggcattccttattcccaaaaggaacagtgcgtatgaaaaacgaagcgattcattagcacgtgattaattaagtattagttatttttttcaaaaatagattaacttgatttttttaaagcaacttttgtatagaaactttttttgcaaaaaacacaccgtttagcagtttgaaaagcgtgcgtgcgaaaaagagagaaatgggttgggaagaaggggtgccgaacacagcctaaaaagatcaaaaaaactgcaaaagataaaaaaagaacaaagaaaacagaaaaaaggaaactgcgcgccaaagaaaataaaaagaaaagggaaccacgttgtccgccgcccccactcttcgcgcgtgaaacatgtcgagtcgtgtgggggagggcgcacgagactagttacgaattagcattcacataggagaaaagtagaggttatcgtaccccggcagtataagcccgataaccatttagttatcaccacgaatagtaggaaaattggacggaatttattaaataaataaatatcgcttaaatgtattttgaatttggtagagctattaggctaccttaccgttaccgcacccaactactacggtcggtaactggcggtcggtaagagaagctctccttgctgttcccatctttccaatgccacccaccgtgctatgtttaaaaaccgtgaattaattatttctccgttcagctgaaatcgaatcattccatataaaattcttgtattctaaactggcgcttgcccatgctgtgcgttcgtaaattgtgttttttcggaaagagaagtggctcacttagtgaaacaggacttagacttacgtagctgggcgtttaagcctccttgagctgtgttttttatcttttgtaatcaaggatctgtttgtattctgtttttcttcttaatcaaattccggcagagctcctgccgtcgtcttcctcaaaaaaaaattgtgttttttctactatattcaccacctgaaacgtttctaacgatagcattcaaaaaaaagctggaaggctggaaattaatgggcagcacgtttgccttgtcccgtcctgttgcacatatttgtacagaagtgggccaacaacctgaagcctttgccgttatttggcgacatctttcggatgggtgttacatgtagtagacgctttgtgtgtcaggtcaggctgcccctctcaacggtaaattattctccctgggtcaccaaatccctttcctttgtctttacaatcacaagcagagacggagaaaaggacaaagcagtaggaggctgagctcacagttcctaattataattgcctgtgtttctagaccgtcgctgggatatgatgcatctggatctggacggtaggtagctgtccgtgcctgaatctgttgctgcccacacgaagctgcgtcgtcgcaccttctcggctatttcaggacttctgtaaagcgacagtttcatcagacggtgagtattcagaccatcagtcatatttacaattttaaactgaagatatactccctccgtaaaaaaaaaagatttttttggacggggagtataacttagtggtcaaaatcgtttttcatgtactaactttgaaaattctatgatcaaagagtataacataatctctacgtctcaaaatatatataaggatttttttatgaatcttgataatttctggctataatacctgttcagattcataagctagaaatgattatattttaggccggagagagtagatcatcaagatcatcgtcatatttacaattttgaatctgatcaacaggtatttattctatttgtaaatcataaaaaaattgaatggaaacttctatgctcttcatcaataaaaatgaacagtactcctacaacttcaccaatacatcaatgatgctttctcatatagattgttcttatgttcattagctttagcgacacggaaaatgttgaaaatacttgagttggggatatggggaatgcatgcatgcaggcagcaggttgtgtaccggcaaagtgccaaaccattaaagtttgcaccattaattgggggcaacacagctcacaacctaaccatatgccacgagccggtgtaagcgggattgggagccttcagtcatgaacgagccatatttttttttcttttcttacaaacaaagaaaaccacttggagatagggttaattagtcgtcaaacgtatgtacgacttgtagagctagctggaaacatttgatagttttagttgataccctaatgttatggaatgtagcagcatgtgcataggagtatataatactgtcacattgctacgacggttgttgtatgtactaattattaacaagccatgtgaaaaatacactaaactaattgacatcgacgcttatttgtattaatttcttgagaatctattgggtgatctttaataaattttaccgcgtttagacaagtctgcaggaaaatgtgtgttattacgcgcgtcgacttcacttgattggttttgaacccctgcagcttaggcaagtctacagcttgagattggagcaagaaacggtcagttcattaaataattatcaccgctaattggtcccatggcatgtcaatttcgcggctaatcccatcgtgaacaatcgttcaattcgtcaattagagtacgtcactgcatacctgaactgaaagaaagttgggcatgtgaacagtcaagtcgtcatagggaagaaaaatactgaaagtaccacgcgagacaaattcaaaggatactat

SEQ ID NO: 46006 - DNA, 13648 bp, Oryza sativa
acacatgtatcagctagggatatgtctcctcgagagtctagggcctatttagagaagcttaagattttgagaaacagctggttaattggtagccagcttctgagaatatggaaaagctgggtttcctagcttctggtttctagttcatttcctggattctacgtacaactacagtttcttagaatctggaccaaaagctggactgtttgggagagcttctgattattagagaagttgtagcagctaaaagctcttctaaacatacccttataatcgtttctacgccatagctactatacgtaggttgcatgcatgtaattgtattcgtgcgcgtatgtgcgtttgatgtgccgtaggcatcgtacgttgcatgtattgttttgtatgtttgctcgtcacatggtgaattgagcacacacgacacatctcatcatcagctgctgcccctgggatttgtagccttcttgtatacctgctgcatggatgtggatttgtacatgcagctggggggcacgtacgaattaaagggcccaaggaattgatcatcgatcgatcggcaataattggtttagtggatcgaattccgtaatcagtggtacctgcatgcccccattggatgatgtttgcatatatgtgcatttatatttatattcgtattgaattattgatattagcgtgttggaccattgatccggatcttgattaattcagtgccatggatgccagctgctttaagtagcttcccgtggatgaacggtctgttaaaccctatgtgcgagaagtgatatgttaaactcgaattgtgattggatgatgtagttaagtgtcaacctatatatagtctcgaagctgtggacactaggacagtacgattctgattgttatgcacttgtgtgcccatggttcagttacctccccaagctagcaaagcacatgttgataggctatttatgagcatttttttcccatgagctgaacccgtgtgatctatctgtagatttttgttgatcgattggactagtaagatgactcatcacatatccaaattgttgcgcaccactccattgaagcagctagccaaattaatgatactacgaggcacttactatatatttccccgatctatttttgatagtcatatttccaaatctgaaaaaattattttttagacatatttcaatccaacaacttattatcttaatgactttctccgatttaatacgtgactctccattcctccacacaagattggttacatggacatcgagaaatataaatattaatgaatcacttgtttacaaggaatgactagtagcatgtttagatagatgataagattgatcttatacctcccggtccagaactagaattacttatcattagtctatatgtcaatatgaaatatgactatcaaaagtagatggaaggagtatgtcgtaattaaaattagttatgtatgtgaacaatagttaagtagtgctgttttaatgaaagaaccaaattacttaaagttccgtgtttttctgtgtgatgattaaccacgcctacctttaggaatcaacttcgatgagaaaaagttggtaagctaacacacaagtcaagacgaacataaatacaatataccctagagtatggtcggtcgatcaaagaaatgaatggcaaaagggaatggattcaagtttaatttggttgcaataattggatgggtagttttcaggcttaccaactacgagagaaagaatagattggaaacattttatgaccttatgtagttggtggtgtagttggagtcctaacccttttgaggtaacaaaactaagatcctctagttgtagatgtgagtgatttatcaagctaggttaattaaaaaacagaaacaaagacagataatgagacaaatcaatatcaataatgtatctgagcagtaagccatatatacggattgcgatgctatttaggacatgtataaagggggagcgtatcctatgcacacaagccctcgcgtgtacacaccgtgtacaccaactaaaaattatcacaaaaaattctaggaaaattcatacatgtactttcaatagtattacatctacgtgcaaagtcgcatcttcaaattcattctacatagagaataataaaaaagataaaattctgacaaaattgcaaccttaaaactgtcagattttttgttttttttgttacggctaaaatataatgaatttgacgttaagattttaaccctaggtgtaatacaattgaaagtatgtgtatgattttttctagattttttggtgacattttttagttggtgtgcatgtgtgtacatgtgagggcctgtgtgcataggatatgttgccgtataaaggtgagacaatcttgctatatatatatcttgtaaagacaactgtacagcgatcacaaacactataaatacaatattgcattattgtctttagaaatagacttcacaataaatacaccacaatttattatagctaacccatagacaatcaagttgtgttttttttttctttcatatgcccaagagcttgtatattttgccttctataacacatcaaattctcgtgacatgttcaccagaataatccacagttttgttagtagtattattttgcaatgataattgatcgatgtaatcttcttctatggagccccacaatgcataacagttatcaagcatatatagtcaacacatcatcacacgcttgatcatccaattaggatgacacacacagcactagaacaaggaaaaacacctgtcctaagtcctgaccgtgtcctagttaaggacatgtaggcagaagagaaacatggacagttctgtacagtctgttgcatctctgtccgtcaacactaagaatcacaccctgtttatatgcatttgattgctgtacaaggtactccatcatccagcctatgcatgtgctataaccgcatcaggtacagagaaaatgcatagacaaaggaaaaaaaataaagctataattaaaaaggtaagagaggatgattaagtaaaccaagaaagcccagatgattatcaacaacggcagatggtttctaacttagaattaattaaatcaagggttagtttgggggggtatggcccaggtttgttaggagtctctaatcatgcttgcagttgcattagcacacacactgtcgaattgccagcatgttatgttctacttgcatgtgtgctccctcatttagacagaggaatgacatgtacacgcaagctaccccctgaatttggatggcactgttgattagttaatgctacttgcacttagttgcaccttaatttggttcgtgcaaatgggtaaattgtattgaatgtaagatttttaggaattgttaattactacctccagtcacgagtcatttggacatacacctgatcaaagttttattttttttcttaacaacgtattataaatatttgtattggatatatggatgtcatatatatgcatggatctgcataaaagttactcacatgttataagtttattgggtttcaacaataatacatagtacggtagaaaattagtggtaagtcacagtaaaatttcagaggttatgtgattttttctcgaataaaaaagggttatgtggatgcttaaaatggcatattatatatgtttaggttgttttcaaaagaagtggtagtaggtgcaattactaagtgttcacgagccacctcacccccaagcggtgagccagacaataaatcatgatcgaagcagatggattgcttgatgaacctaggagtttcacgtgaataataatagaagtggtagcacttgaattttcaaatagatgtagtcaactgtagcatagcttagcggtgtagcacgtctctgtggctaatgactgtgctttacttaattaattagctccctcaattgttcgttgggcggactattttatatggacttgtaatcattaaaacggcagcaatataactaatttgtccatatgcatagaaaattgcatctttatttgagagagtatataaaaaaatgcatatgatatatacaaacaggggattgatgccagagtgacaccaaacttggtttaattttctatctgattccttcttctagacttctagtcacccatgaatgcatagttggtacgtacttggtagcctgcattttctctctccttggagcagagataacaacctgctaataaataaccaatttcctcaactaattttaacgacttgcattacttgcacttccatataaccaaaacgacaaatcagattagttgtaggcttcatacaatatttgaaaatgacaataatatttcgatgctaagtaaccaatctagcattttattaatataagttgtgcgccatggtttacctttccatttccgaaacaaaaacagctccccattggttgccgggctatcggctaaaaaccagtaaaaaccgacgtctttcactcaacaccttacgaaaaccgttaaaactgaacaattttcataaaccgaaaaccaacgatttaaaaaaaagatatgattcgtgaaaactctgttgtgcacgatataacccgagtctgagatagtaacaggggtccatgtcactcttctgtaaatgatctgtacatttgttagtatgtggcgacgtgaggcatcgattgaaacatcgtttttctttttagaaaaggatagttgcactgtgcgcagcttgcatccaacaactgtgagaaatctgaaaaattagcaacagtagcaatcaattgaatggattgatcttatccgctcttccattacttaagtgagcactagtagggtttagctgtgatgatgatgatgatgaaccggtggtttgtatggagaggatgccatcgggtagatgctcttgtcccttttatttggcgatgtgatgataatattgcggtcttcaagacaaataagaaaaaagaaaaggatgataagattgtgtgaatggtactcaagtcattcgtggcaggccaactgatgtgcacttgatgcggcctagcatgatatgcatcgtcccaactttcgcactctagttaattggaggtgatgtcgtgtacgaatcattctggcgtcaacttaaaacaatagtagtgactctgatgcggagggataataatttaattagtcacttttcaaggtgtatctaattcgttttaggtgattaaaaaaaacctcaacttcttctcttcttgtcaaaaagaggacctaatgtggcctttaaaccaaaaaaaaaaagaaaagtgtgtggtcatgagtagagtttcatatctattatatactaaaagtatataataaagtccatgaaacttcatacaaacgctcccaagccgccatgtggcgctctaataaaatagagaaaatcctataaattctataaaaaaaaaagcagaacatatatcccttgattttcacttaaattggtgggtccaatattatacaccgttagataaaattgatcttaaaacaaactaaataccatgggtcccacctatcctcctcccgcgcattggcaggtggagtatatacgtacgtacatggtacgtacgttcctcccccacttttttttattttttcttctttcttcttcttttttccatttatatatataatggatatatttttaaataattataattttacaaataaagaatctaccatcatataacttaaaccggtttactttgtactattattttcaaataatgcactattttaaaataaattttacacaattatatcgtgtacctatcaaataaataatatctatattaactaatttatacgtgcacttaagtgcacttaaactgatggccccattatataaatcatcggatctactttttattacattgatatattattctcaagtaatgcactgtttcaaaataaggtgcacaccatgtgtacccattaaaacatcaatttaaaatatatattaactaatttacacttacactagaactggtggacatattattataatcatcggatctattgtttgcttataaataaagcgtctgaaattctctttttgcccgctgcacaatacacgtctgcacctttgcctttcacacttgtgacaaagcgtagtatctgagacatctaaggtgatcgcaaccgatgtagcgctaccgctttgccacatatcaaatcatatatggagatgattaattttgttaataacatgaaaagaaaattaaaggtgtgatgcagcgagagaataattaagtaccatgggttatgtttttctcaatactaattagctctatttaagttgaaaccaagaattgattacataataattgtaatgtatttgtgttatgtcgtatttggattttgtactatttattcgtacaggtgaaaggaatcattatgttataaatgtgagagtaatattgacgaatatccatagaactcttactacgacaagggtgataaatagagttttaaggccctctctttttttttccccgattccatattttggatttttgtttgcacgctttctaagtttctaaatgttgtcttctttaaacaacattctaactttttagaagtcaattcattcgtttataccctcaaatagctatcacataaattatataattcatcaatttcatctatcctaaaccttactatatatttttttcatgcaagtcatggtgattagtaaattggtgaacaacggatcatcgaagtcgtaagatgaatatgtaagagttactctgaacaattgtaaataggtatcaaaattaattgctattaattagacataatggcttgctagccacaaaattaatttctctctacatgtatagaaacatggacgaaactggaacaaatactaccatatgtcccatacatatatattgcgcagttaatattctaattagtcatttaaaattccttaaaatgctctcaagctaccacgtggtgctctaataaattagggcaaatattagaagttctaaaaaaatcaaagtatctattacttaattttcacttaaatcggtaggtccgatattataaaccattagattaaattgatcgtagaacaaactaaatactacaaggtcccacctcagcataggtgtgtacctacgtgcgcgggttcgtacgcctcccctcccttttttcatttttctttcttcttctttttcccatgcatatgcttccctccctttattactatatcatgcactttcatgagacgatttaatcaaagaattttaagtatcttgcactcgtattttttatttgcggccatactacactatatgtatatagatggactgcatgataattaactaccaatagtttcttatttactcgagaaaaaaaacatgattcaaaagttgtaaatacttaatccatctcctactcaaaagttcgtgaatggttttctaagataccttaagaaaaatagaacccttaaattattataaaataaaattatctaaactttagtttgtcctaaatctatgagacaaaatttctgaacaaacaataatcttacctttcaataatataagtgcccgcgcatacgtgcgggccaccttcctagttaaaactaaaaacacatttgctagtgattagggtgacaggaatcaaatactaagcagcaattaaatgggataatgcatacgagcacatatctgcaggaaagcgagcggttcaaggctcttcttttcaggtcgaaaggtcccttgcagatgaattgtcttcccctcttcaatgcacatatgaaatcatgaggcaatcatgcataggatgaatacaataggtctacaattccacgcagtgtggtcaagaacaagtcggaccttatcggttactatagtatcaattccatgtagtgtgaccaagaacaagtcgcaccttatcgggtgcttgctagtatggcaatgctccaataagtaccatttttgaaccatgtttttttactgtgtcagataaatctagcatactagttgccgattactatttcccacttcttggcaaaaatttgacgatgagatgaactaagaaatagtgtacgttgccttacctgttcagaggcccttttgttaatgtccatccatccaacctggagtgaagcaaatcgtccacaatgccagaaacctactgttacactggcacattacgtagcaaaccggggtccaactagaagtactttatttttgtacaggtaaaaggaactgaagtactgtatggtatactgggctactggcccgttcctaagagcacagagttttttttttttctcttggcaaccaaactgaagtttcgcatagcttgccatgcaacgcatagcattacagtctggaatggccggtaagtatcagaactgcgcaaacggaggcagcagcagcagcagctcggaaaaacacacaacagcatcagatctgtatcccagcaggatgtagacacagggcacctcctggacatggggcacaggcttggcactccacagtccacactccaaactccaaactcagccagagcatggagaacctatcagcacagccgccaagaggaagagtaaagatccaaggacactatcaattaaattaatgttcaggtccaaacctgtacacgggtaatatgatacaaaaggagtcaggcccataattatacatgtaaaaaacctaggtggtggttatcatgtctatttcaaagttctttttcagccttcatttcgttcttttccccctgctttatcaacacgaaatacaacccgccatgcctatgcgatggtgcctatgtgcaacttgcaactccattgcatgattgggaccttactaaatttgaaatactgcacaatggaagggagcaagaaatcaggtaatggggtcaaaagaataccgcgagactatgaacaaaagccattagaagcctctgtcagtgatgggatatcatcaagaacgatatcggcaggatctccaatccaaagcccatccctccatctgaacttgatcctcagtttcccatttgcatcaacgcctacaacctcacctttactctcatatgtctcctccccccatccccaacgtggggttacaaggccaggtcgtatccgtactctgtcccctaatcggaatggcctcaccttctccacttcccaccttttgcacaaccattgtctttcacagaaacagaaggcaacccaaagttcaccatcctcggcccggtggattacccctatgctattatggttcacgtcaccccactgatatgtgggggtcgcaacacaatccttaacctttacccagtccccgacacagacttcttcctcttcctccaccttttcaacctccgctgggtctatcaaccaagctctcgcaccagcgggtgtatgaatcctaagcttcccatcagcatcaatagatgagatggtccctatactagaatgattatgattagaccagccaaatcttggctggtggatacagagtttgacccgcacgcgctgcccaacgacaaacttgctgactccttcaagctggcttgaaggccctatccacctttcctgctcaccacaaaatgccacatgaatggttccatcccagacatcatcttcatatccaatcccatgtaccacgccaatgctacctggtttgagcgacttccaatcatctgcattatttctcagcctaacccattcacccacctcataaacttgctcaatctcaagatctgcaggatcacctttccacagcccaggcacaccaaagaaggctactcttacttctccatcagcatggacaccagcaattatgcctctggaatcaggctttgcatctctccatccccatctgggctctgtaattccagcacggaaccgaacatgatgaccaatcttgagaggctctactttatcaatttctgtgttatgagttaaccatttccctttcctgaaacaaccagccaactccaggtaaccagagtttgaatgctatgaactactgcaatacttattttcccaacactccagtcataagtaggcctgctcccaatactagatttcaaccgcacccagtctccaacctcaaaagccgaaagcctctcagcatcacctggagctaccttccacaagctatttctgccagacaccttgacatttagagtcccatccatgtctatccttgagatagccccgatggttgctgcagtttcatttgaccatccaaggcgaggctgagatattgaaggtaacacatgaattttttctcctacctcaaaaggctgtgccttctccacatctgcaactgagcaagaaaaaggcttgcttctgaagcagaaagcaacacccatatctccatcttcttctagactatgaaccaccccaatactgctacgagtcacatcctcccagccatatttaggggatggtactgctgccttcactctaacccaatcaccgacctgcaaataaaatgataaatagaaaatgagagtccaattaatttgctgtgctccaagcagagcaaatgctggtttgaaaggaaaacccagtaaacttctaaccttaaacttttctatcttttccatgtctgatggatctgcctgccaatgtacagcccggttaggaatatcaattatgagtagcccatcactctcgatgtcaattatttttcccacgctgtgatgggtttcaccaccccaggcatatctaggctctgcaacagacctttttacgcatacttggtcaccaatctggaaatttgaagaaacatgagcttcacactaaacaaaacaaaaaagcagagcaaacaagcacagatacatgcaaggacaagttcataatcgctgtgccatgtaatctaactacaagagtttacaaagttgaataaccaattctagtaaataagaggctatcacatattaatgtatctgaaagtccaatagaaccctcaacattccatcatcatcaatacagaaaattgtccaaatgctactcatgactgaccataccatccaaatctgggaacagaggattttatatgtgattcacatttctcccacaataattgataacctactaagatgagtgaattctatttttatgagacattcctcaaacattggtatattaatggtaaggactttaacattcacatgcaaatggcaaatcccaaaatcatattttaattttgctttttgcagtaagcagaagagcaacttcagacttataataggtaaacatattagtacaggaaacaaatggtaagagtaaaagaaacagaactaccttgaagggatcaacatgttcaacctcctctggttcacaaagccatggacttgacaaatagcaaagtcccaatagaagactgctgtctggcctgattgagtagacaataccaacacttccaggagtaatagattccatgccatgtacagcaaccgttaatgagggacgaatccgaacccagttaccaaccttatattcttcaacccttacaatttcagcaggatcagctctccatcccctagaagctcctggaaaaccaaccctcaagattccatcatcatcaacacagagaactgtcccaatgctatctcgtgactgaccacgccatccaaatctgacaacagaggattttatatggtgattcacaatttttcacataataaatgattacctactaagatgagtgaatttgttatttgatccatgagacattctccacaaatcttcggttagtatattgatggaaggaattctcattaacattgacatgaaaatcagaacagtggctcctattatcagatttttaaagtttgcctttttgcagtaggcagaagagcaacttcagattttgaaaaggtcaaaaatcagaagcaaatcaccatttgcagcgagcatcattttctttctttgggacgaccaggatgccatcatttttgacaacatccagtacatcagtgtaaacttttaaaaccttttaacagtcaaatgcaattgcaagtcactgaaaggacagatcacctcccaggttttgggtcaatggatcttggaacttcaacttacaatcatgatcagcacagagcgaaacctagcatgggctgcatggcacacagaaagtataaactataaagtagagacgaatttattagctgtatcaataggcctttcacttgcaagtatcaataaatacatgggcagacatctaatccagtaaaccatgtatttatgtcagaataaagtagacataagtccccattacttttataatctcggtgtccagatgaatcaaacaggctaatggatttactgacttggtaatgcaaatcgtttaagacagtcacaacttgcgaagttgtttttgctatgtagtaagaaccacattctccacttcatagaaaggcaccatgcacaaaagagagttcagtgatgagaatatgaaggattaaatttcacttacctaggctccaaaacatcaggtttgagctgcacatgttggcccctatttaatggaatgactttgataacttcactcgtcaaaacgcgggcttctccagaacaaaatgacacaacaaggtggtcatggtctacaacagactgaacaaaaccaatgcttctgggtcctgcaccttgccagccaaaagctggttcagtaactgttcttctaaatttcacccaatctgcgaactcatatctggtaacagcatcaagtaaaccattcagataacttgaggtccaaagcaatcataattccagcatgagatcaaatacgggacagccaaaaaatatcgacaacattatgcctcgagttccttacatggttggggtgagatgaactcctttttcttctaaagtttccatcagttcttcagaaatccattctcgtgggagcctctccagaaaatctcgcaatgtccagcctctgtagttgatagaaacaataccgaacatgtaagtatataataaaagatacaaattctgcactgcacgaactaacccatgagagagttttcaagcagccttgcaataaaatgagaaaatactcgataaccaaaatttgcttgctatttacttctaagataccattcaatcattctacattcctggcagaaggacccatctgaaaatttaatgagcaaaatactggcataatacactacctaagaaggggaactaagagaatcttcactcaatcaaacctcaactaagaatcaccgatacatctgccaacagctattcccgtacacataaggagtatcagaatatctataccacttaaaatgtgtgtagtggtggtgtccattcccacaccatctctaccactgatgtgtgggccccacaatctatactattacaccacctttcaatgagtcctcccctgtttcactgttggttctccccaaaatttaaaatcacctactggttttaataagaaaaaacatagtacttggactaaataagtgtttattaattgatttaataggttagaaactcaaattgttgtccgttgcaacgcacaggctcttggctagtattgaagcatttaacgtttaaaattaagtaaattgcccattgtagtgggtaaatcgcaccctgttttgctttgcacaaggtttagcacataccttttactttgcatcacgttgtatt

SEQ ID NO: 46007 - DNA, 6445 bp, Oryza sativa
acttgcctgtggtttctcacatcaacagccggcgatggctgttgtaacatttgaacaatccatgagaggttttcacgtatcattttagccgcatcagcagctatgtggaaagcgttatcgccgtcgtcatcctggataaccaaatagcacaacattaagcacataataacttggtcctgacatacaatggaaattgaataatgttcgaaggaaataggagcagtgacaaaacaaaatgaatgcatggattttaagttattgcaccataattacagacctggaacaagtccagcagccaacccaccataacacctcatatcagacaaattagaaggaagaataaaggacaaattgcagaacaggccttcctattcatttaaacttaacaacaataatttgaggaaatggagaatctattcctcctgataatctagaaaagcatgctggggccttatactttatggtgagataatacagtagaatttgataaggttcagggtgcaaaatcactgggaactacaataaagcaatattgttgggcattacacatttcatttctgaaatatcaatagataccatagcgcctcttggaaggtttttacgtaaaataagctattgttaagagctgcagaggtctacaaaagcagagttttccctcttctgggtaactatatcccagtggtttcatttttttcattcccattcctgttttttgttctgctattactatccattctacatttgattttgtttcaagtatatacataggctcccgctgccctccacagcggctccaagtaatgaaatgaaaactaaatgttttcttaagtatttcaattctcaataacaacaaaaaaatttcttatcatgcatcaatacacaactatgacagtgcctgacagcaaattgatatcatgatgacttttaggatttgtgcgcatcataagaacaggaaaaaacatattgtagccggatatcgagaaaaagattattcaaacataaaacatctggaatcataaaacattattcaaacatcacattatcttgctatctcaaaaaaaatatcacattattttatttatgtttatatatatatgcttcatgagaaaacatgatgacaattgcataaatccccacaagtacaaaataaatataaattactagtaaagaaatgaatcagaattcagaaggataacaggatcagacaggttgacagtttacaattcctaatacccagttgcacaagagatcatgttactgaactatgctttcagaccaacacactgctatccttaaaaatgatcaatgaagccacagtacctgtagattgcagtttgctccagcagctaaaagcaaaccaacacaggagtttgcacctctgttcagtgcaacgagaagtggtgttgtgttctgagcatttcttatatttacatcaactccagcttccaaaataatctgtcaaagaaaatataacaaagggaataaagcatattttcatatagaattaaagcagaaacagcagaaaaatgaagtaaaattccaaccatcagacaagaacagaaaagcaaaggaaaaataataataataataagtagataacctttaccttaaccaattctgcatcattgatcattgctgcagtatgcagtgcagttcgacagtgtgggtcatcttgtgctgtgggatcagcaccagcagaaagcaatacccgtactaactctcgaccctctgtcacatatatatgtcaatattactattaaaacagacacattttccagtagataaaaaaaaatagacttctgtcctcatccttagtgaactaaaacatgtaagtttgcttgtgctaagtgtgaatgagataaatatgaattaatctctagggtgcccatgtgaatcgcatttaaaatacaactctcgttagtggaataagaagcagagttgtgaatatcaaagttctcttctctaacatgatgcttcttctataacagcattcagtgtatgtaaagaaccaacgagatggctcttgatatttgactatttgtaagtatggatgtgacatgaacaaagtcaggaataacctttctcgtgctcttttttaagagcagctgccatgcacaaagcagtcccaacagggctaggtacatcaattgcttcagctatctcctcttcagatgcaacttcaacccatcttttcaccacatccgcattccatgttttaatacataaatgcaatggcctgtgcaccatgacaagaatgaaatatcagtcgatgaatcaagcaggtaacggatccaaaaggaaaatatttcatgattccacagcaccaacagcataaggaaagccaataagccatataaatagaagaaaatatttcatgattccacagcataaatcaaccaatagaagggcaccaacagcataaggaaagacacatcaatagaagggcatcaacagcttgccatttcaaacaaaaaatcattcttacgttttattcacagaatttggtatgcccatagacctgcaaccaccattttccaataagacgatagcacaatcagtatatctcttggccacagcaatatgcaggatagattcgccttctccgtctattgcattaggatcagctccagccatgagcaattcctgcatgacacacagagaatttaaatctaggaacttgcaagctgaagtcatgaaaggtgagcataataacatacccgcatgcactctggttggccatgatgagcacaaacatgagcaagagtaggaccaagaccttctctaagcctcgaattaacatcagaagatctccttacaagtgcgcgaacacactgtggagagccagcagccatagcaaatattattggaggattttcattcttatctaacaagtccacattctcttgataagccacaatagcttcaacaatttctgctgagcctcttcggcatgctaaatgtagggcagtatatccatctgcattctgtgcttccaagagcgaacgaattaaacggccatttccatctgaggcagcttctgcaagaagattcctgacaagcaaaggttgtgtcagacagtataggctatacgatgcagcaaacaaaaagttgtcaaagactaacctaacaccagcagcatctccttcacatacaagatgatgcaaagcatttggattgtcctggaccatgtccagaactgaggctggtggcacatccgtaccgttgggcatgcttgcatttgtgaaatcactgcttgagcaagtagtgcattagaatcctctgtatcagcaagtttgcatacttcaaaagaataagttggggaaaataacatgcgccttactgcagttgatattatagtaaatcaggttaactcaaatatatttcactatatgttttatacacttttagctaaatttctacaaaccttagttccatttataaagcattgtagttaactaatgaaaaatcaggtaagaaaattacttttcaggacttgcaggtgggctccttggtatatctagaagatgcctcagaaaagtttttagcatgtcctggaaagatggtcttcttgaaggtttgaactgcaaacagtcaccaatcatcttccagagctccccaggaagtcctacaccgactacccttgaatattgaggcggtggcttcctctcttttacaacagacttacaaatttcctctgcacttagcccagcccatctgcatttcaattagcatctaaccacaccattcgaggagcattaagaaacacaaatgaaataatcaggctacttacggaacagcaccagtacacatttccacaagtgtacatccaaaactccatgcatctgactctggtaatattccatttgcactatcccaaaacagattcattgacttcttcaatggcacccaagcctcaggagctgtataattggggctaagaagtgtagcatccaagccaaccatgttggaatcatcagacactctacgactagtgaggttcttaagaatggccgaaagaccatagtcggaaacaactgcatgcccatttgtatccaaaaggatatttgacggctttatactcatacaaacaatacctgctgcatggagttctgctactccacgagcaatatctgctccatatctgcaaaactcacgctcgggaaaaatataatcagaagatataaagacttgagtaaacaaaagggaaggtcaaacataatcagactgaacaaaagggaaggtcaaacataattagactgatgaaaaaactaaatccttttgatgtgctcaagaataataacaacagtatactaggaaaaatgaggtggcaattcttataatggaaaaataagtaaagaaattggcatgctgacaaaataagttattttttccctatgtatggcatgggctatttcatgcacttagtacagaagcaattcgcgccatgtagctaccagacaaaagagaaatctgagttcagaattttatgagttatgagtcatggacacttgtgattgtatatcacattctattagacaactacagttcacaaagttccaccaaactataacagaaatacaggatgctcagaaattaatttgcatcgttagtttgacaatgtgctgatgaactttgacccacatttgtattggcattcgcatcaaatgctaccagagtgtgttgagacaaagtgcttcttgttagtaaagctaactagcccgattcggccattaacttatgtggcaccaaactcccttcttcaaaaagagtaaaaacatgtatcaaattgtttagatcacaggataatcatttcttattctttttaacccatggactaatggtacagttatttgatatccgttgcagcacacagtgagtgtgctattatagtaagaaactctacatcaggtaaacacaaatgagtggcccacactattccactgcacagaagtattcaacagatctttggaaactaaagtttgagttgagaggaacagaattaatgcagcagtgaacaaccatctttgctccaatccctccattctaacagccatatgagttatatcttttatggagaaatgtccagggtgccaaatattacagatatgaaccagaaagtgttggcatttcattcgtcgccgtcacgaacctcacaatattctaggaattataattttgggaataaacgattgcacattgtatagtacaaattcatagcacatacaagtgatcattttgttcacaaattaaagagaactcaagctccacatgtagaatgattgatgtgtgttaaatcaacaaaccaattgcaaaacaaaactatgttattcactggacactgaacttcctgagcagcctggcttgaattttaatcgtagtacaaagagtgatctttcattcctccaagcactaagtgtgataattgttaataatagacctaagcactatgtcacaacacaacaaaagatgcaggacagatggaataacaaagctgccgacaatcacccaaacattgccgaacacgtacaaatactacaaactcattgagatcaaatttggcactactaatcgcaaaaaccgctttccacgtcagtactcaaactacaacattttccaccttttatgatccttctagctagacatgcagcttagcgaaccaccattgaaaccccatgcatttgaacacatacagttagcggacaaactgtcgtatagcgccccagctcaactgtatttttagggttatcattttcggcgatcgatagtttgatagcagcaactataaccatacatgactgcagcaaatataaccacgcaaataaaacttagtatccatgtttagatgcaatgccacacctgaggatctgctccaacgttaggcgaccgccattctgccgcatttctgtctgcacagaccccgcgtaccgatccatcacgaagcagaggtgcccgccgaccctcacagcaccatggaacgtggtaacattccggcaccacgtcgcggcgcgcctcagccgctccacctcctcctgaacgccctcaagcacatcccccgcggtcacgggcaccctcttcaccgccaccggatgcttacacctcttggccccacctcccccaccaccacgagacagcgtgccggaccacacctcctgccccgcggggcccggcggcccgctcccgatgcggcgggcgagcttgaggtccggatgcgaggcgaggtcgaacgaggcgcagcccgcgggctgcagcgacggcgccgccgcccccgcccccgcccccgcggcggaggatcggcggctgggccggccgaagaagtcgtcgtcgtcgtcgtcggagccgtcggaggaagagccgccggagtcggagtggaggaacgagggcgacgacggggacgacgacagcagcgagaggatggggaagttcttccgcagcgcggagacggagt

SEQ ID NO: 46008 - DNA, 22998 bp, Oryza sativa
ggtttgggaaggaggaatgggattttttgatgggggggttggtgatgatgatgatgatgatgatgatgatgatgcggtgggagcctaggagggacgacaagcaaggctctctcctcttcgctcttgggaggggaggggtgtgcggtggtgtgttggccgtttctactttctgttccggttttgtcgagtgttctcgccttctcggggggattttgggcgatgttggaataagttctcctctttggtttgggatttagtacttgagtcatgttcactttgatgtcattttcaaccttaccaaattttaataaagttatcaaaaaagtggctacatttaatttgctgtcaaattttggtaactatataagaaatcctgtcttgccaaaattttggcaactatattaaaattttggtaatgtcaaaatttagtaaggttttttttggcatcaaagtgaacaggtccttggttagtgtgaatgaataactaaaagcaactttgttatgttctcttttttattttcttttttttggcgagctaacttgccacaccgatcaagaaagggctgagctgacggatagaccggtttggagcttgcttgtcctagatgtgcttccccgcaacgtgcccgtacacgctatatgtagtttcagtgatatgctaacttttttttttaccgatcgtttggtccacggagtgatatgattctctttgttggttagataggtataatggtcaaataggcaagatgttgttttgataattattttttccaatgtatggcctcatcctttgccctacggcttataagctaaagccaaaatttaaattttaaaacttgattttgaatttgattttgattctattttaacatagtttttttcaactttggcttttcaatcggtaagaacaatatataaaacttttactcgcatattatttcttaatcgttaagagcaagcttaatagtatagctaactactagctccaaatcttctatagccaatgtaatagacaattcatacaatagctgcttactacactattaatacttagtcccacctgtcatacacatattacgtcttggagtccgtgttgcagctggctacagatctgtagcccgcttcccttatctctcttcttttatatttttaaaatatgtttatagctagcttatagtctgctattgtacctgctctaataagccgttatggcttataataagactagaccaaccgatggggaccgtagttattgtaagtataggagtaaagccaggtatagtattttcaaacttgagaaaaaaaatgtaaaaaaaacgtactactaaggttgtgttcggttctatgggttgggaacccatctcgcacgcacgtaaaacggagcggtctattagcgcgtgattaattaagtattagtagccttttttcaaaaatggatcaatatgattttttaagcaacttctgtatataaactttttgcaaaaaaaatgcatcatttagcagtttaaaaagcgtgcgcacggaacacgaggaagaggagttgggaacatccggtgccgaacacagcctaagtgtgtgggcgctaccatcaatcgtgaaaattgtctccacctattgtaacgcacagatatttttctagtacaataaaaataaaaatatcttgtttgtggcttagctttaccgtatcttatattcggatgagtaaactataccgactatccttaaacttttatatgcatattagagcccataatctagcttgggctactaggtcattttaaaactagtccatgcacatgcatgttcgataagaaagcatgccaaaatacaccatatgagacgaaaacatgtaactgtaacaatgaagttttatactaggtttactgtagcgatctacaaataaggttgaacagcaaaaacaacaaaatactataaaccggctataaaattaagttctgaaatttaaattgtctactgcttatttaggtttatactacttctgttctcatttacttataattgcttaccacaaaagttatttgcaaatacttgtcactacacggatcccaaagcaaaattttccatttcacctttagaattaataattccattccactcagtcatacttattgtttctagagagtactcaactatattgatgattagatagcaaaaatccgacaaaacccccttatgtgaatttggctggggaggctagtcacgtgtaaacaatatagaaacgaaagaaccgatgagttcattaggatgtatacaagctcggaggtacaataccctattcttattatttgtaggattacccctatctgttatgaggatcttacaagtctattgattactcaaaatagttatgcttcctctcttctggatttcctaagaaccacacaaaatatgataaagtctcttttctctcacttccaaccctcctcgcttgtcctggttctccccatatatcttcaccagggaacacctgatgatcaaagctcgaggaaagatattgtttttctttactaaaggaaatatattgttcgtatcgggatcaaatatggtaagtcttgccaggatctcctctcattgcccaccccgctgcccttgggtatgccttggcggggtccaccatgaacgggatatggtgagaactcaccacgatacctagctcaatccatcgtggcctcgggtagcccgagtagggctcgatacaagtagcgtgtggcggtggcttgccatgcacccctactcaatccatgcaagcatgcgaggaatagggttcttcacacattgttggtcataggggcccacctatcaatgtttggtgaatggcagttaaagggtagggatcccgacggggttatgatagtcaaccactctctcccagttccccacactcgtgtaggcatacatggttaaagtaatgggcgacaattgcaacagttgccgccatgtctttcacgcgccttgctacggggtagacatccgtcttgtcgctaataaatcatatgatgtcatgggcccgagacatctcgggctacgttgtttcatgtctctgttatataaatggccacaggctacctcggggcccttgcgaaaaatattcacgcgctgtaaggttattttttgaaagcatgggcaatcccttgagggccaccctttagcactttgaggtggattcatgtgtcatctttgatcggctatatgtttaagtaattatagtaagggtcaaattatcatcttctataaaagttatgattccctatttttttttctccctagtcaataatagcaaatgaagaaaactagtacttcctccatttcacaatgtaagtcattctagcatttcccagattcattaacattaatataaatgtagaaaatgatagaatgacttacattgtgaaatggagggagcaatacatatgcagtatgatgctgaatatcaattatttgcctttgttagttatactttataagacttgttagtttctactttatgagattattactgttttagttgttttagctggctgattacaagatataagtatcatcaacagaacaatacacgcaaaatccacacgataccctcgtgtcgtgcctaccttggatctaatctaaagcccggatcaaaaccaagccaaaagcctagtgagcccagctcgctcccgttgatccggtgagcgagccctaatacttccagaagctcctcttcttcgccgtgccgaacactcgaatcgcatcgcatcgcaccacaaaccctcccccccgaccagaaagccaagaaagaaacctttcttcgtcggtctctctctctctctgcccatggacttctcggagcaggacgtcgaaatcttcggcgaggactacgacgacgccgaggccgacggcggcggcggcggcggtgcctcgtccggctcctcctccccgtcctcatcctcctcgtcgtccgccgccgggtcctcctcctcctccagcggcgcctccagcagcagcggcgggggcgggggtgggggcgaggacgaggacggggtcgaccagggggacgccagggggtacgacgacgacccgttcgacggcgcgcccgcgagggccgccggtgggtacggtgacgaggagaggggcgagggtgatgcggaggaggaggaggaggaggaggagagggatttgttcggctctgacaacgaggattacgtcaagacccccgcgcgtagcaactacctagtcccaggtccgcctctaatatttgctaaattatcgtgcacattttgggtgacaatgatcagtctctaagcatgtctaatcagtagaattaattagggcatttttacaaaatccaacccagttcttttggttgcgggtaagctgatcgtagggtttaggggattcagtgagcatgtagaaaattgcgggtttcacatgtatgtatgatgaattattcttgttctggactttttaattcttccttccactttcgataggcatatgatacgcacaatgtgtcttataaagtaacagtacatcatggctactgtcttctgcttgcaactcacttttaaatcgcaagagatgttttacaacaccatcaagcataattgttggagagtagccattgaacactgcctaacgataagtgttaggggctattggattagctgatagttacattgcactatgctagtatgttaatctcccgttttgattataggtagactacagttgaataacatctatctgcaaacgaatttgaagtataattgaagtgaactctgcagtagattacagttatgaagaatactgcatctgatctgatttcctctgtagaacaatttttttcacattcttctcaatctgccatctaactagaaacatagaagtttgaactttgaaagatcaaagttgataataaaacatgcataatttattgaaaaccttcaatatatgctaatcatatttgtgataggaagctccctaaaatcaatacgctatttgtgatgatttagtgctggaaggaatggagatcatgctaatgctttatgtgtaacaacttgatatctattgttggcatacattttatcaatctactaggtccattagtgattggtaatgcccatgcttgtggtaaagattgtaactgggttattttactggctatacgcttgatatgttggtgcggggcttggggcagctagcactttaaaatgtttgaattatctaggagggaaggttgagcttcaacactatatttcattccatgccttcccttatagtgctaccctcaatacggaacaccaacaatcattctcggggaggatatggggggcggaatggcagaggtccacctcttcttccaaggccaggaggccatccaggacggcataactttggatatggtgggaggttttcgcatggaaatgggcgtaatgttgaaggttttgtttcagaaatgaagcttaataagagtgaagaaactttatctaggaagtttgttgcttttcaggaggtgagtaatgataccatattcttttgatttttatatattatctctggtatctatgtatccaaatcctttcctattcatgcagccttctgagattgcatgctacagccgtattgagggtggggatgtatattttgatgaccgcagcttggtaagatcacagaattgctcacgatcaatttcactttccctttagttcgccatttccttaaagtctgtctatgtagtattacagaaaagtattgttataaatttgctgctgtactaaacatactgttattttagaggctcttcaaacgtaacatttgcgactatgttggtgaaaatctcaataaaggatttgaatcttttatagagaaaagaggtaattccatcaaaaactcatgttttctgtttttatgttctggagtactccctccgtcccataaaaggcaaaccttgtacgagatgtgacacatcctaggagacatgtccaaattcatagtactaggatgtgtcgcattccgtactaggtttgtcttttatgggacggagggagtagttgatataaagagtactgttaaatgtagaaattgttcttatctctggtattgcaaacttctgtttcaatcatcctggattaacttgtccacatttatagaaagttcatgacagcatggcaccttccactaattttacttggataatttattcttccttaaaaaatggcatgagagaaaatacataactactaattagaggttctaattatttctcatagagccaaaagagaaatgaaataaattattggaactaattaacccagaagttctttttttttttttggaatgagttgaatcctacatgtggatccagataaacagtagttctgttatttggaagttgttctttccttttgaatttattttcattcaaggggactgtttcatgacgaatgtggtttaattgtcaatatcagatttgggttcagaaggatttggtgatcttcttgcatgcataagaaattcaactgtacctcttcagaacatacattttgtggtaaaatgctgctgtcaaccttccgttttctattttagtactctatgcatggcacgctgatcatgtatgatgctcttcttgcagacataccgcaacaatcttaacaaggtatgatccttctagttcgaactatctaaaacaaactctgtcttcccctcatttttgtagcatataccactcgttttgttcaatatgcttgtatgtttatagatcgatataacaactaatattgttaccagatattggccacggcttatctaagagaaccatggaagatgggtgtgcacaaaagaaatggtgttgtatacctggacgtccataagctccccgaaagaccacaaagtgaggttgaacgccggaggtgattctctttctctgaatgcttcattaagttgatgtatatggtgatggtaatactgttagtgatgctcgttaaacgcatttatgttgggtgatagaaaaagttgatatctggtatggtaaatatattaatggccttagtttatactttatacgtgaattgtcctatagagattctactttcacaagaaagataaatggagattctcttttgaaaagtgttcctgtttatccaccatcagttatttatatcacaaggatatcttgtccaattttatttctttatgctgttttaattcactggcaaactgatgtaacaagacatgcgtaactgttagattccctgggaagtttgacacatgagattagctgtatcttcactcttgctctgtgcatgtatcatgttgccttaatgtttatagtcaattaatcatatgctcagtgttgttattatcgttacatgggaagaatctgaaccataatactttttttgtgtgccttgtctttatctctatatttactctcagatgttattggggatattcttttgaaaatcttgcaactgagaattccattgatgaggatggaagaggtattgatgcaaatgtagagttctgtgctgtaataaaaacgaaattgggtgcacatcgtattatcatgggtgctgagatggactgctgtgacgcaactgatgatggtaggcggttctacgtggagttgaaaacaagcagagaggttagcattactttttttttttgtgatttgctttagtttgggtaccacatttatttgaaatactcagtttttgagcctctggcgtgtaacagctggagtaccatacagtggaaaaatttgagaaagagaagttgcttcgattctgggtaaaattttagtcctgctgtatttcttattctccattcaattcaatatcatttgtaacttactgctctgtcctgcagtgtgaaagtttattttgtgttgtggttcattctcttagaactcttttttaatcaatgtctaacgctgctatttgcttttgttaagcactgataaaaaacactcaattgcattgtaaagcaataatgagggtagggatgcgtatctgttggcccatgggtaccctttggctcaatggtggagccagggaattcttagagcctgagtgaatctaactatgttagatatttgttaccaaaaatcaatttaattcctagagtaatataaaaagttagtgtacgtttgagttttgatgatgagagtgggctgccgcccggcgctggccgctgggtggtggctccgccactgctttgggccattcaacccagccattggttgcacttcaattgctagttcatattaggtacaaaatgtaaaccaaatgaattagtgtttagctgatgggtatccatggtcaagtggtcaaccaacttgcatctttaactgagagtagatgataaggtagcaatcttgttatgactctgtctaccatgagtccatgatccacttagctgccttttatttttttcagaaagtatgcatattttaacttctaacattaactttttttctttactaaatattgcagattcaatcatttattgctggtgttccatatgttgttgttggattcaggtagtattcattctttattgttttcccttacgccatccattttttgtagtcaatgtgatgagctttctatcacctgacagctggcatttttgcaatggaaaatgattttcgtgataaaatgtttgctgatacaatttacatgttaaagaagctgtgcaatgttagtattgggccttctgcttggctaggagattgacatgctggttatcacaaatcagtatgccactatggttgtcctctacaaggaacaagagtaatttcatttacacctggtgtcatcaactgtgtacgaagcaagctcatatttgtgatagtcagtcgtttctcatggatgtcctgttgcaataaataattgtgctgcctacccaacttttgtggggctaaaggctgctggtgctattacaataaatattttattatttggtactaaggtatatttttcccggtacgtgtatgctcattttcgagttaattttgtctaaataattacaacacgatttcatcttcgggataccaaatctttgtgtagtaaactagaggttcatggagacatggactatttctggtaatatactgatatgtctccatttattgattgtaataggcataataacttaaacacatacttgattttctagattcttcagttcaatttgtttgactgcatcacatgtacttgataaaatcgtatgcttatttttaatacaatgttctgatttggtgtggtattttgctcaatatttaacctaccccatatgatgcaaaagaaggcttttacttttttaacttcgactttgtcccaattttacattgattccagtggcttgtatttgtaacttgaactagtacccctcagcattttcctactaataaaggagtttcaaccatatattttttttacctgcaggaatgatgctggtgtacttatacggactgagagactaagaaccaaagaaataacacaaaaggtgaaagcgaagaactactggcaggtaatcaagctttcttcctagcaattttaaaggacacatgcctagatagacaactataatttagacctatcagcaggttaaatactggaaatgtgaatcatctgtaactctagactcccaaaggacgtgcttcctttgcaacaatttacctgctatgtaaaatatgtgagattagattgtctaaataagtagttctcaattaatttcctgccacttcaagcataaaagggataagaatacaatgtacttatcttgaaaataacaataatatctgatatccgtatgtacttcagggaggtgtttgcttggccttcgctgatgaggtcttatgctggttgtatggcactgttagagaaagtaagttcatttatcattctgaatatctaactagttgcattttctcaaatttttaaatcacggacttattggcactcataatcatatgatactctctgtacgcctgacattgcttttttccatctcttacagacgaggactacatcctgcaatttgtacatccattcaatcgcttggaacttctacgtgcccagtctccctgtcctgatgccatcactcatcatgtggagcagctctctggtacagcaggctaggttaattcgtacacacaacttcggcaagtaaaagggctgtttgaggtagatccgtgttgaaggattctattctaggggtgctgactcttaaacaaaacttcggcaattatataatggttgagctgacgacttacccagccaagcaacataggccgacgactaaatggtttgctctttgaactgccaaagagattttgaaattgtcaaaaccttgtgtttctccagtaacattaagttataaattagggaaatggagagctatgcggcaatgctactactgggtcatgccaccgaggcaccaatgatgtaactctctaccagataccagtaccaagggaaatgatatgaattctagagagtttctgaactaacatgtggtatatagctttattttgaaatgctataaattgagaatattaaatcgtcaagaagtgagaaacccatctgcaccccagcactccctagagcagagcatgacattttttgggttagggcctgtttgaggagtttatgtcagctgaagctttttccagaaatataagttctcacaaaccaaacagtctagcttctcatatagataaggccttctcatctagataaggtcgtgtttagttgcaaattttatcttcaaactttaaacttttccatcacatcaaaactttcctacacacacaaacttcaaacttttccgtcacatcattctaatttcaaccaaactttcaattttggtgtgaattaaacactttcaattttggtgtgaattaaacacagtcttatgagaagatatgagaagttaatagttaaaatgaacttataagctactacaagcaagctagttattttagcttctttacattttcagaagctgcctactagatgatgcaattgactttttattaaacgtttgaccattcattttatttaaaaaattatggaattataatttatttttttgtgagttgttttatcacttaaaatattttaagcatgatttatatattatataatttcctaaaaattttgaataaggcgaataatcaaacatgtgttcaaaagtcaacaacattatctattttatagagggggtacttatcagctgcgttctataatttatctattaatgggctgtttagttcccaaaacaaaaacttttcatccatcacatcgaatgtttggacacatgtatggagtattaaatgtggaaaaaaaaaccaattacacagtttgcgtgtaaattgcgagacgaatcttttaagcctaattgtgtcatgatttgataatgtggtgctatagtaaacatttgctaatgatggattaattaggtttaataaattcgtctcgtagtttcctagcggaatctgtaatttattttgtaatattactacgtttaatacttcaaatatatgtccatatatccgatgtgtcaactaaacctaaaaattttttctaactaaacaaggtctaaccagtcatttttcagaattttaagaattttaagctctcctaaaaaggttctaaaagccttgtattccagttgcgcgtctgtcgccttggcagggaggcaaatctaacgttcgcttcagttggattttccaagaagtattttgccctatttttgtgttaaggtgccacgaatgcgagatttccaaacgggaaacatcttgattcccacaagattgatagaaaagaaaagtcactgatctacgcatcttgattcccacaagatttaaaagaagaacaagtcgttgatctacagtatatatagtactgcaaatttcacaatttcacgggaaatatttcagatcccaaaaaaatggggaaactcagccatcgatatacgctcttattatgttgtaaacaggagcattgtgttcaaaccgctcgataattcaaccatgttttttttaaaaaaaatctactaataatttatttaaaatttaccagttttcatggatgacttaagggttattgcggttattgataaaaccatgaatatgttcatcgtaatctttaacttgttatagttttgattgaggggttgttagaagattaatggtttgcataggatatatggttgtttggttagtgtctaagtttaccacgattaaccttaggccaaacgtggtacggcgaaaaaataatacacccatgaaatagttggtcataagtgtgacaatgttttgccaaaacaaaataagtgaataacttgcgatgggggagaagctaggatttggagattagggggacaaccacaaggaatgttcgtgtggtttataatccattttaggccctctttgtttaggcttaggcttattgggttagacttttaagtcagcttgttggcttatatgatttataagccagtgaatttaatgtcctaagtttagtggtggagtcatacatctatctcatataagccaaaaaagcttctccaacctagcttttggcttaatagtgtaagagtggcttatggttttaaaaaagccaaatgaaaaagctgcttgtttgtttaggcttagactttttgacttataagcctaaacaaataggaccttaatgcgatgcactattcatactctgcattgatacctctaaagcagaggatctgaattcaatggtaatggcttctgatgatcgctatatattgaagggtatttaaacacacggttagtgcggtaatcttacggtatacctagctgatttcaacggtaatggcttctgatgatcgctataactgtgcggttttcacgataaccgccaaaccgtgggtgacgataaccacaccctagatcacatcagatttcttacagttataaattctactacctccattcccaaatataccagattttagttagatgtaatatattataatacaacgaatctggagagaagcatccaaccaaaatctcttatctgtgcgtttagttcacactaaaattagaagtttggttgaaattaaaacgatgtgacagaaaagttgaaagtttgtgtgtatgaaagttttgatgtgatgtaaaagttggaactttgaagaaaaagtttgtaactaaacacggacatatatatatatatatatatatatatatatatatatatatatatatagggacagtactaaattatatcgggaacccttgtcgcaaattgcagtgctagctgcactaggagtacaaatccctagtacagcgtagtactccagtcgccggctcgccgcacaccatcgcccatcagaccctgccgccgcggtctcttctcgaggcctcccgttccctcttcccggcgagctagcgcaccgcgcgggagagaaaggagagcaaaaaggatgggcggcggcgagtgcaggagcaacgactacggcgccgccgcctactgggacgcccgctactcctccccttccccctcctccaccgccaccaccggcggcggcggcggcgcgttcttcgactggtaccaggcgtacccggcgctgcggccgctgctccgcgcccgcctccccgcctcctcccgggtcctcatgctcgggtgcggcaactcccgtacgcctctactacctcttttacctgcgtgccttcactcacactagcttgaaactatctgcgtactcaaattcaacgatttcggcgctaattcgtcgcgcgcgccacatatttctgggaatgcactggagtagtagattaccctgttgcattgttatactaattatacggtcacacctatccgttgcatgatgcagtttgatcttattttggcagttttgtcggaggacatggtgaaggatgggtacgaggaggtagtaaacgtggacatttcatccgtagtcattgagcagatgagggagaaacacgttgatattccacagcttacatgtagtgttttcattgataatttcaaactcatagtttgtgaattatggtttctatgcaaggtctatttacttggtgtcttgtgttttaagatttccagatggatgttagggacatgagtttgtttggtgatggaacattcgattgtgtccttgataaaggtaccttaagaattttatttaccgaagcttgctaatgctcttgtggaatacttttttatggaatttactgaataaattcatttatggtatttgtttatttttcaccactacacttaccttgttatgacggaattatggaaatttctgaaggtacattggacgctatgatggtaagctttacttgttgcacaaacaacattttagctttctgatcaggcatgaaatgaaaaatcatctgaccattattgttgttgcatttgatcttactattttagtgtggcgatgatgctcctcttggtgcttccaaaatgctagcagaagtggcaaggtgtctggcatgaaagtttatccttttcactcttttcaaactagttggttcccaatgattcagtatgtttcatgttgaactatttttccccttgcaggattcttaggcctggtgggatctacatgttggtacatcctctaaatctaaacaatacagtgtgtaatcattttgcgtgggatgatcttatggagcgatgatgttcttttgcagataacatatggttgtcctaaggaacgagtgcaacttttgtaccaatctggaagccacaaaaaaattgaactgtacattatgcgtaagtatttttcttatgctatttcttgattcatggagctggacataatttgaaattccagaaggaaacactgaataatggggagattcaggtttgactgattccaaagggaaacattggttccaaagattggttgattctaatgggaaatcttaaaactttgatttgacgctatgcttttaatttctcagttggaccctgataaaatttactgttatcattttgcagccacacctggataccagttgaaatggagcaaaggtgtttcacttgcacaacctatcatggaggaagtttcattgacagtggatggtcaattaccacctgactatgttcttaaagatccagagtcacattttatttatatttgcaaaaagccagatgccgctaatgaagctaattctgtggttgctaatgaaggggaaaccataacttcaaaatgatcttttgtatccttaatttgcattttgttttgggttgctgacgagccttggatagtatgtgctcataataaattttgtcagatgttactgttggatgaaaatcacgaccctctttagccgcctggggccccaaaggttgccaatctgtgctcgatatttcttctcggaacttggaagatgtgacacaaaattcatatgtatttcaatatgctttggaaggggccagctgagttgtgttaagtttgtttaaaacgactgagttcctctttatatcgacacccataacatcagagtgattttgatgtgatcttgttattctgagatggatcatggaacactgcatgtctgtatgcagtgtatatggaatgatattatggctgtgtttagattggcccaaagtttgcaatttggttgaaattggagacgatgtgactgaaaagttgtgtgtgtatgaaaggtttgatgtgatggaaacttggaagtttggaaaaaaactttgaaactaaacataccctatgcaaactgaactccctgggcgattagacattcccgactaatgctcggttaatccccgataggaaggaatcagaagggattgagaatttgagatccttctcaatacctctcaattctccactagttacggaaaacgagagctcatcatggtatacatttgaaggggagcgagtgctttcaaaagtactttaaagagaatcgattttgaacttaaattttgttacaagatgaaaggagcatagtactagtatgtgagatcctggtttttctgaaggaggtccagtgcacgcatccggtatttccctttccaaaaggcccaatgctgtaccgtcgaactcgaacggtcgggaaaaaaaaaagaaacagaagaaggccgaaataaataaagaggatgaaaagaaaaataaaataaaggaaaaaaaaaagcgcacacaaggacctcccctgtgccaagcggccgcgcatcgcagccgagacgagccgccccccgcaccgcactctccgccgccggcgccgcgccgacctcctccgccgcgccgcctccccggcgcgcgcccccgtcaccctctctcgcctcgccgccgccgccgctgcctcctcgtgaggggggacggtggtgggggcctctgccctatggcgagcggcgacggcggcgacgacgcgggcgtgaagcgcgtggcggaccgctacctgaagcgcgaggtcctgggagagggaacctacggcgtcgtcttcaaggccgtcgacaccaaggtccatctcatcccatcccatcaccccccccccccccccacttctcccgctcctaaaaccctcaccggtgcacatcgtcgcgcgcgccggggggcgcgctgatctgccgccgcctcgagaaatttagtcgccggccggctagttcgggccctccggctcgatccgaccgcccggtggagaggcgggtggtcgggtgatttgagcttcaagggttttgttcccggattgtgaaattgcgtcagtgaacggatggctagagctgttctttctgcaggggcagtctaggttggccacccatgagccgtggttgagcccatgaatgcaattcacctggttttgttcactgccgtgtggattgaactggaggtgttgacactgtgagggtgtttgagctgtggttattgttttgccatctcttcttaagcaaatcgcagtttatccactctgatgggaggggatctgtgggatagcagggtttgttgtgtcgtggactcatgtatctttgtattatgataggctatatggtgccagcctttcactctacagattttgggtgtgctcctagtgcttttaagttttaagtttattacatcagctgtttggaatgtattgtcgtggaattttgcttcttgcttttgttaacttttattgatatcatgaatgttcttcactttgtttgagttaatgttagggttattgaacttttacatgttccttgttttcagactgggaatacagtcgcaataaagaaaatccggctagggaagtacaaggaaggtgtcaatttcactgcattgagggaaattaaacttcttaaggagctgaaagattctaatattatagagctgattgatgctttcccttacaagggaaacttacatcttgtatttgagttcatggagactgatttggaagctgtcatacgagataggaacattgtattatctccagctgatacaaaatcttatattcagatgatgttaaaaggtttagccttctgccataagaaatgggtgctacacaggtatccactaataatcttgctaaatttcttttagagagagtatcctttgacaatctgtgctgtagggatatgaaaccaaataatttactcattggcgctgatgggcagcttaagcttgctgactttggtctggcgcgcatatttgggagtccagagcggaacttcactcatcaggttcttttttgtggaattatatttattagaatttaattctctgtataatctagtcgattgtatacttggaacttgagaatcttgttgctgaaacaaatatgcaatgaacatttcttcaagtgtattgatgtttcttttgtatttttttaactcggtcgatattgctgtttgatgcttcgttgttctgtttatcaaaaagaacatccttgtggatattttgcgcccttatgctttacccttttttcaacaacagtaggcacctaggaagtagaaaagcttaaatctttatggatggaacaaaatgcatgtggggaagttcttatgttatttcctggacatttgagttggcagagttggattttgaataaatgtcacaggatactgatttcggaagtatgtgtccttgaataaccattttcttggtaaatattaatagtgttggaatgactgtttcattctgaattatttgtgctgattttcattcaccatcatatctggaggttctcttaaaccatctttttatcagttatgttgacgatagtcaaggatcaatgctacacttattacagcaatgctgtgtgctttgcttaaatgagtgttttttattttttattagtttcactttgaatcatattatcctgatgctgctgggcacttcagttttgaattttttttctcaacatataggtctttgcacgatggtaccgagcaccagaattattatttggcaccaagcagtatggatctgcagttgatatttgggctgctggttgtatttttgctgaactgctgcttaggcgaccgtttctccaggtttaaccgactcttataattttatgctctgtgtaatttcaatctatttataactaagcactttttatgctctgagaatgttgcatggctaagtttgctgttcctatatgttgtgataactgcatgcgtaaatgtgttacctcaaaatgttgtttccaaagccagattggacttgtagttttcaactgaggaaactggaaatggtcaggctctggtgaggtgattgaactgaacctgtaaatgatttaaactttgggtttaaatttgacaaagtgtttcaatggtaacagtaaaaaaattcctctgtggatttgaacctttgtctgtagattctggaatagaagaagctagttcctctgtgcatgtagttgatattagatttatttaatgagcacgttataatagtctagcactggtaggttcacgcaaattaagcctcgctctagttttagacttcaatataacaaaattatgtatgttatgtggggctgcatgtgcagccgcctgtgcatgacagttgccatgctcttcacaaccaacacaccaactatgttggctcctccacaagtttagtagctagatcatttccactgctagtttgtttgtttccgtaggattaaattatttaagggcttgcctgagaatatgatgcaagctgaaagttgtcccacgatctctctcctaacgccatggtgttgggcgacaaggtgtcacgcccttgtcctcttgccatccatcagcacaggtattatctgactgactcccaagaatcccctgaaccatgtgacaatgtacaccttcacaataatgttatttagagaaccagttagatcagtgaacagacgagtcatagtattggctgggtcgatgcctgcaaacgaccagttttcatgcttgaggtcattgtttactatatgtgaaatctgccattagttgtttacgagtagttttgggtaaggaagctacccctagaaatctgtgcatggggagaaaagggttggactttctagattcactagggtattgtttgtttctttccttttctatgttttttggaaggtagattttgtggcatgtgctcttaggccttactttcaagtgatagatctgattattctcttcaaaactattttaggtagaaaaatgttattcctttctccagtcttatgggatataggcacttgttactaagttcacgggtttgtgcttgattttaagcttattgcctgagatttggttaccctggctacttgttctggccatacatattttggccaaagaagggttttcaggttatcacaactataatgttctgattactggtggggttcttttagcattgaaaattaaaactgcaattccttgttattgttttacttgaattttttgaacatggtgtttttttttttggattagacgcacggagaaaacattaatgcacatgggaggctagataacatgaataaaatatggacttgtggtcttgtgctaaatgtgcataattctttttcactcaactgaaagccttcttaggccagttgtagaggtttaatttgttgcttctggtcttgctgcaggtcctcttgagtttcctgattttttatcttgtgtattctccagaaatgtggaatcatggagttgaatattcttgtgttgatttattttttattggttttttttattataaatttgttttctttatctatacttacaagtcaagttcttagatgcagtagaggtgttaattccattttaaggaattttagatgctcatctaaatttttcatcatgtatgaaaggcttttcatgtcactatccgtggttttctttgtgagaggcagcaattggttgaaaatattttgatctatatctaactatggttctctatttgattttcaatagacaagttgtttgctttctaggatcagatctgtctgcagctctaagtaaatgctctactgtcacaacttcttcatttcttacaaatcaagtgatttgtaaactttgggtttataacctcttaagagagcattgctgcatatgtattttgtaagcgttgtttcatcagtatgcctgatctttttgcatgtgtgctgataagagaaggttggaaaatgtgatatgatatttaacagtgggcagcaattttttcatttggtagctataccttaaaagctttaatgggcacccaagtcactaaatgttaatgttgcagggttctagtgacattgatcaacttgggaagatctttgctgcatttggaactccaaagtcttctcaatggccggacatggtttatcttccagattatgttgaataccaatttgtctctgcacctccacttcgctcattgtttccaatggccagtgatgatgcattggatcttctatcaagaatgtttacatatgatccaaaagcaagaattacagctcagcaggctctagaacaccggtatgcctttgttactgatcaatagaacatctgctatctatctctgttattagtacatgccatataaaaccatgtttatctttcctattaaggtactttttatcagtaccagcgccaacaaaaccatcacagcttccaaggccaccacctaagggtgattcagggaataacaagataccagacttgaacctgcaggacggccctgttgttctgtccccgccaagaaagttgcgcagggtgactgcccatgaagggatggaagtccatatgcatcgggcggatagaacagaagagcatccttcaggggcaaggcacatggatgacatgtccagccagagtttagaataccaatgtcagttgatgttggagctattttgggacacgacctgctcctagaccaacgttaaacaggtaaacgacacaaaccttgacgaatggaaatttggaactcatgtccttgtctaaatgaccaatgaacctaataatggaataaatgatgcatttaggattgggtgtgctcagctcgcccattctgtggaataattgaacatatttatttccattttgcagtgccgacaagtctcgtttaaaacggaaacttgatatggatccagaatttggatacacagagtaaatcaccattttttccatactggcttgttgatttttaaaatattctttggggagatagttccactatctaccaacaaaagaggattgtgtcgaaagccataaaaacttcactgaagggcgctgacaggatggcacagccaactatgctgttatcgtttttgactaccaaagccggctcaggaagaggaaactgaagagttacgtgttacgatgctaatttacaccaggacgtgcacatgccatttcattttggctggcatacataaatctgtaatctttattgcatagatgagtttgcttgtgtgagcatgtttcttccagtgttcgcaaagattattatgaagtttatgtctcaagttctttctggtgtcaattttcgttcacttcttgtatggacattgaattttgattgttgtttagtcggtcatcttattcttaggtacagtaattcttgtaaccaggagcggcttatattacctgagtattctgacacgtcttcctgcaatacgctgtaacaatgcatgagtgaaaaaaaaaagagaaaaataagagcaacttcttttgttcttacgatgaattattatgtgattacgatatctacggctttctaatgtgaacattttattatcctttctttagatgtcttctatactgaaatttctgtgatttatatttgtggaatgggtaaatggaatgaaaatgtttctttcggacttctggcttcaggtttgcaaattagcgcaacttctgtgaaggctcagcatttctgccgtgtagtgaaccgggtgtacaagaattgtttcattctcttttttttttcttcgaaaaacagtaaagatgctcatatacacgtgtggtagcttcaatttgcaattgattaaaaacattacatgttgggtgttcaacgcgaggatcaaaattcaaaattcattgaaccttatagagttgtttttaaatctgaaatatattagcgttaatcggcttgttacctcccaacatcaaccatgtttagacaagcattaatgttactcgggcgtcggaagtgatggcacaaacaaaatagaaatgacggtccataggacatgggtttcgaggcatctcatatgaaaagtccatacgctagaggacaagttgccatgtgaaatggacacttttgctaactttataactgctgtaataaataatgtgtgcagtatatgcatgtgaacttgtgatagtaaatggacctgactaaatggcgtgacatgtggcttgtacttgaatccatattactttatttatctattatatagaatgtggcatgtactcgaatccatataatatcgtacaatattggttatttatggtattccatgcgtatactatgttaaattactgtaataaaaatattttctaattttac

SEQ ID NO: 46009 - DNA, 8036 bp, Oryza sativa
ttcattttacacaaaccaataaaaaaaagactataatacccttcgcttttatcaaatctcaatgcaactatatcttactttatctactatcattttttttcttctttatctactatcattttttttgcttttacaaactcggatacaatgattactcaacaataaacttattttggaataaatgggaggagctaaaagtaacttatttcagagacctgggaagtaagattttatgtccagttcactctaaggcgtaaccgtaagagttgtcttaatcctccatatataatcatctactcccttggttgaaagaaaataagtgaattctttacatctcgaggaaattttagtggtgaggagaaaagaccaaagtaaccattatatatggaaaagtataatcggtaggtggtgggtaggtaatattaagggataaaatttcttaacttttggactatagtatgtatgaaggtgaaaattaatttatttttagacaaaatttaaactgtagaaaccaaattatttttgacgggaggcagtattataatttttatgagttaacaataaatttattgaggagatagaggttaattttaagtctcatgaagaaaaaacaactctaggtaaaaaaaaaagaggagagagggacatgatgatgatgattgaagaaaattttattttagatccacaagtactcctaggaaatagaaacaaagcattgataaagtactacccttctcatttcatattattattagttgcttttcctttttctcagtgaaacttctttagatcttaatcaagtttatagaaaaaaaaatagcgacatttacaatatcaaaatagtttcattaaatattacattgaatatattattgataatgtgtttgttttatggtgaaattgctatttcttttatatacctagtcaaattttaaatggtttgattaaaaaaaaatcaaagtaccttataatatgaaaaggggttcccctagtgcacatgtaattttatccatacttaaaacatattgttttaaacatatttttttcaatcaaattagatactcaaacttaaactgtatcattttatatattaagattgaatgtgctcatctttacccaaagtaacctcgtactcttataatatttctgggttttataactatactactggcatcggtgtgcattaggtaggtgtcatcaagatgagatgagatggacaatatgacttaattgacatgaagagaatttatgttcaaatcataattgacatgaggagaagtaatacaaaatgtaaatattactatgagatatttgggtaagaatcgaacaacaaacctcatccatatgatcagataactgcatgtatacaacagtcagtattaggtgcattaacactattactccctcaattccaacagtcactatgtttattattattataacacatctctctcgactaaattattgttattattttaaatctttcatgctcaagatctctgattctattgggtatatgcattatattttttgattgatccacataagaagaaagtgataataattgtttcgaaagtgataataattgtttcgatctttatggattaagggtgtaccttataatttgtaacagatggagtatgatatgatagttagttctctccccgtccttatatttttttatatggtctttagtggcatacagggtggatctagcatgagggcgacggggtctcgagcctccactactgacgtgagaactatagaagcccccacgaatcctccactaaaattttttactataaatagatggggagagggctatagcttcgtttagtttattcagtccctcatgttatttctttatccatcacgtgtggtctactttgaccattaatatatttcatattatgtgcccaatggatatgtaattagcataactcgaaagtacttcaaaatataaaacgagtgttataacgtgcataatatttagtataatttggttagtatgattattagtcaaaaggtaccaagtttaattttccttaaaacgataatttgggacggagggagtatcattatactctttatattatataaatataaataaataacatcactattgctttctaaataagctacgatgagagcataaaaacgctttcgacagtatcaattcctaccaaaaatgaaccgcaaaaaaattccataaaaaagagagccattccttatcggaatcagaacccccactacaggattcgcgctccgcacgggcgggcagcagcaggcaggctcgctcgagaccgatcgacacgataacgacacacggccacagtgcaccaccgcccggccgcacccgatccctcccctcctcggactccgcccccggccccggccccggccgccgtctctcgggctttactctctcccgtgccgtccacccagggccccaccccgccccctgaccccacccaccacccgggcccactcgtcattgcccccaccacttcgtcataaaccctccactgctataactgcgactgcgacgcactcgtcatattctcatatactagtagtatcaactacccaccccccacctcctacgcctccgccgttgcagctaaacccctctccctactcctcatccttcccatccgcatggatcgcgccgcgcgcctcgcccgccgcggcggcggcgtgaccgtggctgaataccgcatggtgcggggccgccgccgcggaggcgacgcggggccggtggtggtcatcgatgtcgaagacgacggggaggacgctgctgatgactccgccggcggtgggggtggagcggcggcggcggtgaagaggagggtggtggttccgggggccgtggcgacgcggacgcgatcgcggaggatggcgatggcgcagcaggcgcccgtcacgccgccggctgcggcggaggaggcgccgagcaggaggaggaagaggaagggggcggcgagtgcggaggcgggtggcggagggccgtcgaagcgccgcgtgcgatcctcggggtcagcgggcgggcgtggtgcgcgcaagcgcaaggaggcggaggcggatgaggaggaagcggaagcagaggctgaggaggaagcggaagcagaggcggggactcccgctcgcggagaatcgatggaggtgtcacaggttgacgggggtggcagcagcgggcgagccgatgacgcttcgcacaatggtaatggcgagtctcgcgtgtgtaacgcggatggcattgatcaggcaagcgaggagcgtccaagtgtcgctggtggggatctaattgaggaggagcactacgggaatggggaagccagcgtcgctggtggggatcgaattgaggagcactgcggtaatgtggaagccagtgtcgccaattcgaatcgtgatggcggtgagatcatcgctggggagggcacagaggatcgtgggaaccggagttatcagtggtggatccagtgaatgaagagttggcttccgatgaggatgattacgacgatgaaatgttggaggaaaagcttgtcggagatgtcattcgtgcttacagcaatggcgctgatttggatacaaatggagtggactgggaagccgaggatgagatggaatttgctgatttggatacaaatgtagtggactgggaagctgaggatgagatggaatttgatgatgataatgataatgatgctgatgacgacggtgataattttgggggtgatgcggatgaaggtgacaaatctgtacaaatgcatgacttttctaaggtggaaacacaagatttggtgagccacaatgttaatgttagtgaagtgaggcctcatgaggatgaggaggctatcaaggatgagatggagtcaaagggaaaaggatctctcagttttaatgaagggagctcctatattgaaattcttgactctgacgaggaagtcaaagtggtcaatgacacagggaatgccttgagaaggaagccattagtaccagcgaagctaccgattgtgccatcttgtgttgcatggagaactcggtcatcatggggtatgaaggaggagaggatttcttacaatacatatttcgaggtattgtctgatgagccaaaagaggatgatgatgacactgaagtggaattggatgatgaggaggacgatgaaaacgatgacgattgcaatagtgctagctgtgatgaagaagatgaagaggaagaagaggaaagagaggaggaagaggaagaagctcaaaggagaaagcaaaagaaagggattgactcatctgatgatgagatgattgatgatgctgtagattgtggcattgattgggaggaggattacccagaggttgattttactcggccacttacctttcagaaagatggcagtgaggcccctgtgggcagcgaggcttttacggagcaacagaagagatcgcgatttacatgggagcttgagaggaggaaaaaactgaagcttggcatgatgacgaatcatcgtttgtatgaacgagacctggaatcagattccaactcatcagattctagtcagaatcgaaaaaatggatgtcaagggagtggtgatcacagaactgggaggaaaaggaagaatccattatcaaaatctggtaagaaatccagccgcatgttaaagaggcagtctcttatgaagcttctgatggacaagatgtgtagcaatgatgatgggaagtctactccttttgaccagaagccccagattgagtatagtttcaaggatttgcatccgttggttttttcatttggggacgatgatcctagtccaactgataggtcagagcaagatgctgcacttgatatgctatgggctgatttagacttcactttagagtcagagaacattgggacttattatgatgatgaggtacttttgctgcatgaatttatctgacattgctgacgtcctattattttccttaatggggttgatttgattatggaacatggcaaccctatctatattacatgattgttgcacttatctttgcagagaaaataagctgggtatagacataggttcttgttaatcattcatcaccattgctgcccaatttgttacattctattttaccactatttgtggtaccaatatttgggaacagcagtcttaacttggcgcagccaattctaagtagtgtatgtatgcgtattttgtgccactaccatattgcactctttaacaatgaacatatatttatttgtttggagaataaatattcctttatgttatctctgtataacagcagaacaccttttgatggttgacaacaggagattctggtcaattttaactatattatattatgtaattctccaaaattttccagtgtgacaaatttgatgctttcatttttttggtgtcatctagtcaaggctaccatgttgaaatgattagcttctgttgttttgtagggccaagaggacagtctgctagatcatgcacttgctcctattacaccttgttctagagggaagcatgaatttattattgatgagcaaataggaatcagatgcaaatactgctccttggtaaatctggaaatcagatttattttaccattgctggtgagtttagtatctctcaaaacttctggcttgcttcccacaacataagttgatcaattccattatttatcttgttcttccattccaggcctccaattttgcagagaaacctgcatggcgaaacagctcttgtttgaagactgcgttgatgtgtcctgatctttatgaacaaacagggactggtgatggacaatctcaagatttccatataaatggaactgtgtgggatctcattcctggcgtcattactgatatgtatcagcatcaacgtgaggcatttgagtttatgtggacaaatctagtgggtgatattaggcttaatgaaataaagcatggggctaagcctgatgttgttggaggatgtgtgatctgtcatgccccagggacaggaaagactcgtttggctattgtgtttatccagacatacatgaaggtgttcccagactgccgaccggtgattattgcacctcgtgggatgctgtttgcttgggaacaagagttcaagaaatggaatgtcaacgttccttttcatataatgaacactactgattactctgggaaggaagacagagatatatgtagattaataaagaaagagcatcggactgaaaagttgactaggcttgtaaaactgttttcatggaacaggggtcatggtgttcttggaattagttatggtctatatatgaaactaacatctgaaaaggttggctgcactggagaaaacaaagtgagaactattcttcttgagaaccctggtttgcttgttctcgatgaagggcacacacctaggaatgagcgcagtgttatttggaagacactaggaaaagttaaaaccgagaagcgtataattctatctggaactcctttccaaaataattttcttgagctttacaatattctctgtttggtgaggcctaggtttggtgaaatgtttttgactaaaacaagagtgggtcgaaggcactgtgtctcaaagaagcaacgggataaattttctgataaatatgagaaaggagtttgggcttccttaactagtaatgtaactgatgataatgcagaaaaggtaagatcaatactgaaaccatttgttcatatccataatgggactattcttcgaactcttccggggctcagagagtgtgtgatagttctgaaacctctaccgcttcaaaagagtatcattagaaaggtagaaaatgttggatctggtaacaattttgaacatgagtatgttatttctttagcctccacacatccttcacttgtaaacgcaattaacatgacggaagaagaagcttcccttattgataaacctatgcttgaaagattaaggtctaatccttatgaaggagtaaaaacaaggtttgtaatggaagttgttcgtttgtgtgaagcattgaaagaaaaggtattgatttttagtcaatttattcagccattagaattgataaaggaacatcttcgtaagattttcaaatggagagaaggaaaagagattctccaaatggatgggaagatcctcccgagatatcgtcaaaattcaattgaggttttcaataatccggatagtgacgcgagggtgttacttgcatctacaagagcttgttgtgaagggattagcctaacaggggcttctagagttgttcttctagatgttgtctggaatccagctgttggaaggcaagctatcagcagagcatttaggataggacagaagaaatttgtatatacatacaatttaataacttatggaacaggtgaaggtgacaaatatgataggcaagcagaaaaggaccacttgtccaagttggtcttctctacagaagacgagttcagtaatgttaggaacatgctttcaaaagctgaaatggagcactgttctaagttgatatccgaggataaggttctggaggaaatgacttcccatgaccagctgaaaggcatgtttttaaagattcattatccaccaactgagtcaaacattgtttttacttacaaccagattgctcctgagttaagttaataatgactggcatcagatggattcattctttaaggtggtgctctcgaacttttgacttcttattgttgtggctagttctagaatgatcagatattgatggaatgcgatgtgcatgtgtaatgcagctgactagctagcgtgaggacagtgagactgaatacagcataaattttcagctgtttttgttgcagatgatgattcattaattataaggtgaacccttgtgtaatcgcactggaagaacatactattgctatggcatccgtggtccagagttaaatagttctagttgactgtaagtttgttccactgacttcatcatgttataaagttgacttgcatacaattagtagtcaggtggctgctgatttccattattttcttttaatggacagctatgtgttt

SEQ ID NO: 46010 - DNA, 2064 bp, Oryza sativa
atttgttgaactaaacacaatcttaatatgaataagcggactagtttcagctatgcttcagttttcgaatggaatcgtttctgtttctgttcttgcccatgccatatgagcatggcaatttcgcctacatagttatgcattgcatatgcgttcttgttgagaggtaggtttatacaagtgtttgcagtttttaattttaaatctgtgcaatgaatatgttcatttaaggatcagtgctatcctgccttcctatcttcattgccaggagaggagtatatatttttgttgcaacagcaaatctgaagggtccaaccggagcctggaggataccaagtggtgtcaacctatggaacctgttacctgtttagtacctagggtgtgtttagttacgccaaaattgaaagtttggttgaaattggaacgatgtgacggaaaagttggaagtttgtgtgtatagaaaaatttttgatgtgatggaaaagttggaaatttgaagaaaaattttgtaactaaactcggccatagtaagcaaaataatcactatcctatgagaaaaatatctgactgtcagaaagttgtaaaagcaaggtgctagatggaagattcaagattctcttgtactgtttgtactgctcatcgtatggcaccatcaggttgtaatacatcacatcacactgtcagattattactactatttgttttatatatatctaccataacttgtgatgttattacgtgcaggattaattgggacatgacaggttttgttgttatcagaggctcacctgtgcagtttagttgatgaggatgcttcaaatgatataaggttatcttcaaaaccaaggtaacttatttggacaattcatacggaaataaaaccactaaaactggaattatcgaagggcaataactggaattatcgaagggataatttctttgctttgtgtgcgttgatttgctgtgttctgtctggagtagtcccctttttttttaacaaactcatgcttaatagactctcaatttgaagtttgtatgttaaattatagtggattaaaattttatatttcatctaaaaagaaaataaaatgattcatcaaatcgcagatccatatcaatggatttgtggagctagcaatacctagcttcataaaatcttggatccgcagttgtgccaaacaaacacttgagaaatcttaagatactgaggctgtaagacggccgtgatgacaggggaagaacgttaataatcacaatctggatcagctgaccactgtcttgtgcagtagggtagaaatgatggaaacagctgtgacatgacacctctaaacttgctttgttacccgtaattagcagtattattgatttataatcctataatttctttttaatcatctgcagagatgttcatcttaggggccgtttggaacagttcggagacagtaattttacaggaaacagttcaattctcgtaggatttatgaaaaaaaaaatctgcatttcaaaaggaccttaactggtcattagtgcctttttcgaaatttatctctctccactcagcaaacaatgatattttgaatgttgtactgtgttttggcgaatagacgctcaatctcacaggatcctaatgcaaacaggacaatgacatatgcattgtgtttcaacaaacaatctacaaagtccaaactagatatgcagtagcaaggttttcttttttataaaaatgtgcaatggtattgagaaagctatcgatgttattggtgtggtggtgaagttgtgcattagtgtggtggtgaagtcgcatgactatacttacaaaggatcaaatctttgtgctcataggtattacgcatatgtaggtgcaattttaatagatttttagtgattatagggatcggttgctagtctatgtttctttaagcatgtgaagcacactcattggcatatgagtgcgcatcttccattaaattttatatattaagaatatacagacatgtactccctccaacttaaataacttcatttttcaccatcttatttgtttcaaaatattttttttcaaacaat

SEQ ID NO: 46011 - DNA, 9674 bp, Oryza sativa
gctcggcggcggaggtcctcgagcggtggcccgtggtcgtccctgcttcgagcggcggagggcgacgatggcgcctcggatccagaccgacgccggcgcccccgcccaggatccagactaacgatggcggcgagcggcgtagcccctccctcctccttctcccgcggcgtgtggcgaggacagagtggcgcaggtaagtggagtcggcggcgagcggtggagcccctccctcctccctctctctctctcgcggccggtggggttgctgctgctactgcaaggccgcgccgcgccgtttctccctcctcccatccgcgacgatgccgagcgggttgctgctgcatggccacgacgcgccgtttctcctctgcacggcgcgtcctcgtcctcgcatctctcatcagtgggccccgcactcgactttttgagcaaggttctcgttccttcgctgggaaccgaagaagctagtggagctatgggccccaccaacttttttcaccacgtaggacaaagtaacgcttcacatagacaaagtaacgcccccactgtgaagggcctaatagatgtcacatcactgccttatcaatggattttactcccaatactctctgggtgtgtttagttcgtgccaaaattgaaagtttgattgaaattggaacgatttgacgaaaaagttgaaagtttatgtgtgtaggaaagttttgatgtgatggaaaagttggaagtttaaataaaaaaattaggaactaaaccagtccctagtctctataaagtactacctcctaaaatataataatctagaatcgaataaaatatatctagcgctaagaatccgaacaaatcatctctctagattcgaagtactactaccttcgtcctaaaatatagcaactttttgctatgaatctgaacacacaattgttgagattcatagctaaaaatgtttacatttgagatggagggagtaacatatatcaaatcttatcatagattcttactacctccgccccaaaataagcgcagatttgatatatgtgtctaatgtttgaccatccgtcttattaaaaaaaattaaaaaattagtcacatgaagtactaatcataaaaaaatttcaaataagacaaacggtcaaatgttggacatgaacagtgtaaaactgtacttatttttgggacggagggagtataatatagtaatctaatatcagattagatatatttaaaagtataaatctgaacagatcttttgttcagattagtatcactaaaatatatcaaatctgaccatagagtcttatattttgggatgaatatagtacctctttcatatatagagggtgccaacattcgattaaaaatctatccggtatcgatctcacctactccatccttgaaccagctcacacctttgttctgtcgttgttttaccgacactcacaatgcaaagtttatattcgagaaggtaatcgcttggagtacttctaacagcctctctaaatttgactagaacagcctctctaaatttgactatttaaatatctatttagctagtttgttaaaaatattaaagagtgaaatttgactttcactctaatattcttattattacactttccaatatgatagtgggttacacatatcaatctttatattcttcgtcttccttccttcctctagatattttccccctcaccattttttctctccacccatttctttccatgccgcttggtggtaggtggtggacaaggctagcacaagatgcacaggaggtgacggcatggacgaggcgagcatagaggctgtgcgggagggcagggaaagggagggaagggcagagacacctccgtcagggaagccatatccacacaggggggctagcagggtgatgagctctccgaccgctgatgccaccgcctatgccttcttcgctagattcggtatcgagctcaccttccctccctacctcatgcagatcgacatagaggacgagcttgacagtgctggagaggggacgatgaagggagaatttgttggcggtgacacatgaggatgatggaagaggtgtggatcttgacgattgtgacatgacagtagaggggtttgactctgtgacatgcaagctttgatggcggcctcaccattataattgtcgagctgctcctcgtcgttgccattgtacaccaccgcttaaggtcgtatcctatgggatctacaggcaatggcccctccattcggttccagcgggtggcagcggcggaagggaggcaaggagggttgatcgtgtaagcccacggatggccaacgattttggctggccaaattttagtagtgcggagaggataatttggccagccatttgagaagactattggagggccattttttctcaaacttaccaaattttgacttgagaagccatctaacaaggttattaaagatgctcttagaccttcctctaactcaacccgggtttgacaatgtcattgtaactaggacaaaagacattaaaagtgatttactttcatataaatgctacacactctgtataaaataatataacaatgtaatactgaattagacacatcctagtactaacatgtactcctatctaattcagtgctatgtgcttgtagatagattgatcagtccggttctttgtcctcggatcgtgttatgcccttggacaacatctatgatcaaatatagtggggtttcagaggtgttaccgttgacgccggtggggttattcgttgagccccgcggttttctccagatcaagtggcagcgacaagccccatgggccatggcggcttgatctctagatccatagtgacatcctagttcttgactttgggctttcttcgatggtggtggccgtacactagtctgtcaatgctcaagcagacgacaaggggaccttgggcctgcaaccctccccgtaacaccaactgttattaaatttatttctctttaagaatggtttggtaaatcagttttgtttgttgttaataactgatactatcattttactcctaactcgattgttagaaaaaacatactaaagatcatatagtaattctcgtagtaaaacgtgggaagcacacttaggagaaatcgagctgtgtttggttggagggagtggaaacgtgtttgtgggtcgtgtgtccttgatgtacccgcaacaatgagcgctcacacattttcatgctctcctccgtacaatataaataaaatacaagcatggttgatgacgaaagattttctatgaaaacgttcacatcgtgctagattttgaatgtgcttgtttggctttatcatttgaaacatattatttattcgattattgtcatgaattatctacttactattaaagagagcaatctaacatcttaaaaacggtttagcttaaattatggcgacacatgttacactatgaattttttagcaacttgatcctctctgcaattcgtgtaggagcagcgttaaactggctagctaactaaagctactcaaaaagactcaattcttgggttccagtgtccaacgtttgactgtccgtcttatatgaaatttttttatgattagtatttttcattattgttagataataaaacatgaataatactttatgcatgacttatctttttaaatttttttataattttttaaataagatagacggtcaattgttagacacggaaacccacaaattgagtttttttttgggacggggggagtagctaggtaggcagttatttatatatttatataattttacacggtagttacaacacacttacacatcagttacgtatgtaaactcgacttacacatcacttacatatgtaattagtatgtaattttgggatttacatatgtaattttaggacttacatatgtaattttgggagttacattgtaaatataataaaattacatatgtaattttgggacttacaatggaaatatatgccaactattttttggtgaaaaatatagcgccataaatatagctactccctcttaaaaaaataagcttaggaaatagcttaaaataagtggtttaaacaatagtataatagaagaaagttttcttaaaaaaagttttttaaaagcacagaacaaataatatgtggcaataatctttaaataagctgaaaagaacgggtaacacaaactttagatgtgcaacaaattttttcaagtatctgtctggtttactgcaactacggtggttagccatacgttttagtcatgtgacattatggattagagattttctttttttactttgtttaaggtgtgcctactttttctatcaataaccaaaataaatatagtctttatcatgtctttttcattctttatcacattctccttcctactagtagtatcttccaatggttattgctaacttctaattctctcatgaagccatcatagagccccaaagacaagctagctgccttgaaaaaaaattgacttgcacatcatgtttaatatttcgtcttgaaaatttcttaggttagcacggaagcaactgcaactaggggcttgtttagttgtggaaaatttttagatttggttgtcacatcggatatacggacatacatttgaagtattaaacgtagtctaataacaaaataaattacagattccgccagaaaactgcgaaacgaatttattaagcctaattaatccgtcattagcaaatatttactgtagcaccacattgtcaaattatggcgcaattaggcttaaaagattcatctcgcaatttacccgcaatctatgtaattggtttttttcctacatttaatactccattcatatgtccaaatatttaatgtgatagagtgaaaattttcgttttaggaactaaacagggcctagttgcatggatgttgttatgttgcatagatggtacggagttagcagtaatcttcagcaaaaatgtttcggagaaaaagccagaggccagttcgaatttgcagttcggctcggaaacatgatggattattagcacataattaattttgtattaactattataaattatatatatatatatatatatatatatttaaaataactctacatagaaagttgttatacaaaacgcactgcttaccggttccagaaatgtgctaacctaaaacgagtttaagaaagaaattgctgttttgaattattggaaagaggtagacacgtatccttgcaattattgttgatggatcttatttcatagtaggtttgttattgatggatcttatttcatgataggtttgtttattttgatggtttattattgatggatcttattacataatactccatctattcctaaatataacggattttggtgggatgtgacacatcttaatataatgaatctggacatgcttcagtctagattcgttgtattaggatatgtcacctcccaccaaaattctttatatttagggacggagatagtaggtttgtttattttgatacggatgaagtaatacacaccttgcctagtatcccatttcgctcaagattcctttattttcatgacaacaacagtgtgcccacgttttggtatggactgcaaacaaataaaaatggatttttttttacacatagaatatacaaagaacaaatattctcaattgtaaaaattgaacagaaagattacatggaatcaatcaattgctacttattcccacgtgcatcatttcttttcttttacaaaaaatccttcaattaccactcatgtccaacaagtgtttgccacaaataccaccactcctgcaactgcaagaagtgtaaacaccatctttcattttttttttggtgcacatacaatgccttcggctgctgagttctggcagaactctagtactctacactagacatctgacattacaagataaatttattgcaactgattcatttccagcaaagaaagaaggaatatgaacagaactgatatgtttacacgctacatactatacgtagtcactacaactaattcgatctgtggaacacctatttcatttcaatagctgtagacattcaggggtaaaagaagaaacaaacgaatttattcagaaacattccctgacgctattaaaaagaccccacatgtatgacgtgatgttttgcttttctgtatctgttccttattcctgagacttattctttggtacaggatctcaaaataccgcaataccacatggattacattttctttacgaagggataatgataaaagttatgcactcttgattctcttctgagaaacaaagagatatcgccgcagggcaagcagtgaaatccaagtaaatcttgaaatcttctcctttatcatcagcagcaatgcagaactcaggacagtcttgagtatctgagcatgtaatcctttgaagaagcctgggatgccttccttgctccacatggcatgcaaagcgcccaacattgttttgggagattttgattttcctggcctttcagattcatcgtcatcatcctcatcagggtctgcagcctgaatcatgaccttgcacctgtttgataatgatgtcatataatttatatggtgataataatttatatgtagcattggcaagcaaaatcaggtggaaaggtccagatgtacatcttctgagaaaaaagaaggttcacctgattagtgggtaggttaatattgtagcaacactttttgagatggcaccaaggagaaatgctgagaaagcagaaagagcaactggtgaagaaccaccccctgcttctgcatttttacgtctctgtctctgaattagcttctgcttgagctgatcaaatacagtatactgcaacagacaggtaatggcaaccataaaataattgtcaattggtgcgtgcaaagaataaaagtgaagctaataagtccgaaatccagttctaggtgtttcttagagcttatttgttacaaattccacacagacatcagccatgtcattgaagtgatcttatattagaaatgttttttttataacacgttatcttgtctgcaatttttaggcagataatatatacatgatacttgaactaaatgaagtttcttcaattacagaactagaataacatttacaactgaatcagataggaagaaagtttagtgcaggcccacacatcatttttgtagtagtagttagctatactcaattctactagtaaacaaacttgaagcagctcacacatgaagttctgcagttcctccattgttgagctcaggatattcttaattattaagtcaaaaggcacgagagttgcatttcatttatatgcaaatacagtatagttcacaaccagtcaacagtacaatagttttgccccttcctgtgtttttcaaacaaatgaatttgtgactttcactaaagcttgcagataaatgactgtataactgccatttttaaaagcatctcagtacatatgtttctatacatacaaaaaaaagagagaatttgaacaatgcagaacctttgtacctgaatagaaggattacacgttagtataagagaaattcccaagccatcaaatgcctcaagccaagtgccttcggcaagagttgcccgcagccctttggactttccaaaggcacttgtttgcattctagaagatgctgtatctagtggctgaaaacacaggagagatgaacacataaaggtcagcaggtaaaaacgattttcagtgaatggtagctaattacttatggcgttagttacctgagtaacaacaactgtgcaagcaccagcagcagctgcaactaacaagttcgcttttgtgccgatagactttgctccactcttctccaagtagagtcttttaaagtagctatagccataaaagtaaacgaattgtgaaatgaaagattggatgttctttgtcttaaggccctgatatagggatagaatttgtcttttctgaacagcttcccaaaagacatctgaaagattcctggaaaaaataaacacgtgaggtcacttattgtatgaaacagagtaactcagaacttcagaagagatggaacaccatgaaggcctggatgccaggacatacatcaaacgctggcaaaaatgcatgacacccaaatcaatttaacttttttaagagtataaaggtgcaatcaagtgaggtaccaatatgtgaaaatgtcaaggtcaatgcacatcccaaatgctacaaagagttagctggcaaaacctaatgaataaggaattaactggaccatatcatccaggtggatgttatggaagagaaaaataacatgtacatgccaaagtccctctacaatcttatatcttgtggtggagcgatcggtaaacaaaatatggaaaggcaaaatacctctcaagattaagatctttgcatgaaaattatttcttagtgagcttcctactgatgtggagggtagtgaccttgaataaaaatatatagcttttgtggtatacttgaggttcaagatcatttgaatttttcagcgctctatgacctgctctgtatgcctaactaacctgcatgaactaaatgctggctgctgttgtcttttggtaatttctctttgaatctggtggtgtctcctaatatgtactatatgttgcttttagtgccagagatgctcccaactctattctctttcatattatctcctgaaaaactctggctttcaatacaagcaggtattggacccctttggttcaggaaaaaattacaaggtatttccacccactgattatttttttctttttcatgactagtccattgattggccacagaaaaaaaatctctatatgcataacccttctctctcttttttttttctctttgtggggtgcataatccttcctatttggttaaaccattctataaccaacacctattggtgggcaactgggagctgaaccaaacaatctccaaccaatcaacatagtgccaacatactatacgattccagattaagtgaactccttgtgaagtgtgagcctaattcagagatataatgcaaacactaggtctaaagttcctttccccccttctaacaacaaagctggcgaaaggagacatggctggggtttttctgcatcctttggccaccaaataagaaatcaacgacagttctatcccagggaaattatcaactggcctatgcgaagatcacgacatccgccgctaacgccaggttatccacgtcaatcggaccagtgcatcacgatcagcccaaacactgaatcagtagcagccagatcccaattccgacgggtcgcctgcctctcgatcgagaacccggcgatctccccagcaagctcctgacaaggggatcagcaatccaccacatggcgaagagagggagagagagagagagagagagaggagccgctggctgagctgcttacctgtacttgtgcgcgcccggctgcgtctggagctcggcctggaacttggtcttgcaggtgtcgagcgggtagagcacggtggtgctgacgagcgcgcccaccgccccggacgtggcctccgccacgctctcccagtccacaccatcccccgccatctctcctccctctccctctcccgcccgcccccgacgagatcgatccctaactcgcgagcggcgtgcggcgtggagaaatcccccggggagcgagcga

SEQ ID NO: 46012 - DNA, 5088 bp, Oryza sativa
cgtgcgccacgaggggtgttcccgcgaatctgcgatgcgttatctggccagtagtccgcgcgcgcggctgtgtaccgtgtagtgtaatcccgggtcgcgtgcagagcagtggtgtggtcgcgtgcgcgtggaacggtgggggagtcgcggcggcgtggtgggtgggtggggtgggggaagtgaccgagggagtggtgggcggagggtcggggacggtgaggacgggagtcggaacggggtggcgcgaccggaggagaccgcgagaccggtccgtcgtcgtcgtgcaggtgcagtcgcttcgcttcgacacgtgaaacgcgtgcccggcgtgcgagtgcgagagttgccggttggcggcgcggcggtcagcgcggatcgtgtttttttttatactcttctccgtcacgttcacgttgggatcttcgtgacaacacgtcggggtcttcgtgacaaccgagagatagttgtagtcataggtcctatttagttctaaagtttttttccaaacttccaactttccatcacatcaaacttttcatacacataatttttcagtcacatcattctaatttcaaccaaacatccaaacttcagtgtgactaaacacttctatactggtggggataacccatcggcaagatcacatctgggatatctgatcaaactaccggcattagttggtgcattggtgcgctatgcatttgtgcgtgcattagttggtgcattggtggagcacccgttcgctgagatgtgatgttcggtgtgccatgatgatagtgaatctgtgaatgctgcgttggtcaattgccaatcagcacaacctcacaccggctaacctatgcggacgcagcaattttgcctgcataagctaatgaaagatctcgcttagagttgctcgtgcatattatttgagaaagggattgctggtcccaaaaattgacagcaatttttcgttcttgcaacgggaaagagtaacaccctgtacgcttcgtgactgccacatgggcgtacggagggcaacctatccgttcactgtactccctccgttccaaaatatagcaacttagaatcggatgggacgtatcccagtactacaaatctggacaggagacatgtccaaatttatagtactatgatacatcacatacgatcctagattgttatattatgggacggagggagtagctacctgtggtctgtgcctccttttgctaccttccgacaatccgacgaatggtttggtgcacgaatcacgatcgacagctcacaggagggtaggacttcgaccggagctgctcgccaagacgccagccggcccacctttttgctaaccttggctcgcaagcccagagtctaggcccaagtgcatctcttttccttcgagtgaaattaggcttacactagcccattcaacgcagatttttctattggggaaaagtacaccgaaggtccctcaacttgtcatcgggataaaaaacgtcctcaaaccacaaaaccagatattcggggtcccttaactatacaaaaccagtcacccgaggtccttcggcggttttgaccctggttttagtctacgtggcggttgagtcagcgtgggacccacgtgggccccacgtattaggatgccacctcatcacctctcttatttcccactcttctccctttctctctctttcacttttctcaggccggccatgggcggcgctgtggggaggaggccgccggggggaggggagagaggaggtccggcggccggcgtcgcgccggtggaggaaatgccgccgtccgcatccaacgcgcgcaccggctgctgccacaccttcctcctcccctccacctcgccgccgcccgaaacagcatcggctggggcacccggcacccatggtggaggcggccggatccggcgagggcacgccggctggcgtcgtgctagcccctgcaaggagtcgaaggtcgtcgagatggctgcaggcaaacggtgggcaacgtgccgcgggcgacggtggccggcggcggcatggatgacgacgggccttctgcggcggagatggaggacgcggaaccgtgcccggatctagccgtcccatggccggattcgaagctcccgcgttgaatcttgccaatggcggcacggcaacaacggcgtcggcggctggacggcggggaggcagctagcgctggcggcggggctgagtggtggtgccggaggtggcggcggcggcgtatggtggtggtggtggtggtggcggcagcaaatcccgagacctggtggtggtggtggtggcggcggcggcggccgacgaggtcatggtggaggcggccggatccgtgctcgcgctcatcctcctcctcgtcctcttcaccgtcgcggcgcgggcgcaacaggagtacgaggtcacctcctcctcgtcctccttgccgtcgtggcgcggcgcgggcgagggccatcggccgccgcctcgggcgagggccatcgttctgctcctccccactgctctacgcttccgccgtcttcatctccaacctcctcaacgtcaccgccaccgccgtcgactcggtcgcccctgtcgccgccgaccccctcgtcctcacgtccgttgtcggcgacctcatccccacccgctggctagcctgcccgagaggagaagtgagagagggagagagagacagagaggaggaagggaggagcggccattgacgtggcatgctgatatgtggggcccatgtgggtcccacgctgactcagccgccacgtaggacaaaaccagggtcaaaaccaccgatgcacctaaagtaaacggttttgtaaattaagggacatcagatatctggttttgcggttaggggatgattttgtaactcgatgacaagtcgagggaccttcggtgtacttttcccttctatcggccctcttcggcctgttctaggctgtggcaattagtgcttgagctatggatctgtctagtaaatctattttaaatcctatactgattttgtggaaaaaaagtccaaatcaccctgaacaaactgatgtggcaagtggcaaccacggagagttcgagttccaatacaatacaattaacctttttctaagtaaaatgacccagccctatgttgttgaggtatgcaattctaaatgcatacgttaactgaacattactttagctccacaaattaagagtaaaatggaaattgatacctaggtaaccgtgtagtgataaatattttcaaattttcaaaagtggtgaaaacaacgaagaagcgaatttcaaaatataagtattttttagattggtacgaatatttagaaaatagatagaaataattgaagaaaatttatgattggttgagaaaaaaagttggtgaataaactaaatggataattgttacagaggataaatatgacactttagaggaagactcagaggacgaacagaggttgagagataaagatcgatagagaaacaactttattcaaaataaggtgctatgttaaaataatatctatattttgggacatattaagtagtaagttggtttccagtattttttttaatgaactgcaccagacactcgtgttgtttcattgaatggagtaggaaaaaacacaaggctaaaaccctggaaaggcagtagccaggaacgaaaaaaaaaacaccaccgtgcaccaatattgcctacacacaagtacacaacaacgctagcattggaccagatgccgctagaccaacaacgaaactaccgctgaaccgcactaaaccaaaccctaacagccgaacaccaaactcaaactctattcacatcttcgggattgaaggggaagagggtgaaagagaaaaatggatccgctctcccccacaaggcccgccaatatgatcaacttgcagaatttagggtgtcgtagtaagaggacaaacatatagagagagtacacacaagctgtcagagagaagttttggtaaggaggcctcctagacgacatctccaggaagaagagtgacaatgagcactgacgccaccttcccttgagacctcaaggagaaccaagacatggttttcaccaggaacgactcaaaaacggccctaggagggagaacgacaccagaagcgttgtcattgcttgcccggcatggccgggctaggtttacacctgccgctctccctagtcaattcgcagctattgctccaccaccgactatcctatctcaatgcgtggacactgctgtaccgatgacccccgccaaccagcctccgcatacctttgtggcacactgtcgtcgtcgcccttcttatcatcgccgcgttgacctccgacgatgtcagccagggcggcctccttgccgtcgcctgcattgacctcttgacgccaatctccaactgttgtcacctgcgccgatgtcacctgcgtcgccctcccgctgttgtcgttgtctctacgagccggccgctgccgctgtctatgtcgcgctaactctggccagatttatcgtggggggttcggaaacgggtagggatgtagatctgggcacggccatgccgaatcagcgaactccatcaccgctcgctgtccatgcacggatatgtccgactgcgccatcattgtctccgctaacgccattgctccctaccccttcctgtcactaagagtcactgtacagggggacgacctcccttgctagagaggccaaatcccgacccggggaggagggaagaggcaccagatctgacggcttcgtgcgtggtgcacaccctctgccctgccgccttctctctaccttatgctgcctctgtgctctccgtcccggcaccggcacgacacctccgccttctgagtcgcctcagtactcccatccgatacgacgtcctcagagaagaagcatcataccccaatcgttcttacactgtttagttttgactaccacacttatgtaccgatcaggtggaggaggaagaagagagtggcgacggcaatggcggttggtatagttgttcaggccatcttttaggtgggaccaacgcgggcggtctcccgtacttggaggttggaggtatcgtgcatccgaacgacagacttcacccggtgagttc

SEQ ID NO: 46013 - DNA, 1478 bp, Oryza sativa
ccattccgcggctactactacctgctcgactgcggcgccgcggcgtccaccaccgacagccgcggcctcgagtggctccccgatggcggctacgtcaccggcggcgagccccacagctccccgaccagggcctcctcgacccggcgctcgccacccgccgtgacttcccgcacgagcccgggaagaagttctgctacgagctccccgtcgaccgcaaccgccgctacctgctccgccccaccttcttctacggggcctcctcgccgccgccgcccgtcttcgacctcatcgtggacggcaccttctggaccgccgtcaacaccaccgacgacgtcctcgccggcagcgcctcctactacgaggccgtcttcggcgcgagcggcaggaacatgagtttctgcctcggcgtgaacccggactacaccagcgctggccctttcatcaacgcgctgcaggtgatccagcttcacgattcggtgtacaacgccacgaacttcactaccagcgccatggggctcattgcgcgtaccaagtttggctccaccgacggtgttgagaggtgagtgctcgatcactcttgccttcactattatgaacttctgcagtccccattaggtcctctattacgattagcttagtgatgaaatgttgaatggggattacatgattcactagaagtgagtatgtttattgactgcaaagctgagccaatcttgatatgatggacaatgatgtgtattcataggttatagggataaatgaaaattttgaaacaaataagtaatactctttggatcattttctttgatggactgaataactcaagtttttaggttatcttctcacgggttaatgtggagtgatatgctgtgttatattcatgtattaatttcttatgtatgtaaatttcacaagatctgtacaagtttttgacctgttttcctatattcaaacttaggtaccctaatgacaccttcaatcggtattggcagccattcccagacagtaaacatgcagtcagtagtacccacaatgtcacatcggctgatttttggaatcttccacctcctggggtgtttaatacagctttggtggcagaacaagatgcacccttggtgctgcaatggcctccaatacctctccagaatgatagctattatgttgctctttattttgctgatacagtctctgagagttcaaggacctttaatgtatatataaatgattacagcttctatgaaggcctaacagtaacatcagctggtctttctgtctttgcaacacaatggattctctcaggcttgaccagagttattttggctcctatttctggccttcctccacttatcaatgctggtgaagtctttggacttttcccactaggaggatacacatttcctcgggatggtatgtcagtcgctacatatattttttcttccatttgtatcttttttcgtaataggttaaactaaatgact

SEQ ID NO: 46014 - DNA, 3183 bp, Oryza sativa
gtcaagattgcctcaccccaaccattccttggaaagtcccgcagtgtctaacatggcattcaccatctcagttagagtgcagttctttctttcggctaccccgtttgattggggtgaatagggaggtgtcctctcatgaataattccagactcttcgcaaaacgacgtaaactcattagaaaaatactctccactcctatcggacctcaaccgtttgattttcctttcaagttaattttctacctcagctttatagatcttaaagtaatgtaatgcttcatcctttgttttcaatagatacacatagcaaaatctagtgcaatcatctatcagtgtcatgaaatatttatttccccctttagtcaacatgctgttcatttcgcacatatcggaatgaacaagttctagaggtaccaaagtcctcgcctcagatgccttgtgaggctagcgaggttgttttgattgaacacaagtatggcacttggaacttttgactaaagtgaattttggaattaaactcatgttagccaagcgcgtcatacaaccgaaattcacatgacaaagtcgcaaatgccacacattggactcatcattctcgctaatatggttcacaacattattattacacatgtcatccaaagaaaagcggaacaagcctccgctatcatagccttttccaataaaagttccatatttagatacgacacatttattggattcaaacacaagtctaaaaccatctctacacagtagagagccgctaactagattcttctttattgaagagacatgctgcacgttcttcagctgcacggtctttcccgaagtaaacttcagatcaaccataccaacaccatgaacagccgcaagctatccgtttcccatcaacaaagaggaacctctcccgacctgataagaagaaaatagggaaatattagcacacacatgaatattagcaccagtatcaacccaccaatcaagtgaatgaaaaacagagagaactgtaggtaaaaaattaccgtaccccaatgttcctccacccttgctaataaccatgttggcggacttcttgtccctacgatcaggacaattcttagcccaatgcctaggtttaccgcacacaaagcagttgcccttggcctttcccttgcctttcttcttaaaattggtagtagcctttgaaaaacagagagaactgtaggtaaaaaattaccgtaccccaatgttcatccaccctcgctaataaccatgttggcggacttcttgtccctgcgatcaggacaattcttagcccaatgcccaggtttaccacacacaaagcagttgcccttggcctttcccttgcctttcttcttaaaattggtagtagcctttggtttgacatcaggcttgactttcttgttgttgttgtgagatgcgtgagggttcttcttctacaccaaattggtgctggaacctccctcgatcttattgccccggttgtcctttgccctctccttctcctcaacacccaaagagccaatgagatcagtaacactgaacttttgccttttgtgttttagagaagtagcaaagtccaaccaagaaggtggcaatttggcaataatgccacccgccacaaacttgcccggcaactcgcagttgttgttctcaagttcctttgccagcatctgaatctcatgagcctgttgcactacagaatggtcatcgaccatcttgtagtcatagaactgctccatgacatacagctcgttgccggcgtcggaaactctgaacttggcctcaagtgcatcatacatgtccttccgtgaaggcatgtgaatgtacacgtccactatattatcagcgagtacactgatcaatgctccacggaacaggcaatccgaagcctcgaacttagcctccttctcagaagagagaggcggttcactctgtttgccccgtgaaacatagaagcattgcatcgctgtcaaccatagtagtgcacgtgctttccatctcttatagttcgaaccatcaaaagcatgatgtttcagtgttgcggcaaagccaactaccgaaaaggacctatcaggactttggagtgttggaaattaggtcataattcggtatattttaacccaaaataacaagataataaacatgatatttacaatgggatttgatccagtgatagtggtgaatgtaatcaacatgagcatgcttaacgtagaataagcatcaacaatcacataataacgcaatgttgacattgtgatgaacattaacagaaaaacttctaattgaaataatgtaagaaggttataccccaagaatggtcctctgttggagtttgaggcagtattgactccgttgatgttgacaggaacctccttctccttgtctccagtgttgccgttgtgtccagtgttcgacatgttggtgaagacgaagtagacattgacgaacagtgagtagtcgcgccttgcgctccccaaaaacctgatcgcccgcccatccgtgcaaacgtcgcagtagtgaagcatctaggcccccggtgttaattttggtaattaatgacaagcactaattgtggactaaccgttgtctttgagctatacattttaagttaggtccacgtcatatgcgcgcatggatgattatcgatggattaaaattgacggcgcaaagcaaagggaaagaagacggtaaaactagcgctttaatttagaattgatcgaggtgtagggcgatcaaatttgctagtttaattttagtttcgtcgtactattaagaggggtaatgacctagcaaagagatgattttaattgccacattaggtcattgcattttcatttgtgctctctttttcattacacaaattcactgggttcagcctgaccaggggcggtcagaccggccacatagtggcggtctgaccggcgtgccctagccggtcagatcggctacatagtggcggtctgaccggcggcactttcccggtcagaccggcctcctggaggccgagatgatgctgctcgggatggccgatacagagccgacggagccgtagtcggtcaaaccgagccaatggcggtctgactgagccgaggccggtctgaccggccaccccatgtcgatctgaccggccaggccgatggggccctctgacaggactacaacggctagttttctagccgttgc

SEQ ID NO: 46015 - DNA, 4283 bp, Oryza sativa
gcatttgcttccattgtagagctagtgtggcacttgatcatctccacaccgggtcattgcttgttactcttggaggtgccgcctcctagacggcttgtggaggagttgcccggtgacctctccgagaagattgtggaggaggcccggcgccggtttgtgagtggtttggagttcaccaccttcggagtgaaggaagaactaccctgagtgatcgaggcttgggtagtcctctccgtgggtcggctcccgccttgcccaccccttgacgaagggggcgtgcggtggcttcgtggttgagcggtgaagttgggctcgcctcaacggggagtaggaaaccggcgagtttccgaacctcggtgaaaaatctcttgtctcattgtctcatttgattgtcgcatttacatttgtgcaatttacttttctagagacacacttgagatcatatcaccctaggattgcaaaacatcgacataggagcgtgatttactttcctagagatatatttgagccactatcaccctaggtttgcaaaacataacttagttgcttagttagagttcaccctcaccaagcctagcaacttagattagatttgattaggtgttatttagttttaaatcgcctattcaccccccctctagtcgacatctcgatcctacaagtagcgcgtggtttcggaggcctactctcccaacgcgtgtgcacacactcgtcaggatgggattatcgtagcagcaacaaccttagaaaatggatgaaagtgtatctcacttctcacgcagaagatcaaatccattctctttttataggaggaatggaagatgaagagtaagagtcatggaataggaagaggaatagaataactaattctcatcaactagccatcaactatcctccactacacaaccatcaaccaaccatcaattaggagtaattgatgtaggttaccaatgtaataggaagagaaatggagcaactaattgtcatcaactagccatgaaccatcctccactacaccaccatcaaccatctatcaattaggagtaattgatataagttaccaattcactaatcaaatggattaattctcaaaactcttcatcccattgatatcctataagagaatgaatacatatgaattcatagcataatgagccttgaaatttatttgatttaattgatttaaatggatcaattacccaattaaatctaacagacacctccacatagggcttcggcgcatgctgcaggtcggccattcacggcagtcacgtcgtccctcctgaagctgcatgccagtgttccagatgaatgaacgatgctctatgcaaactagctaaattttcttggcaggcagttgatcgatcatttatgcatgatcgtttagggcaagttttacggtggaggtggatgtcacatactcacatctaatttagaccatgtcatcttctcattaattaagagcaagtataatagtgagctataaaagcttactataagcttatgtggaggagagaggtaacaaaaaaaatcaaaggtgttggctcttatgcaagagctagcttaacacaagctccaagacaaaaataataaatgtgtaagtgagagatacagataggagaagaaaattatagccaaccttatagctaatctattacttctatatgtgttagctttaagatgggctaatagtagatagtgatctctactattatccttgctctaagaggtaacacatacaacatatcacatataatacactaatcccaatattagttcactctcacattgaacgcgctgatgaagcctagaggggggtgaataggctgtccctgaaatcttaaaaacaaatcgcagcggtaaaattcaaacagacccggaacttcctggtaaggaactccggaacttccggcctgccaagcccggaacttccggtgttctaagacaggaacttccgagtaacaaaacagagatgaaattcaaattttgaaacaggagactaagccaatcttcacaaaatggtgcacaggtattctaagcagaggatatatcacagaatcattcacagaaacatcacagaaagagacaagagcgattttttcccgaagttcggatcttgcgatcctactctccgttgaggagctccaaagagctgggtctcgattaaccccttgcctcacttgtgcaaaaacccctgaggaaatccacagccttcaaccccaaacacccctaggcaaatttctagaattgagtgaccaccaagatccaactcaacctacttctataaatccactacaaatgtgggttgctctacttggaaagcctttagaatctcagcacaagaacttcactaacttacctcgtttcctttcggaggagaggaaatccttcacaaacttacccgggacatccacaatatgcaacggattctcgcgggcgacacctaaccgtctaggagatcatctctaagagtaataagcaccgagatgacagcccacgagatattccaagtgctcacccaagatcctagtcttcacacatctccaaatcttcttctctccctctcaatctctctttctcacaagaattaggctctagattcagtggagaaggcaagaaacacttgggaaaggctagcaatagctctaggtttgaaaagtgaaagtggaatagcccaggacgagctggaaacgagctgtatatgtataacggctaggtgacgtcatctagccgttactcacaaatttgaactggaaacttgacaggaagttccggacctagaagaccggaacttccagactacacttgggaaaatctttttcacaagaccggaacttccggacttggaagacaggaagttccagacttgcatttttggacagatggagtatttgcaaaaatgactcctagggaaacttgacacttggttcacactaagagcacttgatatatcttagagcatcacctggaacccctcttaatagtacggtttttcctaaaaactcgatttcaaaagataaactatcctatgcacttctcgagttccggtccgctttgattttgtactttttttttgggggtctccaagcttccatcttccacaccttggactaatgcacctgaaagtcactcaatgaactcattagtcctttaaccacatttgtcattaatcaccaatacccactaaggggattaatgcactttcacacattatcttgcatttttcttggagattgtgtagaggttgccccttgcatgaggggtggctcattttctctctcctacttctctcctccacctcatcatttaatcatatgtggcaaatttaggccattcccaacccaagacattagactagttactataaactccacatcatcaagaaactagtactagatactacccttccaatacaaacaccactattccatacttaaatttattgctacttatctcacatgatgtcttggatgttgtatagaaaccatatctcatgcaagacatggtttccttctctttcctaatttattcacttgccgcgtcatttttcatcctagggccgtgtttagttgcaaatttttttcttcaaacttccaactttttcatcatatcaaaacttttctacacacataaacttccaacttttccgtcacattgttccaatttcaatcaaacttccaattttggtgtgaactaaacacagcctaggtgtcaacttatttaatgctatggacaccatcctagtcattgggttgggaatggccttagagcaagtttaatagtatagccaactaccggcttcaaatcatctatagtcaatttaatagccgatttatacaatagtcacctataaacgtatactacacaattcatagttggtcccaccagtcatacgcacatgtatcttggagtctgcgctgcagctggctacaaatttgtagcccgctgtccttctctcttctattttatcttcctgaaatgtgtttatagctggcttatagtctgctattgtacctgctcttagagcaagtctaacagtacagcccactactagctccaattcatctatagtcaatctaatagccaattcatacaatagtttcttactatactattaatatacagtcccacctgtcatacacacagtgtgtcttggagtccgtgctgcagctggctacagatctgtagcctgctgctcttctctctcatcgtttatctcattaaaatatgtttatagctaagctggctaatagccagctattgtacctactcttaggggctaa

SEQ ID NO: 46016 - DNA, 2166 bp, Oryza sativa
actccaaaacgtaatgtgtgcatgataggtagaaccaggtattaatagtattgtaagcaactattgtatgaactggttattatattggctatagatgatttggagctagtagttagctctactaataaacttgctcttatagtacttgccctcattggtgcgcgggcaatgcattgcagaccgtgaacgctaacgcatcggcaaacacatggcacacaaggatcaagaaaactacatggttaccgggactcaagacatgtaccaccacgcaagggtgtgtttagttcacatcaaaattaaaagtttggttgaaattggaacgatgtgacgaaaaagttagaagtttgtgtgtgtagaaaagttttgatgtgatggaaaagttaaaagtttgaagaaatagtttggaactaaacacggcctaactaacatagttgtttaagatcagttgcacaagcaaactggcagatttgttcagaaattcagtttaggacttctgggtagggaggacagtaaagctctactagtactctatcgtcactcatgtgtgctagcatcatcgcgtggaatcatgcacccaagagatcccctcgtttgaggccatcagcaatgtccaaatcttaccaacggggctctcaacaaggctctgctaactcaaccaatcttatctatcttgctgcagctaaaattgatgcagcgtttcttgttgacacccagagccattaatttttcgtatgtactggcctaacggaagtgttatgtactggagagtttccttgtcagtgaacagatcatagattttttttagaaggatattttttacctagcctctacatccaaccggatatatacgtgttatgtactggagagtttccttgtcagtgaacatatcatagattttttttaaagaaggatattttttttacccggcctctacatccaatcggatatatacgaccattgaaataggtaacttagccccgaaaacaaactaatcagataacttagctctgcaaacaatctaatctgaaatttgcttctataaagatttgaactcagaaccttatcatactacgtaggtcactgtaactactagcctacgtaagcatgccggcagagtgtgtgggccaccgagtttccctctcggtatatttgtcgcacgtccacctcggcgaagcggcgcagcagttcgaggatctcctcgtgcgtcgccgccgggatcgtccctcggacagattgatcaagaagaacttgttctcatgaccaataacttcattaatgaatctgacggcaacatctcttcagggagcctgatttccccacatttgcaacagtggcagttcatagccaaccttccagtccattctccaggatcctcgcagcttgattagagaccaggacctgatgacaattgacaacgcaacctgccgcgtcttgtgttcagattccagatgcctctcaagcctatggaactgtaccgcatgttacaaacaaagcttcgatcgaactctgctcacatactagcttatcatgaatgagcttaattagtgactgtttcctaatctctaacctagcataagccttgaaaggcacaccatcacaagcgacagtagaagctcttttttagtctttctccaatccctcatttcatctgaaacacatattgtagccatctctaagcttgtgccctcttttatccttcagcacattggacaggtccaataatgaatatctgcagtatttatgcagtatttactgtttctgacaaacttctactactatgcatgatatgtgctccctccgtctagtgctgtgtttagttcctgaaattggaagaaatttagggaaagttggtagtttggaaagaaagttgggagtttatgtgtgtagaaaagttttggatgtaatgtgatgtgatggaaagttgggagttggggggaagtttggtgtgagttaaaccgggcctagaaatataggggacttttaagtactcgctccgggctgtgtgtttagttccacgttaaaattagaagtttgaagaaattgaaacgatgtgacggaaaagttggaagtttgtgtgtaggaaaattcgatgtgacggaaaagttggaagtttgaagaaaaaagttgaatctaaacagggccccggtccctaaatataaggaattt

SEQ ID NO: 46017 - DNA, 3779 bp, Oryza sativa
tggggtgtgacacatcctagaacaacaaatttagacaggctaggatgtgtcgcatcccaccaaaatcccttatatttagggatggagagaataaatataatggatttctcttctcgcaagacaagcaaggattgttagtcattcaaaaacaagtacccctccgtccaaaaataattcaatagctaagagttatctttttttttttttttgacagagtagtaatcaacagatacaaccatgactaaaaagatacagaaaacataccagtactactccacaccgtcagtatcagaaacgataaaaattatagagaacgccctagtacaatttggaactgattatgcacaaggtttgatcgtccgtcttatttaaaatttttttatgattagtatttttattattattagatgataaaacataaatagtaatttatgcgtgactaattttttaatgttttttcataaatttttaaataagacggacgatcaacattgttggatacggaaacccacaactacacttaaaacgggatggatatagtactaatttgtttattgtgcccaggatatcttttgaagctaaagatgtactactttctcttacttaatacatctccgtcctaaattagttgtctttctaccattcaaaatgtatttcataatacttgtcactctctcaagtactatttatcccatcaatcacatccagttcaaatttctgcgtattatactcctcaaccaaccttctatcctcaaccataaattatttttataagctcaaaaaggtgtagctcttgcaaagtagttactcctggtaatttctccattttacattcgccaaaggaatgctagctgaactcttatgccagtagcagtgcaagcccctcatttgagttatcttagatgccatgtaggataaatacacagaatccacttctctcacagtgcaaactactttcacgggatccccgagccaaccaccccaacatccccgagccaaccaccccaacccaaccaccgctactttcgcattctctctcccactttcctcggctgctcctcaccaagtgggccttgcaccaggcttgtgcaaagaaagcactcattactctagcgagaagcgaacaacaaaccaaagctatggccccacctactttttcctccacgtagacgaatccacacgccatgtccttgcactgtgcaaggccttaagccattcacactgtgcccaatccccatgccgtgacccaaggaaaaaggcaaaaatacacatgtgcaggctgtgcagtggaggaaccgggccatgacctccagagtgcgctcacgatgctctcgccccatgcactcattcaggattagactgaagaacaagtgaccaaagttggatacacgaacttcagatatgtgtgccagaagcaaacgtggcacataatatttgttgggggaacaatgaggccaaaatgctgaatgccacctcgacacaatgtaaacgcccttaatgaatgtagtgttgtctgttgtcaagtgacacaccggccttttgcattggcacatacttttaccaaaaacatctcataattcaacagaatatctatactattttaaaagagacctgcgaaaagtgagagaagattttacagatttactttccatacaaacaagacccagacaaaagaaaaatatcgaaatattcttattgtggaatttctcatcgctctatgatatattggacaataggaataacatattttagaggctttaaaataatatataataaatagttttttaaaaaacaaatccgttgcagtgtcacgggcattatgctggtatgcttaagaatttgaagtggtcactacacaaaccatccatttactggttatcttgcattaggtaagcctgaaagattagctgctgcagccagcagggtatccatatgcatttttgtataagggaggtggaaaaattcttaaaagatgcgatggaaaaagatacaacaatctactccctctgcttgaaaatgtaaggtatttaactattttagttttgtgctaagtcaaagttctcttactttgagtaggctcatagaagaacagtacaccaaataaatacacgagtaaattgcaccagcgattcttaaacttataagcatgttttttttacctagatccacaaacttgcaaagcatgcatcgagttacctaaacttggtttattgcatcatcccaatccaaagctttgtttgaccgtggtctaacttacgtggcaacgatcacatgacacagttttattatttttccttttccttttttttcttctatctcctttggcctctctccgacaagcggtgcaccagcacctatcttctccggatcacaaatcagataaaaaaatttcgaggaaaaatcatttaacgcttacaacaaaaacctcgtgctacatggagcctaatagatgctagttgcatgcaaggagatgcggaaagagaaaatgactctttttctcggacacgcaaaaagattgtacgctaatatattaggagagagaaaaggactcgtgcacatgcagagctagagccatcagttgaacgtctgactttgtgttgtgcgtcgaaccgtcgatcaaaggcattctcggaaatcttgtgcagattaaccagaatatattatttaaacccataaacagaatacgatctcagccgcacacacagtatctgtccagctctcgccgccgggggtaggggaggctcctctaactttacatgtgctctctacccatttggcatttcagatttattttgacactactctgcaatctgcatgtgcctatgtaacaatttaagcatggatcgatcaagtctatctaccactagttgtaaagaaacaggtttaatcgattcctctgcactttcccatcttattgacattcacaacaagcataaataacaagtgacaaccacggcaaattttcatgtttgttcctaaatcgaaaaatactaacttagttctttattcctgaatcgaccgttttgtagttaaagggagtagttgtattgcgcccccgcgttgtcctcccccacgggcgacatgggaggtggaaaccaccggcgtcgcccgctcctcccccctcctccctccgccgtctcgccgccgcccgagcggccgccggcaaagccgcgcggccgcaaggacggcggcggcggggcttcaccctcgtcttcgtctccctctcccgtcgcggtggggggccacgcacgggacggcgaagaccgcccaaatccgggctgccgcggccggatctggcgggcaggccgccggcagcgggtcggtgtgaggtggcggcagcagttggtggtggtggcggcggggattgaaggtgggggggtggtggcggcagttggtggcggctggcgccgggaaaggcgacaacggtggcaggggaggcggcgacggcgacagggatggcgtgcgtgctggtggtgtgctgcttctcttgctgggggcgtcggcgacggagttggagatggcggcggggatggaggtggcggcgaggctggcgacggaggtcggatctagcagtgatgctggcatcggcgaccggatccaggcgctggagatggttttgccccagtggcggtcacgacggcacgagagctcgacgacggcgttggggcggttgcgttgcggtgtcggcggtttgcgacgacgactgctggcgtcggtggctggtgacagcggcatcggcgacggccgccgacttgcagtggccgtgactgagcagacgg

SEQ ID NO: 46018 - DNA, 4808 bp, Oryza sativa
ccggcttggcgcgagaggcgcagccgatggagggaggccggattggcgcgagaggcgcgtccggtggacgaggccggcttggcgcgagaggcgcggccggcggtggaagaggcgacctcggtgcgtggtggagctgccggtgggtgtggcgcggtcttcggcgcacgaaggttggccggcgggggcattcgtgcagggccccacatgtcggcagagtttgagtggtggtggagcatcggtgcatcagccgtagattcgtaggtggtgagcggcgggtgaaaacccagcccagccttggccggaccgacaacgatgaattccccctcctgagggcgttgtcgtgctatctcaccccttaagggtgattaccgggcgaaagcccagtcttggctcctttgagccctgatggacggcggcggcggtcttccgtcgcttctcttcttgaagacgtcgttttggcacccccccccccttgctgtagggcgatctcgtctgtgttcctttgttggtctagcggcagccggtcacgcttagcggcggctggtccggtgctaaccttctcctggtcgtgtgtgttggcgctgccggtgtgtgggtggtggtatatttttttctttctcctggttatgaccctccagggttataatattgtaattttttcctgctctatcaatagaacttcgcatcgtctcatgcgagtcgttcaaaaaaaatcctgaatcgaccgatatatgtttctatggttattgattacaatttttttcatactggtaagtctattacaatatttaaaagttagattgctcgttgtttcactccaagaaaaaattgatatagagtcatcagacgctaaatcaagtgactgatatataagggtaaaaaacaatagctcaggtagtccattttcttttatatcgcttcgaccatccgatggcaccatatatttgatcatagcatccaggtgcacttcctttgaaaaggcattgtttgcaatccatctcttacaagaccaaaaatgaaaaccgtgctatgcccgtgcaacattcacgcgttgcattgcaccatcgggtgcagaggtagatggtaacatacgaatgtttgatgccttggtatgtgaccaaattttgctactgttgaaaccatggattgttccagatattttcacatgctccatacaaaaaaaaacttttacaagttattgtactaatgttacattcaatgttttcttttccttcaaacgaaaatctttacacagtatttgacttgggaacttcagaactcaagtactcaaccatctctgcatctcgattatgcacactagagacacagcttgttggcttgaaactcatctgcctcatgctagagcttgagcgtgtgagataccctcacaccattctcatgatgatacattaatccagagcaaagcctcactgcttgagttacagttgaactctgaatgactagagcagtacaaatctaataggagttggacacccaggtgcagaaaatattctacgaaaatgcattgacgcccaagcagatatcagctaacctttgtattcaaatgctaggagtttctaactagcagaaacctgagaatcagctcaaaaggctgcaccctaattgcagctatcaagtactcagccggtaacttctagtcctatgtgcgcagaatttcatggtcctctgcaaactcaatcctcaccatttcagggaggatgccagttccaggagagattccacttgacgtatggtccgcagcttctcttgatacttcaacttggtcgcaacagcttccgggtcattaccagttgggaccttattgttttcatgtgcagcttgaacttccttcaagagctcatcaacttccctgatgaaatcaactcttagaagaacatcatcatcctgaggtggcagcttgatctgtccttgatgctgacaaaagaaagaattcagaatttttttgtagcatgagagaaccaaagagagaaggagcaggaaatccagaattcaactatgaactgacaacgatattccatattatctttggactaactaaattaactatgagggatgtggcagtgtccatgcttgcttgaaggaaaatttcattgctgtcaatgttaacaactatgaagtatatggctaagattaggaggttatgtataataaaagacttggtaacacttatgttaagtggcacaactaattttgaatacaactaggggatgatatttttgtgtgaaatctgtaaagtcagcatctctgttttggaattgtgtcatgtaaattaaaattttgtaaatgtctcatgcataaattttcattctcaagtctcgaataactctaaatttctagcatggtcaatttatcccatgaggaaaaggcatgcatttaactaacatacttcctccatgttgaaaccagcaggaaagaccatggtgaacgggtcttctctgggaaaaacttcaagcatatgttttttacatttctttaaccacttgtcatcatcagatccatcatgaagattcagaaggtcattgagcaatctcatagcaggagttgcttcactccttaaaatttccgtctgcattcaggttatggtttctgattagcccatcagagaccaatgaagcggtcaaatgaacaggattgatataaatataagagcttaatggactcctccaacaatgataagataatggaggctgtgtgcggtgcacctgtgtgacttacctctacccttctgtataagagatcaaggcttctgatggcatccctctcatcctgcgggtgtataagtcaatatctaaacaataaatatggtatcccattctttcaaaaaaaataaatatggtatccctctagtcaaatatcttgattgtagatattagaacttataggcaaaggaacttctcccttctcaaatatacttttgctatgctgcctctagtcaaatatcttgattgtagatattagaacttataggcaaaggaatttctcccttctcaaatatacttttgctatgctgaaaatttatggaaagactagatatcaacaattgagcaacagaagtgataaaagtttaaatatcaatcaatgtttacaggttgtaatattgagtggcagtgtggaataagaaaaataaatgcatgggatctaggagttcttacaactcacaaggtgttttagttgtccaaatctgcaaggtgagtaaatggtatgttgtagtgttatacagcctaaattatttcctccttttttgggggcagggaatccaaaattcaattgttgttccatcaatacttcaacattcgtacttaatgagtttctttaccatgagtcgtacttacatgtttctcgaaagcattttctgcacattcaactatgattatcttacgcccaaaatgaaaaaaaaaaaaagcaaccacacttttgataacaaaagggtgaatactgactagtaccaccgtaaaacaagatgaaaactgcaagggcttgaaataaataaaaaaataaacaatacataagtcatcagataattcaaagagaagattagcatacatcgcggcgagcaacatcaagtcgattccatatgaccataagaacaagttcagtaagctctcctctttcagcagccttctcaatttcctgcttatgaaagtagagcagcaatgtattaagaaatgaaatatttcataagtggcttaataaaaaaaaaaaactgctgtttataggaaaactcaactctgatgaccctacctaataaaaaactctttcaagctattatgttaacagaactttgatgtgtgagcctggagttaaccttttagtagtcacatacaaatatttttgccaacaaagaaggtgccacagagagaaactacagacacagtacagtgtgggtgttcaactgtacacagatcattacatataataaagtttcaattaaagttccttaataggttttttatgtacctcacactatcagctgattagtctacagcatatgccgtcccaattcaaatgtttcagattgaaccttaactgacctggttggccgttggcctaggttgtgtacctttcttttcttccttcaatataaccagttaacagttctcccgcgataacctttaaaatatatctgtatgtcacttgtgtttttagccagcaagtttgggccctgattctacaaaggcttggcttctcttccaagttccaacttgccaaatcaagacacacataagtcctctagttggtgtcgaaggctgtgaaaggtatgcagaaggatgaggagaaagtatttaactcagctcattatcttggttgcttgagagatttggaaacataggaatgattgtgttttcaatggtgcaacacctagtatggtggcagttatccaaacagtggctaatgaaggagcactttgatgcttggctggagcctcaaagctccaagagttgttggctaggtcgatagtccttgtctcctagaatgcttggttgcgtccgtcctttttttttctgttttattgtaagacttgctgttggggtgggagagtttattctaattccccacctgttgttttttttttctcttgcttaatgaaatgatgcacagatctcctgtgtgctcgaaaaaagtatctgtatgtttaaagtacctccataaaagtttcaagatagtggtctatactatttaatttagtagttcatttagtgttggcccccttatattgtctcaagctctgcccccttgttgatatgacagcacatgctggtagcttaaggcatacacatgggaaaata

SEQ ID NO: 46019 - DNA, 2031 bp, Oryza sativa
tggtttataagcataacatgcatctactaaccatatgttagattctaaggtcgtagttttgtcatcttctgttcacgattcagcaaaaactgcactaccagtagcattgggaaaaaaggatgaaacatagaattgcagagtggagacttaataaggataggttacctcttcaatatcttcaccagctcttataaaacttgaaaccaaaatccgagctttgcgaacttcttcctgtgggtaagctttcaaacgcatgcctatttcacggtattcatttgttagcctttcttcctcagcttcctctttcttccgatatgcattccattccttagtcttttcccgctgacgagcttgccattcctgcatgaaaaatcctaggtaatctatgggtgcagaaaaatgtttgctgctaatataacaaggagaattaactgcactggtgtttaacgagaatgtagcttcatatggacataacagcttagctggcggcaagaaagctgtaggtatgcagacgttatttgccacaagagtaaaagtatgagtattgactctactgaagtagccttgatctagttaacggttgcagcacactggcgtagtgtcatttatgtaccattgtacctacatagtcacgcttgatcaggaaacatatgtggaaagccatcaacgttgaacagcacatatttgcctttttcttatgcatattgacgatagagacagagtcacctccttttttgtgctagtgatgaatttgattatcatagtgagcagagcaccagtccccaaaaaccaagtgccaaaaccctccctgtagtccttctatttgccaatgaagctaacagcggtaattgagggtataattagcccattatgaaatgaaatataaacagttgattgttgattgggtttgtaaacatttacaaacccaaacaaatttcccatgtggatgtgtggctacagataaaacaaacaggtttgctactattgaccacctagaaatgggaaggtcgttctaggttactgtacaactatttcctggtttcacaacatcctcgaatcaatacgcaaattaacgtgcctaacctcgtcgtagtactccggcggcatcccttccagctccacctccttggcttcggcggcggcgcccttgcccttctccacagctgcagtacgcgaaacaacacacgaaaaggttttcatcccaaccatacgagagggggcgctaccgaagagcgtacgagtagaagcactcgagccgagccgcacctgagatggcggggagcagcttgacggggcggagagcgccccggcgagaaggcagagggcggggccacgggatgcggcggggaggcgagctggatgaggggaggagaagcgaggcgaacgccggcagcgcgggcgccgcggcggccatggcgcgttgtcacggcctcacggggttttgtgggtatttttttttcggtgtagcggataaaccgcgaagggcgaagcagagagaattctatcgagcggagtaaacggacgcgcccgcagcccactgcacaagtgaacaccacaccaccaatctccactacaggcggagccaaaaatttaatcatgcgaggtcaactattagcttatatttaagttttaagtgagattatttctctaactttttaaatttatacataaaaatgaaggattttaagcgcgtttttcaaaaagttgtggggtcagctgacccatagattgtgcatggatccaccactgaccgtcaccacttcccctctcccttcaaaccctagggacaagaggctggccagtggcaaggcaaggaggctagccagcgtcggcaggtggcagggtgatgggcaagaaggctagggggggtgcctggcgacaaggctcaacgcagcgacgggacctggagacggcgtcgacgcaaaatgggagcgcagcgcacgcgtcggctccccttctacggtaaaaccctcatctctttctctcttttacatgactgttcgcgtcggccattcgcgccggggtgcagga

SEQ ID NO: 46020 - DNA, 6985 bp, Oryza sativa
cttcctcctctccaccttcaccctcctccccaacctcaccccccaaacttgctctaacccaagcttgtcacaatgttatctagacatgtttgtaggatacccatctcgcgtgcattcccgaagtagtttttttttagtttgctatattttaaaacagggtaattctatagtaataccaggcaacacaaatagctcgggcacagaactcttgttggtgcaacttctagttgcccacaggggcggatccaacgtgggtgcacgggggacttgagtcccccctaaactcataaaacccatggataccccccggagcacccctttaattttttcactataaatgataaactaaaggtccctagatggttggaagttaaagaataaagaaactgtgtaattgagtcccccaattttttttttttttgatccttatccgccccaggttgcccattttatttcgggattgcacaaatagcgtgttgggcatcggcgcctgaagctcaggcatccagtttcggacgccggactaacggactcatgctaatgaccctccaggcgatcaggtcaggcagcagcaaaaatcaggccaccaaccaaacaccaggggatataaaggagagctcaggtcaggctagctagccatcgacagcttaatagcgactccgtgacatatgctgacatgggagtacatagggcatccgacaaggcgagttatattacacacactatgcaggtcaaggaaatgcagagggcaaccagaacaccgtgacatgaatatatccaatgtttttattccttttcacagttcttttattattgcatctgtttgtttctttttcagtgtttctttgagatttcaaccaatcccgccttacaatacaaacatggcacaaccacttgtaatcggtgtatcttttcactggaagtatattatttgaacagtttccaccctatggcagcctgaagcaacaatgttgccattggggccaacagacttttgttcaccggacccctccatcggctggcaagcccagtgtgctcctgcaaccatggtagttcaaacacaaagcacgccctttggttagtcttccggtgaaaaaaaaatcagtaaatgaatgcttagtatttagggtaagattaacagacaagctagcaatgaactagcgatggttgaatccaaacccaaacttctgctatttttaaaaggatttaaaaatcaactgtgtatgataaagtttaactataataaacagttagtttcataattaaaagaaaaactagatgggattcatgttggatccagatctccgttcagaaattatgcacaagagtaccaccagttaatctgatttatctagagatgtgcccttctatgttccatgattccatctatacaaaaaaattgccaatcaatgcagtaccatgtattccttttctaaaaaatccagtactatgcaaatcctaatgtagcaacgatcttcaagtcaaatccaaccaacttaagactcagaaagtagaaatacaattgcataaccaaactgaacagctagcctgcacgttcttaactgaagcaggctgtcaacgtgagttgacatagcagaatgcattttgctgttgcaaaaattgtgtgtgtgatatgaggtcatcagaaagattacaagataatgaagtggaaggacttttaagaaaataaattttacaactcttttgctataagtagagttacgagaacccgacctcaaaaaatttggtaacaatcaatcaataaaggtaaataataacttagcgaaaacgtttttcgtgtacaacggtgctacgaggcaaagttatagatactacaaaaatactgcaagagcatgctactaacaagtctaagcagagagccagagatcacatatttacatgtcataattgccctataagctgtaccaggcaattttagtcttagatatatgctagagaacaaaattgaactggtagcacatacatgctactggtataatcgaaaagctactaccaataccaggacacttggtgtcctagagaaacagaattagtgacagtaaggatagagtagtagcattcattatgaacttcaaccatccagaagtgatactaatgtaaattggtgatccttttttaatccgattccagaaactacaaagctcaagctatcaacagtactctaaagtctaaaccaaggcggtttataaaaaaaattgtgcgtgaagcacaattaatctcagcagcagtgcagcatttttcaagtcatgccaaactgaaataaaacaacgatagacagtatcgcctcatcgcatcagtaccacaaacacagtacttccaaaccctccattgtcaaaattcatttcaagattttggttttctgattttcttagaaatggtataaacgtgctataaggtgtgtctataaacaaggtatgacacattagtgccttaagatatacataagtaattttggcctagcaagtgcttctcccaatgacggttaggggctagatgccggcatgttcccatgctggtgtttaatacccccaaaaggccaagtggactggtggctcatctcagagatcaagaatagcagatcaggagcaaggagctagctagcactactgagctggtagtggcccaatcagaagctagtgcatgagcttgcggcagcagtagagatagagcagggtagcagcagtgaatcaatttagtaccacctcggaaatttagatagggccaaacgaacttgtaaacctggcaggtatgaacagaacaatacagctttagtctttattctgtgaaattaggaaaaaagccaaaggaagtaattgcgcaggtgagctctaatccaaaattgggttaggcctgaaacggagtcaatcactcaaccctgtacttacagtggtgcaagagccaaccctcgcagttacaacagactctcgttgtggaccaagggctcgggcatatagtgcaaggcgcgtgtggtcccaaagtgggcacacggcatggcatgtatgtagggcactagagaaacaaatgtgtgctaagaaggggaaatcctagtcatttctcagaaataggtaagttagtttctcgaggacatacagcttgttgaggatggtagcatgtgatgccccgaatcaggaaggggctgctggcacatcagagatcaagcagagcagatccaggaacacggagctagctagctagcacttgtggcctgttagtggcccaatagggagctagtgcatgagcatgtaggtggtagcgatagagcagaacagcagttaatcaatttagtaccacctcgaaaatcttgataggccgaaccaacttataaacccagctggtctgaatgaaataactggtttaaacattttccacgaagcaacaactaaagcaaaagcaagttattgtgcagctgaggtctatccaaaaatggggttaggcttagggccgctagaccctggatgataatggtacctagcatcaagagaaacaatggtcccaaaaaaaatcatttacaccccagcgtacttgagaaaagtagcaatagaattcgaattatgtccacaaagacaagataaataagattaattaggtaacaatgtttgccaatatttgatcatgttaacaggatgctgcattcatttggttacattttttttccagcacagcaatttactcttgcagcctaattaattttccacaattattgagtcccaaactcatggccaaattttagcaacggtagggttcagcgcaaaccaaatagcccaaaataccatggagaccattgaatggagtattggcagaattcattggttttggagggaaaactagatgaaaaagttcacaccgacatactgatacagatgaatcaggtaaatcccctaatcacactccgaagatcacacagaactagatggccatactgcccatttacaaataaaaggacactaaagatatagatttaatgataatgtaacaagataacctcaaactgcaaacataatcttcatctaaacacattactaacttgtaccccccacgctgaggacagaaatgctcttgctatctgaagtgtattataacagatttgcattctagcatggaaattgtcggaactatcttgcaatggtgaaactgaactaatctgatggaagttgtacggaatggcatatggtcaacgggcactcacctcttgcttcggcgcttgctctttggaacaccccagccctccagcttagcaatgggacatccacaccggttgcggaagagcagtacagcccggccgtttggtggagccatccgccgtagctccgcgcggaggcactcgtaatccgggttgttcccaccctgcccgcccttccacggcagcgcctcgatctcgcgccacatggcggcgtcggcgccgccactggtgctccccgtgcctgcgcgcacggcctcctcggtctggagctggacatcgaactcgagcgccttcacgaggccccggcaccgcgggttgcggcagcggcggcgagggaggcggctgcaggagaggaaggtcgccccggcgagcgccgccgcggcgccgaggtagggcatcgcggccgccgcggaggcgagcgccgcggcggccgggggcgaggcgagcagcggggtcagcgagcgcgagacgtgcgcgagcgaggaggcgagcaggaacgcgaccgagaagagcacgagcagcaggatgaggagatcgagcgtcgccgacgacggcgtgtgcctgcacgccgacgacgacgacgacgacggcggcggcgggtagaccgacggcacgtggtgcccgccgcccgccgaccgggaggacgacgacgggtggggcatcgccgacgcggcggcgaagggggcggcggcgacggcgacggcggcggcggcggcggtgcggttggaggaggggaatggccggagcatgacgcggccggcgccggggggcggtggattaatcgggtggactcacttgggcggatgattaatcgggatccgattccttgcttgccttgtaaatggctttctcccttgcggcgagttggggttttggacgtttcggactttgcctttcccttttcatttttctaatcgagagattaatcctaatgatattgttttattaattaatggcttaatttggaacacacagtttgtgattgggtcgggtggtgttggtggtggatcagtagatcagtttcgtctggattggaacaatgtcttttgttattgatgaatcagatggggtgtgtgtgcgcaaattgacttgctcagggtgatttttttttgtttgttttgtttactcgagaagctcagtgtgttattttaattaaaaactatctaatttaaagtaaaaatattcttattagacgtcattttcttgatttcgaattagaatgtgctaaactgtggttgcaggtacagtgtctcgttggctacaattaacatacatgtaagagcatccgcaatggtaaagtaaagtgttatctataaaacatgtacatctcagcaatagactagattaatagtaaaccatttcaatggtatgtctacatgggtatttatagatctctaatccattgcctcgtttttctctatagactattttcaggttagtagatagatagttttgctctctctcttcatttaatctcttctaagtagaaaaatatgctgacatggatctcttgtagagagcctatagataaccattacaggtgccctaatagtttaagacgcgtgcttatgaaaaaggatggaatagttccacttctcattagaactcagcgagacgaaaagatgtctttgataaaattttcaaatgctctaaaacttttgctatttgttgtatccagacatcccaaagttttggatgcattttgacaaatcgtggtttcatctaaaaactctttcaggccaacgacaatactatttcgttccaccaactacagatgttgatccatcctcgcatcattttgatatcccacttaaatttaatcctttttttctaatgaattcagatttttgcgtgtttggacaaagagaggggagattagtgcctttgcttgaagctttttctaagatcaattcatgctggaagcaccatctgttcagaacttgttgtcgttgtcggcaaaatgacaaatggcataatttgaagcaccaaaaagaaaaaaaaagacgtagaccatatatattgtgtcccctttcacagcctcacagtacagtatccggttctagtttcaagggcaatgtcccgaaagatcatcaaacacttcttgggtatcacaacccttcctcctgaatatattgacaatgtaacctacaacaaactgtacaatcagttctactattcactaccgttgctaacggctttgactaggtccaaatcatctgacactgtaaacttgctttcatgtacagaacggcaacaaaatcttggtgtagccacccaaagaatcgacaaattgtcctcctagttttgaattctgttgagtacagttgggagcaattggttgcaaataaaatgcctgattgtcagcgaggtggtcttggaaaaaagttgttccccggaagaaacctaccaattatacgaatgaaattaagaggcatcctatggagtatggacatatgatccttagtaatatagattttcagctagagaccaaatgagacttactggtaagtcaaaccttgattcaacagcaagttcagtggaactgctccatccagttcattgttctgcaagaatctggatgaagagaaacattttaacagattgtcaaatggtgttctaacaaggtggtgaaacatcatgttggttatgaatccaataagcatatatggacattcaagatcatcttgttgacaatatcatattgcaccaaagaataaagcatgaaactgacataacatggtacaagcataaacctcgatgaaaccacacaaaatgggggcgcag

SEQ ID NO: 46021 - DNA, 1710 bp, Oryza sativa
  unsure (1)..(1710): unsure at all n locations
attaataacattaatttaatgaaaggttctgtattgcagaaggccattaaagggcaagcggcggctgatttcttagcatcacaccacacatatatatctagtaaatagaataattcccagtgtagttctaataattcccagtgtagttcactggatgagcaatggcagagctctttttaaacactccctcctttgcattgagtgtcaacttcactgttttcttcaaacgcacaagaaataacattatgttgaatacagtataattttaagacaattataaacatgctatgcagaagctgtatatcgttctttctctagactgtggtagatcctttttcatttctattaatggaaatggagggctcttgccctttgttaaaaaaaattgcagaagctgtatatactgtattcaaatgaaaaaaaatattgacacaatcaacatagtatgaaattataatgtcaaaccataaacgaaaagctatacaagtcaacttacagttcacgcaaagatgtgatttccccagtgtctgcggtactgttccatttaatttgttgtcctgcaggtgcctacagaaaagagttttttttcctaagtagtggataagtaagcattattcaaatagtttgggaattgactagctaaggaatagcttacagtcttgtgagattcctcaggttgctgagatttggaataggtccagacaagctattgtttgcaaaagatctgttcatggaaatagtgttaattttggcattcactcagtttgatatatatgcagcagaacttacatatcagtcagagcggtgagccttgcaatatcagatgaaagatatccagagaggcccatacttgaaaagttcctggtgtaaaccaatacagaaaattgttaccacaaaggggaaaagaataaaatcaaataatataagcaccatgaggataactcacagtgagatgacacgtggtatttggcctttatcacatgtaactccagtccaagcatatccatgaggcatacatggatctccattccaatcatcaggtatattttgaaggcttctcttaatagcttccagggcatgtgctgcagaaattgtggagtaattaatacgttaatctaataaaaatatgcatatgcagactattcaaaggtggtaatcaagtaaaagcaacttggtgcattaccaaaaaaatcagtcaatagttcaatacagatacttaaggaagcaccattgttgtggtggtggagtcatgggtgcatgaatccacccaccaaggttcaaattctggtgtccacaaatatggatgtatggatcctagttggtgcaaaggctggaaataatacttccattatctaaatataggtgatgctacaacattaacacctcacagagttacaaagtgaaatgtactgtggcccttttttttgcgagtcccatgacctgatatgcagcaacaaatttccataaaacatattttgatgacctgctgctacatatataatgatgatttgttggccacataagtgccaccaaaggcataatacataagttgattatttggttagcaacagcttgtattgnnnnnnnnnnnnnnnnnnnnnagtcatttagtttaacctattacgaaaaaagatacaaatggaagaaaaaatatatgtagcgactgacataccatcccgaggaaatgtgtatcctcctagtgggaaaagt

SEQ ID NO: 46022 - DNA, 715 bp, Oryza sativa
ttcctgcagccctgcgcgcatggatgattatcgatggattaaaattgacggcgcaaagcaaagggaaagaagacggtaaaactagcgctttaatttagaattgatcgaggtgtagggcgatcaaatttgctagtttaattttagtttcgtcgtactattaagaggggtaatgacctagcaaagagatgattttaattgccacattaggtcattgcattttcatttgtgctctctttttcattacacaaattcactgggttcagcctgaccaggggcggtcagaccggccacatagtggcggtctgaccggcggcactttcccggtcagaccggcctcctggaggccgagatgatgctgctcgggatggccgatacagagccgacggagccgtagtcggtcaaaccgagccaatggcggtctgactgagccgaggccggtctgaccggccaccccatgtcgatctgaccggccaggccgatggggccctctgacaggactacaacggctagttttctagccgttgcagagtagcacggtctgaccggccgcatacctccggtcagaccggcagagcacagagttgggggatttcgcccccaacggctagttttggtgggtgggagtataaatactcccccaccagcagcaagggggctctcttggcacccattcaattgcatacactccttgcacctctctcacactcacttgagc

SEQ ID NO: 46023 - DNA, 820 bp, Oryza sativa
ttcccctcaaaaactgggccaagtctcttcttctttaatgaaaacaggctctccctgtcctcttctaaggcttttcctcaaaaaaagaaaacttgagttctttatgactaagcaactaaatagtgtagttcacaagttttacttggcatacgtaccataaaatgaaattaaaggtatggtttttgcaaaatggcacacttgtgtcaattatcatttgaaccagaagaaatatcagatttttttaattctccttttgtacaaatacacgtttgttcattgcaaaacagggatccaattcacctgcggcacacaagaaccatttccagatgcttcaaaagaagaaaatgtgaaaaacaggaggaaatcttcttatggagaggcaactatttcacaacatttcactttctcttggatgaatggtcttcttgctaaaggtgccaataagcctttgaatgaggatgacataccagatgttggtgaggaggaaagtgcccaacacatctccagaatattcagtaatatcattgtgaaagggaattttcctctgacagtttcatcgatttgtaaagcagccttccttctcatttggaagaaggcggcactcaatgcaacctttggagtcctaagtgtagtcgcctcctttgtgggggcatacttaatcaaggacttcgtgggctatctaagtggagataatggatttgaaagaggctactctcttgttcttgtatttgtaggtgcgaaggctattgaaactcttgcttacagacaatggttctttggaagtctacaggtttatttgcgcctaagaacatctctgata

SEQ ID NO: 46024 - DNA, 2531 bp, Oryza sativa
tctagtcaattgtaactaaagcttaaagttttggataaaatagagcaggaatctaattcaagtaagcaaccagtaattacattatggaaaacagacagaaaacaacagttctggcctgtgcaatataaacctcaatgaactcgtcaggttttgattaaaaaattgagagcatgactacttgtaagaattaatatggattatggaaatcagcacaatctttcaagaagcctggttgttgcaatacttcactaatttattgcaaaatagtttccagaaccccggtgacaaaaatatctcatgccagaaaaagatataatatatcttcaagtggatccactatccaggagcatatgcttacctgaccactagttcctttaccagttttgaactccaaaagcattactctgtcgtatgaactaccattgcatgaaacccttgatctaatagaagcatcaataatccctttcaaaccatatcttggagcccaagccatctcctcaatatccattacctaaggtgaaattcatttcaataaagccattaagaatgaggtgtgcaagtcaacactaaagtactgaaggacatggggagagtgaaagttctgtgttggcctaattttgatggctgagaaatcacaagaactacaggagtttaccatgatgaaaagaacttggctagatattacatataaggtacataatatgaaaaggtcatattccaaagttttgcaagctaaagatgttgcatacctcaacaaatccaacaagttttttgtctttctatttgaccaaaattacaattgttacattttgatacctggatgtgccgacgatgattagcgcagaacatgtaacagtatcttctttaaacaagtaaaggacaagacatgcaatatatccaccggtgaactttgcaggcaagttagtccaggattgataaaggaaagactagatcaaaactttctcttaaaaaattatactccgtaatagaaatggcatcattagcaattaaaaacaaaatggctcaatcgagtgattaatcattgcctagaacctctgaaaagaaatagaagagtgccatatgggtataacaacaggttccaattcaacaaaaataagtggagtattcatgaccatggtgcaactctatggacttcgaaaattcttgtggtcatttaaagagccccaacagtgaatataaaaaactgctgtgcaagtcatctactccaccttcataaagcacttgtaccaattcaatattttggggactgcttcaatcagcgttttaagcgtggtgctttcactggctgcatagaaaaatgtcaaaaccagtaagatatgcacatggctggggatataagatagtttgtgtaatgttataaatatcaataaagaagctgagctacagtacagtactgaatcaaacatgacatataccaatatgacttgagtaaatgaggatgtatgagaacaaccacaatgtatgttgatatttcagaacaaacacaacagatttgcagaacttttggaatgacattccatgttccttgtgtaaacatataaaaataataggaaggatatagcacagaaaattggatcaaattagtcaaagcaacattcaaaaattaaatataaagtttcacaaaaaatttagtagcacatgataatttactgataactatagccttactgaatcggtgctctaagaatagagtaagaaaaacattattggtcagggcactcagtataacataataagtcatgaacagtccatgtcatagtgtcatacttttgtgtagtgtgttttttatggattaaaaatgttgtcacgaatcttacctccacatgcatataaactctcaatatttttcaaaagaacttctttggcttgctgctctaagaattgcgttgaaggaacatcttcaagtagccctgcctgaggcacaagaggaaagaaacaaagtgaggcacacacaactgttacatgaagataaagtgcatgatgtattaaccagagctgccaatttttcttgcaccaacgaacctggaatacttgatgcagcagagtaccaatcaaagcacttgttgaatattcattgctttttagtctgtcatcgagaacagaccttcttggacaatgaaaactagaagcaacctaaaataagctatatatcaaaatatgatgacaagataagatgaatgtatttttacaaacagttcttataaaataatatttgaggatatcatagcagcttgttcatattgatctgggatattgactacaaaggttataataaagagatggggggaggctaatactaacccgtgttccagatatgagtaattctggatgcactataacaagatttttgtcatgatcaataatacatattccatggtcagtgaattctccaatgacacttactgtgtcgcctgggctaataaggctatggaacctgtagtggtttgaaatatataggcaatagattgatgaaggttcatatgtatatagaaaataaaaatggaatcatg

SEQ ID NO: 46025 - DNA, 2908 bp, Oryza sativa
tcctgcagcccacccatggaggtaaagaaagcaaacctccaacaccaaaaagctatcgaagggcggggcatcaagggacttctgggagggtacattttgatcgctgtcagcaataggagaacaactaatgtttttcggatcaccatttatgagctgctctcctttattctcaccatcagcaggtaattcttcttccatgattgcatcttccacttgatctaaaagatcaagtagtgcctggtaaaaagaaatggcatagttttgtcgatcaattctttggcaacttagttcttacatgtaataatatcatgaaaccaatggcacccaggacatttagtgttatcttagttcacctttttgtgctcccctgcccccaactgctcaggtcctccatcagaaaccacacccccattaagctgctgcttcatgcacaaaaccattactccatcaacacgatttggaactacattagctagcattcacacaacaattcatcgtataactgtatgtacctcactgcacctataggacagtgatggaggagtccgaaatgggctttgggtgtcctccacaccgtcacagccacctggaccagttccacacatatccaaattgcgtgctgaagcagtacatcttgacatgcccagcagtgatgaatgccatttctttgtagactcgaccgaggaatgcttctagaatacaattacatatcgaatagcaaaccagaaagccacaaaaaacgattaatttcatcacacaagaaagtgttgtgtctccaccggctccaatgcacatacatacgtgcattgcacgccggtatatacctcgcaagaacataaagaaactccagtatatacctcattgtttaggccgggatgaaggcccataccagtctttgccctgaaagtgaccatgggcaggcgtcatcaccggcgagatcttcaagtcacaacctccccacccccatcgtcctggctctgcttaatcagctggaccgcaccaaacaagaaaccaccaaacctaagagtcgatccaaacgccaactaatgcattccaaatcggaccaagcgcaagaccaatacttaccatcccaggagaaaacctgacccgcttcggcgccagagtcttggtgacctccggcgacacctccgatggctcctcctcgatgagcggcggtggcggcggaggcggcggcggcgcgggaggctgcgaggggccgtcggccttctggcgcttggcgttctgggaggaggcctgtgactggcgctcgaagaagtggagaatgccgaacttggccggctgcgacggctgcgaggccggcagcttcttcgaaacttgccccggcgcccgccccgtccgcttccgtggagccatggctgtgttgaggactagggttttcttctttccggtcgctaggcggttcgatacggcggaggcggcggacggcggcggaatgggggatcgggttgggaagggaaggtggtgggaaggcgaggaagagaggagaggagccgagaaggggaaggggaatggccgaaagggaggggaattgggcggggttggaaattggagttcccgcgcggtagagatttcggcggggtagactgcgacgtgggcccgtgacggcccggtgaaaactaggcctgaaaggagaaagcattggtccagaagtgagatttggcccataaaatattgggccccccttacacggttctaaaagcccatgtacgacggcaaagtttctttcgttccctcatggaacttgtgcaaatctcatgaccattttttgcgttcctctgatcaagtggtgtacaagaaagtctcctgcgtacggcgcactcctcctgtgattcttcttcaactcatcaaccatcatccaggttctgattcgataatttgtcacctatttagattagagatctgatgatgattgactaccacgcgcatttgttcccatgtatcacctgatctaaaaattggtggtaaaaatcatcaaatttgccggcccgcccaagtacaaaaatggccaatcgttcaccggcgcacgaggattgacagccacgccaaaaagcgcggcgcgcgaggagtgacagcacgcggacccgacagccctgtcggggcgagagcctcccaactcgcgccacgacgagtcgtcgtcagtcagtcctcccccttcgacttcgaccaccagacgatggatcaacgctcgccaccttctccgagacaccgcgcgtccgtactcccatgtcgattccaggcgaaacaccaaagacgatcgtgtcgctcgtcgatcgccattgcccaagaacacacgcctcatcacctcatcgcctcgtcgtcgggtcctgcgcgagttttctctgccggtggttggggcgatcgatggaagagtaataaagaggatacatccaatcggtatggttcgtcttggtgaaagatggttcaggcaacccagcacgggaaaaaacgccgtaatttacttctcttctcgatcactccgtcacggccgccaccgcgaccactttttcccgtcgagaaaatgttgccaccttttgttggttcgccgtggtggctgacagggatccgggtgaagccgctgctgcacacgccgccgcgagcggaaaaggctccgggagaaccaaccccgagtggcacgtggggaggctgcctgccgcgcggtgaagcttcggtcacggactcgcggctcgttttcgcgctcgcgcgcctggtcaatgggttggcaagtggcaattgcgacgcacgcaggtttggatcttggctctggcctctggctgctgcgatcccagtccaagcgatgtctcgtgacggtcacgatggaggcgcacacacgcggccacgcgggcatctaaagtgctaaacccaccttatacaaagctgcattcgaaca

SEQ ID NO: 46026 - DNA, 7540 bp, Oryza sativa
actacgaaaaggtgaaaagcggcgcctctatatacagaggagagaccgcgtcgtcctcctcttccttccttccttcctccctcccctctgctgctgtgcttgataatggagaaggcaaagagaagagggcaatgaagtgcagcaggcacccgtacgagggcggggttggcgtgtgcgcgccgtgcctccgcgaccgcctgctcgcgctcgccgccgcgcagaacgaggcctcctcattgccgccgccgccggagccggtgccggttttcccgaggtcggtgtcgccgtacgtgtgccgccggaagtccgacgcctccggggcgaggaggcgcacgccgagcctcctctttttccggacgccgcaggtggggccggcctacggcggcggcggcggcggcggaggcggcgcaggtggattcgaggaaggggacatagaattcgagatccggcgccgcagcagcaagttctccgtgctcgccgcgctcttcggagcccatcggcaacacgggtcggaggaaaagcgcagtagcaaggagcggaagcaccgttcttggctcgcggcgatcatggcaccctggggcccccggaagaaggatccggccgtcgcgtcgccgccgcggcactcttgccacgtgatcagcaaccgcgggctctcgccggcgatgaggtacgccgacgaaggcggcgaggaggggagctcgccggcggagtcgccatggcgaccttcgccgatgcggaaaaccccctgccggcgcagaccgggaggcgcgactggggccggcggcgtctcgggcttcgccgtctgcatcagcccgctcgttcgtccaagcccggcgcggcaccacccgggggaggccacccgccggacgccgccgcttttccggcgagctggggccgtcaccgctccaccgcttctcttccggctcctcgctcccccactgccggtcatggaagctcgccgacggcggccgcttccggtgatcctatcctttattaatttttttcccgcgctccgacattatttatcccttttgggaggcttttcttttttcctttttacctttacgtgtaaactggaaaagaagaattcatcctggccaaccacgagctggcaagctgtcccactgacatgtaggcaccgacgtttgtcaaaggttactgtttgtcagttgaacatgttgcaagccactgtaaaaaaaaaagcttcttgcattatctatgtacaggattactcctagcttttaaattattttcaagatattatttctttcttgtgtttgagattcccaagccaatagatttagttgtgtgtctggcatggagggaatgaagccatgtgagcggaattgaatgtgagcgttatgaattgaagatctgaactctgagaactaagtactcctacttactccctccgtcccaaaaaaaaaaaacaaaccttgggttttcatatccaattttgactgttcgtcttatatgaaatttttttataattcgtatttttattgttgttagatgataaaatatgattaatattttatgcgtgacttatctttttaatttttttcataatttttttaaataagacggacggtcaaatgttgggtacggaaaccagagtttgtctttttttggacgaagggagtacttcagtagtgctgaactgctaatgtcaacttggagtaactctgtactcatgcatccatgaagtcatgaaccctccacgatctgatgtctgatgagtgggcactgtggatggatcgtggctgatggttgtagaatcgtaatcaactttatgataaggtcataaggataatttatccattttaccatctagtcagagaccttgtccccttttttctctttttctgaaggcagaggttgacatgatcaagaaattcaagatctcttcctgttgtttcttcattgcttttgccggtacactgcgcaccaagcgattgtttccattttcgtccgggaaactataattgtggtatggctcttccagtcgagcactgtttcaaccacacgacgacagttgccggattcagtacacagtccgttggcaacatttactagttcgttgacgttatcgcgttgcatgtaatgtacaggatgaggtactcgaacaggtatgaagttttggtcaacaaatccagcaaatcttcagactggtcctccaacagacgtaggttggctctcccgttctcccagctgcaggttttcgtaacttctgaaactgcatatcctccactgccaccttgatctgaaattctgaatctacatcggtgacagttcttttgatctcgtttgatggctgttgccatcacctctcagtctcaggctctcaccggcgcgccactaaggtcaaccggcttcatcattctcatcgatgcatttaaaaagtcaaactcgatacattaacggctgcagatttggcgaataaacttgctgatgaaaagctcgcaatcatggggcatgcttagctagaaaccaccatcgacatgggcagttgagttgggaggtgattgcctcgacagagattggccggggtttgttgcgtgcgagctcgctttctcatcatctcggatggactcccatcatggcaggtgctctcgctctggtcgagaaaggtcgctacctttccggttaatcagaggttagctccgctagtgcggtggtggtggccgtggccgtcgtcgttgtcgtcctgccaaaagcttgcgatttcaccgaatcgcggtgagctgtgatgcgcgcgcgcgggcgtgtgatgggtggatgcacgaacctctgctcgccttgtgatcgatcgtgcgctctgcctgccggttgctgcatctcttgagaaaaaagaagcagcatgatatcactatggaaaaggcgtattttttgttcgattttcgcagtaatcccagagcttttctacactccgctgggtattactatatgtttattaaggacaggagtatatgaaaagtggattttgattttttttagataatggaataaataaatatcccggcctttactcaaaagagctacagccaattattatatagaagccaattatatgaaaagtggattttgatgaggaacataaagctttaatgctgactgtctgacggccgttggtttgctagtacacattgcttcgctgtatgaactccgaagccacatgccattgtcaaccgggtcaagtacccgtattattggctttgggggagtgaacactaggttagtccagtacccgagttcttgttacagtattgatgaggccaacagaaaactcctactcgttgacggtatcgaatgaactaatgcccatccgagggagacgattgccagtgcagtactgatttgtttcggttagctgcaataactcttttcagtgaaagcttgacaagaaactgcataagttctgaatccttatattagattatgacaacaatttgcaagcagggacaagtgacaacagtggcttggttgctgcttcaattcagcacagcaagcaacaggatcaaccttcccaatcttgttctttttccgcgtcagaactcaaaagtctcagaataagcaacgaccagccgaagattttctaaaccacgccattttcagcacagcaagtggtattgggccaattaattaggcattctgaatccatctgcagtccatataagattatgcatgtgaccaaggagttgcgtgtcagcttcagttgaggcctttgtggatcaaaatcatcttgctctatagtctagaccaaacatttttcccttttcttcttggtaatttggaaccatgacattataattttgtaacgtttgagatatgtcatcggtatctcaatgacacgtagaacccacatgagtcaatggcatgtgggtcaggatggtatagctcaaatttttcaaaattataatggcatggttcaaattttcccttttcttttatgcctgtcacacacgtacaacagaggcctggctgagtggtaggtcgaattataccgttgaggtccttaatttctgactatacatttctcagttgaggccattaatttctgaccatacattcctgtcggattactttagttttgttgcatgaatttgacaaaacttcaacttacacgggaaaacttggagcgatcaataattggaaaattcctcgcgaaaaaagagagagaagagaaggtgtagcaatgatacgcttctttgctaggtcaaactgagcaaacaaatacttcatccgtcccgaaatataagaatctaaaaccgatgggacatagtattagaaaatatcctatccgattttaaattattatattttggtttatatcctatccagttttaagttattataatttaagacggagggagtataaagcaaaattgcaaacggagttgtcaatggcgtgacaagtggttggaccttctgtgaaacaacccagaatcagcccattacataattgggccgtggtgagacacacacaaacaggaccagtaaagtgtttgggccctagctgcacctttaccatggttggataaaggaaaaagtacaccgaaggtccctcaacttgtcaacgggatacaaaaccgtcctcgaaccgcaaaaccagatatataggatcccttaactatataaaactggtcacaataggtcccttggcggtttcgatcccggttttatcctacgtgtctaatgagtcagcgtgggacccacgtgcgccccacatgtcagcttgtccagtcagcctctatttctttcctctcttctctcccttccccttctctctctcgctcttctctctggtgactctgggtagcccggcgccgccggccgacaggtggggaggagatcgacggtgcgaggtgggagaggaggtccggcggccggcgacgtggcggcggagacgacgcgggagcaggggagcaaggcggcagcggcggcgagatgtccacggtgaggtactggaggcggagctccgtcggggcggggagcgggtccacggcggcggacggcaggcacgggattgcgtcgcggccccacgctggcgccagcaccggcgtcgcccgcctacgcgcgatctcctccaccgccgtcatgaactgcaacgcgccgagggccgagggccgatgcgccggcggcgacgccaccgatggctgtcgtcgggcggtccgggagaggcgacagaggaaggagagatcgaggatgacggcgccatttcggcgggcgtggcgcagcagtcggtgtgctaccacggcgacaagcagtggacagtgtcggtgtcgtgggggttcgcatggtgcatggcgcatgcatgcgataatggcgcagctgctcacacccgtaatagctcatccagtgataaggttgttaggattagtttcttatctccaaatttgttctatctccttatcacttgtaactgaacattgtaagccacggtagaggctgtttctaccactatttaacagagatgcggcccgaggcaaagggttcaacgcttcacattttatcacatggtatcagagccttttccacctcggtagattgcatctatcttccaccactcatgccgtcgtcgtcttcctcaggcgcggcagctgtaaacctcgctcagggccattccgttacagagaaactcggaaaggcaatcatgcactgtggaaagcgcaagttagcgctgcagtgcgcggagcccgtctccagggctacctcaccggcgctgtgaaagctctagacgccgagatttcagtcaccgtcgatgggaagactgtgacaaagccgaacccggcattcgaagattaggaagccaatgatcaacttgttcttggctatctcctgtcatctctttcgagggatgttctgattcaagtcgccatgtgcaagacggcggctgaagcttggtgagccatcgaggaactctactccagccgcacccgtgcaagatcggtgaataccaggctcgccctcaccaacacgaagaagggaacaatgaaggtcgctgaatacgttgccaagatgcgagctcttggtgatgagatggctgccgccggtcgtcctcttgatgaagaggatatggtgcagtacatcatctcagggttagatgaagacttcagcccgatcgtctctgctctctgcaccaagtccgatcccatcacggttggggagctgtactctcaactcctcaactttgaaactctccttgatctctaccgcaacaccggtcagggaggggctgctttcgtcgctaatcgcggcggcgggcgcggcaacaaaaacggcgcccacaacaacttcaacggcggcagcggcaggggagcgctgcgcggacgcggtggtggccaagcacgcggtggccaggggcgcggcacagggccctggatttttcatattttggtccttttaaaaaacttatttcgcaaatagacccctaaaaaaacttattctagaaatggtcctttttggggcgccagagtggctggcgccgtcatccaacgggacgacgccagcctctctggcgccgtcctcctgccaccatggcgcacgcgaaccgacgtggtaggaggagggcgccagctatgctggcgccgccccaaggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttactaaaaccctttgatcagcatgttaaacataatgcactctaccactatatgaaattacttaatctaattcaaaatataaccacatgaaatgacatatataagttaaacagtacatagagatgcaatttttttatttttatttcatttttttgatatttttttcacacttaggagaacataggaaccaaccgtataaaaaataaactcaaacggacaaaatatgtgacatgtagaattttccaaaactctatcgaaacggacaaaatatgtcatctattaaaataggcgtaactttctcatacggacttgaaatcaggaaaataatatatgcacggacatctacagaaaaagttacatccaattctccctagctttgccgggttcggtgatattaaatcccccaaattccgcttgcaagattgtgttttcgaggagagaagtttttcggtggagctttggaaaattccacatgccacatatttcgtccgtttgagtttattttttacatggttggttcctgtgagttcctaagggtgaaaaaaatatcaaaaaataaaataaaaataaaaaagttgcacatctctctcctctgcactagttcggagagaagagaggagaggaaaaattctacatgtcacatattacgtctatttgagttcaatttttctatggttggttcttgtgtgtccctaagcgtgaaaaaatat

SEQ ID NO: 46027 - DNA, 7843 bp, Oryza sativa
gatccccctagccacctcagcatcaccccgccacgtcggcagggggacggcgccaaagaggctggcgccgtcctgttgaacgacggcgccagccactctggcgcctcaaaaaggaccattttttggataagtttttctaggggtctacttgcgaaataagtttttcaaaaggaccaaaatgtgaaaaatccagggccaagacaggtgccccacctgccaggtctgcttcaagcgcgggcataccgcagcagactgctggtatcgcttcgacgaggactacgtcgcagatgaaaagcttgccgctgctgctactaactcatatggtatagatacaaattggtatattgatacaggtgctacagatcatattaccggtgagctagagaaacttaccaccaaggaaaagtacaacggcggcgagcagattcacacggctagcggagcaggtatggatattagtcacattggtcatactattgtgcatacccctagtcgtaacattcatctaaataatgttctttattttcctcaagctaagaaaaatcttatatctgctagtcagttagccgctgataattctgcttttcttgaacttcactcgaaattcttttccataaaggatctggtaacgaaggacattttgcttgaagggaaatgtaggcatggtctctacctgatccctaactcctttggctgatcaaccagcaaacaagcccttggcaccgtcaagctatccttgtccaggtggcatagccgtctaggacatccgtctcttcctattgttaagaaagttattagcaaaaataatctcccatgcttagttgagtcagtcgatcagtctgtgtgtaatgcttgccaagaagcaaagagtcatcagttaccttatgttagatctactagtgtgtctcaatttccccttgaacttgttttttctgatgtttggggccctgccccagagtctgttgggagaaataaatattatgtgagttttattgatgattttagtgctaaaatataagtctcaagtctttgagaagtttaaagaatttcaggttctagttgaacgaatgtttgatagaaagattattgccatgcagactgattgggggggagaatatcaaaaacttaattcctttttttgcaaaaataggaattgatcatcatgtgtcatgtcctcacactcgtcaactgaatgggtcagctgagagaaaacactggcatattgttgaagtgggtctctctcttttatcttatgcatcaatgcctcttaaattttgggatgaagcctttgttgcagccacttatctcatcaatcgtgtgcctagtagaatcatccaaaattctacacctctagaaaaattgttcaaacaaaaacctgactactcatccttgagagtgtttggttgtgcttgttggcctcatcttcgtccttacaatacacattgtggagattatgggtaccccatacccacacggcatggttatccgactagttataggggataacttatatgtatggaatatgtaacagattatgacttgggtattacgtttccttgtatattacggaacggcctaaagtcctggtttgataagattgtaaagtagagttaggaaaccgataccgtattggataatgtttctatcttgtaatcctgccccccattctatataaggtgggcaggaggccctctagagggcatgagacaacctgatcgtcagatcaatacacactcagcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggctgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgctgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacagctggcctattatgccgccgctgttgggcgtctacgacttcaccgccggcctgcctccgtcgccgccgagtggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgctgttcggtgtctacgacttcgccgaccggctggccttcgtcgccgccgactggtgtccccgcctatacggttggtcggtcacaccaccgttcatgggcgtccacgtcttcgccgaccggctggccttcgccgctgccgactggtgtttttgcctatacggttgacggacttcgccgctgttaatgggcttcatcatctacaccactggcttggttccactggcgccgactggcgtttttgtcaccattgatggactgcttcgttcccacatcggctacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgacgaactcatgtcactcatatgtcgccgccgactggtgtcctcgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgtttccgcctgcacggctggcctttatgccgccattgttgggcgtctacgtcttcaccgaccggcttgccttcgccgctaccgattggtgcttccgcctgcacggctgacttattatgctgccgttgttgggcgcctacgtcttcaccgaccggccgccgcatccgccgctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgctgccgactcgtgttcacttcatcacggcgatgcaactttgtcatcatggtggagcgacttcttctttattatcttcggcactggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgttttccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacatcttcatcgtcggtttgcttttgtcaccaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaagaacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgtcccgctgactttttaatatagtcatggtgctgtttgggttttaaagcaattgattggttacaatatcgttgctttttgccacgtaagtgtgcatttttattgaccaatattatggcttaggctgattatatattgtggtcatttttcaggcggttggtaaatcctttatgagtttatttactcggattttataccacatatgccgtatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttggttaactataattatcgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggccttggagtaatctggttcgagagaagattatcttttcgactgtgaaggtctcaggggctactgtggagattatgggtaccccatacccacacggcatggttatccgactagttataggggataacttatatgtatggaatatgtaacagattatgacttgggtattacgtttccttgtatattacggaacggcctaaagtcctggtttgataagattgtaaagtagagttaggaaaccgataccgtattggataaggtttctatcttgtaatcctgccccccattctatataaggtgggcaggaggccctctagagggcatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacacacataaactccaattccgttccaaacagtgcgtgttcctaggttttagtactcaccacaaaggatttaaatgtcttgatgtgtcatcaggccatgtctacatcttaagagatgttatctttgatgaaaatatatttcccttttctactcttcactcaaatgcaggagcaagacttaggtctgaaattcttctattgccttcctccatgacaaattataatacgactagtccagggggcacacatgtagttacaccagtggctaatattccattacctagtaataatttaattgtgtctgatgctgatgatgttgtttctggagaaaatggtacaacacatgagcaggaaatggagaataccatgcatggggacgtgcatggcaacatcgtgcatggggaggcggcactggaatcgacgctacaggacagcagcactgtgcctgaccaggacgctgacagcagtggcgcagcctctgctgcagcctctgccgggctgcaggaa

SEQ ID NO: 46028 - DNA, 14455 bp, Oryza sativa
  unsure (1)..(14455): unsure at all n locations
gagtggtattagaaaagaaaagatatatattgatcgaactgttaaatatggttgttttaattctacttgtcgaaactagatttcggcaataataaaagggggtggctatcaagctggagaagtgaatgggtttggagacaaaggatttatacaggttcaggccttcttattcaagaagtaataccctactcctgtccggggatgaatccgccgagtatcttattgattgtatgatttggagaaaatcaacacatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcgtgcatcatatgacaaaagcatacacggcgcctaaagaagcattcttagccgactgctttttagccataattaaaaggaatccgagtggttaacactctaaaaggttcacgaatgaacacacttgacaggcatccgaatagaaaactctaaagattacccaccaaatattataaaaattatggtaatgaataagtctaatagcctaggctatgactatttaccataatgaaaacaggcatataacataccaaggaaatgactatggtaaaaacaagtcattccaagttaacccagacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaagcccattcgcacctccgatacccttaacaagaaatcccgagatccaagcgacacttcatcttccccgccggaactctcgccattttccccactccctgctacagtacagagctacgccggcaaactagggttcaccattccactcgaatccaccttcgaaaagttcatcaaaatccttcccgtgatccaccgcctcaatccctcacctctccctagccatccctcgaatcaaatcagcgcattcggaaaaaatcaatggcggaagagaaggaaagctttgaaggccaatgggcgccatccgacgtgacggaggagaacctgaaggagatggtggcgcacggcgttctccctgccaaggaaatcatcgggtggcggccagcgtgcggtgaggcttttccgacccccgatatacacgaggctgtggtcttctcccatttcttctatggcggcttcgctcttccgacctcaaaatttttccgcgggatattaagcttctatggaatcagcttgcatcacctaaacccaaattccatagttcacatcgccaatttcgtccatgtttgtgaagccttcttgggaattaagccccacttcgctctgtttcgccgaatcttctttctcaagccccaaccaaacaagagtaagccatgtgtagtcggaggggccggatttcagctgagggggactctgagccagaagtacttctctatgcccttcaagacctcaaacaaagggtggcatgcaaactggttttatattcagaatcctgagcctgctcttcccgagtactcttgtcttcctccggtgtaccaagatgcctggaactctcttccgattggggatgaagcagcccaagccttggagctgatggatcgcatgctaaaactcaaagaacaaggcttacaaggagagcagattactcgacacttcatcaaatgccgattggcaccaattaaagaaagatcccgtacggcattcgagtttgacggcaagcatgatcctaatcgtgaagaaccagattctctggattttaaaatcatgaaggagagaatgtgtaaaatcttctcaaatgctattgtcgtcagctactcacatcagctgccagttgtgccatataacgcattcaatccgcctccgcaggtacgtatccgaaatcttcaacccatgaccaaaacataatcttgtcttcatgttgagttaactaaccgtggaggcatctcattcaggaatatgtattgatgaagtctgaccccccaatcactcagcgccggtctcctcgccagcacaccgttcagggaggtggagggccgacaatcagatcagatccgcaacctcaaacctccaatccgactgggcagacaggttctcgcaagagaaagctggtgcttaatgacgacaaaggcgacgacggcaacaaatctggggacaaaggctcgcccaataaactcccaaagcataccactcccaggaaaaaactggctagtcgtccaaggccaaagattagaacatcttccaggtataaaccttttggtaccatttcacttcgacatgcttctctcatggaaataatactgaatattgaaagaacactttgcaggaaaccatccgacatagatccaactggaaaagatcctgatccgactgtgacagaaccaagttcatccaaggattctgagccgactgccgaaagccagccgactggcgcccatacttcaggtgataaggccaatccgagtgaccagcctccgactggaaaccagtcggcagcaactgaaactacaacaacccaagagcccccgactggaaaccagtcggatgtaggtccagatcaagaaactcccgaagttgaagcgcagacaacaacttctcaaggaccagaggctggtaacgactcgatgattgggtctccagataaagaacaaggatcaccccacgctcagctaggaacatcctcaagtaactcatcttctcaagtgatgccgatttaaataacttcagcttattcgtctaatatcttggaaatacatcaggaccaccaggcgatgacgaagaagaaattcctcgcataaaggcagctgatgactctcgtcctcctatcttgctcaaatggtgggacgagaactcacaagctgccggcatcgtcataaatcgtcaaaaagaagatgaggaagtgtgccagttgaagaaggcacttggagaagccactcgcattgtgaatgtaaatcttccgggtgactgcctttgatgactttgttttctcttcagcaaaactaaaccatgaaccatcatgcagagaatccatcttcgcaatgaggccaagaccgcaactttagaaaagctggttcctcatttgggaactcttgaagcagttagggaccagctacacgaggccaaggagctcgccaaaaagacagagaaggaattaagggaccgaattgctcagctccaggattcaaacttcgagctgagtggttcatcaaaaggtaatctctagatctgtcccattaatttacgctgtcgtaactgtatcctcaaccatttggatttcaaacagcgcaagccgccaggatggctcaaatggagaaacaaattgaagccctggaaagagacaaggtagaactggctgcgcaaagggactcggccttgaaggaggttgaaggtactgccagctgacaatctgaacttctctctttttaatgcagtagatttttatcataaatgtgttttgtagaccgcaaaatcaaatctcaagctcaatttgacgtcctggttggtaagatcaagaggcttgaaggagcaagagatgaagtcgctaatgtcgctacaccactcgtccaagctatgttcctcaataacagtggtccgagtgcactcgacgcaaccgaaatcttcgacaagctgagagttgctccggatgtatatttcaagaatatcaagaaagctggaagtatgggagctagcacggcattggcgatgaccaaatccttgtacccgaggattgaaattgacgccattgatggctttgcagacgggacaagcgtagaggctgctcttgatcttatcagcaatgctcaaaatgcggctgacaagattgcaagtgacgtcgtagatcaattccgcaacaccgaccttcagccgagtagtaataactctgatgatgaaaggactgattctgactgagcataaatgtagcaaatggaggcataacttgtacaatactggtgtatttatgctgtgcttgataattctagccaagtctttgatttcttaaaagcttttatcaagctttgttgagcctaaaacccaaagaagctattaaaaactttcagtcctcgcagactaagtagaaaaatcaaacaaggcaatgatagaccaaggaagcaaattgaattgataaaaaatcacactccgttattatgatgatagcccccgactgacaacttcaagaagaaaacttgatgttgacagtcaagatagggaagtacagtgataagcttaagcgtagaaacgacgaagatgttcgatgttccaagagttgtcgacgagtgtaccgtcttcgcgcttgagtcgataggaacctggccgggtgactgcagagatgataaatggcccttcccatagaggagataacttgtgccgatctcgtgtagtttgaattttcctcaaaacgaggtcgccgactagaaaggcacgggatcgaacattgcgattataataacgtcgcaacccttgtaagtatcgagccgactgaatcaaagctgcttcgcggacttcttccagtcggtgcaagtcatccactcggtcctcctcgtagcgttcttcgcggaaattacgaaagcgcaaagactcgaattcaacttcactcggcaacattgcttctgccccatagacaaggaaaaaaggtgactggcctgtggtccgactgggtgtagtacgcaaagaccaaagtactgatggtagctgttccacccatttgccggcatagggttttagccggtcaaaaactcgcgctttaatcccttgaagtatcatgccattggctcactccacctgtccattgctcatgggatgtgccactgaggcatagcaaatcttaattccaaagtcttcacaaaagtctttaaaaactccgccagtgaattatctgtcattatcagtgatgatccgattgggcactccaaatctatgcacaatgttgatgaagaagtctcgagcgttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgagctggtagatgaatttgtctggcaaaaaactggcaaccttcgcacgtgcgcacaattttgtcggcgtcggacactgcagtaggccaaaaaaaaccctgccggtaagctttgccgacaatggtgcgtgcggcagcatggtttccgcatatcccagaatgtatgtctttcagcaattgtctcccttcctctaaagatacgcagcgttgcagaatccctgaagggcttttcttgtacaactcagcttcatgcataacataaagtttgcttcgtcttgaaatccgctcggcttcatctttgtcttgggggagttcttgagaagtcaagaatcgtatgaggggctctcgccagtcggctgaaaccatagctacgtcatgagtgcccgcaacttgagtagtatctttgtgaggtactgtcggcgtataaaggtgttcgacgaaaacatcggagggcgccacctcgcgcttggatccaaagttggcaagtctgtcggcggcttcattattgtgtcgaagaacgtgactgagctcgagtccatcgaacttgtcttccaatttgcgtacctcttgtcgatatgccatcatgttgtcgtcaaggcaggaccactctttcataacttggttgacgaccagctgtgaatcgcctcgaactattagacgctttatccctagggagatcgcaattcgcagtccatgaaggagcgcctcatactcggcgacgttgtgggacgccgaaaaatgtatccaaagcacatagcttaatctttctccagttggggaaattagaaccactcctgctccagtgcccgaaagtctttttgatccgtcaaaatgcatggtccagtgctccatcttctccgcgggggtatcctcctggcactcggtctattcggtgacaaaatcagctaacgcttgggacttgattgaaattcggggcttgaatgatatgtccaaagacatcaactccaaagcccacttagcaatccgtccgtttgctccgcggttatgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaagtaaatcggtcgctggactttctggacatggccttcttcctcacgctcaacgaccaagactgtgctcacaacctgggaggtggctgatacatacagcaacaacggctcctgcgggtgtggtgaggctaagaccggtggctcggtgaggagtttcttaaaatcttcgaaggccttctgtgcttcgggtccccattggaaatcatctgttttcttcagtagcttaaagaagggcatcccccgctcgccaagtctcgaaacaaatcggctgagcgccgccatgcatccagtcagcttctgaacatctttctgggtacttggcggtttcatgttgaggatagcagtaactttctccgggttggcttggatacccctgtgagacaccataaaaccaagcagcttccctgacggtactccgaaggtgcacttttcagggtttaatttcatcctgaaagcgcggatgctcgcgaaggtttcttctagatccgagattaaatcatccttttgtttggtcttgacgactacatcatccacataggcttcaacgttgcggccgatctgcgttgagaagcatctctggatcatacgttgataagttgctcctgcgttttttagtccgaacggcatggtgacatagcagtatgctccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttagggcaagacttgttgaggtcagtataatcaacacacatgcgccattgccccgttttcttccgaactagaaccgggtttgccagccagtcgggatgatggacttctttgatgaagcctgccgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggattagaaggatctaggggaatcttcttagtcttggcttcgctttctccactttttgaagtcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtctcaaaatcggtgacttcaaagctgatattctctgtgcggaagttttcccgagtgccaaaagtgaccgggagggtgatctggccgagtggagttgcggataatcctggaattactccgtgaaaaggcgcattgcttggttttagcttggagcgaggaatctgcatatcatccaaggtcttggcgaagaggatattgagtgcactgcctccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccgccgaagatatggttgagctccttgcggtggtcttgaaatcctaccggggtgtcgccgtcgtccttcttcctcgacgtgctttgttcttcgtcggagttcttccgtgtagtcttggtgtattgctccgcgaattgcttgtagacgaaacaatctttggccacgtggttggagttaggatggtgcgggcattgggagttcatgatcttgtcgaacgtgttgacgcgcgaacgctgtcgagaagagtgaatggcggttgcaacaagttcctcaggcttacgcttgcggtccttatgattgttacttccacctcctcccgtagccggcgtatccttttttggcttccaactgggacccgactgctttgatgcggtgacggcgtcttcggctttggcgtactcgttgactttttcaaacataagtttgactgtcctgggaggtttacgcccgaacttgccgaccaattcttcgtggcgaatccctttggtgaatgcggcgatgataacgtcgtcggtgatgtcggagatcttgttacgttgttcagaaaatcgccggatgtaatctcgaagggattctccggacttctgaacaacgttgtagaggtcgaattgtgtgccgggacgctcgaaggtgccttggaagttggcgatgaagtggtcgcgtaattcggcccaagatccaatcgtaccacggggcaatccatggagccaagatcgggcggaatccgctaaagccactggtaaatagttcgccatggccttgctatctcctcctgctgcgcggatcgcgagaccgtagacggtaagccacgattctgggttggtggtaccgtcgtacttctctattccagtcggcttgaagccggctggccaatccactcgacgcaggtcgtcggtgaaggctgctactccatcaaggtcgtcgtcgtggcggtccggcgaatgatgatggcctcgagctgctcggcgctgtatgattgtgtcgcgaagatcgacggggcggcgacgaggtggtgagcgaggccgttccactcggcgctccctatgatggtcgggaggcgaatgaacggaccgctcgtcgtgacccctgctcctgcgattggatcctgcgccagtgatgctgaggcttggatgacggtagtcatgagatcggaagtgggggagtcggctgccagtcggcgtgcggacgctttcggagttaactgggaccgaagccgcaatcatggtctttgtctggttcaagatgttgacgacgtgatcagattgattgagctcgttttccttgaggagggtgtcgaggagggtgatcgcggcaaccgcattctgttgaggggtgcggaaaaccggtgtcccttcaacatcttgttggccgttgaaatcacgcgctcggcgccctgcttccaaggctcgctgccgtcggtcctcagcctccttcgcggttcgctcacgctcctgctgctcacgccgtagccgttcttgttcttgtgcttgacgctcctcctccagtcggcgacgctcagtctcgcgacgtgcttcggtttcccgggcttggcgttgctcctccgtctcgttatcggccatgaagacgccgaagtagagaggggtgtagttgtcatctaggcttccgtcgaagtcgtcgagatccgggtcgttgtagcgagagctaaactcgtcgtactctacgatgtcggtgggacgcgagtcgacggtgggagagctgtagtagccatccagctgatccgtcgaaaccgtgccgagtggttggaggatgacgccgacttccctgaagctaggcgaaatcggtgttgaagccgacttccgcctaggcctacgggatggagacgctgtcgtgatggagacggccgccaaatcgtcggggagcttcatcaggatcggtgggtaagcctcatcatcttgatctggtgacattggagaagatgcgatctcgcccgagtggtttgaagccaactcgattgagatggtcttgaagtaactttcagccgcgtttgggagtccaaacgggactgaaatccggttctctcccgactggtctgactccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgcccccctacctggcgcgccaactgtcgaaactagatttcggcaataataaaagggggtggctatcaagctggagaagtgaatgggtttggagacaaaggatttatacaggttcaggccttcttattcaagaagtaataccctactcctgtccggggatgaatccgccgagtatcttattgattgtatgatttggagaaaatcaacacatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgagatatccataatctccacactactcgtgaaccacaaaatgatagagaggccacaaaataatagagaggctctaggagataaaaactggatagctgcaatgcaagctgagtatgatgctttgataaaaaataatacatggcacctagttccgtatgagaaaggacaaaatattattgggtgtaaatgggtatataagattaaaagaaaggcagatggaacacttgacagatacaaagctagacttgtagcaaagggctttaaacaaagatatggtattgactatgaggatacctttagttctgttgttaaagctgctactattagaatcatcctgtctattgctatttctagaggttggagtcttagacagctagatgttcaaaatgtctttcttcatggattcttacaagaagaagtctatatgcaacaacctcctggttttgagtcatcctctaaacctaattatgtatgtaaattggataaagcattgtatggtttaaaacaagcaacaagggcatggtattccaggctgagtaagaaacttgttgaacttggttttgaagcttcaaaggccgatacttcattattctttcttaacaaaggagggataattatgtttgtattggtttatgttgatgatataattgtagctagttctacagagaaggcaactacagcacttctgaaggatttaaacaaggagtttgcacttaaggatttgggtgacctgcattacttccttggaattgaggtaactaaagtttccaatggtattattttgactcaagagaagtatgctaatgatttattaaaaagagttaatatgtcaaactgcaagccagttagtactcctctctctgtcagtgaaaaattaactttatatgaaggatcacccttgggacctaatgatgcaacacaatatagaagtatagttggtgctttacaatacttgaccttgactagacctgacatagcttattcagtaaataaagtttgtcagtttcttcatgctcctactacccgtcattggacaggagtaaaaagaattctcagatacttgaatcagtgcacaagtctaggacttaatatacataagagtgcgtctactcttgttcatggatattctaatgcagactgggcaggtagtatagatgacagaaaatcaacaggaggatttgctatatttgtggggtctaatcttgtgtcctggagtgctaggaaacaatccactgtgtcaaggtcgagcactgaggcagaatataaggctgtggcgaatactacagctgagttaatgtgggtacaaaccttgttaagagaattgggaattgagtctcctaaagctgtcaagatttggtgataacttaggagccaaatatttatcagctaatcctgtgtttcatgcaaggacaaagcatatagaggttgattatcattttgtaagagaacgagtgtcacataagcttttagagattgattttgttccttcaggagatcaagttgctaatgggtttacaaagtcactgtcagttccttcaggaggggctgtgaaacaacctaactctatcctgtgcgtggtgcatggcgcatgcatgcgataatggcgcactactggagatgggaaggctcccgtgtgcatgcgaatattaccgggtgtttctctgaacacacggtaacttaccgtgagtagaacaataaactcgggaaccatcaagcgcttaccgtgtgttagagatgactcacgggaacaccggaatccacctactttccgtctgtgcgcgtcaaactctgttggcgcgagtagtatttttctctttggcgcgaacggatttcttttggcgcgcgcctagctccgtttggcgcggcccaatttttcgctggcgcgaaacagaaggggtgttcccgtgtttttttttcattcagcgcacgggaagtgagtgatggcccacatgtcgattggataaaaaaaagaaaaaggaaaacaaatcctaaccctaaaaccccaccggctcccacagcccacgccgccacagtcccaaacacctcgccactgctgcccttctccttctctccctcctcgcggcacctgcgcgccgccccttcctcgccgcacctgcgccgcccccttccctcgccgcacctgcgccgcccccttccctcgccgcacctgcacgccgccctcttctctccgcacctgcacgcaatctgcccaacatcaaggtatgtgattgtcgaatgttggctagcttgtatagtctcttgatgtttgatgaagaaataagaaaggagaaattaatccctttgttctctggatttatcaaataagaaatatagtctcttgattattgcttcagtaatctcatgttttgctttagatcgtagactaaaatgcttgtgtcctctagcagtctttttagctttaggattttaatgtgatggcatgctgttatttctgaagtaattctgacctaccaatacttgtgaagttgaagaagtattgcagttgtatactgttcctatttagccttgcaattctagattgttttggtgcctatggatgtcctgcctgatgttctattaaaggatgtgtttttggtgcctttcttcttgtaacaagagatgattgttatatcctgtcgggatggttatgtgcttgggtttcagttagatgtctacttttgggagtttggtggagggaaacatctgtagtcctgctgttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46029 - DNA, 758 bp, Oryza sativa
agcttctgaaggtactgcatatcccatgcttgaagtttgagtatcttcatgcttttaagaacttctgtcgttgacttcattctaccatctttagctgccatgatcttggcctgcaaccttttctgcattctggtcagtggaatattgcaagccattattgccagtgttgctgctaaaccagcccaggctccaacccctagattttgatggagaacatagacagcaagagaaagctgtatgggtaacatccaaatatagttggtgtaccatataacatcagttatcctttgtacatctacactcatgtagttaatgatctctccacttgtgtgtttctgccttgaactgcaggataggcggagtcccttttgatagatatgtgatatcaaagccgcccgcagccgcatcccgagctgtcgagccccgaaaatccattgtctctgagcaactgtttccacaactttggcactgagaaaagcaacagccagaaggtaacctcttttgagtccatactgcctctctccccctaggtacttcaccaagtcattgatcagggatggtccaacataggatgcacttgcacttaagactgcaaatcctgcattcattatagcttttcttctaataaataggaacattgctgtgtaaattgatttagtatttagaccatgcctgttctcaacatcatctatgatttttttgaatgaatcagaaaggaactcagcggagtccttcccatagacatttggcacatcatt

SEQ ID NO: 46030 - DNA, 29833 bp, Oryza sativa
  unsure (1)..(29833): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtattcaataaaaaagaagtggaatcaattgctacaaagttctgatacacatgacgaccttaacattctgtaagatggtttgaaatatattcaggtggggaacgcccccctccggcgacttggtcagaaaaaaacaattccgtaaatgtaatgccgaaacaatttctaccaaccatggcctaatttcctcatttttggtactcaattgccgattcctcatgattcttcccatcgcgctagcttctgctgcaggcagcacaatcttacccgctaccctaacccatccccacacctcctctccatgtcccgctgccgaggaaaaacctaccggtcgattcaactacgcttcctgtctacgaagtgttcgacgaatcgcaggcacgagaacaaaaggggagaggtgcagggaaggattgagctcacctcgctgcggacgatccatgaaggtctcgatatgagcacgctaggaggggcctcgtgaaatccggggagcgagctcgaaggagcctgccccgccggcgacgccacgccgttggggccggccgccggcgtcgaagccatcagcggctacaggttgcggtaggggcggtcgggcggatactggaaaggcacggtcgcacagagagaccgacctgttttcatcagttcaggctgcgttatccgcccacgattgggcctctttgggttctccttaactgggctaggctgggctgggctctattctaacgaaacaatgaataagttcactttaggtccctcagtttgctatcgagttcagagtccctagatcacaaaactggataaaacgcatccccaacttacaaaaccgtacaaacgaggtccctcggcagtatagcatctgattttaactgacgtggcatctacgtggcttatttgactaggtcttcgtcccacgtggcatttgatgtgccgtttacgtggcaattcgatccaaaaaaaataaagcctatagggcccacatgtcagttacacaccaattatttaaacatggtgagggccatgtaggccacatgtcagcctcattactccatttatctcactatcctctctctcctctgcatggggtcggagaggagcggccggcgcaaccctagccacagccgccgccgccaccgcgacggaggaagatggggcaaccacggggtcttccatggcgaaactggggaggtcacagcctcacggcatcagatcgaggggagctagggttttgggaggctaagaggaggagaaatgagctagagaggaaagaagccgctctaggttttctagttgggggaggagacgcgatggcatgggtgacgggtggggtggagcggctagccggccggtggagcagggcgggcgacggaacgaggcggcagcagagcagggggggtggagcggccgcggactgtgggcggagcaggccggcggagcgggcggcggaacagggtggcggcggagcagagggacgggcggagtggccgtggaccgcgagcagagcagaggggtggatgggcggagcagagggataggtggagcagcggcggagcagagggacgggcggagcggctgcggaccgcgggcagagcagagggatgggcgggcggagcggcgggacggagcagaggagataatggccgtgcctcctcctcctccggcggtgacgacggcggaggtggcgagctccacctcatcaagaagccgttcctttcccccctccgccaatgaggatgaagtgaggctgagacggagcctgctctaccgctatccccggaggaggcgctcgctcgcaccgttactgaagttcttccacctttctcccttctccccactggtcgcgtcgctgctgtgcacctctccatccgcccgtcgctgtcgagcccctacctgtggtgccctaccaacatcggcctccctgcctctggcctccccacccgtctcgctgacctccctgccttatccctctgcggctctgcacgctctcgccggtggagaagtggagaaaggagatagaggtagagaggattaggtggaggaggtgggacccactgacatgcatgtgaggcccactatttttattgactgacatataggtcccacatattttgttttaatttttaatgttgcttcgtttatttttttcaaatcaaactgccatgtcagcgccatggcaccgccacgcaggacgaggactaagttaaaccagccacgtaggcatcacatcagccaaaactgccatccaaactgccgagggacatcgtttgcaccggttttgtaagttggaggacgtattgtatctggtttttgagttgagggacgaaaatcgaatttggtgccaagttaagagaactctaatgaacttattccatgaattgatgattttttaaactatttataaaaaagttatataaaatattcaaaattttatatttctacaccactatatatggctgtgttcttaagttcaagttcccaaccttattctctcgtttaccgcgcgcatacttcccaaactgctaaacggtgtatgttttgcaaaaattttctatagaaaagttgctttaaaaaatcatattaatctatttttgaagttttttaggctaataattaattaatcacgtactaatccattgctccgttttccgtgtccaacccttacctaagaacagaaccttaatgtttttttatgacgtggcacacggccatgtggagggatgccagtcattttgcaggcaacccctgccaccctcctaaaagactataaaagggccgtcaatgtcattttacaaccggccccttagaggctacaactctctccagaggctacaactctctccagatgcttagaaatgtcctaggctgccattttataggtgagcccctttgcaggcgataaggtgactgcttgtaaaatggtgtcttcctccatgtgacattgtagatttgtgaagggcaacataggtgtagatttataaaactttaaaaagaatatgttttaaatattttaataaataaaattaaaaataaaaattcgaaaacaacaatacactctttagtggaattgaagggaattttaaaggaattgcaaggaactttggaatgtaggattttgaaaacataaagcatgaaaagcacaagattggaatatatcttgccttgcaaattcctaaagaattagatgcactcaaatgctccaaaataatcattcgggtggtacataggaataggaatgataaaataatagtggacacaataatagaacaccacgggataagaccttaattgtatttccacataaaattttaagcatcaaccctttgttctaaaggacttgataggaattttgccataagtattcaaatcctctaaaattcattcactttacttttttttccaaaagagcctaaaggttttgattcctaagaaaaatttcaccatgtaaccgtttagatcaaaggaaattaaaacaaatgaaagtttccctcaagttaaaaaaaaagaaataaaaagtttcctgttgtaaagaatcctgcatcctgatctgcaacatgtctatatttcttcttttttttttcagttctccgggtaaattgctcatgctatgcttagcacaaatcctatttctttcccaaacacaaaacattcctttttttgtccattcttctagaggcgctccgatcaaatcatccggattattttggggttgtttggttcggtctcaaactttgccaaaaattgacacacctcatgttagacacatttgaccaagttaactcatcgtttggtttatggtcacacttatggtaatattctctttcatttctcatggtcccacgtgtcatcaactaaaaaatgtgtgccacactctttttttctagctaaagtgtggcttacattttgttggccataactaagataaagtgtggcacacaagtatggtaaatgattgttgtatagcatgcaaacagcccctttattttgcaatatagtttgtttattttttttggtttgttaatattagctctttttctagagacatgtggggaccgatgtatatattgacatttgacacgtttctctagaggtgcatgatgtgttgtttgttcggttttttttttggaagccattggtttcatcggagaaacatgggtggaaggcgtgcgggtggtgcgaggagggcatagaaggaggatgatttcggttttacaatagtaggaatatagatagttcgatttttctggggcggttaatattggtatttttaagacgtgttgggatgcataccgtcattttaatgaaacgcagtatatattgatctatttttctcaggatgcaagatgtgctgtatgttttgcttttttggaagtcgctggctttttgggagaaacttgggggtgataggcgtgccgagtggtgggaggaggaattgcaagacaacaacttctttttatgttactaaagatattttccagttgtactcctttttttctactaagattttagtcttatattttgttttagtgtaccgcgatatatatttacactttttactgtgcatgatgtgtcgcgtgtttttttttaaagccgccgctttttcctaagaaacttgggtgttaggtgtggggcggtaggaggaggaatcgcaagatgataggtccgcttttatagtagcagacttgttttctagtcatactcctatattttttctcttttctactaattttttattcctatatgttgtttttcagcattcccagggtcctactgtacataaaacccctgcagcacaaggaagcctaggagagagagcagagagtagaggatgacattcccctcacaacatgagggaatgccaacatgagggaatgccatctcgaacccctgaagttgtagctggtcgagctagtagaggatgtcatcatgtcaatgtcctccctatgtcgggcaagatcatgctgccattgacagcagcgtccagtggcagtgtggcactaccatgcgatgcgccggtctttactgagaagttaggctgcctctcgtatagaaaaatgtcgtaagttttcaagcacatcgccattactgcaagtccagtaaaatgtaaaaaaaaagtctttagtacaattcaagggaatttcaaaggaattgcagggaactttggaatgtaggattttgaaaacatagaagcctgaaaagaatataattagaatatcttgccaagcaaattcctaaagaattagacacactcaaatgttccaaaataatagtttggatggtacataggaataggaaagataaaataatagtggacacaagaatagaacaccacgagaggaaaccttaattggatttccacataaacttttaagcatcaaccctttgttatgaatgacttgataggaattttactgtaagtattcaaatcctgtaaaaattcattcacttttcttttttttccccagaagtgcctagtggttatgattactaagaaaagcttcactatgtaaccgttttgatcaaaggaaattaaaacaaatgaaagtttccctcaagtcaaaaacgatattgaaagtttccctttccaaccatggcaaacgatcgttccctactttaaggattcatgcatcctgaacagcaagatgtctatatttcgtgttcttttcagttctcctggtaaattgctcatgctatgctcatatcaaattctattatttgccaaacacaaatcatccattttttggccagtttttctagaggagtactgatcaaatcgtctatattactttgccaaaagattgccacacctcatattaggcaagtttgaccaagttaactcattgtttggttcatggccacacttgtggtattccctttcatttctcatggtctcacacgtcattaactcaaaaatgtgtggcacactctttatttgctagctaaagtgtggcttacattttattggccataacttagctaaagtgtggcacaaaagtatgacaaatgattgttgtatagcatgcaaacaacccctttatttcgcaatatagattgcttaattttttgggtctgttaatgttggctcttcttctagagacgcatggggaccaatgtatatattgacacatttttctagaggtgcatgatgtgttgtgtgttcgattttttctagaagccattggtttctctggagaaatgtgggtggaaggcatgcgggtggtggaggatggcatagaaggaggatgattttacttttacagtagtagatatatagatatctcgatttttctaatattgatattttgtaagatgtgttgggatgcatacaatcattttaatgaaccatagtatatgttgacctgttttttccaagacgcaagatgtgttttttttttgagaaacttggggtgataggggtgtgccgcagtggggagaaggaattgctagatcttaaagatattttccagctgtactccaatatttttctgctaatatttttattcctatattttgtttcaatggaccatggtatatatttacacgtttttttttaaaaaaggtgcatgatgtgttgcgtgtttgggatttttttggaagccgtcattttttccggagaaacttgggtggtttcgcgatctttgtttccttgtgccgcgcgcgcggcgtgcccaggtggtccgcgttctttgaacctgatcaaggaggagttcgtgatgggcgaccacgcgcggctcatgtccttcttgtggttcgccatggagcttgccatgtcatcgccgcttttcgcgaagctctccgcgctcttctcctccgatgccgcgtgcctcgagggcctggagcgcgtccgtgggcgtggccacgagcggctccgtgtcgtggcgtataggctcggcggcttgcggtacagctgggcgccacggttccgcctcgccgtgctgctcctcctacgggacaagtttcccgagctggttggcgccatcgaggtggttgatcccaccgtggccccagtggagcgccgggccatggaggagctgggctgcattgtcaccacatctcctgcgctatgcctggtggtagaagaaccaactctgatctttatgccatacgcggaccgtgtcttctttgagaatttgctcatcttgaactggagcccggacaagctcgggaagatcgtcgtgctcgggcacagtttcagcaccatggtgaagatgcttgagctcagcatttcaaagcaagagaagtgtggtgtcaatgagcagagggagaaggtgaagagggtactggcaattccgagctatgttcaggaattagagctttgtgcagagatatctggcttattcgataaccctctcttgggagatgagtatccttatgaattgaaccagtacgactacaataattcaccagagcagtgtacatgcatgcactgcgttgcgcgtatggaaagcggtgctttgatttgtgctcttcccagcaccttttcaattcatttctttcacctcgatgctgaaatcgatatggaatatttgataccaggttcttttgcagctcatttccttttttttcaaagcttaagagtgtgtgtgtgtgtgtgggtgggtgggtctgcgcgcgcgcgccaatatggattgtggcattatggtcttctgacttgttgcctctttcttcgatgcaggtaattgcgctacaagggtcgggagcaatgtcaatgtccaaatgggctatgatgctcagttagaagggtaaggctacatactgccaaacgaatcatttggattagttttccatgcttatttgtttgcctagttctatgaattttaagctaaatgaaagtataatttggtttcaaaaataaaagaaaggatgatgcaaacaagatatgtttgctaaaagaaagggtttcttgtgtaaaaggggttctctgtttgagtgagatttgctttgtactattgctgcagtgcaggttattgttttgcttcggcgattaactcaaatttgtcctgaacagagaaataaaaacaacatatttttgtaaaacatgtttgttgttttactgcagtcattaactttaacaattggtttgttgcgatatgtcacatgtgaagcacatgccttaatttttgtggtatatttttgttgttcactattgatgacttcaaaactaactagctgggtggcccgcgcaattgcgcggctagcacccaaacaaaatcatatattttttatgatattacttaaaatttataaaatagatatctcattgtcttaagactttgaaagactaaaccttatcatcctcgtgtttctaattatatagttttttaaagtcacaccagttgctaccccttatgtcatcttcttctttatttgcttgctcgatctaccactatttctattcattcttcttggaacctttaaaaattggattttatagtttttagagtttattgtcacgttgtgtttcatttttataatttctagatgtcccgtcaaacgttgccattatactcctctacggcccgtccactgtctcttttctttattgtcattgagattttaaaaatcgaacataattatcttttgggttcatttttactttctagaagtcccgccaaaccgtcagcggctttgtcattgtactcctcggcggctcacccactggctcccttctttattgtcattgagattttaaaatcgaacatgattatcattgttttttttactttctagaagttccgaacctttaaaaattagacttgtagtttcattttttataatttttagaagtcccatcaaacgatgccactatgcccctctatagcccgtccgccgccgactctttattgtcattgtgattctaaaaatcgaacataactattgttggaattcatttttttattttctagaagtcccgtcaaccgttggcggctctgcaactatactgttatacaccccgcctactgcttttattgtcattgagattttaaaaatcgaatatgattatcaatgaggtttgtttttttttactttatagaagtcccggcaaccgccttactcatttgcttcacagcctgcctgacgtccctccctttaatcgtcatttaggattctatttggtgttttattaacaatttttgtatggcgtattaataccgttttgtgttcttttaatgcttttattttttattttcaatttcagttgttttaaaattgtattcctactttaactctctttttatttttctattttagatattattttattttttattctaaattttaattaatctcgtattgggttcttatatggatttttctttcaatattgtttatttttaattccaaatttcagctaattttaaattgtattcctacttgaactcttcttttattttcttttgctaatttcggatttatttatttttttctgatgtttaattaatctcgtattgggttcttatatggactcttcttttaatattccttatttttaattccgaatttcagctattcttaaattgtattcctacttggactctcatttccttttctaattttggattttattttatttttatttcgaattttgattaatctcgtattgggtccttatatggaaatttctttcaatattgcttatttttaattccgaatttcagctatttttaaattgtatttctacctggactctctttttcttttctaattttgaattttattttatttttatttttatttttgattaatatcgtattgggttcttatatggaaacttctttcaatattgcttatttttaattccgaatttcagcattttttaaattgtactcctacttggactcttcttttcttttttttctttttctccgattaatgtgggaatttctagcccccacagcgaacgtggtgccttcttttcgagctgtcttaataatataatagattcctttccaaatgaatcaattcaccatgtggcatttaaatcctagtgatgcatacattgaggacagacacttatatgaagctgaaagcatagttaaagaaatgcgtgaaactatttctgatgttaggaattctacgctatcacaaagtttgttgatcacatgaagaaagatcagagcatttgttctcacatctcaagcatgttgggagctcatgaatgcattcaattggttgtttatggcattgggagctttgaatttgatgtgaagtcccaatatcagattgcttttgctctactactaaaggaagacaatatattcccaattagtgatatcgaaatctatgatccatcactacctcctgctgatgtgaaagcatgcttcgacttggatctacgggtgctcttggttaatgaacaatgccaaagaagtgttgacaagccgataattttctttgttccaggactggcatttgttggaaacctcattgagtcaaatttctctcctgagcaattaaacaatattattctaatttcctatggggtcaagaatatcggggatagaatttctgccgaacttgaaaattggaacaatggatttaccagtttgaagggttccccagaattggaaagagagaggtttatttgggcaagcataaattatattaatgaagtcattgtgatggaaaattttaatgcccacttctggggagtctctgatatgagatttgagttccttgatgttgctgctgatgtggacatgaactcaaatttgccaagtatgtgtttttgcttccgaacatcttcgatttataccaatttacctcatttttttttgttttcattacttttgtttgatggtggagctgactttgcaaggccgactcttaaggaaaagtttttacttaacttcaaattggagctggaatataattctttctttgcttttgagtacgccttcttgagacttatgggcaatatcttgttacttagtagcattcattgtctagtgttgttacatgctgaatcatgtactgttattgtctctgtattttcagccatgtgtcttattttcgtatgtgcttggaagaaagaatgtcgcgtccatttcaagacgatcaagacgattgcaaggatggtaaacctcaagactgggcacatgaattcctgcaccgaatcccagcaatgcatcggaagacttggtctcctcctcccaaaggttggatcaagttcaatttccacggcattggtggttccaaagatcgttctgctggcatgggtggtgtatttcacaatgaggatggtgtgctctccttctttattggttcattaggtaacgtggatcaaaccgtggctagtattggagcaattgaacttgggctaaaggtcatgcttgagtaccatgaaccagttaaaaagctgatcgttgagggggacgatctcacggtgatacgttggttcaacagagtctctcacccgcctgcaagagcgcatgattcattcctacgtagttacttgcacttgacttcgatgccattgccatgtgagggggctgccgtgcctgctgagatatccaaagaccctgaccatgagaatggtagttcttcacatgatgcatcacctactaagccaccgaatgacggtaacatcgagaatggtaaagatagagaatcatagttctttacaatattctttatctgctattaagctatctgaagtctgtaacagtaggaatggttctttgcagatgcttcacctgctaagcaatttgaaagggagtacatagcttggcgggtcgatgaagaggctaatcaggtcgcaattggattggcacgtctaggcagtatgctacctgaccatcagaatcgggtaaaggtacacagctcaacccagtgtgactgtgaaatccaaagagaaatgaggaatggcaggctaccagacatcacagttggtgagaacctctccattttgccgatccattatgtagccacaagtccacaagtgctatttttgtgcattattaacgatcaccatatgctacaggtttgcctgttgaggagccaagctaataaggagtggagggccttgtcgtgtggaaccagcactctgatgctaaaacagttttgcctgtgtctggcattccaaatattctcaaatctgaatgtatgtttgaatggtccgatgaaaaatttaaattatgtgttctttggggaaatttttatgtgccttttgatagttcatttgcagattcaattgtagtttttggtatatcttttttttttaaaaaaaatctttctaccaggccagctgaagaattggctgaccaaattgtattaagagttgaagaatttacagtatgggaacattacaatatcgaaatgaaaatgtgaagacccagcgttcaggcgaaaaacctgaactccggaggagaaaatcagcccgtacggttatctcaaaacaactcggcctccttccaaacaacaatctcaaaatagcttcgaaaagttgcactaccgttcgtgatcattgatcgaaaatcgagcattgtgttcctttcacaccaaccagcctttatacaaagataatttgttctacgtatgcctctagctcgtccgaaaacacagtcttgtgctcagtcaccaacctgctagcttttaggctccagttcgctctcgcctggcagcagaaagcacacaattgtccatccttcgagcatcctccacactcgattggacggacacgctacaaacaggtgatggcactcttcctgcattgctcggcattcctgaaattagtgcgaaaaatgtaaacatatatagcggtcggaaacacatcgtttataaaaaatgattatcggtcgatctggaatttccatattttattagtttaactatttagtggcaaatgcagtatggtgctagaagaaattaaaaatagctaaatataatatgtggttaaaagtgaaaatgattagaaactatactatttttacataaacgatactcggtgagtcaagaatttcgctagcgtttttatccccaagtaggcgaaatgctgcagctgaagttgtaccatgtgccaacagtcagcatcatattatatccaagttaatgagggggtgtttgggaactagggtccctcttacaaaagtataagtccctatgatagggacttatgtttttgtgagagggactaaagtttagccccactttagtccctccaaccaaacaccacctgaatatctccaaaaataaaactcccataagaaaatcattactctcgctccaaccaaaaatatttaaatatttggtgcttggaacaaagttcgatccaacttttaaaattttgattatcaattttttttatagatatttagtttaaaaacaaaataaataatatacttggatttgcctaaaaaaatactaccataataccataaacttaatattaaaatgtactttttacggtaaagagatagctttattgataactgaacgaagggattagattcctgattcaaccaattcaaaatccgtgcaagcacacataatctcccctcctagcaagatcttgaattcgtcgtcgtttgattaagagtatgtactaccctcttagcttcttttcctattttgtgcacttgcactctttgaaagcattgcatcgcacctttcgtttcatggaccgtcgttgccccagccgatctcgagggattcttgttctcgagggattcttgttcgattaggacgcaacaacttcagcattgtcagttttcaagattagcggcgtatcatatgaatccatcccattgccacccgaagtcaaaatttacaaacacattctaatataaaattgatttttggaactataaaagcatgagcaaatctttatctaaacatcaaatatttaaaagggagcactacatttaagtatttaacggcaccctatctgtaacttggtgatggactaataagcacaaccataataataagggtatcaatcagatcataattttctttttcgttttatcttcaactaccgctcatctcatttaatgataaacaccaaagttatttccccccaactttattctctgctacacaaataaaaatgagatgagcgtggatcaaaggcagtactcgcttgccataatcgcgtgattcgagacatgctttcagcgttcagcctccaagcaaatcaaatctgtgtgattcatacacaaatcctttttcccttttcctttttgccgcaaggaagcaacaaaatatctctgacacactctgaaactgtgacagacttgacagtcaatggaactgaaaacgcaacccccgtgccaagaccattttcttcccacagtccactgcgcgagacgggagagacggccgcgacacaaaggaagcccaggagagacgcagacgcccgcccacaaagcccactttgcccatggcaacttccgcttcactgcctcctcctcctcctcctcgcagtagtagtaaccgcctcatcgcctcctcctcctcttcgctgcatactgcatactactgatcagctcttccgttctcgcggctccagatctctgcagggtgacgggggagatggcggagacggaagaacctggccaagatcgacgagtactccctcctgctccacatggtgagggttttaccttctcctctccaacttttttgatttgctgcggcttctttctcttcacgcggcggtcccgtggccaggcctgatcatggaggagttcgtgatgggcgaccacgcgcggctcttgtccttcctgcggctcgccacggagctcgccgtgacgtcgccgctcttcgcgaagctctccgcgtgcctctcctccgacgccgcgtgcctcgacggcctggcgcgcgtccgcggccgcggccgcggacgcgagcggctccgcgtcgtggcgtacaggctcggcggcatgcggtacagctgggcgccgcggttccgcctcgccttgctgctcctcctgcgggactagttccccgagctggtcggcgccgtcgaggtggtggatcccaccgtggccccggtggagcgccgggccatggaggagctgggctgcgttgtcaccgcgtcgcctgcgctctgccttgtggtcgaacagccaactctgatcttcatgccctacgcggatcgcgtcttctttgagaatttgctcaccttgaactggaccccagatcagctcggcaagatcgtcgttctcgggcacagtttcagtgccatggtgaagatgcttgagctcagcatttcgaagcaagagaagtgtggtgtcactgagcagagggagaaggtgaggagggtactggcaattcagagctatgttcaggaattagagctttgtgctgagatatctggtttgttcgataaccctctcttgggagatgagtatcctgatgaattgaaccggtctgtctacaatcattcatcagagaagtgtatatgcatgcactgcattgcgcatattgagagggctgccatgatttatgctcttcccagcatcttttcagttcatttctttcagtttgatcctgaagttgatattgaacacttgataccaggttcttttgcagcccatttccctttttgtaaaagcttaacgtggtgcctacatggactatgttgtctgatgacttgttgctgctttgtttgatgcagataattgtgctacaaaggtctggagttatgtcaatgtccaaatgaattgtgatgctcagttagaagggtaagactgcatactgacaaaacaattaatttggaccagtttcccatgattatttgcttgctgaattctgtgaattttaagtaaacaaaatgatgctttggtttaaagaaatatttaatgaaggataactcaagcaaagatgattacaccattttaggcagctttcttgcgtgtaccctaaaaaaagggtttcttatgtaaaatgggctattttaccgtttaagtgagatttgcattaattatagtattgctacaatgcatgttcttcttttacttcagtgattatagtattggcagattgctgcagcctgcagcacctgtttgttgttttatcaatcatcgactatgtttctaggccatctgttttatgatttttcacgtgcgctaataattttgtgggatgtattttgtcgttcgctattgttgacttcacaaattaattccttttctaaatgaattaatcgaccaggtggcatttaaatcctagtgatgcatacattgaggacaagcacttacaggaagctaaaagcatagttaaagaaatgcatgaaactatttctgatgttaggagttctgcactgtacacaaagtttattgatcatgtgaagaaagatgagagcgtttcttctcacatttcaagcatgttgggagctcatgaatgcatccaattggttatttatggccttgggagctttgaatttgatgtgaagtctcaatatcagcttgccttcgctcttcttctaaaggcagataatatattcccaattggtgacattgaaatatatgatccagcactctctcctgctgatgtcaaagcatgcttcgacttgggtctatgagtgcttttggtgaatgagcaatgccaaagaagtgttaacaagcctacacttttctttgttccaggattgaaattcgttggaaatctcattgagtcaaatttcactgctaagcaattaaataagatcattctagtttcctatgggttcaagaatagtgggaaaagtatttctgctgcacttgaaaacaggagctgtggatttactggtatcaagggttccttagctttggaaagagacaggtttctttgggcaagtattaattatattgatgaagtaattgttttggaaaactttgatgaggaattctggggagtctctgaactgagggttgagtttcttgatgttgccgctgatgtggacatgaactcaaatgtgccaagtatgtgtgtttttcttctgaactcattttttttttcggtactcttgtttgatggtggagctaactttgcagggttgtctcttaaggaaaagtttttccttaactttgaattggaactggaatataattccttctttgcttttgagtaagacctcttgagacttaagggcaatatcttgctacttaacattcttcatttgattagtgtttgtacatgctgaatcaaaatttaggtcaataagactaattatgtaatgttcttgtgtttgtgttttcagtcgtgtcttatttccatatgcacctgaaagaaagaatgttgcgtccatttaaacaagatcaaggcgactgcaaggatgatgaacctcaattctggggacaggagttccagcaccgaatcccagcaatccatcggaatacttggtcccctccacccaagggttggatcaagctcaacttccatggcactggctgctccaaaaatcgttctgctggcatgggtggtgtattccacaatgatgaaggtgcactctcctacttcatcggttccttaggtaacgtggatcagactgtggctagtattcaagcacttgaacatgggctagaaatcatgcttgagcatcatgaaccagttaaaaagctgatcgttgagggggacgatctcacggtgatacgttggtgcaacaaaatctcttgcccacctgcaagagctcatgattcattcttacatagctactggtacatggatttgatgccgtgtgagggggctggtgtgcttgctgggtcatccaaagagactaacaatgagagtgatagttcttcacaagacgcatcacctgttaagccactcaatgactgtagcagtgagaatgataaagatgagtatgacggttctttgcaggatgcatcacctagtgaaccaccgaatgacagtaactgcgagagtggtaaatatgagaacagtgactctctacaagatgcttcacccgctgagctatctgaagtctgttacaatggaaatggttctttacaggatgcttcgcctgctgagctatctgaagtcagtaacaatggaaatggttctttacaagatgcttcgtcttctgagctatctgaagtctgtaacaatggaaatggtcaggatgaggacggatgttcttcatcttctgagtttgtgatccctcctggatgggctcaaagggagtacatagcttggcgggtcgaagaggaggcaaatcagaccgcaattggtttggcgcgtctaggcactgcgctacctgaccatgggataatggtacacctctcaaccaagtgtgactgtgaacatggaagagaaatgaagaaaggcagaccagacatcacatggtgagaagctcttcatatagttgattcattctgtagccacaattgcttttcttttctgcagtattaacgatcaccatatgttacaggtttgatcattagagagggccgttgtttgaggagcaaagcttgggctaacagagagtggagagcctttctcatgtggaacctgtcgctgatgctgttagaatttcaatggttactctcattgagaagaggatggcactcgagatggggcaattttctggttttcttcatttactaaacacaaaagccatgtcctcccaaagaggattggatacatatttatagctgcttgtagcagccatgcagccatgcaagtctaagagggtgctgtcctagagcatcccaacaaactgtcctagagcagagcatcccaacaaactgtcctagagcagagcaacccaacaaactgtcctagagcatctcaacaaactgctgtcctaactgtcctagagcatccaaactgaaagtagagatgctgtcctagaaagttgaaaagcaggaaaaggcaccacaagaccaagaccaaccagccaagacttattcctacattctccccctaagtcttgtgcgccgtcttgtgggaaagttgagccatcccgatccgggagcaaagctcaaggaacttgatcctcccaaggggtttggtgagcaaatccgcaagctggtccttggtgttgatgtagctcgccttgatgctcccttcctccaggtagcttcggatgaaatggtacctcacccggatgtgcttgctccgttcgtgaaaaacggggttctttgccagggccagagcggacttgctatccaccctgagctccaccgctccagtatctctgccaaggagatcactaagcagtcgagcaagccagagcgcctgggtcgaagcggcggatgccgccatgtactcggcctcgcagcgggacagggccaccacctgctgcttgattgactgccagctaacgaggcactcgccgaggaagaagagaatcccgctcgtgctcttgctggtgtcaatgtcgccggcgtggtcgctgtcgctgtacccgacgaagtgtgccttgtcaggacacctcgggtagtagagaccgtggtcgagagtccccgcaacgtagcggatgatcctcttcacagcctgctggtgctccgtcgtcggtcgctgcatgaaccgactgacgtagctgacggagaaggccaagtccggccgtgtgtgggtgaggtagcgaaggctccccacaagacgccggtactgtgtagcatccacttcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccgggaatcacaaatcccggcggctggtgcacgtagacctcctccttcaagtcgccgtttaggaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaaccccaccgggctgcgctcaacacgagctggcgtcggagtagacgtgcccggaggagtggctgttgatgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctcccttgaagtggacgtactcgatggtgaagtcgtcgtacgtcggagtcgaaccatcatccaccgccttgtcccatacccaccctcgcccttcgtcgaacacaacatcgcgcgcaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcggcgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgcagcagcctgcgcatgcctgatggcgtccgcagcctctcccttgatgccgaggaccatcacccacatgtagcgggagaggtcgtcgacgagcagcaggaagtaacgtcgtcctcctggtgtggccggtgtcactgggccacacaagtccccgtgcacgagctgagccgctccttggctcggaagctcgtctgctggggaaaggggagccgccgctgcttcgtcaccacgcagacgtcgcagagctgctccatgtggtcgaggcacggcatgcctcgcaccatctccttggcactgagctgcctcagggcctcgaagtggaggtgcccgaagcgctcgtgccactgccacgcctcgtcgtcccgacgagcggcgaggcaaactggttgtgcgacctgcgcgctgaggatgtagagtcgattagtgcctctggttaccttggcaagaaggcgacggcggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggagcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggttcatcaaggtggaggaaagccgctgcggccggtgccgctggaggtagctcgatgcttgcgtgagctaggagcagagccggctcttcctcctccacccatgcgacgtgggcctggccgcgtcgtggctgtcgacagtctttggcctaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtaagatggagcttcccgccgatggtgatgggccccgagagaggctgtggctcatcaccatcaacgaccttgaggcgacctaacgcctcctcgatcgacatcgtggagaggtccagcagagattcgatcgagcgagcgatctgtctgtacttctcagggacgcagcggaagaacttctcgacagctctctcctcgtcgtaggtgtcgtcgccgtactgcaccatcttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcgggactgcagcgatgagggcatccagtgcccgccgatcctcgtcgtagtcgacgtcgccgtatcggactgcctcccacatgtgccgcacctggagcctcaccctcatcaccgcggcccactcgatgtagttggttttggtgagggtaggccacccaccgccgggaccaaagtccctgaccaccgtctggacgccgtggtgaccatggcgccggtcaggggagagagagccgtgccgcctgcgagggccgcgtgcgggctccgggctgccgccggcacgcccgcgcccgtctgggttcccgtcggcgggcgcgcggtcccttgggccgccgccgccgccgccgtggaggtgggctgctgcccaccgctctgctcgctcccgtgcccttcctcttgccagctcctcaagctccctgtcggcggtgatgtcaccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagtggtctgagccgttgctcgcctgcgctcttctgctgcggcgagctcggcgtcctgctgacgccgagtgctcaaggcgaccgaacgccgagaccgagcgtcggacatggcgcacctccggggggctgctgtgtggagagggggaagggaaaggggaaggaggagcaaccggtgctgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggagcaattttctggttttcttcatttactaaacacaaaagccatgtcctcccaaagaggattggatacatatttatagctgcttgtagcagccatgcagccatgcaagtctaagagggtgctgtcgtagagcatccaaactgaaagtagagatgctgtcctagaaaattgaaaagcaggaaaaggcaccacaagaccaagaccaaccagccaagacttattcctacagatgcaagaagtggtggcgcaatccttttgtaatattttgcagattatagtatgtctatgttagcatgttacctgccatggattcataacgatgagaaagaaccaatgatgctaatacaacagatccaggattgacatctgtttttttttagtcacctgtgcgtgagtatctccttgtgtatttgcagcttgtgtgacttgttaatataaacatgctacaacatcttggtttttttatttcagatgaacagtgggtttaaactttttactcctttgctagtagaaagtggctttgattctgcgcggactagctgcagcctgcaggttataaccctgacgtcacgctatgttgagctcccaatgggcctaacataacggcatagtgggccgttaacgggcctcgtacctgtacggccgaaacggatcggagtagcaaaccaaaggaaaaagtacacccagggtctctcaacttgtcattgggttacaaaatcatccttgagctgcaaaacccgatatacgatatacgacgtcctttaacttacaaaaccgttcactttagtgcatagacggttttgatcccgggctgagtcaacgtggaacccacgcgggccccatatgtcagtataccacgtcatcgccctctctccttcccctcctctccatttctctctcttctctgtcttctcgcaggccggccggcaggtacggaggaagccggtggggcgaagcgggagaggaagagagcgacggcggccggcgacgacgcgggagagtccacagccgccgtacagcgagggggcggggcggcgggagaaggcgaggtgggggcgaccgcgacgcagagaacgaggcgagctcggaggtgcggaaggaacgccagtagacggctcgggcaccggcgatgctcgcgaccagttgaatgggatggtgccgcagccagctgtgggcgccgcggtcgacggcggtgcgcactgctctccgtcagggtcgacggcgcagcgcggcattgggggcgccgtggccaacggcggtagcgcgcggctctccgtcggggccgatggcgcggagcggcatgggggccgccctcaggaatgacgccgccccggatccagcagtcggcggcggcaaatgtggcgagggacagcagcaagaagatggatgagatggggaagaaaagatggatgagatgggaaagagaaagagggacgacgccgccctggatccagccttctccgctcgccgccgcctcgctggcttcgcgcgccgccgctccgcctcatcgtcgccccacttcgcccgccgccgccgccgccgccccgctccatcccaccagctccgtgcgccggcgctccgctgctcggcttctcccatgggaagatgaagagggacggcgccgccctggatccagccttcttcgcccgccgccacctcgccggctgcgtgcgccgccgctccgcctcgccgtcgccccgctccatctcgccagctcagtgcgttgccgctccacttgctcagctgctcccatgggagagagccgatagacacacagaagagaaggaagggggaagaagaggctaacacgtggggcccacgtgggtcccaagctatgtcaggtgccaagtcagataaaaccagagtgaaaaccaccggggatgtgttgtatctggttttgtgtggttcaaggacgattttgtaactggatgccaagttgagggaccttcggtgtactttttccgaaaccaaaaccaaacctccaaattttctcaaaaaaaaaaaaagaaaaggaaaaagacaaacaacctccggggcttctgctctcgcccctcgccatgccaaacacggcggccctcgctggcgtgcgcggaacacgaacctgaggccctgagctctagcgcggcgccacgcgcgtctgcgtggtgtttcgcactcccatctccgaaatccgcagctgcgcacggccttgcgcgcggttgcaggccaccgcccgccgctaccaccctgcttgaccagatgcaagctccatcttcccagtgttcaaatccgtaagcactgctcaccaaatctcagtatcaagtctcaagcattcgttaaaatcagtgtgcattcgtagacccagaagtctgggattaccagtctgtgctggtcaggggacgcgaaacagctgttcgacggaatgcctcaaccagcaggatgttttcttatctgggaatcacaagctaaggtagtgccatttttctgtaaattaatcatttacgctgttttgctattcataggttttacatgcaacatttagaaaattttacttggactacgaagcaattccctgccccttgctgagttgctgtggcgcggatacttcaggtgtgtcgtggggaatatagccatgtagaatgtagtatgtcttcaggaaaattagtagctacccatcctgtgcattgccgttgaagacttgaagtgctgcgattgttgtgagtactctttggttagcttagagaatgtagagtcctctctctggagcagtttggtgggggtgtcgtattctaaaatactacctgcatagagatatcagatttaaagagtgacgtagctgtgcaacatgatattctgaggttgttttagtattgtagtggtatacctaccttcaccaagaacaagaataaggtcactatcaataacagtgttcatcctatgggcaattgcaagcactgtgcaatctttgaattcttgacgaattatctcttgaataatccggtctgtagcagagtcaactgaagcagttgcctcatcaaggactagtatcttgctcttcctcaggagaattctgcctaaacaaaatagttgtcgctgtcccatgctccagttgtccccattttcaattactgcgaatgaaatataaattcatagtagcataagtatttcagaaaaactacatattaacatgttcttttcctaaaggactcattgcagtttttttgtcttccttcaaaagtttaatgctgagcagtacctatttcatccagctttttctcagtcgagcgcaccacattgccaagctgacacttgtctactacctgacatgggtagttcattacttcagaatgaaaactactgttgatctaccctaaaattacttctagtttgtatgcttgcttttgaggtcttattcatttactggtggataggggtcgcaatctgtaccatcttcacttcatattgttgtcgtctattcacgcttacccattttttttgctttatatgatttgtgctatttatggaaccattgtctatacaaatagaaaagctttgtcatatattctagttaggatgtaacatgtaagttttctgcacttacctcccatatcctactatctgggtactcgttcatgggatcaagatttcctctgattgtaccatcgaacatcaccggatcctgtgggagaatacatattctcgatctcagatcatgaagtccaattttgcagatgtcgatgctgtcaatcttgatggtcccttctcttggctcaacaatccgaaaaagtacttgtactaaggttgacttcccactacctgtgcgtccaacaatacctactgttttctcagctggaatcacacaagttatgttttttaatactgaagggagatgttctgcatatctgacctgtatgattaaatgtgcaatatcattactgggccaactaaagggtgtacacctctgatacttagtatgaaataaaattattatgatcttctttctaatcatttagaaccatacctctaagttgcttatgcttatcatgccaaactctggccatgccattggtggcttgctaccctcggttatggttggggcttcacttggaagctttgtgtactgtaatattctttcaactgatatcatgtttgcttctgcacgacttatattccgggtggcttctgataattgtgtattcaaattccatgcatacatcactaccagcccaccaatgcctgttttgcagcaagagaacatcaacccttataccagaaaaaagatatttatccttcaagtttgaatgacggtagaacagcatgagtttacgttcaattaaattcatgggtccgaacaagtcaaaacttacttggattaacaaaaccttgtggaagacgcacaagcaaaaccaacgagaacccaaagacaaagttgcataacaaattcattctgaaagagagccattctactgcagccatcaagtgaaaccatggtcttgaatgattgtcaagtagactcagatttgatctgtagaaccggtcttcttggcgaaatgctcgaattattgcagctccatagaaagtttccccaaaatgatgaagaattggagccttttgaattcctgataggcgagctaattctgttgctgttagactgtaatatctctgcaggatattatgggagatatgattcattctcaataggcatattgtgtgtactgatactattttgaatctgactaagttacagttaactcttacctgatacctgatgcaaatcaatattgatggaataaaaataatgagaactggccaggaaacatatgatatgattagtattgttcctagaaactgcatcactgaaaatgtgctctcacttaatgttgacgctgtctccaaatctagcacactttgatcaatcgaagcctacatgaacaatgcaaaaatcatgtattagcaactcaggtaaagcgacatacacattacactttcctgtgtaatgcagtatatgtttacttattttacatagaatttctttaggatttattttacatagtttacacttctgagacaggagaatggactgaccctgtttaagattcgccctgtaggtgtcgagtcaaagaaagacataggagcatgaaagatgcaatgcatcatgctcttgaacaatttttctgatgtgaggaggccggttacagctacaagaactgctcgaatcaagatacacaaggcgctgccaactgatataaatacatataccatgaactgggtggattccatttttgatttgcttccagttcgtggatggcaagctgatgccatccaatagttgcttcccacttcaaatatctgaaagaagcattgtgctgcaattatcataggaatgaaaagaccacctcgagcagctgtgaggtatgaccaatacacttgcttgctaatgtatccattctctctttcttcaccctgcagcaatttcccttcttcagtgttatctctaaatacttcttgtctgcaatttatcatatttgtgttttgccatttgctgctgatttccttttctgcatcggactcattgatgcttggtaccttttctgattctgcatgatgctttgacaaatatatgcttgtgccttttgcgttacaaacttgttcgacggcacaaaagtgagccccaaagataactccaaaagccatg

SEQ ID NO: 46031 - DNA, 1285 bp, Oryza sativa
attgtttgtcgtagagaacatgatgacttcttttaactatggaaaatttgaaaccatcaaagcattatatttttgtgaccctggtgttattttcttttgttgctcttaaggggaaaaggaccttgtatagatgcctcccagtttgagggtctacagcactgaaaggatcatcaaacaggtagacatcagcatccttgtaaactgctcttgctatttgaatccgttgcttttgtcccccactcatagtcgttccccgttctcctatatctgtcatatcaccatccgagaaaactccgatgtctttaaccaaggcacatgcttcaattgtccgctcatacctatcagtttcaaatgggctcccaaagagaatgttttctctaatagtcccagaaagtatccatgacgactgtggaacatatgctttggttccaaagaccttaaccgttccttgcacttttggcatctctccaagtacacatgacaacaggctagattttccactcccaacagctccacatactgccactttcatccctttgtgtatctttacatgtatatcttgaagtgttgggatttttgcatcagttttccaactgaatgctccctgatcaatctctgcagaaaattcattttcgtctattgctacttcctcaattgcatcagatcttatttcttcttcttggagatatgacactattctgtcagctgagatcttcccctgtgcaaaggcagtaagcaattctggtagactaaagataggctccttcagtatattcacagttgctagtgtggacaacactcttccagctgttagagggattcccatcagaatgcatgaagcaaatgtcatgattgatatgacagcgggtgctccccagaacataaatgctagtagtgcttttagtcttagaaattcccacaaccacaaatgttctcctttcctcaaatattccaatttcctaaggtattggatatcccaagcttgaagttttaagatcttcatgcttcttataacttcagatgtcatgtccattctgtcatcttttgctttcataattcctgcgtgcaatcttttctggattcttgtaaaaggaatattgcaaagcattattatggctgttgttgctattccagctaaagaacccagaccaagatttttccaaagaatataagttgctagtgtaatctgtataggcatcatgaagaccatgttcacataccatgcaacattaacaatcctctcgatgtcaacactcacatagttaattatctcccctgaggtatg

SEQ ID NO: 46032 - DNA, 10693 bp, Oryza sativa
gtttaagcctgaaatatgttatttttccatgttgcccatttctcaataatggaagctttattaaaactcagtcaaatacaacaagatgatacattctaattgagcccactcccgacctctgcaagaaatgcacacagccacaaaacatgacctatctagacccccattgccttcttcatgctcttaatttctgtaacatactgttcacctgtctggctatctgggatttttcaaggtgtacacctacggtcattttgatggaaggtgaaggggaattacctcaactgaacagaggatgctggttatacagaactactaacatcgtaagaacattctatgattctgatgcagacatacagtacagttttaatctaatcaaggaggacgccatatgtgggacaccgcagcgaagtgtaaggagtcctagaacatctaccttaggagttaagagaatctatgagattgtatgtataaacatcaggtttctgcaaatactcttatctaaattcctaatgcctgtattgcaaatacatactttcagttcgcattaaagtgtgatagtatgtatgcacctttgttctcaggtagcttggcaaaatggcaggtcagacggatcaagctgctcccaggtattgtgttctatatatcattttcttcttgtgataatgttgtattgaaatgctccatcaaggagcgcctttataattcctacgtgtaggttaatcttatgcagtattattgattctattgtgtcccaaaaaatactatctattcaacttgctggttctaccgtatctttgtggggacatagtgaaatggttgtgatctgctccggaaggtaggaattccttccaaagtatttataaatgactaggaataattatttgaaaaacttctatttcagtagaaagcacacgataaagcaagattccattcacatgagcatgacaaaaattagcatgaatcttacctgattgatttgcagtttctttgtacaccatgttgaagccgttggcttcagctactgtttcgactagaaattgtccttagctgctgaacagtaacattagtgtaaatcagcttacaacttagcacgggggactggcttgctagtagtttccattaggttatatacttaaatgtcgtacttggattagtacagtcattaagtgcttaagtgcgtgtaaagtatgcgccctctaatgctcgattacttggctaacttttctggctcgacgcgtgtaaagacagtatcgtatgattcggatccaaccttgaggctcagatcaatgacagatcggcaccggtgtaccaatctgaatctgtgttgtggggatgatcaaacgatcgagtataaatattccgttatctaatgtgatagctctgctttcattcgctacatgcaaccttttcttcataacaagtttttgtaaacttataaagctataacatatgtctacataaactagttcatggttaaaaaaatctacgctacagtggtatttacaactctgtttacatggtcactcacttcaggtcgacatgaaaaagatcgatttatcaagccggttaaaataattgcctaccatagtacttaaataactcaaactatcaaagttcaaagataatggtgtcttagttcgctcgcacgataggtaggccccaagttgatttgtgagaattgatagacatgtgtgcgcacctagagtagtggaatggcatggaagaatccggacacatacttgtttggtgccggaacaagttttagtttaggcaatttgtaaaaggttagtaaaaaaaaagttcatcgatccagtctacgaacgtggttgcatacaagtgtgataagcactggtggagaaaggggctttactcccggttttcaaaccgggactaccaatccgggactaaagatcactatctttagttccgggtgaaaaaaccgggagtaaaaatacatctgttaccaaccgggactaaagatagagctagcctagctagctagatccggttgctctattatttttttttcttcattatgtttttaatatattgattttactatatccccatcccaaaatcccaaataaattatccccaatcctcaaattcccaaatcggccatattcaaatagatcacaaaatcttaaaacaaaattacatcacaacttctacaaaattcatcataaatacatcacatattcacggacatcatacacaaatcaaatacacagatccgaatcacaaatgcttaaaaaattattgaattaaaacacaggctgtcgactgctgccgcgccggccgccggcgcgccacccgccacaaggccccgcggtccaccgccgcgccgctgcgccgccccctgctgcgaggcctccgccccgccgcgccgcccaaggctgcccgggcctccgccgccctccgcgaggccgccggcccccgatggatactgggaggtaaccagagcagttacaggccgcgttagagcggacgacgaacaatggcttattggggagggaaggagaggagttagaggagaggaggaggaggaagaggaagagatgggatgaagagataaggtcagtggaggaagaggtgaagagataaggctgcccgtctcctcctcctcgatctctcagatggcagatgcctcgtactctccgccacaatcttttgttccggttggtattaccaaccgtgactaaaaatagatctttagtctcggttagtaacaccaaccggaactaaagatagtaggcatcttttttcccggttagtgttaccaatcgggactaaaaatagatctttagtcccgattggtgttagattaaaaagcagctctaaacttttgaactgggactaaagataatatttaatcccggtttttattgcaaccgggactattgtggattttggctaaccgagcaaagatcgtttctccaccagtgaaagttactctcaaaactaattcaataacatgtggtgagcaatgtttgttatcataaagtgataaaccattgccgtgacaatgaccacactcgtgacggtaagcagggaaattctgtatggtggcttcccaaaataaatcaaacaattattccctctatactaaaacataaggatttctagaacagtgtttgtattgtttgtgatatttaaacacacattgtattgtttgcactcacaaatacactgtaaagtataaatttactagcttaaaaggtaataggattagtttcgtatggaacgcaccgtttgaaaaaagtgctaaagaaaccgaggtaaactctataccttaatgagagaagaacagtgcctaccatttgtaatttttatccatagttcttcgtatattttatattatgagacgttttgaattttttttaaaattaatcttctctgagttttattaaatttgtaaaaaaaaagcaacatctataatactaattggcttcattaaattcaatgttggatactttgtctgtttcatacgtaagtcattctaacatttcccacattcatatatatgtatatatatctagatttattaacatatatataaatatggaaaatgctaaaaagtcttacattatgaaatggagggagtatattttaataatatatttgttttatctttaaaatgttacttttttatataaatttagttaaaacgtcttaaaaaagagagggtagcaaactatacctggttaccatgcgggagtcatacggcctcatcttttcgtttatgcttatacttattagctaaattttgaattttcaacattaaatttggagttgaatttagggttttttcagcctttgcttttagatcactaagaatacgtatataaagtctttattcacatattattttccgtttgtaaatatgcagtttcgtttattccgcgaataagcgaaacgatggggccagtatactcgtatcattcgttgttaagggaactagctgttgttgcaccgtaacgccgtagcggccggctgctgcagaaaaccaagccccaactttttctgaatggcaaccacatctagcattactaccgagcgaagctgaatcaacaacaacaaaaaaacacacacacacacacagacaccactaccacatatacgcgcgtatcgtccttgtagaaatcagaatcggccgacatgatcgcgactttttcctgcgctgtatggtgtgtgagtgtgagccacattggctaataaaaaaaacgagatttgaaatgagaaatgtccctccaacattttttaaaaagaaattacgatttgaaggaagatgtttccctccaagtattttttaagagaaagttgtgaatgtgttaagaattgaacatgaaatcttgaagttaaaactacaccccttgcaactgcattattaacaatgtgagctacattgctaataagaaactgttatactgctaaaacactgttgtggcaataagctaagccaaccacacacaatgaaccataccacagttaccacagttaagttaacgtgacaaaggccatgttcggaactataaattctcacttttactcgcatgtttcgctatgcacatgtttttcgaaccgtaaacgatatgttttataataaaataaaagttattttaaaaaatcatattaatattttctctaaaagaaaaactaaaactttattaattatattatgagttaatggactacctcgtttttcgtgcgagcataagcttctttcgcaaacacagccacgaagttatacaaattttgacaatttgaccctttgcaaaaattaattatacaaatgaaccgtggccaaaacttattttaaaaatgacccttttgttcagtgcgaaatcccatggcgctgaaattagacacctcagcgccaaatagcacggcgctgaatacacattggcgcgccgactcagactcccatccacggtggcacgacattcaattccagttgacgtggcgctgaggtgtctaagttcagcgccataggatttggcgatgaacaaaagggttattttttaaataagttttggccatggttcatttgtataattagtttttgtaagagcaagtttaatagtatagccaactactaattccaaattatctatagccaatgtaatagccaattcatacaatacttgcttactatatatactattaatacctgatcccacctgtcatacacacgttacgtcttggagtccgtgctatggttacagatctgtagtccgttactcttctctctcttcctttatctctttaaaatattactcttctctctcttcctttatctctttaaaatatgtttatagttggcttatagcctgctattgtacctactctaaagggtcaaattgccaaaatttgtgcacaaagttaagcactgaaccaaccactggctcacttggcacgccagttttttttaagagagaaaattgtcagataggcaatgtggtgcaagcggttagatcaacgatggacgatcccgattagcccgcctcgcggttcatccggagaatcccaatattctgaccgccaccgtgtccctctacccgccgtcacccctgggcttcgccgccggcgagcgaaccccgccgctccccttccgaatcccgggccgacattgcaagccggtgggcatcgccagttcgccaccgccatctggcttctgccctgaccctcccgctcggatcagcgcgtgttaccgcggcgccggatgaaccgcgaacgccgcctgcctgctcgacggaatgcctgagtggagtgaggcacgctggcgcgtaagtcccctcgctgaaaatctcgctccgttgtattacctttatttgtttttcaagcaattacattcggactatgagtagcttcgctgcattgcatgagttgggggaaagtttcccccacttcagcttgagctcatacttacagtactctacataaattgtgtttcttttctttacttggggatcatcctgaacctaagagctagccaacatcaacggtaggccccttagttggtgtatatttctgtgggttttgtgcgttctttgtcatttgggatcgtgtggagtgcggcccctttctacccaagtgtgttgttgtagtgcgcttggttggcttcatgctgttctcctcgcttttcaaattgtagtgtgccgcactgctaaaagccctttgatctccgtgaatactcctttatgagcctagagaattcagagttctcgttctccagtaatttcaatggtgtgtcgtactctatgattcttcctgctcgtcagataagagcgcacaatttagtggcatgtaaaaaactggcatgtgtttgtcaagggtgtggcttaccttcactgaagacaagaatgagatcactgtcaataactgtgtgaattctatgtgctattgtcagcacggtgcaatccctgaattcatcgcggattgtttcttggataattgcatctgtagaggagtccactgaagcagttgcctcatcaaggatgagaacattacttcgttttagcagaaccctcccaaggcaaaacaactgtctctgcccaacgctccaattttccccattttcgacaactgcagaccaaatcttatttgatcatttcataacttgtggtaggatttctaatctgatccctacttttctcaaattttaccactgaacccaaaaaggatacattacctgttgaatccagcttcttcgggctctgtcgaactatatcaccaagctggcatttatccaatatctggccagaaggagattaaacaagatagctaatcaaataatagaataattgtattctgataaaaaaattaatagaagaattaagtttcgttttctatttgacacagttactactcactatacatcacattcttacagtcttactatatccatattgatttcatagcaggtacccattatccatacatagcaaggtgttatttaacatggattatgatttataagcaataatagctatgatatggctaatgatatgtagagtaaagctctctacttcatatgatgaaaaacattttatttatcatgaaagtgtgcatagttggttaattacctcccatatacgttgatcagagtattcattcactggatccagattccctctcactgtgccttcaaacattgtaggatcctgtggaatgatgctaagtctgcctcgtaaatcatgtaaccctattctgcaaatgtcaatattgtctatctcaattgttccctcccttggttcaacaatccgaaaaagtgcttgaatcaaagttgactttccgcttccagtccgtcctacaatccccacctttttccttcctggaattgtacatgatatgtttctcagaacagatgggagatgctctgcatatcgaacctgtaaaatagtaaaagtgaagacggcatttggatggcttcatttgagcaaagactactaatttaagaaaatttataaataaactttccttttattgtaatattgatttctttcattatacagaaatagaaataaattgtcacttttatcatttctgtttccgattcaagacactctttttctcttatgcaaacatataaaagtgaaaccatgacaagcctacttcagagatttttgtatgcgttcttgttctcctcttcaatagaatattatcaggaaataaagcaccttcctaagatatgttttccttttgaaaatttttcccgagtagtaattttcatttaggcatttattgttctttttcaaacttatattgttttctggtgaactcatcctgatgataaaatttattttatttctgctaaataaaattatatttgcattataaactttcttgtctagattcacagctcatagcaccattgcacttacctccaagcatcttatattgatatttccatcaagtggccagttgtttggggggcggcgataatcaactactagaggagcctcactagggatccttgagtactgcaaaattctttcaactgatatcattttgttctctgtgttgcagatgttccaaataatagatgccaactgtgagttgaggttcaatgcataggtcaccgcaagtccagcaatgcctgcatgtacaatatataagtttgaaaacagccaacatagagtgacttaatgcttccataatcaccaagagcctaagttcttcttagagcttacttggatttataaaaccttcaggaaggctcactagcagggtcaaagagaaagcaaagacaaagttggataacatgtttagcctgaaagaaagccattccattgaagaaatgttatggaaccatggccgggatgattgtcgacaagtccaaggtttgattttctgaaacgatctttttgtccatatgctcttatacttgatgctcctgtaagcgattctgcaaaatggtgtaggatgggagccctttggatttgtgataaacgagccaattctcttgctggtggtatgtagtatccctgcacattacacagagtatatggtttcagtattttgtgaatgaacgctataatttatggagaaaaggtgtacctatagcttcttggaactcatcgtggtgcacagagtgacttttgcacatggtgctatggtagtacaaaaggctagtaataaagtttttttttcttgttgggagttcatacctgacacatgaaacagaccaccgttactggaacgaagatggcaaaaactggccaggcaacctgggacataacaccaatggtccccagaatttgtatgactgaaaatacgcaccaaccaagcttgtttgctatttccagatctagaacactttggtcattggaggcctgttaaagcataaatacacacctattagtttaggggtggagagagtacgtgatgcagtataaaatggtttacaaactaagtcagtcttaaccctgttcagaattcttccagtaggcgtggagtcaaagaaggacattggggctcgcatgatgcagtggagcatgttcttgaagaacttttctgatgttagtagcccaattagtgaaacaagcatggaccgagcaaagacacacaaggcacttccaattgacaatgctatgtatacggcaaacatgagccctaatccgacagttggcctggttgctgatgttggaggagatgcccatgccatccaatagttgcttgctacctgaaatatttggaagaaggactgtgctgcgattgtgactggcactaaggcacctccataaactgccctcaggtatgcccagtaaaccttcttgccaatacctcccttttctcgctcttcatcttgtgttaacctccctttctcattgatgtcctgtgatacatcatgtgcagactcttgctttgttataccctgaatttgatcatctgtttcattttctgcttcaaactcatcatcagtatctgctggtttactgttctcagtggatgtcactctgctagaactttcggcatttatgacagactcaagagcctggctgtgggctcccactatggcttcaaatcctatgttctgttgaagaagctcatcaaatttccctttctgaacaatgttcccatcctgcatcacctattttttgcatcgacgtgttattatttaacaacactaaccttttgacatgattatctaccaaaaagtattttagatacataccagtataaggtcagcggtaggaagaaattcaacttggtgggtcacatacagtattgttttgtctttaagaattcccatcaggcaatcctgccaaggcaatttgtttcatttgcttagagtctaacgattattggtctaaaagtaacgaaataggttttgcccttttttttattaacgttatgccacgaagaatggagttaatgccacgaagaatggagttaagacataaccttcatacttgagcatttattgaaagttttaaacaaacagaacaaaccttgaaaagttggcttccagtatgagcatccactgcactgaaaggatcatcaaaaaggtatatgtctgcatcttcatatactgaccttgctatctgaattcgttgtttctgtccaccactcatgttaattcctctttcaccaatctccgtcaaatcaccatttgcaaacaactcaagatctttagtcagcgcacaagcttgtattatcttgtcatacttttctttgtcatatggatttccaaacagaatgttgtccctgatgttcccagacaggatccaggcgctttgaggaacatatgctttgctcccactgaccctcacagtcccagctagctttggcatctccccaagtatggatgataatagacttgattttccagatccgaccattccacagattgctactttcatccctctttttacttttagttctacgtctttcagagttggagatgttgtctcgagttcccagctgaatattccatgatcaatctcaatatcatattctgtgtcattcctgggtatttcaataactgcatcatatttcaattcttcttcctggaggtatttggccaccctatcacctgaaacttttccttgagcaaacactgaaagcaagtcgggaagagtgaagattggatcttgtagcatccggaatgtagcaagagcaggccaaacagtaccagcagtcaaaggaattcccatcaatatgcatgcgcccaatggtaaggaggata

SEQ ID NO: 46033 - DNA, 9847 bp, Oryza sativa
ataacaagcatgaacaggtcaatccatttttcaggtcctaaaattcatgatcgagtaaaatagacctgagatcaaataccacactggtaatgattgcagaaagctaaatatccaccatgctcgaattataaacggaagctttgcggatttcgtcttctgaaaactgaacactactagtgataatattatccaggatagcacctgcacactttcacctagaacaaatgctggatatttgcagtcacttatgcttccttgtaacaacaaaactactatcttcagagtatgacttgctaagttaagcaggcaacaaactttgcttgcttgatatgttatacccagctttttgtctgtgttcttctgttcctgatatgaatgcttgctttcagcagttgatgtcttaaatctctgcctgcaccaccttattctcttatacagaaactgaaccaagatactcatgatgaatatcaggtgtatcagtgcaaaagcgtccatccagaagcaaggtgagtacatttcttgccattcttgcaaatgttgcaatttagtggaatctgtaatgttgcaatgtaaatttatgtgttaagaactaacaggagaatagatttgttcaagagtcatttttcatatacccttttatcaaaagcttttactacaatgaaccaacacaaagtattatcgttggcttccagctaaagatacaacttctcctaggaatccagtgtactgaaaagaatattccatttccctaatgacaccataatatttcttttaatccattcaaatgttttgcaaccataaatccatgatatctagtaatgttatgtaagagactgtaatatctaataatgttctggatcgtttcctgtagttatatggatttttcttttaccaaagtagttatatggatatgagaacagaaagttaatcactgattgccatgctgagttttccttaaggaacatgtgtatggccacaagcaaatgtatacagctgttctcatagtaaacatgtaacttctgcgtgttatcccacctatcaacatgaatacgtttaacagaaccacgactgttatgaactgcaaccacgtattggtccttgctgtttcctgtctgctaatggttacagatgcttggattgttcatttgttcacattcttcttatccatgtgaagaatgtatgaactcacccaacatgagaaccccaaacttatcatgaacctttcgttttttccagttcccctaatttcttttgcaaacattttgcagaggcaggaaaaaagaacaagaagggaaaaaggagaaacaaagataatagcaaagaaaacccatgcagtgcaatcaaactcatggatgtctcggcggggaggaatcagacgtatgcatgaaccaatctctgcatgcagatgcagggtatgattaaaccttacttgaagaatcacggagcaatccccagcggagaaacgcctgctgcgccgtctcgggaatcctcgcgagaacatgcaagtgcaggctcgctccttccatggcgcaatgcgaatgagacaggggaggaggagagagggagggagagatgggcagtggccgtgaactggtgacggtgatatagaaggtggggaggcctgagtccgcgctagatggttacgggttttggcgtatcacggtacacggtgacagagatccaaaaatacggttttcaccccggtaaggcctggttcagttaatccctacgagatagggattggaggggatttattccacacctattgtgatgtggaattattctctctcaatcccctctaatcctctttaatccccacaccaccgtagaataggggctcgttcgatgggaaattgaagtgatatgcatcatatagtgcatatttgggtctacattaactatttttctacgattataatgtaactatgaaagtgcatatgcacacattactgatcgatcagtcacctttctttatgcggttacaagaaaaacgtgcacgctcaaaaaaccaaccatgcacaccatttatccacatctgtgattataagtgcaccaatacattggttgtgtacattggctttggatctaatggtcgggttttaatccattttctgaaaaaatcattggtatgtgctgaacagtcagatagacctgataaattaaataatccgtaaattttttaagtgcttactcgcatgtggtataattatagacatcatgcatcctcaacttcaccattgcatcttaggaaaggaagtatataatgggaatcaatgcgcttagttcagaattgcacctccattactaatggacgtggactagtggagtattatatcggaagaagtatcaaatcaggtgtattgccctctgctgaactcaagggcaaacttataagttataattctcctttaactcaaagagacacagctttgtggtcagagtattggaaatggtttgaaaagtttttttttcgcgaacgcaaaaaaaattgtacgtcaatatattaaaggaatagagttttttttacacaacgcaaaaaaatgttttaaaagtggcacgtgtaatcatctgccacgggtgcagaacgactttaagcatgcagacaagagcaaaaaaaagcatgcagacaataccaaagacagcatgaacgaaaccagcttcaattgaacacccaaacatactatagtttccacaatatattctccatcaatccatcatcatttcaccggtattttttatccgtcatcgatcgatcggtcgattgcatcaacacgcacaaaaggcaacacagcagctcgagaatccgggcacgtaagctaattattaacacaacataaagggctccacacgtgttgccaaagttgccacgaaatgatgctcagtttttttttaaaaaaaataaccatgtccgttggtgcgatgcgtacggctgaaaaggtttgcagcagaataaatataccgatcgaccaaatacaatctaagcacatgatattcacccaacacgaacagattaaaaattgacagcacataatttctcagcaactgcccgtcagctcagataacctttagtttactgccggatcagatagccgtgaggacagtgtcagaatccattacgaggcaccatttgatttagattagaaaaacagacttaccaaatactacgttcgtcctaaaaaaaataagggaaaattgtaacatgccattataattttgtaaaatttgagatatgccatcttgacccacatgtcattgactcatgtgggtcctatatgtgattgagataccgatggcatatctcaaactttgaaaaattataatggcatagttctaaattacccaaaaaataaatctaatattggatgtgtaataatttggaaaacgtaacagctccacgccctccgccccccccccccccaacacacacacacggggggcgaaaccctagcagcgccgccgcctttcctctccccctcccccacctcgccgccgccggagctcaccgccggaaagccggcgggcgagccatgatggcggcggcggggcctccttcatggcggtgacccctctcagcgcgggagaggcggcgaccgatcccggcgaggagacggcggatccagcgtcaccttcgccggatttggccatcccctggccagatccggccggagtgggtgctggtggcggaggaggccgcggagcggcgacaccggcgcgacgaggcggcggcgacggcgacggctacggcgcggcgacgcgacgacgacgacttgcacggcagccagcggcggccgccgcgacggtgagatgcgcgcgggcggcggtgctcgcaccgccgggggcgagcgacggctgcagcgccgccagccctggtggcagcaggccgagcgactgcggcgcgaggctcgcggacggcggtgactggcagcgcggctggtgatgggcaacggtggcggtgccagtggcagccgcggctgcggcctgaggcagcagcggcaacgcctgtcggtgcagaggcagaggcctcagagctcgtcgcatcggcggcgtcagcggctgctgtggcacggtggtgcgttcggcagcagcggctgcggtggcggtgaccacggtcgcaggaggcatgacggcctcggacgactagctgaggacatggcagacggctacatcggaccggcgtggcatcgtttggaggaggggtcggagaccggcttggcatagagtggcgcagccgatgacagcggaggccggctcggcgcgagaggcgcggccgatgaagggaggccagattggcgcgagaggcgcgtccggtggaggaggctggcttggcgcgaaaggcgcggccggcggtggaggaggcgacctcggtgcgaggaggagctaccggtggatgtggcgcggtctccggcgcatgaagactggccggcgggggacaccggtgcaggggtcccgcatgtcggcatagctggagaggtggtggagcatcggtgcgtcagccaaggattcgcaggtggtgatcggcaggtgaaaatctagtccggccttggccgggccgacaacgatggttcattccccctcctgagggcgttgtcgtgatgtctcacccttcaagggcggttgccggacgaaagcctagtctcggcttctttgaaccccgacggacggcggcggcggttttttccgtcgcttctcttcttgaagacgtcgtttttggcatcccttagagggcgatcttgtctgtgttcctttgttagtctagcagcggtcggtcacgcttagcggtggccggtccggtgctagccttctcccgggttgtgtgttggcgctgtcggtgtgcgggtggtggtatatttttttcctttttcctggttacaaccctatagagttgtaatcttgtaattttttcatgatctatcaatagaacttcgcaccgttaaaaaaaatttggaaaaccgtatttctccagcgtaaagtaataattatattaacaatcatttgaataatgaaaaaaggaacaggccactgatgcgagatggcgatgccgcagcctaaagtcgtcgtgccgattgctgtagctggccggaatggtccgcgtgaacagcagcgcgaggagatggctcagctgcctcagaggctgggagccggagctgcatagtgctacagcgaaaggcagcaggggaggcacgacgaaatgggtatgagaaaagcaccgtgacagcgtccctttctccggcgcggatacctacgtgagcgaaagtgcacatagggttggggtcggattgaagcacgcgggagcgggacagcggcaagcctgcaactgcaactgcaactgtatcagaaattcgtcgtatcagtccatcagaatcagaccgatctcctcgtgagctgagctgctgccacgcgccatttttactgccatctcgttcatcatcgatcctgtcaaaattacggctcaaatctccgttgatacaacatggtttggagtttggactgtaaattcgtgccgattcggaagcaatcagagagagatagagaggggatgggtggtgaggtgatgtcactgcttagttcctgcttcttgtccgtacccatccgccgctctgggaggccgcgagaattcattcgctcaccgcctcacgatacggacccccgatcgcgacgcatattccaatttatctcaaaatacacatattcccatttctctcatacattcgttcgcgcgagtgtgggctccgcaccggtccaccaacaacgtgctactcctacctgcaaccattgcactacaagtctaccacctcccttttaaaataattatcgctattaattaagtgatgtagtatattttaggatgtaacgagtacaatactactagtagtaacatcctaacagggcaacacaatgattaattaactcatcacctgcagttaattaattagtgagccgctagccctgactcacttttcggcttgtatcaacgctggcgatggccgcgatattctcgacgccgaccgctcggaccatcacatatacggcctggccatgatctctgcagcgcgacacgcaagcagtctcagtgcacacatgcaaccctatcatgcatccggtgcacagtgcaagccgttggatgtctgtcgattcagttcgtacgtacaccggcccgtgcgctacataatgcatgcatatgcacgtagtgtgatgtatgcaagctgtaggtgggtacatgtgtcgtggtttctttcgtaccgacccatggccgagtctgtacggccattaattgcacttggaattttctagtaaaacgggtcaatcttgattaattagccatgtgcttaccttctactccctccgtcctagaaaaaaagaatctagtactgaatgtgacatattctaaaacaatgaatctggacagatgtatatccaattcgtagtatgtatcacatccagtactatattgattttttatgggacggggggagtactcaattctaaaacaagttaatcattgatatatcctaataatataaatctggataaaagaaaatatcattatacatacatgatatgatttcattccaaaataatttaacttatatatagatcacattatattttaggttaagttattttagtacgaaggaagtagatctagaattggtggctaaaacacatcagctccatgcatggccagttggccacagaaaacatggtaataagtgcagggtgtgcagtacacgaaatgaaaccggagcaaatagcaaaatcgatcgtccacacctctttaatcactttagctgctttaatttggttatagtggatgaatatgcatgcatgcgggcgtgtgcagcagcagcagtagtaggtgcttgattgacagtttgagaatgagatccacactctaattaactctgaagctgacagcggaccccatgcttcctgctttccctgacagccgtcttctgcaattatcggagtcgaggtactccctccgtcaaaaaaatagacaaaatctgattttcgtgtccaacgtttgaccgttcgtcttatttaaaaaaattataaaaaaaattaaaaagataagtcacgtataaaatattaatcatgttttatcatctaacaacaatgaaaatactaattataaacaaatttcatatgagacggacagtcaaacgttggcacagaaacccacggtttgtctttttttttggacggagggattagctacctatatagtcatgctgatgcgtgtcatcgatcagagtttagtggccacataaggtgtgcactctgggaagccaaagagaagagagcagtacatgcatcgccatctcttatactccttccttccgtcccataatataagagattttgagtttttatttgtactctttgatcactcgtcttattcaaaaaaaaattagaattattattttttttgactttctttattatccaaagtattttaagcacaacttttcgttttttatatttgcacaaattttttgaataagacgagtggtcaaacattgcaagcaaaaactcaaaatcccttatattatatgacggagggaatactaatttctaaccctgatttgggtgttactttccacttggcaattcagccaactggcgtacattatactgtgtcttgtcatctgtcactctcctatctcaaaccagaaatcactttgccgtgcatgcaaaggcagagcaactccatgtgtagattcagtaaatcggtagtaacattagtcatcatgtatgatttagcttttcgaacatattgatctgatgtgcatgtcatgtaaatacagtcatcaagacaaatacgacgtcctcgtcttttaataaaggaaataaacctcatgtaagagagtcaagttagtcatcttcttcatttaaaccatcaaagaaacatcagagcaacttccgcacatttcttagataatgaaaaacaaataaacttcgctctctcgctcatacaagtacagccacccttgtattagccatgtcttggcagctactcaatcgactacaatctgcaggttgctagtacacaagaagaaggacaagaattacaaaattaagacaaatggatgggtcaagacaaaattaagacggccaagtacgtcatgtaaaagcgtcaagtcaatagtcctttttttccctaacatattgtcaaaacaccaaaggaattgaagttccacacgaacactagcccatccatgtagattccttggcagccacgctcaacaaatttatactatgcaaagaaagggagggaaaaaaattaattaagacaaatggatgtgtcaaaagttagctgaattcgtgcggcgcaagagagcagatgaccaaacaatgctagtcaactcaagtcatgcagctcccttgttataattaattaatcatcgtattcgtatatatattgatatactgaactaatctgtcgttgttgttgtgtggttgtcatgcatatactgtcatgcagcccaacgtttagtgcgatccgacgcaggcaagcacgttggctactttacaccataaaaaggcagttttttttaaagaggacaataaaaggcagttaagcactgagccagtcattacacacaacgctaatcttcgtcctttctcttgtcctgatctgcaaggaagagtatatacagttctgtgctagctaccactcatcagcctaagtgatcgagagatgtggatcgatttgatccaacattagtgctgtgtttaggccttaggtgcagaatcataatgacggattgcgaaagttagcaccgagtaagcagcagagtcgtttttagctggtggtggctggcgccgccgccgcgcgcgccggtacggtcttcttctccggcaccggtgcggtgatgggttggtgccttggcggaatccaactctgcactgcagtctgctctgcactctggtcgacgcgtgtagaggacaggacggaaggcccaacaagtgagcaggtaggtctcgacaatgtgtttgggcctttagaagtcatgggcccaagcgatcaagttgcgggaagggaaagaagtccatttccagtccctctatagttcaaaatgacaaaactgcaactttaatgagaaaactatcagtttgctgcaacattagcggcatgtttcagtttgctgcaataatagcgtgaaaaattatcacaaaactgtaacttttatgttatatgctgctacagtacatatgtcgtggagggccgccctgcatgccggtgtgcttaggaaaacggagaaaagaaaaaggaagggcgaagaagaagaaaaggcactgacatgtggaccccaccacgccgcatcagcgaaaatcgcctttaataatactgtctgggagtcattttgtacctgttttaattgttgaaaatgctgttcgtcggtcgaccgacgggggagcaaaaaatcgggcgctccccccgcggtccgtctctcacgcacatgcatgtatattctgggtcccaccatgatctttattcccacctaccatgtgtctccatcacatactccattgcaacaaatcgctcacatattttgaaaaccctttattaagggaattcgtttcattttttgttccaccaaaaatatttcaactaatgtattcacaatgtttcactatgtatagatataatgttgcagtgaaccaaaacattctttcacaactaatcacctacatattttggaaaaccctctatcaggcccggcctgagggcgtcgagcagccatgggcccccacctacccccgaccctcaccccccccccccccccctccccctgcggccggtagagcagcacgagcgcgatggccgacggggggatccact

SEQ ID NO: 46034 - DNA, 9333 bp, Oryza sativa
cccccccccccccccctccccatgcggccggtagagcagcacgagcgcgatggccggcgcatgacgagcgcaattgccggcgtttgcgattcctagaacatgaaaatcggacgaggccgctgaatctttcgagacggtgccggaatacaacgagtagcagcaacgcacctcgccgatgtcagcagctaccagcaggttctcgtgcgattgctcaacggcgcgaggcagcaacctccgcggcgccgcaggcccaggacctgcaggccctctctccgcctcaccaagtcactgcctccgtctccgatgcatatcacatccgtacgtacagaaattttcaggttcgcaacatttttttagcataccatgaattcatgatacgaatgcaatactatctcatctttaggattgtgagggtattatgccattatactctcacgcaggaactctcctccgtttctgtctatttgattcctctatggccgcattcagttgattgactgataccgccatccgccgctgctcgggtgctctgatcatgtgtactgcactactcctgtctgtctcatatggcaaatgtacattgatgttagcactggccactaatcggtaagatctagattcgtttcaattaatatgttgcttttctagctttgtaatttatatgagtttagccattagtatattaattttctcaatcatcaatttgttcttttatcacaccttctagaaagtttaaatggtttgccattttatacattgagtaaatgatttagatgagattgacattcataccatctttagtaactatgcatttcaaacaaattttaagctgatatatatgaagttttcaatatggatattgattttggaatgaagtatttatatatttggtacatatatattgactattatttagatgtttatatcaggggcccctgtttttaattttgtcccgggccaccaaaacctcaggaccggccctgccctctattaagggaattcgtttcattttttgttccactaaaaatgtttcatcgagtgtacttataatgtttcactatgtatggatcaaatgttgcagtgaactgaaacattatttcgctatttgctgaaacattgtttttatataaggtgaaacaacgtctgatttaaacgattgaaacatttccgatttacttagtgaaacaattccgatatatctggtggaacatcgtgcaacatttaaaaataattcaataataagcttaaaaaaattcgttggaatatatccatgtgtggttctgttttgaagatttaattgcaacgaatttaatggtgcaatcggatcatgatttagataaataatttaagagaaaaaatagtttaaagtgtttttgtacacatgtgtggcgctaacgtttttcccccacccacgatcgggcgcccgatttgtagggggatccttttattgttggagttggagggtggttatacttggtttgaaggttacgaattagactttttccttgccggaagcaaagtgcgggccaacactgagaagaattcgaaatgtgagaggcccaaaaactatggatatgggccttgagaagaattcgacatgtcagatatttgggcctttagccaagatgggctttagctttccaatttcggctcggagcttgggattgaagatgaacagagatgggattaggtaagcatgaaaaaaaaatatttattaatgtactgaagatacaagttggatgattcattctgatatatcaatatatcatgcattacagtggtgagatatcagaaccgacaacacaagtttgatgcttcacttttctgcactctgtacacacttaatacagtgaatatattaattacaggaagctgtcccagctagaagaccttttcttgatcaattacaaagcgagtgctaagctaggactcgtcagactgatggcttgcgactcagtcagacgatgctttctggattctgatcttgaagcaccaatgccgctgctgagaagagcatttactggaatcggagcagctctacgtcttcttctcaaacgacgatccgatcctgcccggcgcagccgccggcctcttggcgtccctgctgctcgagctcgaagcggagtgatcggaagcagcaggggaagaagacggatcatcgtcggcgcgcttcctcttgagctgatcatggcggccaggcgagcgaagcagctgccgcagcacgtaggacggcaggtccttccggcggacgtgcgccaccgcgacctccatgccgggcctccagtagtcgtacatgtacacctcctccttgaacccctctgtcgtcgcgcggaggtcgaacagctgatgctgctgctgctgcggctgcgccggtggcttggacaagcccacgaagaaggacgacgtgcgccgccgccgccgcggctcgttgtggggctcggcggcgtacggctgcgggtgcaggtggcagagcagcatcccggacgtgtccgcctccaccctggccgacagcagcctcagccgcgactccacccagcccttccactcgcggaggtcgtcctcctccccgccggtcaccgtcacgtccacctggaggtagctcttgtacgcgccgaagaagttgaacggctggaacagcttgtcccacccgccgccgccgctgccggccttgacgatctcctggcagacggcgtcgccgacggcgagctgctcggtgatgacgcgcagggtggcgtgcgagacgttgtagccggagttcatgcacgggtacgccggcgtcacgatgggcatgaggtgtatcttgtcccgcggattccggcgggggtcccagaccgggaggctgaggccgagctcgccgtcgtcgtgctcgatggcgcgcagcatcaccgggctgggccacttccaccgcgcgaagacgcggaagaagcgcgggagcagcatgctgggggaggcgttggggtagagcaagcacacgcacgccacgaggatggcccagccgacgccgccgaggaagcccgcgacgttggagtagacgccccgcgccttggcccagtgcttcacgcaccgcagcgtggtgcggaacgcggcggcgtccgggaccagccgcaggatctcgtcggccacgcggacgccgttgaggctgcgcgcggtggcgaggtcgaggccgcggagcaccgaccggccgctgaggtccaggtcgccgggcaccacggggaggcacacgccggcgtacacgaggtccacctgcacgccgtggaacctcatcttgatcacgggaacgtgcgcgccgggcacgggctggagctcggcgacggccgccgtctccgccagcgcggcggcgagcgcgccgaagaagtcgcggtcgcagtcgacgtaggacgggccgacgacgagcgcgtcgatgtcggagccgcggccgtggacgccgaggcggtaggagccgaaggggagcaccagggcggtggcccggtcggccatgccgtcggggtacccgcgctgccgcgtgaggcgcttcacccagcggtcgacgacgccgcggaggccgcggagcacctcctcccgggccgccgtctcctcggcgctctcgtacaggccctcctcgcggaggagcctctccagccgcgccgtgctctccaggtcggccggcgtcgggccgacgagcgagatgggctccgcgacgccccgcgactgtggcgactgggaagccattctctcgtgctcagatcggcggcgcgccggcgcggtggcgaatcgggtggcgtggtgcaaaaagcgagggatcaggagagggatgcgagaaatggaccaaatgggagcttgacttgaagcctgcctccctatatactaagcggaaggcaatagctcgaatcctagtcggattcgggaagtcaacagcggaaaatgacaggtcgaatcctagtcggattcgcatggaaaaaaagctcgtacggaaacgcgaaaagctcgcatattttgccattgtggtaatgtggtcatttggattagaggtaaacaaactgaagcaaaagtacaaattagttcatcactaaacaagaaaaagaaatgactaagacatcagcatctcgtgactttgcagcaattatgcattcaatttgtaggtttgacacacaatcatccaaatcacatataaatatctatttttaatattacaccgttaactttttaaaatacgtttgatcattcttcttattaaattttttttataattattatttattttagtgtgacttgatttatcattatatattctataaacatgacttactttttatatgtttatacaaaaaattttaaataagacaaatgatcaaatgtttgtcaaaagattaatagccgtatattagaaaacaaagatactataagatgtccacggatataagatggtcttaagtctctcatcagggcaactgcaatgatcatattattacctttttgtttttacataactagtggcatactgccatccggaccgaggtcttcagtccttgcaattgtaattagagatattgtttccaaaatttacatgcttggccaacatatgtcaataatttacacgtaccaagtgaacaccctaatgccttcactaatttactacgcaggctgacagtaaccatcgcctgtgctgttaacactaccaagtaacacgatcaaacttggctatggtcaattggccactacactccaaagcaaaagcaaaatatacaacatatatacggctttagcctaaaaacttgcaaaactttatctatgacacgacctattgtacattcaatcgagagcttgttagctctcgaattgactgtacatccttatttgtcagatctaactgaccgccacgctcagctaccttctcaatcataagtctcaacaatgggatcgttgaaagagttgcagcggatcccaccatgatgagcttcttctgcaaaaataatcactaaaacttaagttgaaataaaaaaagggtagaaatgggagcctattaacgcagagtaatattttgcgttatcaaggcagttgtcattgacagagtttgcacatttgtgtttcaaatgaaaatgacaagcatctaagttagatcaaacatggcatgagtacatcagcatgtcttctttttgcaactattcaacaaaattatgtgttgataatcatgaaagaccaaaacaatttaattataaaagaacgtggttttgagaaatggttgaaatgggaaaaattcattcgatgtactttacctttgcacgtgtcaagacaacgttgatcctgtgccaatcaccaagcaaagaagaaccactagcccttgtattcccgttggaccgtacaaaagatactataatgcattctttatccctcccctgaaaagagtttctgttagagctgcaagttacagagaaaccacaaaactaaggaaccacaagaagcaaaacatggttgctcccaaagcctggacagtttttcactagtgatgagggtaacagaataaccataatgaattactaagaaacagtgcaaattcaaaggcactgattcttctatctttttaaataatttaaataactttttacttatgatctgaatggctgctttaaagatgcatgcatggagccatagatgatttgagatgtaaatgttcactagaaccatgtatcaaagaccaaaatcactcaaatcattgaaacaatcttgaagtgttcagatcattgaaacaggtgataatgataatgaagactgagaaaaaacaaatgctcttcatttatctaataaaaagatgaagggaacttttatcacctggtacttgtcaattgtatgaacctcaactgaagcgtctacatgttgctgaatgagatttgcttgggcattatatggagttattataccaaccccatcttgagctacacctctctttagcaattcattggtgatctacaaaaaggatgtgatcaaattttgaggatgaaagggaagtgatgatatttcgatttttatataattaggctcaatatatgtaggtaaaaaaaggatgcacaacactaagcctcagcacaagtttgtggaccagagcagtttaaatcaagcgatattttcctagcttaaaagatataagataattagatattgctaattatttagcatggcacaacaaaagggcagaagcagtcagcaagacagcagcactatgaagcagatgaactttttaagtacaggattttaactagtagctaaagtttactgcttgcttgctatattgtccacaccagacatagatcagggcatacccatgaaacaattaatgcttctgtaggattgttcacagttctatgttccttggcctcaaaagctggtacttcatctgcatgatttgcccacatgattagcattgaaaggcaaatcaaaaggacagactaatcaaactaatcaataacctgtgttcgcaaagacgacagccctatcagggttcaagatctgcaatttgaagtcaatgaaaaattaaaactgctcctggaagataaagcgcatggcagtagaaaaacacctgacataacaaaaaaatgtatctagtaacagagtacttatacattaagaaataggccgcagcgctacctctttcagcttcaagcgaacaggacctctgccagaaagcttgagtttggcatttgcaatttccaacgaaccacaggataacctattgccgtaaatcaatgaatttgaagctccataatgccagatgacattcggtactacaaattggcagttgcacattgtgagttttagtgaaacaaggggtcttcaactcaacagaaaataagtggaagtggaatactagataagtaagcataagtgtgatattcaaatagagatacctggcatcgcaatgctgaaattgcttgagggtgtgcttctgacaacctccaaaataaactgacacccataccattctctcgagcttcagaactctgtgatttgtttgaaagaagtaataaaaaaaagggaaaggttggtataaaaagcattaagataatgagtgtacaagcaaagcagtgaaaacctgaacaagtggaggaagctgataatgatctcctactagaacaaactttgttgcaagcatcaaaggtcccagagatacctagtgagtaaaatattacaatgtgagaaattataaatggtataggatgcaagactctttagaaaacaattttacagatcattctggtttagcagctttgaccaactaatgtagtcttgaagttaaatgaggaccatcgtgtggatttttgtggtttccttcaagacttgtaccaagcattcctagtttggagcctaccggtaatgtgatctggcctgcctcatccatgatacatgtgtcaaacttcttatgtgctagtaaagggtgataaattcccaaacaagtgactccaacaacttgcacttgctccattctagctttgacggcatctactgattgtatatctgttgctgttcaaaaaaataaataatcaaacacacattcttcattttaaaagcacaagtagaataatgagaaattctaacttgacaagcagtggcctttgacatcaggatgtacagcttcatgccttccaattcgaagaaaatctacaccctatataaatggcattagagcatgttcatattttgatgatttgatttgttgcgctacaatgctcaagccaaacgttgctcattggaacaatgcgataggggaaaagagtttgttcatttgaatagtacagtgagacagggagttatgactgaatttatgaaaggaagtattgcgaacacaaacctcagccttcaacttcataagcaaattatctatagctgaattggtatatgaggttagcaaaatagattcccctctcatcaataatgacttcacggcatgcaccatcgtatatgttttgcctgttccaggcattcctaggataagcgcataatcttttgctgctagaatctgaaagcaacatagtgtacgctttacatagtgacattgaattttcagaagaaaaaaaataatgaactaaagaccaaagatttactttatgcagcgatctctgttggtcattgttcaaatttggcaatgattgtatatatgatagtgccggatcttgacttaggagtcctccactatcaaatctgggagcctatcaacatccaaataaggaaattacagacaacaaaaacagtatggagaaacatagcacgaataggctagtggacgaacagacctcgaggtcaacaatcaacttccttaggtgagagttttgtggattctcagcaaatagttggacaaggttgagtctggcaacagttcaaatacaaactttatttaggaagaaggaacttttctaaattactaattcagaaccttcaccaaaaaaaataaaacaagggccaacctcatggtagcaaatgaagaaacagactcatccttatctatacgccaaacttcacattggagatctccttgctctaacaaggaattacttcctggaagtctcagacgtcgtggcaatgaaacctacaaaaattccagttgaaatattaataatcaacctaataaattgaaatggatgcctaagcaggttcgcaaggtcaggtaataccgttatatgggcacggctgaggtcccttatgtatccatttgcaacagctattcgcccagattttgtgctaagcacctaatgaaaagtagaagaaaacatgacacacttcattatggagaaaaataaaccagcatgcatcactataatagctaagtatccatgaagcaaaggggtgtgagctactatatgtgtaataacgcataaaaaaatgacccctttgtggccataggcctacagcactaaagtaaacatcacaaaacaggaggataaaaacaaagtaatataacgctacaatactccaaagtgttagctggctgttgctgattgatcggttagcagtagctgcagaagttttcaactggtattatatttgccatttaacctccttatatgcactgagcatatctatgaacctatagttctacttccttaccaacattaagcacataacagttcaaacggaaagaaccctacactccaaacaaaatgagatggagccatacattacaaatttgcaatatggtgtgccaaatatatgcaataaaaatatcaatgttgctgggaacttgaaatagctaacatagtaatgttgctgaatattgaatacagaaagtgtacaaggtttaccacagaatcaccgcatttgaggctaaaatctacactttcagcatgttctcctggctgatcagctgtc

SEQ ID NO: 46035 - DNA, 726 bp, Oryza sativa
tattatgccgccgttgttgggcgcctacgtcttcaccgaccggctcgccttcgtcgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggcttgccttcgctgccgccgactggtgtcctcgcctgcacggctggcctattatgccgccgttgttgggcgcctacgtcttcaccgaccggcttgcctttgccgccgccgactggtgtttccgcctgcacggctggcctttatgccgccgttgttgggcgtctacgtcttcaccgaccggcttgccttcgccgctaccgattggtgcttccgcctgcacggcagacttattatgctgccgttgttgggcgtctacgtcttcaccgaccggccgccgcatccgccgctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcg

SEQ ID NO: 46036 - DNA, 781 bp, Oryza sativa
gcggaggcaccactcggcggcgacggaggcaagccggcggtgaagtcgtagacgcccaacagcggcggcataataggccagccgtgtaggcggaggcaccaatcggcggcgacggaggcaggccggtggtgaagtcgtagacgcccaacagcggcggcataataggccagccgtgtaggcggaggcaccaatcggcggcgacggaggcaggccggtggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgcagatgacgatgcccatcaacggtggtgtgaccaaccgaccgtataggcgaggacaccagtcggcggcgacggaggcaggccggtggtgaagtcgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataagccagccgtgtaagcggaggcaccactccgcggcgacagaggcaagccggcggtgaagtcgtagacgcccaacagcggcggc

SEQ ID NO: 46037 - DNA, 1136 bp, Oryza sativa
ggcgcccaacacgggcggcataatagccaagccgtgcaggcgagtacaccagtcggcggcgacgaaggcgagccggtcggtgaagacgtaggcgcccaacaacggcggcataataggccagccgtgcaggcgaggacaccagtcggcggcgacgaaggcgagccggtcggtgaagacgtaggcgcccaacaacggcggcataataggccagccgtgcaggcgaggacaccagtcggcggcggcgaaggcgagccggtcggtgaagacgtaggcgcccaacaatggcggcataataggccagccgtgcaggcgaggacaccagtcggcggcggcgaaggcgagccggtcggtgaagacgtaggcgcccaacaacggcggcataataggccagccgtgcaggcgaggacaccagtcggcggcggcgaaggcgagccggtcggtgaagacgtaggcgcccaacaacggcggcataataggccagccgtgcaggcgaggacaccagtcggcggcgccgaaggcgagccggtcggtgaagacgtaggcgcccaacaacggcggcataataggccagccgtgcaggcgtggacaccagtcggcggcgacgaaggcgagccggtcggtgaagacgtaggcgcccaacaacggcggcataataggccagctgtgcaggcggaagcaccaatcggcagcggcgaaggcaagccggtcggtgaagacgtagacgcccaacaatggcggcataaaggccagccgtgcaggcggaaacaccaatcggcagcggcgaaggcaagccggtcggtgaagacgtagacgcccaacaacggcggcataaaggccagccgtgcaggcggaaacaccagtcggcggcggcaaaggcgagccggtcggtgaagacgtaggcgcccaacagcggcggcataataggccagccgtgcaggcgaggacaccagtcggcggcgacatatgagtgacatgagttcgtcaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctag

SEQ ID NO: 46038 - DNA, 902 bp, Oryza sativa
gacgatgcccatcaacggtggtgtgaccaaccgaccgtataggcgaggacaccagtcggcggcgacggaggcaggccggtggtgaagtcgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggtggtgaagttgtagacgcccaacagcggcggcataataggccagccgtgtaggcggaggcaccactcggcggcgacggaggcaggccggcggtgaagtcgtagacgcccaacagcggcggcataataggccagctgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcagcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagca

SEQ ID NO: 46039 - DNA, 791 bp, Oryza sativa
ccccttccttgaccccctccattgctgctgccaaggcactgaggcctctggctgagaagggagagtctacggacttctattttcatttcttgcctagttgcctgctgaaaaggatgataatgcccctaacaactcaatttaatattcccaactaataagctgtcgatagattaataggaattcccctatccaaatggagaaacgttggattaacctagggtctaacattgttttgaatgaggctgaaacagaagtcttagtagtcgtcataatggaataccttgaacacccaaaccttcctatatcgatcaataacttgtttgttaactaagcctaacctaatcctttaacttgctgattcataacttgctaactaagcctaacctaatccagagaagttaaaggatcaataacttgctaaggacactccctggttgctgatattgctactgtacgccgctgctgttcatttgttgaatatgcataccatagattaattgattgtaattttgctttgcaaataaaaacttccaggcttgctattcaaaggctcgaaatagcaaagaatgatctgcagaacagaattgccaaagaggtatgtgaagaaaatgcacataagaatattctattttatgcttgccatctaacaaggagtggcttcaggctaggggtaatgcaattctacaggcaagtttggaaagaaggaaacaagcactgcatgaacgtcgtttggccctggaacaggatgtatgttgcattcccttgtaccatcaaatttgcttggtcgtcaa

SEQ ID NO: 46040 - DNA, 1321 bp, Oryza sativa
tcctgcagccccatatgtgaggtgcttttataggtacataatatctctcatgtctatacattgaaaatttatagctggattgcacacatgaatagtccgtcgtaacgcgcggagcattatttagtttttttttaattctagtgtcacataagcgtcacgtcaatgctacgtggaacgaggaccgggtcaacaccaccacgtaggcaccacgtcagcgaaaccgctctccaaaatcgctgagggagttaaattgcgccggttttaatagttgaaggtcgaaatatccggtattgtggttcacaggttcagggatgaatggccactcgttaagagattcaaagtgaacttattgtggtggctatagcttcgtcagcttgttagaccgtttgagcgtgttgacaaccgaccatgatatcaatctattatattattaaaggaatagaaaaaggagcctccacgttcactctcatggcctagaaattctcacattaatcggagaaaaagaaaaggcagagtccatatggaaatacaatttagaaatagctgaaatttagaattaaaaaaataaggaatattagaagaggagactagagtctatatagaaatacaatttagaaatagctgaaattcggaattaaaaaataaggaacattagaaaaggagactagagtccatatagaaatacaattaggaaataactgaaattcggaatttaaaataaggaatattagaagtaaagtatagagtccatatagaaatacaattaggaaataatagaaattcggaattaaaaataaggaatattagaagtagagtatagagtccatataaaaatacaattaagaaaaaaaaactagaaattcggaattaaaaaataaggaatattagaagtagagtatagagtccatataggaatttaaaactaactaaaattcagaataaacataataaaattaaaagtagagttttgagtccatataaaaatacaatttacaaataactaaaattcgaaattaagaaaaacatgggaagaagaatttaaagtcaatataggaatacaatttagaagtaactgaaattcgaaattaaaaattaaagaatattgaaagatgagtttagagtccacatagaaatacaattagaaataataaaaattcagaaataaaaataaataatattgaaagaaaagcctagagtctatatagaaatacaatttacagaaaattcaaaattaaaaaaagaaatattaaaggacgagtatagagtccatataggaatatatataacttacaaataactaaaatttgatattaaaaataat

SEQ ID NO: 46041 - DNA, 7787 bp, Oryza sativa
ttcctgcaccccataaatatgatttttttaaacaactttcgtatagaaactttttacaaaacacacaccatttagtagtttgaaaaacgtgcgcgcggaacacaggggagaggagttgggaacctcttatgccgaacacaccaagcctgtaaaaggtgttgatcactttatcagaaattcagatcccatgttaaccaaactcaagagagcctactccttccgttatataatgatcattatatatatttatacacaaagaaaaagaataatttaaactgtattaatcaagacacactatacacatacttctacaatacatgtatcgattaaaacaccatatcatttatactatagcatgcacatattctcccatcttgcattaattgtatttcgatagaatccgtatccatgtgattatatgatgatcaatttgagaaatatttgatttcattatatgatgattagtttctgaaggagaaagtaataacataatacccacacctaccacatactatgtcatttatcactcaaaagaaaattaccttttgcttttactttcgggggcgctgatcgatcggatgcatgcgtgatcaagctggccgccggacactccctgtacgtttcacctcgcgatctgcagagttcaaacttcaaagtgcaagaataagtcctacgttacccggtcgagcggggacgcataccatggccaacgctaagatgtgacacgtacctctagcctctcccacgcggacgcgatgccaaaaagcagcaaaaagcacgtgcctgcgaggaggcgcgaacctcatgcacccctgcgcgaggcgtcgggtctaaggccagggttcgagccgtggctcgcgctgagcagcttgaggcctcttgggcgtgtagctttacgcaactttacgataaataaggtctcacttgtgggtattacctctattaattggagaaataagctctcctgtgtagccttgcccacctaacaaacggggctacggtttgcgtcggtcatggcctaagcaggcagtgtagtgtatagtagtagcctcgattgttggtgcatacgtacccaggcagcaccgtgcatattcttatcggattaggatcctctgcagtcgactgcaccgcgtcttttatcattgacatgtgagtctgaagatcatcagacccatatgtaataaatgcatctggcagtgaccgcagaggatctcaatccattctcgtcgggttctctttccctcctgcaaagcccggccggccgctgccattcaccgagcggcagctagccagcagcctacagcctgcctctcgctggctctgagtagccaagagtccaagacgtaccatctcttttctgaggccagagaacgtaggtactagtgcaaaccaagataaaaagttaccggagataccaccaaatatctaattattgaataatctgtattccctggcgtttttacattataagatgtttcagtatttttcaatttaaacttctttaattttaactaaattaatataaaaacaaagttaacaaatatattcaacgttaaattttataaaataactttatcctagatggccttttgccgattgccattgaactttgaacaatactacagtgctacgcctgaatatgagtccacgttcacagctcggctctacaagatcttaaacgaaaattaaattgacaaaacaacctcagattaattatccccaatttgaacctaatcacagcaattacttgcattctccaaaaccagactaaatattgattcttgagtagcaagtttgattagcctaaccacaccccccgtacacacgcgcgcatacagtcaccgcgaggtaaggtcacctcccccccttttcccttgcagtgggtctctcgccggtcgatctcccccacgcctccgaagaatataaaagcccccttcaccctctgttgccttgtagcctcaacacctcaccagtgcaccaccccaccaaccacctctcgttttgcatttctctgcgctcgctgtcgctgccatggattacggaggcggaggcggaggagatggtggtgtgcgcggcggccccggccgcggggaggcggcggtgggggagcacagccgtaccggcccaccggcgtcgtgtggccgccgccgccgccgggtagcacccctgtcaccgtccggaggcctccaccgtcgacctcgccggctccgcaggcggcggcttcgtcgtcgtcgacgtcgacaccggacaagctggtgaggcagaaggcgatggagatcgcgctggcgccacccgccgcggcctctccagatggtgaggcgctggcctcggacaatctcgcgcaggtatggaagaaggaactcgtccactcttctcgaggctatggtgtattggtgtacgtcactcgcaaccacgttcccatcaacaaactgagctcatcttaccctctccccttcccacccctctagatctctgcacaaccgtttactactcttctgctgttgtttctatatcgatatagtagcggtagcggcctagatccggttctaggcatgggtttcgagtgctaattctgaatgttttgattctaggcatgggtttcgagtgctaattctgaatgtttttgttgctgatcacgatgaacgttttcgtgtgtgcactgtgttcgtttacgaatctcatgctgcctaatctgttttgagacggcgagattgttgatatatgattccaagtatcgaggcttccgatctcatcctttgttcgtttacgaattttagtgctgcttaatttgttcttgagacggcgagatgttatgtgatatgatccaaagtatcgaggcttccgatctcatccttgtgatgtttggcagaaaacgaaaaccaaagcatatttgaacgtttcttagatgtctttttatttcttattttgtattacatctttattgcatccctgtagagtacattacagtttaatgtatcctcctgacatcttttctgggtgagaaaagatgtattgcattttgaatgcataagtgtcaatactgtacaatttgaatgtattttgagatagcatcttcttgtgttacatttttattgtatctcgctaaagtactgtgctgttgaaatttattccgagagcaattttggtgacaccatgtattacattttacaagaatacatttaagaacacatcttgtaaaatgtgtggtaagatttaagagcacactttgattgcatctgtagataatgccgtgcagctaaatttattccgcgagcatttttctcttgtcaacaaatgagtactgattctaaactctaatgtttcaaaatcttcagataaaaacagcattaggtggggtttgcattgaaacaaatcatcaggatgataaaatcagaaggtacaaggggattacccctattcctttgagccagctgttgtacttatctttcatctgctgtttctgtaactttaactccctttctgtttatgttctctaagttaagggaaatcaatgtagattgttgaccttctgaaatacttgttgaggtgttcacagtttgaatttttagtccgaggaaattcacttcattattctacattagactagacatactacagaggttttcctttcagctaaaatcttctcttttcagaataagtattcccaaatgacagagatactttgtcctccttacaaggttaatcatggtttgcattgtcagcccaaaacattgaattactgtttttctagtaacacattgtatgttaaattttattatttggatcctaggatcctttgttagcatgctgttaaaaacaacaggtctattaacacattatatgttaagatcatgtattgattgctgtaatgataaattgtttggcttcaacccgtgaatgccgttagttacatagtcccctgcttgaggaatgttaaggaatatagagtcctttacattgtggaaagcttttaaatctgatttttaaaaatgtcaaatagtcctttattttcaatgtagattgttgatggaatatttgaatggtctttgttaaggattttgggcatattagcatatcaattatatctggatgtgggatgaaatattttttccctttaaaatggttatgacttagatatctttcaatcttataaacgatccgtgaatattcaactgaaatgatgtgtaaatgaagtattacacgatttccctgacctgggggagtatagcatgtgctatcatctttttgttagacctgcatttttatttatgtacattggtgtttttttttccaaactgatgcccagtatttaatgttatcagattttctgttgacaagaatgggacaagatgctgcctagactctagcagtgagtctggaccatggtactccaagaagcttaataacaagaagggagtgactggaatccttagtcaatggcacaagcagacggaacagaaagctcatgaggtataatgcgacttatatgcagatccaaaccttttatgccttttgaattttagctccattttgaatatgaccttttatagattttcttagaatgatttgtgtgtagaacatgagactttttgaatatgaccttttgtagattttcttatgatgatttgtctgtagaacataagattgtatttctcttgacgatgtaatttagtcatgaatcatgtatttgtcttgatttccatctcattttttgtcaggttgttatctacaaacgttgtactgcttctggatctgcagttactctttttcttattatgatgagcttggtttgtacggtgagaggaagcaaccatggaactgattgcgacatcggcgagtactcaacgagcattgctcaagtttgtcagtatggtgctcctcccgcagtgtgttgcgaccttttacaatccgctgtccacacttgtggcaatgctagtgttttgtgtgaaattggcagatctgtgccaattacttctagaggtttcaatgttcatgatgttatggattggcaccgagagtgcacgggtcaaccagaatcatccagtgtagatgcatcgtccatttgttatgtatcaggtatatttccctttgcttgtgtgatctgttagcctgctttatctgtttactgaacaacattgtcttatctgatctgttagcctagctagtttaactgtttactgaacacattctctatattaggtgaaaggcacaaagagggcacaaaagaagagggccatcaagtaaatattttgattgagaccggtaacaaggagtgcaacgcaaggaagtcaacttctactaatccgatgtttatcggtttaggaattgggtttggatcggccatgctctttgctttcgcgctggtggtgatttggctgttcgtgagaaggcgatcacaaggtatgagtttttctttaaactagtataattctgtttgcttgtaaatacggccaattgaactcattttcattttgcatatggtcaattgaactaaataagaattcttattcctgcaggaggtcctctggtgccgcagattagcttgctcgcaatcgcgcctcacttctcccaagggcttcctgcgctgcccttccaagagcatcctgcgctgacgcttccctgcgggcctgtccctgtcccgacacctcaagaagttacaacagtgcagccagccaccagtgcatatggtcagccagcgccagtgcagccagccaccactgcatatggtcagccagtgcaaccagccaccaatccaatggcgtacttggcatcagtcgtttcctatgcgattgtagacagacttactagccgccgtcgtcgctagtacttgtgtttgtctctcctcatacttttttacaactttcttctcatacttgagacaactattgagtttgatgatttagaatacttgagatgaccactgaacaattccggttactgtaaaatttgagacagctagtgagtgctgatgatttctgttaatttggttctttaaaatacctggacgactattgattgagggctgatgtttttttcttttgttaatttggttgtttggggtatccagaattcataatttcagtggactccggacttcggaacggttcgaaaacacaaaccacttgtttttaagtttttttaaaaaaataccaagtatatcttaagacaaaaggcacgagggcatagcttttaatagaaagcagataaaattcaaattgaacttaaagtttttggaccaaatttattcggactttattgattttagtcggtttatcaacggattacatgaagagatgtgcttccaatgatatcattcagtagattttgatctaatattaggattgtgagatcctgtttagatgggactaaaacttttaagtccctatcacatcggatgtttgtatattaattataaatattaaacgtagactattaataaaacccattcataatcttggactaattcgcgagacgaatctattgagcctaactaatccatgattagtctatgtgatgttacagtaaacattctctaattatggattaattaggcttaaaaaatttgtctcgtgaattagctttcatttatgtaattagttttgtaagtagtctatatttaatactctaaattagtgtctaaagacagggactaaagttaagtccctggatctaaacaccacctgaatctgctggtgtgtttgattagagataagaaaatatctgtttatttacgttttaagggcctggtgtagataagggcctgaatgaggaacttctcctccatatatttatgatgtttccctagggtccaaatgaaatacgttttctacggctccatatattgtgcggcaatggcggaagctaagtcgaggtttttttttaatggtggaatcaaatgtactacacctatactaatataaaaaggatcaattcaaactttttgctatggccacccaactgaaatgtacaccgaaaggtctcatccattccgtagccgtttgatcgtctcatccaacgcctcaaaacgcatctaccacatgatgtgtgtgtcaatttcagggagtaggaaattggggataaacttgttgcattgacttagctctatgggcaatatattgtgtacaagagggatgggaaataaccaaaatatccaatacacactattacacttaacacccccactcaaatgcaatgtgtatgcaataacgttgcattgaaaactacaactaaacactaaactaaatcaaaagtccatgcttgatgatgacgtcgaagtgtgcagttcttgaaatgatgaagaagaaatgattcatctcatcttcaatgaagcggaccttggagccttcacggatcgttcttcagcctttaataccttaagccttcacaaattgtttttcagctcttcattgattcagagatggtgacaatgatattgaaggaccttcacaaactgttcttcggtccttcatgattgatgatgatgtcagctccaacggggagcatgatggaccaactccggcagggagttggtgatgatgacaggacaataatgaagaccaactccgatggagagttggggaagttggagatgacctgctccgatgtggagctggtgatgaactgatgatgacggctagctccgatgtggaactagtgatgatggagatagattggcaagacttcgacaaattgaagaataggcaatgacttcaatggactcaatgggaactagtaaatgacatgacgatgctagtatatactccctccgtattttaatgtatgatgcc

SEQ ID NO: 46042 - DNA, 11917 bp, Oryza sativa
ctttctcttaatctcctatgtatacgagataaactatttaccggatattcgattaaaaaaacccaaagaaacatacatacataccattaaaaaaagctataaagcccaaaaaataaatatgtatgttggtacaacatcgaaaaaatatagacaatccttaaaataggattttctatactatgaaacaaaatttattactccagaaatatgcaagttaaactagatcattataagtatcaaatcaaaggtatttaaacacccacttttaaattataatccgttgtattcaaatgctgatgacttatcatagttatattatgatataaatacattacaacacatggatctgacatataataattaatattataataattttcaaatgatttaggcgacatataataattaatttcatcataatctttgaaataacttcacatcatattttgtggtgtcaaatataacttgacaaatatataacactaactgaaatcgacatgcttgaaaacgaaacaacattatgctttgtcagttatatatgatttaattttaatttatggagactaagattctcaaatgttttttttcatatttttcaaaactatttcattggtattcctaggcaataatcttgctataatacggccccttaatccatacgtttttcccgccagattagtttgttaacaaatgtgcattaaattactcatgatatattttgtttatagtcgaggaattctaatttgtcgggtataaatgatagttgatagttgatgaatgtatgctataagtgcactccaataaattagttatttttaataatttttgaaagtaaataaaatttaaaattagtaaatgtgtctcatgcaattatgaaccaattatgaacaacaggtgacgaaaacaaaccatacgctaaaatattgatctttgtcaaaatataaacaatgatataatggtatgatactctgaagatggttatggtcatatatctgtttagcgatacatttcttaatgatcaacctcactcatttcaaagcagaatattgtatttatacataaaaaattaggtagtactgctcaatactagaaaaaattatgtctacacaaaacgtaaaaacaattattttttatgggaagaattattttcattacatcaatcttttcttgctttctctaaaggctattgaacatcttttacaagtatagttgaggtggccccagtggaaaccaccgttgacaatagtgctcaactttttacttactcatgcaatcatctttaagaatgctgatagtgaattaggacttaaaattgtactgcacactgtccttgagaggcatgagtatgtcgatatggaacccatgtttaaaggcaaccgagaaataaagacttggtatctccacctgttagaggggatattcatgtctaattttcaacactaatatcacatttaccaatagatgcagtattttaagtatatttatttatagatttagaactatgtgttgacataaacacttaggtatatagtggagataaatgttttatgtatttatgatgtattaggcttattttggtgctacagatgcagttccgtttattaaaaaggcatctagcgacaatggtaagaagtaatggtgacaataggcaagtttacataatcaggacaaaagtgatttttttaatataagaaacattcctatcgtttatattaaaacctacaatatatttcacgacatagatttttgttattatgaggtaaaatatataatttcttatacgcatatgatgtgatatgacttaattctcataacgttatttttataatcataatgaataagttccccgcgtatctgcgcgggctttctttctagttactagcaaaagacccaaagaatgctagtgaacgtgttgacagtagcaagcaatgagctaatgatctaactaccactccaagccatcatgataatttggagatgtaaaatgggattatgataagcagctaacaataataaaatacggtgataattgatgagtgattatcggatggcagcgaccagcaagcacaaaaattaactgcatatgtgtgatggagtacaagctcaaagacatgaaaaacaaatcgacgattttgacagattttgcaactgaaattaggagcaaccaacaattttgacagatgatgatgaacaatgaagcattgatgcatatcctttgttctccccaaaataaaactgaagcagcacaagctacatcagtacatgcaaagtaatggagagagaatgtgcagaggagagctggagcttgcgttgacttagccataggcgtcttagcagtgacggctaaagatgaaattgtggaagaggaagagaagatgtggaatatttgcttgctggttggagatgaaatagactacgacggggctcgctgctgctgcatcaggcaggacccctgctgctgctgcttgactccgcgagaccgttcagtctcgctctcccattccgcggtaccacgcggtctcgcctttcgccgcgcgataccatccacgacgtcattcccacgtcgttctcgtgcaacatttgtgcgagaccgacgatatatttacgcaaaaaaatttacatcccgaatatttataagaaaaaattgaattaacagtatattttcaaatttaatttctaccttagctgccaggaactagagaaagctccaggcatcagtcgtttagtaattttgatgttcatattctcgtgagttgccttgccgcattatcatgtacagttttgtgaatcaaaatgaaaaccgaaggattataggttctggaagttccatgctcaaaacaaacaattgttgccatgttagaatctgaagcatgatcaatttagcagtttcttttcgtagctgtgtcttactactttcagttatatgcattagctgcttcaactatgacctgaaacccaaattctactcaattttaagttggaacgaaactagataaaacatgctgggtaggcccacatggtgcttgtgtctatcgagcaatagctagacttatacttggtgggtacaagtccaaatttcccaacaacatcacaattgtttatatgatctgccatatccctgtttttcgtttggatatgttgctaagccgagtaaatattcttaaaaaaagcagagttagaactcaagctgtggcagagttgctctgaaatctgaaaataccaagttcagaacaagcagcacatggtacaatttagctgtattcaaacacatctagtattactgtttttaggatgtacgattttatctatttttagtccaaaagaaaggaaagcaccatatacttcatcctagcaacaataggtgcaagttatataccgtacccttcatttgatttccttgtctttgattcaccaagaactagttctacctgaataccaacattggtactgtatgatagatatgtatgttttatggcactagattttttgagaacccatgttcaagtcttttgtgccaatgataaatttggccgcaactcatggccaatatgaacataactgaaattcccggtttgaacttcattggaaactatttcagttttaattgggactagcacatataggccttgtacttcagaaatatttcaattttactgatgtaaatcggttgtactgcactggtttgcaacctgaaactccatttaaaaatttaaacctagatcataagatattcagagataatggcaagaagtagccgggccactgaagctcatggtggcattagtgctatattataatttctcttgcacttgagtgggtccttaaacaagtattataccatttcagttctgcttcagcactagtgttcatctttttcctggagttgcacatctggcgtttgcagcatttctgtaaattggcatagtataatagtgttgtcactatctcttttaaggacattctgtaaagcacgcatggatggctttctggtctggacatgcaggagaggagcacttatgttatttttttagcacttctattcagggtgaagacatcctttggagcaagcattagtgtcggatcttatgtgattgaatatttgcctgatacttttacctttcgactgagacattttactgcttatgtgattgaataagtagatgtgtagggacagttcttatcagatctgtcaaaccttgtgaattgtgatgatgctattgatgttcagatgggcaagcgattaattctgtgtatatgtgtgctagtgagtatgattaattatgcgtatgggtgctaatgtctatgattaactagatgggtaccccgcgcgttgctgtggaagaattatgtaataatatagacttaatatcggttgagcagtaagaaggagaatcggttatggaatatattcagagatttcgtaatgtccgcagccgatgttatagtttgagtctaagtgatgagcaactagcatatcttgcattccaagggctatcaacacctatcaaggataaattattttgccacgagttcgacagcttagctcatctaatgcagacagtaagtaagatcaattttggagttattaagactagactgaagataatattgaagcatgagctctcgtactccaattttttttttttggagggggggcctgtgttaacaatgaaatttggtaagccttgaagacgtcatcagcctaaaatcaatatcggcttcagagttttggaatcggccgatgagaattatcaagtcgccaatagtcggattcttgctatattcggttaagaaaactaatctattaaaggaagcttagccagaagtgaccgagttcaagaaggatgctgaatgcggcatggcaagttatctattaattaggcagtatttgttagtttccttttatctttaggaaagtgtgtttagtgtcccataaggactttatgttttactttatatttaggaaagtttctttcttgtccaataaggactagtacctacccatgggtataaatatgtacacctggggtgattgtaaactatctccacaatcaatacaaattcggcacatcgccatcctttttactgaggtttttacttatcatccgacggaacttgacacttaacgcagggctgcatcggctttcgatctccgacatagggggcaagtcctacgttgcgccggtcctaacaattttattggctacattggcatcgttcaaggctgcatcgcttcgacctcttggattgctcaggtttagttgatatatttgcctacctatttatcatatatattagttaatctagtttggtagcttgatttacttgtaacgactgatattcattttagggtttatgccggtatcggctaagtcgctttcccaaattagattagctaaggtatctaccaccctgaaaatcagtcaagggcttgattgtctagatattgtgtttcatacttagtgctgcatcagtacattcgacctactaagtcgtatttagaaccataatctctagcctgcttcttgatcgctaataaaggtttcatcggggttttagccaatgagttatctggacgttgcatcggcttacaaggattgcatacaagttggatttagccgatagcaacaaaggtttcactgtttgtctaatcttgtggatttatgacattggaccttcaaccgatgtatgctttaactttcggatcaatatttgttctatcatatcattgttagctgattggttcctacaggattatattattgttatattacattatcatcagccgattgtctttatttacatcaagtgtcagattttacatcaaacatatggccgatagctcaaaatcctatcactatcgactgataccggtatcggctggaatcactccatcggcttgtcagccgatcggttatttgatctgctatttgtatatcttgtcaattgcaggatcaaattgactggcacgtccgcacctcatcaacctttggacctgcactggagctaagcagatctctcagaccgttgtgttcgactgttcgttgacttagttcgtgccaacacagacccggtaccatcggctgagcgcggattttccgtcaaaagccgcgcgctagctcaatcactgactgctgctgctttccacccgcatcttggtcctcccgcgcctccgcctcgccagtcgccaccgtagacgtccctgtgaccttgtccatggcgaacctcaccaggttgctgagcagcacaacaacgctcttctcctgctctaccacgaagctcagcaggctctgcagaacggcggccttccagttgcccccaccgccgccgaggaggaagggaaggagagaagatgacatgtgggtcccccaatttttttttttaatagcatatgggccctacacatatctatatatcctatatagttggcaccaaaaactaaacatgcattcagccgcatcactgacaaaacatgataaaacaagagccattggatcattttcatacgtaaccacaaccatccaatagacattaaatatcaacacttatcatttttcattgattaaaaggtaactcaacattcagtgaccacttagtgtagtatatgctataaaaaaaccactacaagaagtagccatcggatcatttttcatatgtcatcacaaccatccaatagacattaaatatcgatggttattatttttcattgatcatgaggtaactcaacattcagacccttagtgtagtatgctataaaaaccactacaagaagtatttcatttttcatatgtgaggtgcttttataggtatataatatttctcatgtctatacattaaaaatttatagctgcattgcacacatgaataatccgacgtaacgcgcagagcaacatctagttttttttaattctaataccatataagcgtcacatcaacgccacgtggaacgaggacctggttgacactgtcacgtaggcgtcatgtcagcaaaaccaccctccaaaaccgtcgagggagtcaaattacaccggttttaatagttgtgggtcgaaatatccggtattgtggttactataaaattataacccaccaaatcctaaagctcaacctacaagatgctatatcatcatctgctaacaattattacacctaaaacatcattgcgtgcatagtatattatctataattctatatttattaaattttagagctttaaaatgcaaacatattaaataatcatcccacataattcacataatatttaaatatatctatccattattttttataatatcctatataactatatagttaatcatcacttagttaatgttatgtatcttttctctcattaagccaaatcatctcaattgtttttagcccttagatgattaatctatgttctaaattacctctctcatttgattctctcataaagtctcatcgcctttcttttatatttggatcatcatactatataatatttaaatgaccataaatcatattaatgtttagctatcttacatattatttgtacttattgctattatactaaactcccgcagcaatgtgcgcgtggggcatgacctagttaagtatataatcagtgacaataatctgtttcgaccaggggtcctgcgttcggaaattcccactttatatttatttgtattgtctaggtttttacgaatttccttttttcatatagcatctagtttttcattggcttcccgttatggtgctcttttatcaccttggaagctactaggtaaaatttcagaagtgagcttcatggaagacgttcgaggtttgtttgtctttcttttcttatgggttgctgaggagtaacgtggttttagttcactttaatcatctttgttcatgaacaaatcctatatatactattctaataaaaacatcagcttgatgctccctttaaaatttctctaaattaatatattctctacataacacaattaaaggacgtgggaagggcatatgggggaatgatctgtaggacactagtaatatgcccgtgctaaacgctacggtgcaattcgatgtttctttaataacttctaaaatttcatgttagcaaaaaaaagtatatgatatgtgcaattggagctttaattcaattaatatcgtacagttcacataatgtacaataatatgatattgtgtgagcacaataaatcttaataaaaattaattatatataatcaattcagaatacaatatacgaagccaatatatgttttaaaagaatatgttcaaaaagtatagatttattccattaatttgttgctactgcaaaaaaaaaaagaaaagatgaggtcacgaccaaagttcagatagacaagttcagaaatggagctatctcataaacattccaaagctcactgaaaacttcataaaatccaactaaatttacaaacgtattcagagatatatgtttttagaattcattgttacaaacatattcagagacatatgtcagaatcataaatttttcatgctggcaaccagctgaagaggtgcacagatcaagacttgcaaaagatgtactcatcttcagaacaatgttcaggcattttccattctggcagctacaacagaaccagaaaaactctttagctccaggttcattttaaaaaaaagctccaggttatccctaaccagggcactcagggcttctcctagctcgacaaaagattaggcctgctatctaaatttgagaaacacatgcagataataactttttttttgtcacacatacacataataatttgatttcaattatatcacagatgtatgttagtgggagggaggagaattaaatagcaagtattttgtcacagatgcacataataatttgatttcaattatctcactgatgtagatcacataactgaccgagtcactattgaaccgatgcataatagccattgataatttaatattaggatggttcatagcttctgttaacatgaaaaagaaaccatttttgtttccatacagcaaccatgattagtgacaatgacagtaaatggataataatatggattggtgaaaccctttcgaaaaaaaaccgtgccatttgattaaatagacggtaaaaaaatggataggatgaaaaaaagtattccgtgaagacattgaaggataagatgcagctgttcaaggaagaaacttacagttgatttaaaagtataaatatgtgcacagaagctagagcctattttatttattaaaacttatcagagcaacgcattatcctgaaaattataaggcagattatgaacttaacacaaattctacataggaagtaatgtgtcaggaaaataaatttattatgtattgaaatatatatgcctccttccagcttttggtgtagatggaagattgatcggggcagtgacattgttgaggccaaattcctcttattcggttgtctggcaaggtgatgggtagcgacggcgatagggccgtagtggcgggcattgacggttgtggggagacagcggcaaatctagaaacacttttctttctttaggttgatggaaaaatgaaccaccctactggcagttgaaacggtcgatatatgtaaagttcgctgctgccatcaaaacccgctcgatattcgtcatatcacttacaagtaatacgactctggtttctgtataccatcagaaatatagagaaatttaccatatgcctaggaattcatggtggttcctaaactaaatggtacatattagtcatattattctgaagatttaaagtacatttgaacttttaaagaagcttaatttgaattaggataaaactaaaacacattacattttggaaattggaacagagggagtatcacagtaaaagtgtaatgctgagaatcacaaaataaaagtacttgtaacaaataaatgacagtggattcaactctcaatttagttttagcaacgaaaaatatatagtacataaagaacagatatactggttttttttttgcaagtaccagggcattgtgagctataggcaacaatgtgatgtcacaaaccatgaagtgatagcagggcagtggaagttgatggctaataccatgaacagatgcattgacaatagtaaaaggcgtagcaaaaagaaaaaggacataccttgaagctcatttttcacacctttacacactgcagaatttgtcattgttgcagccctgaataaaacagttgtactcagagcaatgtagggggtaatctccagagcataacataaggacacaaattctcactaccaccagtctcacctaagccagattgatgccaccgtcgttgccaaaataaatatacagaacactgaattgcttattaaatgtgtcatctacactatttagatccgtacatacacaagcagattactacgagaaaacatacatgtctgtgtgacttcgtcaacaatgggaaaactttatcactgaaataaaatattgcttcgtcaacaatggatcagttggtgagttcttaaactgataaataaatggctgtgtgactcctacgtttgcaatatgcttgggtcctgccactgtaaaatctggtgataatttgggtcccgtcattgtaaaatatcattcaaccatgataccaataatttgaactattgattgaggcagagcggaaaataatttgtacggttgattgagacagagcggatacaaactttcttcattgcctctgacgaagaactgggaggcagtaaaaagaaggggtgaacgattgagtttgtaatgtaagtacaagggtcatgggactgcacctgagaggggagatgatggcgctaggtccacgactgcccggaatgcctcgccttagcacctcccaccctttcgtcatccccaccctcctccacgcacctagctagctagcaccgtgccggcctatagggcaagcgcccgtagatgacagaggcggcgtggtgagccgtgagcagaaggggcagagggtgacggagcggcacagcgatgagggcacgggggagtggcggcgctggcgtgaagatccatgtctgcaagagggagtgatggcgacctgatggcggcagcggcgctggcgacgggcgtggggtgcggagcggtggaagggagggagcgcgtgggaagggaggggaacgacggtgagcgcacaacgacgtgattttggggatagtgcggctgccgagaggcgatggcgatctgcgcagcggggccgcaggggtcaggagcggagagggtggagggggattagggttaggggagcgcgggcgcgggctgagtgaggagaggggcgctcgcggcgtgatttgcggggagacggggagagggatgcgtgcgtactgtggaaggaagagggggagacgtggggcgatgtgagctgttggattaagatgttattgaccgttggatgtgtgatatgatgaatgagtaacgagtaaaactatttgttcaactatagggtagatgagtaccttcaaaatataaagcaagatttttcacttggcttgtgcttaaaaacctcatatggacgaaggacagattgccatcaaggagggtatggcaaaatgactaatatcaattacaccttacgaatctggagacagttaaccacctccttgaatgtcttcttgccactgcagtttggaatacgatatgttgattaattagaattggaatacgatatgttgattaattagaatgcatcaatctcacatcctttttagttggcaccaaaagctaaacatgtattgagccacatcaccacaaaacaagagccattggatcattttcatgcgtcaccataaccatccaatagacattaaatatcaatggttatctttttcattgattatgaggtaactcaaaccacttagtgttgtatgggaaaatatg

SEQ ID NO: 46043 - DNA, 1276 bp, Oryza sativa
catatatgctattatatgagagaaaatataatgatgctagccacgcaatctgtgcgggccaccatactagttagtgtattaaatctgcacgtcgcacctcgtagctggcgttaaatagaggatggttaatttgcctatgattaaagaataactcccgtgtgtaagggggcaaaatatgttttgattgttaaaacaacacataaacagtccaatcgtcgatgagagccgaacatgtctgtacagtttgttatcggaatcaaagtatcggatcaacgatccgatcaccaatgaaggttctagtttcgattgaaattcaaatagtacttgggtagtccgatcgccggaggcagggaggggggggggggggcaaataccaccctaatcaagagatagagatgcagtttgatggttgtgtttcagcctccttattgacaagtttccgtggtcaataccctgcatgtagggatgcaagtgggatagtcccgctatccaaataaaaattcgcttactagttcatttctcacatgatagtacaaaatttaaaagaaaaaatgaattagaagtgagataagtgagtaaaaaaacccgcttgcccgccccactggcatgcacgtcgtttgcattaacttgagtctactactgccacactacagataataagcgtatgtggccacgtgattagtagcaaaccaactaggtgcagctattactagttaattgctttcttttttttaactactcgaaactttcaaatcatatatcgaaatcataaactggtcgaacccagtattttctatttgaaatatgcaacaaaacgagttagatcagacactttccttatgtattttgtaaatttgggctgcaaacaatattcacatgtgaaattaatgactaattatttattatttacctttgaattttggtaaaaaaaatattcatcaaacaagtatacaagaaacctactgtgttcctaacattttttacctaataatcaccaatctaaaaagaaactaacaatcaccaacaaccatctgaaaaggctatatagtgtgaacttgtgcttgctaatcaaacttactatcatcatggcgattactttcacgattaaggtggtggtgcttctttccattattttgcctgtgacatcctttgagaaggatcctcttcgtaacaggtatatatgctactctctccattaagttatcttttgatcgaattggcactttaactatgcatgtaaaactagtcaagtttttatgatcattttgcccttaaa

SEQ ID NO: 46044 - DNA, 8927 bp, Oryza sativa
tgccatccttcggacgtttatcgccttcatcactagcacatctagcatgctacaaagacctgtcagtgaagccccagagtcgtggaacatggcgcatctcatcggcagagacggtgacgagacgatgctgtcgatgcgcgacgacaacctctatgttcttgggtttgccaacaggagtggagattggcacgcattcgagaggcacgcccatctttttcgcgaagatgtgacgcccctcaagatcaatgataattatggttctcttctaggagctgggcaccgtggacataaggaccgacctaggatcgcccttggccaacaggccgtgctagatgccatacaagcattatccaactacgatccatcaaccacagatgacaggattctcggagatgccctagcaaccctgatcgttaccctgccagaagcggtacggctcaggaaaatccgtgactggcaactcagaggatggtccacagggacgcatcttaccagtaagctagccgatgaagtagtgaaatggcgagtgatgacatgtggactcctcgttagtcacaggaacaatggctggtggggcggagaggaggcaagggacttgtatggatcgttacgtattgcgaacaaatttggtgcgatggagagagtcggcgtcatgctttggcccgcacgaaggaaatgctcggaggaggtgttggatgaatggcacatcagcaaaatcaggagagatatgatgatggtgcagcaaagaggatgatcgatcgcgcgcttgtgtttttttttctctctcaatgtaatagctgtattaaatctataagtgttttcttatcaatgtaataggtcatatttactctttgcaagtgtttatctcaacgtacgtaataacttgttatgtactgatctaaccatatttaatttatatataagccatatttactctctggaagtatttacaaagaccattcgacttttaaaatataaagtatatatgtccatgtttcttgcatgaattgaacatttattcattttgatcgcacggccggtattgctagactaattaaaaagggtgaattggaaccatgccattgtacttttgcaataatatactcgttcatgctaacgctatgggctggctacggagacatttattctttacctcttaccatgtggtctacaaagaaaatcgctacataaattttaacaaaaaattcaatacattgtcgcatgcataaaataaatcgcaacttttgataagaagaatgatatgccttggacgtcatttcttaaaaaaaattgttaaagcatatatactggctttcatagtcatgtaagaatctacctctaataaataaaattttctggtgaatagattcgggtaataagttcatccgatcctctcaatagaagatagttaatcaagttcttatcagagctgatgggcaatcctcattgttatgacagttgatttttgtacttgacatttcctcaaatcaatcaatgcaacttttctagtacaggtacaaaactttggtccatacacaaacatgaaggctacctgctcatcataggaatatcttcaggaagctcacggttgctctcgcaattctggaatgcattgcatacgccacaggcctccctcttttctgcagctcgtcctcatccttttttttttttttgcatttgcacttttatgctcgttaacttggtttaatataccaaccacccatagtacaatgatcctctgactatgtgtgaccgctaacgtgacgcgctacacaggcaactcatttgcacttagccctgaccagtacattccaacccgaatcctcaaattggctagggtttcgacggtgaggttagcggtgggaggcagcgaggtagctgctatggctgcctagctgatgagattaatggtaagaagcggcacagtccggcaaggtaagcggtggcacggtgcggcctgattaacggcgggaggcaacttacacacttggcatcgcatggattctccaagctcgtcctcgccctacagtcgccggaagaaggtaccattgattaagtgcacgttgtgcaaggataaggccatcgtggagcgtagaccaatggcatattgctaatcggggctacattttctaagaaagaggaaataatgatttggggactttttttttttgggggagggggggattcgggtgtcactatagctacaaggaggtataagcgacgcgctgtgatgtgaagggggctgagcacataagtgttgcttgtgcggcgtgacacgttggcggtcaaacatagtcaaagagcaattggaacgggggtggtacaataaaccaaattcatgaacctaaatatgcaatttttaagttttgggacctaagtaacatcaccctacaagtttaaggaccggctatatatttcactcgatatcttatcactgcttagtactataaaataacatgggataatgggtcaaatgttttcatgatcgtactcatgtaaaatagatgtcctgagttgtgtactgaccgagtaaaaaaatgtgaagtctaaacagcaagcaacaggaacatctgaaaatataaagcgctaatcatctgagctaatcactccttcaagtcttggaacatatcaaatgttaataatgaaaaattcatattcaaagcatcaaaattcagagtgtatgttatacctctatgctgcagaatagaacaaaattaaaagcatagataaaagcagagcgatagtcaagatagtacctaattacctgacctagagagcaatttgaaagaggattggacggtgagtaagaaaaaccatcgctgtggcagaacccctataggtggtacccatcacacataacggagcctgtcatggtggagcaggaagcaacaacaggaggtcgaccttgtacttaaaattagctggggccaaacagaatgtggaagacccataattttaccaaaacaaaatggaaagtggatctgcaacgtatcgcccaatggatctgaaagacagtggtcattaattagcaagaatagtaggattatctttgtaggtttcaattctgatatcaattacatggataaattatgttcagattgtgttatgtgtataatacagggagtagtagttccaattcatttcatgcagggatatttatgtcaacaaaagctttgtagtaattcttaattgttgggttagagaagtcgtctttagaagtaattgatttcaagataaattcagcagcagcgcatcagtagaataaactatcagatgccctattaccccacataatgcatgaaattaaatttctttatttctgagtagcctccagatcataatgaatgcattggacaatatgtgggtttttaagcaatctgaaaatcagttggcccaaacacattggcatacacttaatacttacctatgattgacaagaaaattgattgatgtactgaatggcagattgttccacttgcattgaggcaaaaacctcatgagctttgggcaaagcaaaacagagtacgtgcccaaatagagatgttgctcgtaatcgttcatagctcaagtccaaaccaaatcagacagaatcaggcagaaaaacaatgaacgaagaagatgttgaaactggacaacagaatgaaaggaaggaccttgaggagaggatgcagagacgctgaattcagagctctacctaccacctcgccgctgctccgctcccccggagaactccagtccccgccaatggcgaaggccacaaataaccaccatgcatggcgctggagcgagatgcggccccttcggtgtagccgtcggtgaggtggagcagcgcgatgaggcggttacttcgtggacgggcgttggtcgaggaggggcgtcgtctccgagcgcttgcggtttcaaggtctggagacggcgatctgcgaggaggaggagacggtgtgacgcgggtaggcggcgatgtggggaaggaattggcagcgatagcgacgaatgcggatcggcgactgagggagggagagtgatctgcaaggggttgggggtcggtgcgacgcgtgggaagcgaggtgaggtctcgtcgcgcacgcctcgcgatcgtagtgaaggcggactaggtttccgtgggatgtgatgtgactagtacggtgatttcgggagaggtggtatgatatgagcgctctggttcgttggatctgtaccagaacatctgcaccagattgttgttggtgaaccagataaggaggaaaagacatggttatgaaaagaaaaataataaagttatgctctcacaagcatgagcatgatgttgaaaaaaaatgtagccatgccctctcctaatcaataaggaaggatttttgggagaagaaagtaagcacagaggagaagcattttatttatttttcttcataaaccattttcatcatataccacacacgctgcacgatcttggtcttgatcttgagtgtgtttagttatctgctttagtctgagtttttgacttagtaataaatgtgaatgcaagtatatcatgtttgatctctaccaagatccacatatcaaaccttagagtaggaatcaaaaaggcagaaatggtgaggaattcaaattgatacacttagagagattgagtggatcatttgaggaacttagttttcttttgcaaaatcatttgaaaacttccggaataagaagttgaataaatattgggtgattgatgctctaattgctattctgtctttcaaccgcccaaggcaaggagaagcagtgtctcgtgggaatcaggggtaagggtaagccaccgtgccaaagattatttaacctgagagagagtacatataccttgcacctgtatatttgagatatacagcatagtaacaactcctgatcaacaaccaagtctttgtttcctttcatccttcactcgggatgagcaaaggttcaagcttggggagttttgttaacggtcgttattgatcagttttgaccgtcaatattaccaaaatagaagagaactagtgatgcttgcaatgcatatatatgttagaataataatattccactaatattaggtttactaacctttttgcagagaataacaataaagtggaggagaatcgacatcaacacagacgataaatcaatcggacgaggtcgaaaattagacttatgtatgaatgagccaagaactcagaaatgacacaaccaataaggccaaaattcacaagtctacggaggagagtaataaaggaggccgccagccgacgatgggccagattggcccagcccatggttcggccgaacctcccggggcgccaatggatgaagggtttggatggacggctgggattgagacccaatgacggttggagggtattaccgaccattccaaccgtcataaccgtcattacctgcttataaaaggagctcctcttctcacttcactcacacacctcaagcaaagctctctcatattctctcaagtttagtttagtagtattaagctagtggaataggaataaagtagaaatcaggagtccggaagccttcggaagagttcgggtatggctctagtagtttttctttcctcctttataagctttgtacttttattagaatactcttatatatacatttatggtattgaaatactttctgagtatatgaatgctagctttacattatgttcatgttatactgaatatactgctagcttatctgggagatgctttgatgcgggtataatgtttgcttatgcaattactctatgtcatgaagatgatattagagtagtatctggtagtttagacatgatgtctagattacgagatatcattatttggggttatatgctgcggatgagaggtgagccgctgatggtgacagctcagtacgagtattcctccgcgcgtgtatataatcctaagttaattccctggggagggtactcctccgtatttagccccggttgtatggtcatgacgggctgtcgtaaggaactcggcagtcaggggtggcttctcgaagtaccaggatggcatcggatagagggtattagctagtatatcggataactagaatgtatgtatattatgtttattaaaagtataggagtagattatctttctcttttctttccacatagcttagataatatattatgagaatgagtagctactggttgtgttcactcttgtcgacgtttgatgtcgcgattccggtatttgcatagtatggggatcgttggtactaggatatatgcgagattgaggtaaaagagatggagacagggatttttatacaggttcgggctcctgaattgtcaggtaatagccctacatcctgttggccgaagccggtcgttgctcttattcatcataattacaccagtacaatatttggggtagcctatctaactgttgtcgacttggcggtctgaagtgctgactcatagtcgacaacagggtagtcttcctcctcgaatctatgcccgacgagatcagagatagcgctagattcctctctttggttcccgtgggtaccctatggggttttcctaggcttatctctgatatcgatatccggcggcttgtcttggcgtatgttggcttgtatgttgatcttgcgtcttgatctattgttccgtatcccctctcctcctagggggccttgtatttatacccataggtgtccccttgtccaagtagaactagggaaaccaatttggatacaatccgagtagtacttgtcgtttccatgtagaactccattcatccttccttatgcggaactcctcctatatccgaaggttgtttccgtataagacatggtatgtggtgggtcctgccaagatttagtcaactactactaggtatgtggtatccataaccctgacaactctacccttggattatcttaacccctgcttaggatattattatcacaagtaacatataaattattagtcaagttctctctacatgatcttcccacaggataaaataaatacgatacccttggaatactctcaggtgaaatgctacaatggtatatccgtgcgcttgcggatgaactctgtaaccataatataccagaagtatttctgcgtcattgctgggaattatatttttagtaatgtcgttaagaaataccaacagatagtcttagccttagatagattacacacgttccctaagttcgatatccttttggggtcacccgaaggtgaagtgctacagtggtattccgtgcgcttgcggatttatctgtggtcgtaaaaaatacccaaactcttgagacacaccccctccactatcggatcgaggacgagtggatagcgacctgggtgggggaggtggtcgaggtggtcggatcgatcgaatgtgatcgaggtcttagaccaccgtagatattgcggtgtgtcagagattgcgttaacttatgcttgcgtcgggactcgtatgcatcggggcagccgtagatatggttgagctcggcgtgagggctcgagaagcttgtgacttggtcttgtccccgtcttgagagggatcgtgtgttcttcctcctgagccactcttgtcggccaattgctgggcatactgtttgagtagccagcattgcttagcggagtgcttgagctcggggtggtataggcatggaccgtccatcatcctgtcgaagtcgtctttcttgggttggcggaacttgcgctgggcgttgctgcgcccgatggtgttgactttatcatcactcttgcacttgggtggcctactacgggaggagttgctttctcgacgcggctggtacgaaggcctcctcttgatttgggcgtagactgctagctcggagttggcgtccttgttggcgtggtcgaacatctgtcggacggtgagagcggcgcaccctccgagtgacgtcttgcaggcccaccacttgatgaagtcttcgttcttgcagccttgttggaaggcggccatcacctctgtgtcggtgacgtgtgggatggtgttgcaccgttccgtgaagcagcgaatgtagtcggagaagcattcgttgtggccttggacaattcggtagaggtcccactgggtgcccgggtgagggaaagtgccttgaaagttggcgatgaactgtcccttcagctcggcccagctgttgatggtgtaccttggtagccctgtcagccatgctcgggcgacggtggtcagcatgaccggcaggtagttcgctatgaccacctggtcgcccccggtagcttgaatggcgatggagtagacggcgagccatgcgttggggtcggtcttgccatcgtatttgtcgatgcctatgggtttgaagttggctagccagcggactcggcataggttgtcggtgaaggccggtatgccctcagcgccgtcgtcgcggtgtgggatgtggtctggtgagtggtcgtggtagtattggtaaggtcgatggacgacgatgcggccgtccggctggacgtctgtgtgacgacggctagcgtcgaagtcgtcctcgtgaatccgcaacctttcagcgtcacgaagtcggcaatgctcgttcatgacgttacggaggtcggcgtttagccggcgcccggcttcgatcttgtctcttaggtcgctggtgcgtagactggggtgtgaactccccgcttgggacgccttgacgcgcttcaactcaaaggctggttgtcgggactgtctcttgccggaggaaccgccggcagttgaagtcgttggcagtgcatcagcgtgttgaacagcggtggcttccaccatagccttcacttgggcgatggtggtgttcacggccgggtcgactgggaccggcatgttgtcgaggagggccttggcggcgatcatgttgttctacggcgtggtgaagacgccgtgttctcctagcttcacttggaggatagcgtcttg

SEQ ID NO: 46045 - DNA, 5169 bp, Oryza sativa
ctgcagcccgcctgactggcccggtgacccctgggctcacctgacggagtttgccggcgctgtcgacgaggaagtcaaatgcgccgaaggagatttgggtggtggcggggaaagtggtggtgctggcgatctcaaacccagtgggtgccatctccgccttgaaaacgatcaagcgccccctacctggcgcgccaactgtcgatttctatgatcggcaatatattttatggggtgcgctagatcaaggagagatggtgacgcaggtgtttatcctggttcaggccctcgagatgaggtaataccctacgtccagtgtgctttttctctgtattcgtggaaagaaaatgaatcgagaagcccaaaggatttcggaaggacgccggcctctttatacaatctcaggccgccggcgccaatcaagaccccgtatcctcacaatttggatacttgccttctattacatgattggggatctgttactataatctccctgtcttgcccaactatgttagacttactatatcggtcatgggcccttggcccacccccgaagcctaacttgggccgctaccgtgaggtacccgggtgccgtatcccccacagccggtcccactaacttccatctaaactaggggtaaacgcctctttcggttcaaaaaagtgtgggcaaaaaaacgaaaaccctaaaaagtaggggtgtaatcaatattggacatgaaagtgagaaaaaaacgaaattgtccagttatggttgaaaaaaagagcaagggcatttgtccatccgtgttaaattatttttgtatctacacgaaaactaaatgttactcgtaggcattattacttgtatcgtgcattggatggctagctaggagtatgtcttttttggaagtaatgtgggaatttccggttaatgtggaaatttttaactattttacctctttagatttattcttcatgcagcagagccccaattagtacaagtataaatattgtgaaaattctaaataatattcctctacagtatcaaatttaatgtataaaaaggactgaaaatgtacctttattcacagtggtctttttagatttctttgtgtgtaaataaaattaagggatttattaagtgtcactctaaagttaaatcccgtatttgtggaatattgccttgattttgttctaagagcgggcgttaatttgtagaagagaagattatgaaaacttgatatgctgggtgatttgatcaaatacaattccttattcagtgctttccctaaaaaaaatataattccttattttagatgaaaaattaaggaacctcttatgccaattacacggaggggccatctaaggttagagatgatacgtaggccatgagggtaaagcctcaacctttcatctagagggaggttataggataacatttttctttatgggagaaatggaagcgttaaggaacatcaggaaatatgtgaaagatgtttcttgatttcaaagtgatatcagaagagaaacaacacaaagggactatatacaacttcttttagataatgagaacttttattgaagtcggtcaattacatcaaagtatacaattatcatgagaacactgcgagtcggatatatatatatatatataactatatcccattagagagctctccaatccagcaaggcgtatacacgaacgaccgattaacgccttcgacgtgccaatggtcgaaaaaattggggcgtaacctacctaagtcttgagccttagaggtacccaagtgataagccaatcctctgcttgatccttcatctagaaagataacttctttgtaaggatgaaatccaaggattaaaaaaccaccatgagaagacctttgaaccctatcctccaagtcgagaacatcatcgctgtcagagtcccactcgaacttcctttccgctacttctgcattgtaattagtgtcatctccatcataaacatcacggcggctgtagtgtaaagtccatggtccgacactttcctcatcgtagttccagcgctgaaacgagagttgaatttccttgtcgtatttcagttcccacttcatctgctcacatgattcgttgagaatccaaacccgtagatggcaccgatcaagtactgcgaggtacacgcccttctccgatcttgcaagaaaaggatccacatatccatcttgcgctataggcaatttaattacttgatacttacttttcgacggagaaattctgcaaaatggatcaaagtagtaagcaaaaacagctgagaacatattaccctaaatataaatgatattattatatataataaacaaaaatgattaaggactagttagttctagtacctcataacaaaattagcttccctatgtacgtagagtgcacgtttccaatagaccgcgttgtactgttccaatagcggttgcgatctcatatccgcgatcgtcccggcggcctcaccttcacgtacaaaggatctctcttcccattgccctgtgctcgacgagaacacactcaagaagcaaggagagggtggccactctgattcctcaacctttggcctcagttttttggacacaaattcctcgggagtaacactcgggatcaggaacacctcgtagtgcggagatacggtgggatcgaacacgaggtactcgtcatgatagaagctcctcgtgatcccgggccgaggtggcgggggttcagggaaggccgcccaccgctgcgtggccgggttgaccacgtagcggctgcggagcaggagcaggccgttgcagtgatccacgacggtgctcctggcggcggagggggtgaagtcctcgaacttgccggagatcgccgcggcagggggccgcgcggacgggcggcggaggaagaaggacgtcaacacctcgtggaagttgatgaagatgccccccagtgacagcgggaggaggtccgcgcgcagcaagcggtggccgtcgacgacggcccgccagggcttgcagacgcagcggcacgcggctagtgggcgcggcgcgaggcggcggaggatgtcggcgagcacgtcgtcgggtagtaggtctaccatgttcagtttcggatcctccggctgctccatctctctctgctttaatttgctgttaactcaatgctcggccgtgtactgctcttgggttgatttatggaggatgggtggcatccgatccgattccgtcttggttaacaactcgagtccgagtccgagtcggagtcggagtcggagtcggaacgagcacgcgcggcgcggcggcaggttcaagctccgatagagtaacgcatgcatcgaattctttcgtctgtaacactagaattttgtgtccaagttctgcacaagtttcagtcatgcattggaatgggaatcaataatttgatagtaggagatgagagcagcataattagctacctacggtgtgcagccatggatccttttgggtgcaggattcttcaactgagaactacatccaagatgcaaaattactgtgtgtgatagatatcgttttgagcggcatctccgcatctgaactctgaaatttaattattcagtatgactcaattttttgtagagatattcgtgaaagcaaaagaaggctttctttactgattagattactagtgttatgaatcctcgataatgtagtagagatcacacatgaatcactgctttcttcaaattggttcgcgtggatctgtaccggtcttagaggctgtttggttggttgccacactttagccatgccatagttttttagcaatgtatttggttcgctgccgcaattgtgttatgccacactttcttaacattggaacccacatgtcatgctctcaaatttagagctaaatatgccacacttatggccaactatttctaaaccacatttgtgccaccatgccacaactaacataaacttagttatggcaaggttagacatcaaccaaacattcccttacttcagatgaaaaaaacctctatagccgacgagaaaggcactagaagtagcaggcaaacaaggaggcggcgggtggcaacctgtagcgcgaggaggcttaccacaccgtcgcaggcgctccctagggcacttgagataaaagggattttccgcattcgaatttgctaatctggctcacgcaattcacgcagctccggtacagtgattcaatgtttcagtgattgattttttctgtttagttctcaaaataaaaatttttacccggtcatattgaatgtttaaacacatacatggagtattaaaagtagaaaaacaaacaaacatatttcgctaggaaattacgagacgaatcttttaaacctaattacgccatgatttgacaatgtggtgctacagtaaatatttgctaatgacgaattaattaggcttaataatttcgtctcgcagtttcctggtagaatctgtaatttattttgttattatacaagatttaatactttgaatgtgtgtctgtatatcctatgtgatacttaaaaaaaaattaggaactaaaccggtcttaatgtttcacccgacatttgatcactcgattatttttaaggaaatcggacgtctgatttggagctctatcctctctcgaggaggctatgggctccgcgctggtcactaagatcgtggaccattccgaataacctccacacccggtcgcgattctcaacggtttgtacctggacactatctatctacattttattttgtaaataaaactcagtaattactattgattcaatttaaatgttattaattattataaataaaaaatggggcattgaagcatctaggcccccggtgttaattttggtaattaatgacaagcactaattgtggactaaccgttgtctttgagctatacattttaagttaggtccacgtcatatgtgcgcatggatgattatcgatggattaaaattgacggcgcaaagcaaagggaaagaagacggtaaaactaacgctttaatttagaattgatcgaggtgtagggcgatcaaatttgctagtttaattttagtttcgctgtactattaagaggggtaatgacctagcaaagagatgattttaattgccacattaggtcattgcattttcatttgtgctctctttttcgttacacacacattcactaattcactgggtt

SEQ ID NO: 46046 - DNA, 2996 bp, Oryza sativa
cccggcaccggtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttacatttctagagacacacttgagatcatatcaccctaggattgcaaaacattgacataggagcgtgatttactttcctagagatataattgagccactatcaccctaggtttgcaaaacataacttagttgcttagttagagttcaccctcaccaagcctagcaacttaggttagatttaattaggtgttatttagttttaaatcgcctattcaaccccccctctagtcgacatctcgatcctacaagtggtatcagagcttggtctctcttgattgggtttcaccgcctagagagaagatgtcgaacgaggtgaaccatgtagggaaggctcccatgtttaatggcacaaactattccacttggaaaattaaaatgtctactcacctcaaagctatgagcttccatatttggagtattgtggatgtaggctttgccatcaccggcacacccttgacggagattgatcaccgcaacctccaaccaatgcccaagccatgaatgccttgttcaactctttgagctaagaggagttcgatagagtgagcaaccttgagaccgcatatgagatttggaacaagttggcggagatccatgagggtccaagtgagtacaaggatgccaagcttcatttcctcaagatccaatataagacattctccatgttgcctcatgagagtgtgaatgacatgtatgggaagctcaatgtcattgtgaatgatctcaaggggcttggggcaaactacaccgatcttgaggttgcccaaaagatgcttagagccctaccggagaagtatgagacccttgtcaccatgctcatcaactccgacatgtcaagaatgacacccgcaagcctcttggggaagatcaacaccaatgacatgtacaagctgaagaagaaggagatggaggaagcctcaccctccaagaagtgcattgctctccaagccgaagttgaagacaagagcaagagcaaggtgaatgaagtcaatgaggacttggaggaagagatggtccttcttgctagaaggttcaatgatctcttaggaaggagaaaggagagaggaaggggctccaactccaataggagaagaaatagaagacccaacaagactctctccaacttgaggtgttttgagtgtggtgagaagggacactttgcttccaagtgcccttccaaggatgatgatggagacaagtcatccaagaagaagagtggaggctacaagctcatgaagaagcttaagaaggaagggaagaagattgaggctttcatcggggaatgggactcaaatgaggagagctccgcctcatccgggtccgaggaagaaggtggtgatgatgcaagctccaagaagaagaagatggccgttgttgccatcaagaaggctccatcactcttcgctccactttgtctcatggcaaagggctcctctaaggtaacatctcttagtgatagtgagagtgatgatgattgtgatgatgtttcctatgatgagcttgtgagtatgtttgaggagctccatgcttatagtgagaaggagattgtcaagttcaaggccctaaagaaggatcatgcttctttgaaggtcttgtatgaggagctaaagacctctcatgagagactcaccatttctcatgagaagtttaaggaagctcatgacaacctcctttccactactcaacatggagctcacattaatgttggcatatcttgtgatttgcttgatgatagtgctacttgccatattgctcatgttgcatcatctagcatttctacctcttgtgatgatcttatggatatgcctagcccttgctctagttctagctcttgtgtttctatttgtgatgcctcacttgctgttgagaacaatgagcttaaggagcaagtggctaagctcaacaagagtttggagagatgcttcaagggtaagaacactcttgacaagattttgagtgagcaacggtgcatccttaacaaggagggacttggattcattccaaagaagggtaagaaaccttctcaccatgccactcgttttgtcaagagaaatggtaagtattgctccaagtgtcgtgaggttgggcatttggtgagtgattgccccggaggtaagcctcctaagacatgcatgtttgattctcattatatgcttacaaaggctcatgatggtagcattgttgctagatatgtgggtttccctatactcggtggtaaaaacaatgccatttggatgcccaaagctttggtctctaacctccaaggacccaaacaagtttgggtacctaaaagaacttgatcttcttttgtaggtgaactaccggaccgatgggagccattgggtgcttgatagtggatgcactcaacacatgatcggtgatagggctatgttcaccacatttgaagtaggagggaatgaacaagagaaagtgacatttggagacaatagcaaaggaaaggtaattgggttaggtaaaattgctatctctaatgatttgtcaattgaaaatgtctctcttattaaatctctaaatttcaatttgctttcggttgctcaaatttgtgatcttggcttgtcatgtgccttcttcccacaagaagtcattgtttctagccttcttgacaagtcttgtgtgttcaaaggttttagatatggaaatctttatttggttgatttcaattctagtgaagcaaatttgaaaacttgtttagttgtaaaaact

SEQ ID NO: 46047 - DNA, 1390 bp, Oryza sativa
ctgcaccccgagctcttgcatatggatttgtttggcccaacaacctataagagcattggtggtaatagtcattgccttgtgattgttgatgattattctcgctatacttaggtgttctttttgcatgataagtctattgttgccgagcttttcaaaaagtttgcaaaaagggcccaaaatgaatttagttgcactcttgtgaaaattagaagtgacaatggttccgaatttaagaataccaatatcgaggactattgtgatgatcttggtatcaaacacgaactttccgctacctactcacctcaacaaaatgctgtagtggaaaggaaaaatcgtacattgattgagatggcaaggactatgctagatgaatatggtgtttccgattccttttgggcggaagccataaacaccgcttgccatgcaactaataggctttatttgcatcgtctcttgaaaaagacttcctatgagctaattgttgggaggaagccaaatgtcgcctattttcgagtttttggttgcaagtgttatatttaccgaaagggtgttagactaaccaaatttgaaagttggtgtgataaagggtttcttctaagttatgcctcaaatagcaaggcataccgggtctacaacaagaacaaatgtattgtggaagaaaccgccaatgttcaatttgatgagactaatggctcccaagaggggcacgagaatttggatgatgtaggtgatgaaggcttgatgagagctatgaagaacatttctattggagatgtcaagcctattgaagtggaagacaagccatccacctccactcaagatgagccatctacttccgcctcgccaagtcaagctcaagttgaagtggaggaggagaaggcacaagatccacctatgcctccaagaatacacaccgctctttccaaggatcacccaattgaccaagtgttgggtgacattagtaagggcgttcaaactcgatctcgtgtcgcttcgatttgtgaacattactcgtttgtttcttgtcttgagccaaaacatgtagatgaagctcattgtgatccggattggatgaatgctatgcatgaagagctcaacaactttgcaagaaacaaggtgtggactttggttgaaagacctagagaccacaatgtcatagggacaaagtggatctttaggaacaaacaagatgagaacggattggtggtgagaaacaaggcaaggttggtggcgcaacgtttcacacaagttgaaggtttggactttggtgaaacttttgcccccgtggcaagacttgaggctattcgcatccttcttgcttttgcatcatgctttgatataaaactatttcaaatggatgtgaaaagtgcttttctaaatggtgaaattg

SEQ ID NO: 46048 - DNA, 1991 bp, Oryza sativa
ttaccttaccgcatctaggccggatatcatgtttagtgtttgcatgtgtgcacggtttcaagccgctcctaaggagtgtcacttagtggccgtgaaaaggattctaagatatttaaagcattcctctactattggcttgtgatacccaaaaggtgctaaatttaagcttgttggctattccgattcggattatgccggttgcaaagtggatagaaagagcacatccggtagttgccaaatgcttggtagatcccttgtgtcatggtcatccaagaaacaaaactccgtagccctctctaccgccaaggcggaatatgtttcggcgggtagttgttgtgcccaattgctttggatgaaacaaaccttgttggactatggcatattcttcaccaaaaccccactcctatgtgataatgatagtgttataaaaatagccaataacccggttcaacattctagaaccaagcatattgacattcgccatcacttcctaagagaccatgttaccaagtgtgacatagtcattagccacataagaaccaaggatcaactagccgacatttttaccaagcctcttgataaaacccgcttttgcaagttgagtaatgagttaaatgtcatagacttctctaatgtggcttgagatagtgcaccatggttgcttcttttgcatattgtatatttgctcctatttgctcttatgctttggacttattgccatttggttcttcattgagaaaatggaacatgtcacattaagggggagttttggactcttccatgtgctctacttccttttatatgtgagaaaatcaactaaaagtgctagtagtgttttcaaaatgcccaagtcaacataagtcaaaacttttgcaaaatcaatgaaatttgaaaactatctcttggaaaatgtttcaaaagggtccctatatgttttccaagcctcacattgctagaaaaatgatttttgaatgaaaaatgccattttggctctcttttgaagaatctagattcttgtttttggccaaaatgagattaaaccccaaaatgagtttgagaaggaatctgagaaaagattcaaaacaaagttggtagagaggaggatttgaaatgtttttggtattcaaatcatattcaaaaaccaaatatttcaaaagttgtttgaaaatcaaattcgcccaaaaacccctatagaccataaaaggccacctcctagcactcaagtgagttttgttgcaaatcttcataaatttcaaatattatgaatggttggcaatatttcaactcacacatttcaaaattgctccaaaaatcaaaattttgttgaattttattgagtgggggcagccaactgtgcaagggctatgcacagtcggctgggtggccaggcggtctgaccggcgctatatgcgcggtctgaccggcctggtggcagcggtctgactggcggcaacccggcggtctgactggccggggatggtgggcctaagaccttgtcctttcttcctcctcctccttctacccgacccctcctcatcccatctcatctcttctcttctccaactcgaaaaaactcctcctctctcttttcccaaaccctagccacctccctccaccaaatccatccggttcaaccgtcaaaatcactccggttacaccgtaagtgaatctcctcctcttcctctctctattccatggatttgtttgagttttattgagtttgtgatccatggcttggaaccctaggtgaaggaagaggtgttcttaggttttcaccaatagagggtagtttcttggtgtgattcaactccttcaaccggtaaatcactctccctcttgtgcattctctcaaatcggtctatttcaattcttgggttaagggtagtttccccctttgcttcaatctctatgaaatagacctacaccttgatattcatgttccaatcttgtgcaactttgtcctagcaatttttttaaatcatttgtgtgga

SEQ ID NO: 46049 - DNA, 5354 bp, Oryza sativa
tactgtcagtggcggtctgaccggccgagagcctgcggtctgaccggccgaggaccgtcggtctgaccggccgtgagccgttggtctgaccgacttggggcttgcggtctgaccggccttggctctcggtctgaccgcccctgacagacagcactcctccttctcccacttcactatgtggcttctaaaattgttgcttatccatcctttgctccttgtttttcagctacgcctccccgcactcgccatggtcgtcgtgagcccacgcccgatcccgtcagtgagaatgaggaatcaagcggagatgagtatgttcaaagtgatgatgacaatatggaaaatgttgagggtgatgagatggaaataagtgatgatggtgatgacaatgagagtgtaaatggtgaagatgatgaggcaagtgatgatgggagtcctctcgattcctccatccaatttgtgtttaatttgaggaatgctcaacaatacactatcctccgtcatcatgatcaattccggaggcctaacgattgtaatgatccaagatttcatacacggttccaaaagtccgtgtatgcacaagtgtatgccaacaaagccttcgccgaacacaagtggatttcttggaggcacattggtgagacaccggagtttgagaatttgcaagagatgttccggaccgttgggattgatagaattgtcaccatgaagcaaccttttgatgaagatctcatccggcaattctatgccaccgtatgggtgtccggcgattgtgatgcaatgaagtggatgtcggggaccctccgatgctctatcaactgccgtgaattcaaggagttcttgcacattcgcttcaacaacggggatgaccttcatgatgagcacacccacaaccccttccccattgatcacttttctcagttttatgaagaagggggaaggcacacatatggcaaggtggcgggtttgagggctctcccaagtgtgatcaacagcatagtaagggccaccatcctcccaagatgcggcaacaatgatgacatacgcggagttgcttggcatgttattgatgccattatggatggtcgtcggtttgatgttatcaaccttatgatgaaggagattgtcatctcaaaggggactcttggacaaggaatctattatgctccatacataatgaggttgattcaaagcaagttgggacaaattggtcacaatttaaaaaaacataaggagtacaagcctcgtctccaactctcctcccctagagctcctcgtgtgcgccaaccaacattcgatcaaggtgcaagctcaagtgcagccccccctcctcctcaagggtatgatccaagtgcttttttccatccacaatatgcctactttggaatgcaacccaatgacttcttcaacccggtccttggggctattaataccctaagtgaaagcattcaacgcttatccactgggcatgaagcattgcatgaggatgttcgtggcttgcgcaccgatgttggcaacttgaatacttcggtgggaagattgcatactagggtgggtgtattggattctcgagtcccgccttagagagtacccaagcttttgtctatcatcgccgccgtgatgcttctcatccttccacttcggcgcgtcctccttctcctccacaagagtgaagacctttttggtgcttgatgccaaaagggggagaatagtgtgttctatgttttgtgggttgggactagtagtagtgaggttagtcacctcatttttaataggttaaggaggattgggctatatttggtatgggtatgggctattactctatattgtgtgttcctttttcgttttgttgttctctatgtcatttggacccttcgtggtcttgtaatagcctatatttatttgtgagccctttatgtggtcttaatgtgaacttgtgctatgatggatgattggtgtgacattgatatatttgtgaccatcttatgctcatggatgaatatttcttgaagttcacattgagatattgctcttgtgtttgtgatatgttgaaatgtgaaattgaattgtgcattggctccatatttgctatttgtgattgttatgcatatgtttagggggagcttttgcttgtcaatacaacatatgtccatgtgctctatgtttgattatatatatttgtggtgtttgtcatcaattaccaaaaagggggagattgaagcatctaggcccccggtgttaattttggtaattaatgacaagcactaattgtggactaaccgttgtctttgagctatacattttaagttaggtccacgtcatatgtgcgcatggataattatcgatggattaaaattgacggcgcaaagcaaagggaaagaagacggtaaaactagcgctttaatttagaattgatcgaggtgtagggcgatcaaatttgctagtttaattttagtttcgccgtactattaagaggggtaatgacctagcaaagagatgattttaattgccacattaggtcattgcattttcatttgtgctctctttttcgttacacacacattcactaattcactgggtttgtcctgaccaggggcggtcacaccggccacatagtggctgtctgaccggcgtgccctggccggtcagaccggctacatagtggcggtctgaccggcaccactttcccggtcagaccggccccctggaggccgagatgatgctgctcgggatggccgatacagagccgacggagccgtagtcggtcagaccgagccgatggcggtctgaccgagccgaggccagtctgaccgagccgaggccggtctgaacggccgccccatgtcggtctgaccggccaggccgatggggccctctgacagggctacaacggctagttttctagccgttgcagagtagcacggtctgaccggccacatacctccggtcagaccggcagagcacaaagttgggggatttcacccccaacggctagttttggtgggtgggagtataaatactcccccaccagcagcaagggggctctcttggcacccaattcaattgcatacactccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttactcttggaggttgccgcttcctagacggcttgtggaggagttgcccggtgacctctccgagaagattgtggaggaggcccggcgccggtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcacctcaacggggagtaggaaaccggcgagtttccgaacctcggtgaaaaatctcttgtctcattgtctcatttgattgtcgcatttacatttgtgcaatttacatttctagagacacacttgagatcatatcaccctaggattgcaaaacattgacataggagcgtgatttacttttctagagatataattgagccactatcaccctaggtttgctaaacataacttagttgcttagttagagttcactctcaccaagcctagcaacttaggttagatttgattaggtgttatttagttttaaatcgcctattcaccccccctctagtcgatatctcgatcctacaggcatacggctaataaaccatggagaaaatgaatggtgtaaaccaaagcaatttattttcataatgattcaaagttaacactagtaaaaaataagctatgataaaaaaaacatctcaaatcaattttaaaccgttaggtatcttagctaaggtggataaggctacgttcatttggaatggttgggatatttttctccatgcaggcaaaacaatgcgaattattagcacatgactaattaagtttaacttaaaaaattagaaattaaattaattaatatgtttttctctagcaatttttcaatttttatagagaaatgtagtatcgtttaacagtttggaaagcgtggtagagaacgagagagtaaaagctaaaaaaaatagagaaacaaattcttaaagcaagtttaatagtatgctataaacttatatatggaggagaggaaaaaaaagagaaaagtattagctatcatgtaagagcccgctctttacatggttaatataatgtactagctatcatgtgaagaagcgatagaaaaagaaaattaaagataaccttataactcatatatttatataatttagttttaatattaaacttatatctagttgattctaaactactcctttcgtttcatgttataagttgtttgattttcttcctagtaaaaaattatcaagtttgatcaaattagtttcaaactttatcaaacttaaaattgaatatatttcgataatatatttgttttgtgttaaaagtattattatgagttggtttggtttgtggcctaaataggccttaccaaatttttgtcagtgccaaattttggtaagttttggcatgactaattttggtaaggcaaagttgtgtttggattgaagtcaaaatagcctaaattcactattgaaatggcctattttcttaggcatgccaaaatttggcttcaaactaaatagacactaaacactattgaaattgccaaatattggtaagcctaatttaggcctaaaaccaaaccagtcctatattttctataaattttataaaatttaaaagaagtttaattaaaaaaagttaaaacaacttgtattatgaaatgaaggaaatactactacctccgttttagtttacaagacgttttgattttgatcaaagtcaaactataatatttataataccaaattagtttcattaaatcaataattaaatatatttttataataaatttgttttgggttgaaaatattttttttctataaatttagttaaacttgaagcagtttaatttttgatcaaaattaaaacgtcgtacaactgaaacagatagcgtgtcttaacagtttgacgagaatggttgatatgccctgaaatggtcctccaagtgagtgacagtaattccacgctcgcacgcacgcatgggcggtggtgctggtggtgtgtattcactgtttaggcctcagaccgaccatccgaaatccccgattgtaattaaagcatgccacgctagcacctccatatgatccatctaccccccttcataaat

SEQ ID NO: 46050 - DNA, 12450 bp, Oryza sativa
cgatccccccccccccccgcgccccacctccctctctcggctcggtttgtttgtttgtttgtttgtttgttgcttttccctgtcatgtggcgtgtgcgtatcggtggagggggggaggtgaggctgctgctctgattcgttgtttgatctcgtgtgggagtggatctgagctgaggatgaggatccgatcgattcgatgagcgtttgcgctatcggaatagaatagaggcttctccatcgttgcaatgtaatggatcgaagttcatcagacaattatagtatcgtgttcctaaaaaaaattgaggaataatctattcattggtctacgaaacaaagtacataggctgtaattacgagtgagtgtttttttttcataaagagcaaaatttattgttgctgggacttttatctggaattgttagcactcagcagaagcaactgcatacccttacaattgaactaaggtagcactgattccgttagaaaccaccaatttggtttgaggagaacggagctcattttatgcttggttaatgcgcttacgggaactggggatagtgcttgcactgggtttgcagaccattgtttcatcaaactaacccagtgctatttgcagaaaccaaatggataataatggatcatcgtttggcatatttagtaccagagcacttccgatgcatttcttcgtattaatgcgatatacagtttgcttgcttttacactttctgggtttgtttctaatctcataaaaaaatatgcatgatattagttggagtgctatgggatcagcagcttttagtttcagaatttttctacctgctacccttagtcaaggctagctcaacacaatttatgatatgtggtgcggtgctgatttcatgagcatcatgcccattcttcatttgccatgttggatggtagatacaaattttagttttgtttacgtgttctttctttttcagccagcgagaaattccatcgtcaaacattgacttacattcggcacactgcgcacgtaaccttcaaaagtgtgaacactgtggagaaatggtggccagaaagcttatggacgagcactacaatgaaagccatgctccagtatgttcaaaacctcatcataaatcttgagttttgggctttcaaaacattataccatacttgtgatttgcttgggatgcttccatttcagtgctatctgtttatttatcttaggactcagttgagcaatatgttggcacttgacagttgactgcaccaattaggactttcttttgtggtactcttagaaagttgtattacttgatgcaattcgagggatgtgattaaacctttttttagtttaaaaggggaatatagcctatttctctgttacataatcaaaactgaaataggttttgacagtggcccatgttctggattccctttctgaaaaagaaaaacagagagagaagatccctgcacatctggcatctcctctgtaactctgttagtgggacctgcagttgtcattaactcctgaaaaatacggcttccactatctcatggcacaattctccatgaatgaacgtgcaaaatttaatgtatacatagttacataccaaattgcttaccattggtcattggcgtgaaaacttagttactagccaaatgcctgtgcgctgcaaaggtaacaatctcccaaccaacataaaagaactaatttcaaagtgcactgtaattttctaatatttaattataatcaagagagtatttctatagtagagtaaccctggagtttttttgtagttgtgcatctacaactccagttacatgttggagtttcatagtaacttctgggtactctctacatgttggatcaaagggtggttctgttattccatctcatattttccagctacatggtagcttcgagcttcataggtagaagaggtggatagatggagtagtttttggtaatgtgtagactcggattcaccgtcaccactacactcttttaaagtagtaaagatgaacatgagattgcctgcgctattgaatatatcactgccatagttggatgatgagatctccaacctataatttaattgatcattttaggtacatatttactcttcacaataagctttaatattcttaaactctttccgtagaggggttactggtttttgaagcaagcaaagcatgcagcaataataataactaaatgtgtgaggcttacagttataaacaagaacaattttcgttccatagctaccaaaatcatgccatgaggccacatgttcaattgcatgaactgaactgcattatgcctgcgactttaggatcgctgtggaacgacacctgaactgcacgaattggccaaatcagtgaccctatacaccaaggggcagagagtaggggaagggaagagggagcacgaactgtagctacagccgttgctttttgtgtcaatatgtctgtctccaccataatttcttcacatgttgctcgctgaagccactgttgtctctttgctatttgaagccaccacaccaaggatatgaggcatcagcagcgtttcctggattgtatccagagtctcattacaaaggaaaagaaagggaagggtagagcaagagggaagcactgtggcatgctggttgatggtgggacagtgtggctttttttgtggaataactaattgcacaccacaaaccccatacaccatggttgtggttgctatgcttcatccaaccatcatcagcctgtaaactttttgttgtacgtacaaattggatacacgttctgttatgtttgccaaatgcatgatatttttgcgtaccaactgaaaccaggaactaatgccacattacaattccatatacaatagtaagaatattagaatttacatgttccatgatctatagagcaattgtattttttcggcaatgtatgatcactctaatcatgttacatacaggtaaattgcactctttgcaaggaaattgtaacacgcgagatctgggatcttcataaaagtgaacagtgcccacaaaggattgttgcatgtgaatattgtgagtttgagttgcctgcggttgagcttcatgaacatcaggtgctgttttgttgtttgccttgaaacaatctctctcttttttttttactaacagtatgcccgtgccttcgatttataacaagtaatatactataagatctagagctaattgcaaaaataattgcccttaattctgaaaattatacacaagactatatggcatcaaccaaataccttataatacacacaatatgtaaggaatacatctttttttttaagtcgtagatatatgttttaatcgtactagtttgagatgcaggatgtatgcggaaaccgaacagaattttgtcaaacatgcaagaagtatgttagactacgtgaatggattgggcatgaaatacagtgtcatgcaaatgcaaatgcaaatgcttctgcacagacatcaaggtaaaatcttaggcgtttctcttaacacatgctgattttttatcgttaatgtaaccttggtatgatgtaatgtataattcttatcattttaatacgagagttgcatacttctttgactgttcattttcagtgaaggtagattttctcaagctaaattattgcaatctattatatgcaaattatatacacttagcatttgagccttgatccctgcattctttagtcaatgtaggtcagattcattcaataattcaattagatgtttcccacttctttcaagatgataatgtgtatcagagtaatggaactggtgctttgtatcctgatgattcttgtttatacctttcatgattagcaagatgttactagcaattttactagtccaaatgtgaagtactacaaatcttgtactgataagatgcttcaaatttcagtgcccgaatcattccagagagagaagtgcgtcctcctccaccagtaagaccgccacggcctatgcatggtgcacagcacaagcgtctgctcttcacaattgcggtgactggaatcgcagttatgattggttcgatactttttcagagggaggagagtttctaagtccagtgtctatggtctctccccatcgagttgattccaacagcaacagcataaagagttaccttgatgtataatttacccctcataatcagtctataaaatcactttgtttgtttgatagtacagtccctggcatggctttgttaaaagaattgaaataaccatgaagatgcccattattctcagtggtatatcaagacctttgaagcaatttctattttgagttcaaagggtaatttagttcagttgaactggcaatttgtcgctcctatgttgtagcggcagaggggtcctccatgctacagggctattgctagtacttttcaaaaaaaaaaaaccttttaatttaaacttttaaaaataaaacttctgaaacttaatttaaaaagatcttttggtcaaattggtgccacgcccatggtttttaacggcatggcagcatccttttaccatggcaaaaggttgccatctggatgcaagttttgagagaatttattttaaaaaaagtttaaaaaatattgtcatctctctctactgtttgttcatatcttcgaaagataataatactagcttgcaaattaaaataaagaaaaacagtttgcaaaacatattatagccccatcgtttcgcttcaagatgattgtaggcactaacatttattaatgataaaaactaatttgtgagtcaaaattttatatatgtgttgttaatgacttaaaagttaatgaaaaaaataaaccgtaataaaaaaaccaaaatggactttaaatatttaaattttggttacggcagataagctgaagaaacaatgaagctataaaatatctaaattaattctagtaaattatcatagctaactgtaacgccaaacaaaaccgtggcaaaagtacggttttgaggatgcacagtcctatttgggatacattgcaagggcctaaaaagcctaaaaataggacatgattcaatttttttaaaaaaaacaattaattgtttttttctgaatttttttaaccaacccacttgatttttttttctagttttattgagaatgggtggttgtgtgtacttgtgtccataatttgacaggaaaaaggagagaacaaaccgtgtttttataataatagagatattatttttacaaacaatataactgtactaaattatttttgccgtgtgataaacaccgaacacgacgcgaccaaaccgtactaaattgccttaccaaaccgtacaaggaagggcattattattcagctcgcatttgcatccgtatagttggcatgtagtcccattgccagagctacacgcgggtccaagaccaaaaaaacaagatggacccagaactcattcatggcattcttgccgggacaattttttttgtagtacctcggatggatgcatcgatcagcgaattaacgctgatgatcagtacgccgcagttactacgtcgtaactgaaacgggtaattaacctcagctatgatctcctatactactccctccgtttcacaatataagtcattctaacatttctcatatttatattgatgctagattcattaacatcaatataaatgtagaaaatgctaaaataacttacattgtgaaacaggtgaagtacaaaataagctaatatggtggctgcatccttgtcctccctggatactatggataggtcgagattaatggcaccatgtgatgcacttgccgattgacatgtactagtactaagtgcatgtagaaataaaattttactgaaacattatagaagttaattagatgttaatgccctctctttctctctgtgtgtgtgagagagacattaagatccaggttggtcattggttgttgttgatgcatgattaatgtactagaatttgttgttttcaatacaacaaaatgcaaaccttttttccccctcctgtgggaggcgagagcaaaactgcaaaagtcattttggatcctgatttttcgcaaaaaggttcaaagcgagtactcacatggcaattataccatctaacttagctttccatgctttttcttgcatgtatcatgtatgcatttcttttcgttgtctgaatgatgtttgtgagctcattatttctcttagaaagttgacatttcacttcgggacaacaaggagccaacgatgaacagaaaaagaactaatcgagacaagcataaactgtattatgtagtacttagtactaaccaacattggtctctaaccgatcagagaatcaacacacaaagtgacaccgattaatttcaaccaaagctatcgtatttctctactctcatttggaccgcaccatgaggaaaaacctagacaactaaaaatatcgtaaaaggatttagtacttcctctgtttcacatcataaaatatttcggggtttttttaatagattcatatatggatacatgtattttgtttcacgtatctatctaaatttatatagatgttattagtgaatctaatcgatgcatcgagagaccaaaacgtcttataacatgcatatgcagaggtgtggtgcacacacgtaccgtctgaaatgaaccaaaagcaaacaaaagtagattcagcatgacatgtggcagcatccagcgcctacgatgcggcggcgagtgtggtccggcatgccggccggcgcctccggccggctccggtggccgccaccggccggtgttgctagctaggcgagcaaacgagcaaagggacaaagaagctgaggagagaacaaaacaaaagggaaagggagaaggtagtggtggtgacccccacgggccattggcgcggcgcaacgtacggcccaacaatccagccagccagccagcctgcctgccagcaactgcccacttttaatcaaacaaaaaatcggcaccaaacactttattagagggtttaataatctgcaaatgtctttttcttttttccgttctctgtcatgttagtactgcacttgataagtctcagatttgtacgaatagatgatgccccataaggagtattaatcgtaaattgatatattttgtgacgaaggaagtgacatagtggcctttcttattttatattgaaagtaatataggaaaaatagatatattgagggtccctttgaatcgcaggattgaaaaaacgtaggaataggaaaaacgtaggattttggtaggaatgtaagtgtaaaacagaggattgcaaaacgcaggaaaaacacatgaatgaccgtttgattgaaccgcaggaaaaacgcaggaattagatgagagagatagactcaaaggaaagttagcaagaggttgaagctcttgctaaatttcctccaaaatctctataggattgtccattccataggaatttcaaaggattggataggattcaatcctttgattcaaagggcttcataggaaatttttctataggattgaaaggggccctgaaagtttctagataacccagcacacgtagtcataaaatttgatgacatgtaaaaacgtgctaatgtaataaataataatgttatataggaaaagaaaacctaatgaatatttgcacgtttcctattatctacgtagtagtagtttttttttcaggacctatcttaacaatataaattggtcattagtaatgacaaaagatcttcccaaagtaagtgataagtaaattaggatgtgtcatatccggtacgaggttagtttattttgggacggagggagtatataagtagtcatgaatagattaaccttaatacatagtgccctaggatttgctcaaaatttgttttttcctttaaaataaagttaaatttggacttgagatttcgtggtaatgtagttcacgcttatacttatctttataaattttttatataaatttggagaacttttagatttgattttcactggtttttcatataaattttcatgagtcaccatcgttgtcctacaactacaagcacaaatactaaccaataaattggcaattcctaacattaacctttagtgcacctacattttcctccctacttcataagaatcattaatggtacatcaatgtactttttgattgctaacattgattagatttttgttgcgttcctttcatttgtgtcgttgtcatggtcttggctcgttacacatttacattttcatacctctgtgattgacattggatcatagaacgtagtcacaacatgagtgagacagaaataaagtaatcaatgcacaaaatcttgtagaaacctaggtgttcaagaacacccgcaatcctataaagaagtttggatatggaaaaaaaattaatggtgaaaggatgctataattttgagataaaaaaaaagagccatcccacaagtctctttataactaaatcctcttatattatcctttattttaaaaactagatcttcttaaaccaacttcggtgcgagtatagatcgaataatggttttagaggattgagtggagcataaaaccgacatctatattaggccatgtttgaatccaaactttcctaattgcgattcggcgaagtcgcgttataatacccatcaacattaattgtgaaggttatctgaatgatacagtgctagtatccctcgtgacaagtgacacctgttttttattaaattacatctattttaatccatataatagaatcgccgagatcacagtcgattcacactatagcagcgcagcgtaagcctgctaaaacccacatcaaccaaaccaaaccatcacctaccaaccagtgtagtaaactcgtcggctactcgctactactacttgctcgagcaggcgtacgatacgattacaacgcagcacgcacacgaggcgagcaaaaggctccaaagcgaagccagctgccaaagcggaagcagcagcgcagcgccccatcacacacaacacaacggcatcctactccctccccccctctctctcttcgctcttcgcatccatccgcctcgctttcctccctcccccgccgccgccgccgccgccgcccgaatccttcctgtgacggcgagccaccgccgcgctaaaaccaaaccctagacctagaccccactccgtcgcggccacctccccccggggccggggcggagccatccgcgcgccgcgcgcggatccgtacgcgtcggccggatccaatgcggcggcggctgcggccgctgtagcgtgggtgagcgggcccgatctgaggtggtgggagggaggaagggatgtcgtccgcgccggcggcgggcggggcgttcgaccggtaccagcgggcgggcgcgccggcggccagcgggaacacggtgcgttcacgtcgcgtcgcctctcctctccgtgtggactgggcttagctaggagtagctagctagcttccttgcgtgcgtcatgcgcgggtggtggcttgggggattttggggtgggttttggtatctgatgcttacgggcatctcggtttcgtgttcccgcggctctataatttggacctcatggggggttcagcggccgccgcaagcttctgctctagactggcattgctggcaaggagatgctgcgtagctgctattaataggaaggtttcgacttcagtcgggttgcatcagatgagctgcccttttttggggggctcccacgagcttcgatttccttcataccgatggtcatattggcggggtgctggcaatgcagcttaggataatcaccggaacatgcaatggataaggaaatgtaactacatttgtggaggttttgatgcttgccgaatgtcgatgggggcatcgtgaagcttgcctggttttgacctgagattggctctgattacggctgaatggtgtgtcagatgttgcgtggggtttgacgtgatggtgacacgcgtgaattggggccgagtggagagagaatttgagggcgggagatttgtggcatggtaaccgtgaaggataatttggagcaaaaatgataagagcagggtggagcggtgcacaggtaagaaaggaagaaataatatctggttggaagatgatcagctgtcagcacaaggagggagtagaatttaggaagctcacacatgcagatacatctattatttcgtgaaactagatttggggaattctaaatggtttgatgtctagcatatgcatttcatgaatgtgcttaagctttctgcgtggcttcccattacattagtaaattgtaaataagcatgcatgtaaactcagatcagatgacatggtaaattgatcgacttcagtagttcagttccccaagccctaactcttgataaagctagatagaaatagacatcttagcatcaatctacattctacttgctgcgctcacctcgtctatatttagaagatcaaattccaatactactatgacattaccttcaacactaattttgttatcatgccatcacaggatgcaacttttagtaatgaaaacctaatcatattcactttgttaggtccatgcacagtgattttctccagaaaattaatttgggaattcttggaactgtttttattcatcatgttgagcataaagcagtatgcttttagttagcactagagttgaacacacaagagttaattaacaacgtggtcatgtatcggatatacatatacaattcctttccatttcatctactatgaattttgaatgtttgtctatatacatattacgtacttgctaggtattgcaatctcttagtatatttaatattattgtcctgttcacatttctgatgtcaactagtgtgctaaccaggttttcaagagtggacctctcttcatttcatcaaagggtacattcttgctctctacctctgtcacatgtatcataagttgtttcaggccgtttatgtgatgtaaacatgtaaagttagtccaaatattcccattttctcttgtgtctctgtttgaattcttcaaagaattgaggcactcacatatttttggtgatgaacgccgacaccatgattatatagaggatgccataatattcttcttttttgtgatattaattatttcttggtttcttggattataagcgaagggggaggaacatatgttctgtaatttccaacataggttaatcaggttgaagtatcttgctagcaatcatgtacgcacaaaggaactatacgaatccaggaattatctagagaataacttttctcaaagttagatatgcttgtatcatgcctttgtcaccaacttacgtgggaaagataaacctgttgccatggggaaggctccaaaatccaaaccaaatgatagtttggattgccttatgcctcagaaattcaattagagtgccaaatatgactcctgccagctgaatcatgattttcctgagcagattgattcctacgaattgtaatttagttaatctaccaaaatcaccctttcatatttgaattaaatcatgtgttgtgagtcagtatcacattgtctatttttggtatgtcttctacaactttctaatatgatatcatattcttctacagtaaagaaaactctttttatatataattttcaggaatcgggtggaaatcatggaaaaaacggtggttcatcctcacacgaacatcattggttttcttcaagagtgatcctgttagtatttctatcattatatgtttcctctgcttgagaagtcaataattagcctggtgtacctttgcataacttgtttctcagagccctgaatttagttgatgttatagatgaagtatagcatatgaactttttccggcaaaagcacaaccaccacagaatgtgattatttggctttaagtgccatcactcttatttgttgaaactgctataaattgttctgcttgtaagacaagtcctactagggaaaaaaaagttcattgccaccttgccatgcacagataatttgatagttaatagtatatagtttcaattttcgatccatttttcgcatgtgtgcaatactttgaaatgcatgagttttcaacatctagtgctcataacaaatcaattacacaacatgctttggttatataagctctcctgtcttaagttttgaacaacttgttttctcccaattgatgtgcatttccttttctattttcgatagggagttgagttaaattatttaatgagtcctttctctctctctcccacccacccactagtgcagttataacttgtgtaacaacaaccatttcctaattcttgataaaccttttgttgacattgtagagtaccttgccccagagaggtggtgaagtgaatgttactctgggaggaattgacttgaataattctgggaggtatttacctcattcttgagattttcttttcccttttaggatgtacagataatactgtattaaaagctcttatcat

SEQ ID NO: 46051 - DNA, 4066 bp, Oryza sativa
ctgaatgttgtatatttgcttaatacaggcagaaacttctgaagatttatttgagtggaaaacagcattagaagaggctcttgcgcaggctccaaatgcagctcttgtgatgggacataatgggatctttcgtaatgaaacgactgacacatatgatggagctatcccaaattgttggtctacttatgctatttcatttttttttcttctcctactcattacaaccttgtttgttgttaactcatgcctttccaattatttgcagggagagagaagaggccgatcaagtcgttagttgttggcaggccaattcttctcgcacttgaggatattgatggaagcccttcttttctagaaaaagctctgcgttttcttgagaaatatggtgggtgcacaaataatttttaactagcaccatctttagaacctggagtactgctagtttagcatctgtacaatgtacaatagttatgttaatcttttcttgtagggataaaggtggaaggaattctacgccaggctgcagatgtagaggaggttgacaggagattgcaggaatacgagcaaggttgaaccatttcttagtttattctatgactagtattgttaatttgatggtattggtagctctgttttgtttttgtcttcgcttattgattaatttgcatatggttccattattgtgcctgtttatatcccctaccaggaaggacggagtttgcaccggatgaagattctcacattgttggtgattgtgtaaaggtaactctgtcacggtacctcttcttttttgtgctgggagcttgaataatccgttctatcactaactgtatgttcatgtaaacatctctgcagcatgttctccgagagctaccatcctctccagttcctgcttcctgctgtacagcattattggaagcttttcgtaagtgttctattcagtttaaactaagtgatattgctctagtatattccgtcactgttgagtattgacatatgcataggatactaggaaacacacctaggttcctgttgtgtatcacttacaatttaattccatctcagtctattccaggaagtctgtagataactgtggaaatggggataattatctttttgaattatgtagttattttgctcaaaagtgcctggcattggcatgtccccttgtatggccgatgattatatttctatatagtttcatagtatgctcctctattcccgtgtattctttgcctctgaattttagttgatctaggcaagcatctaagatgctagttgatgtacatttatcgctaagatcttacatgctttctcatttcctttgctgtctttttatttgactaactgtctatattctgctttactttcctagggctggagactaaggatgctcggataaatgctatgcgctcagctatagttgagacatttccagagcctaatcggcggttactgcagaggttagtttcatggttttcctcgtatcaatttttttttctgtttttcttttttgttatactggatcgcatctaaatgttctaggaagttttattactctcgcttgggcttcaagtccgccagcttatgctaaatgatttatactgtttatgggttaaaaaccttgttacaagtgctttcatgttttgtaatacaagttacacaaatcttgaagcactagtgaagggtaagtagttggaatccacccttgacttatgcttcaaactttgtggcggttctcaaagggtgaagcgtaataacaccttccataatttgatttttggaacccttacagaatagagcatatactgacctggttattttagccttggttgaattttaagtttgaagtagcaacacctcaataatctttatctagatgtcttgtttgatcaattagaatttggataataatcatatgtcaaaaactcctttttctaattgagatttttttgcagaattttgaaaatgatgtatactatcgcttctcatacttccgagaaccgaatgacagcatcagcagttgctgcctgtatggctcctctgttgttgcgtccacttcttgctggtgaatgtgaaatggatgaggtatttgatatggatggcgatgattctgcacagcttcttgctgctgcaaatgccgctaacagtgctcaaggcattgtcacaactctcttagaggaatacgagagtatatttgatgtaagattctcaactccttttgtggattcaccttttctgtgaacaatctgttgatattaccattatccatcgaaaagctaacaatacttcacatcaacagttgcgctaattctttttcattggaatctgtctgctggaagctatgcctttttcttttctgtgtagaacatattttgaaatgtgaactagaaataaagacaacactaatctattgatcattcatatttatatatcttacagggtgaacacaaccttagatgctccctgtcgccagagtctcaaattgaagatagcggtagcgaggcatcaacagatgatgtaaatttggatgtcaagggtaatggatttcatgatgctgaaaatgatgtagatcaggaaatggatgatgagaatggcgcagaacgtatacttagtggaaaactgagtgagagcagtggatacgctggcagtgacctctatgactacaaggttttgatatgcttcctactttttaaatctctaatctggttattactgctgttatttattgttgtacatgtataagtatgcctttttatggtcttaagaatgaagataaaaactagtagggcattaaaagtagttcctgacttcctgttgagttgttgtacatctatgaggagcttgttttttggacaccagtacattttcagctgcaaactgtgaatatgtaatttaaatgtaattattgtagtttttttggaggaccaaaggatatgataggatgacccattttgacccctgccagtagatatcattgcagatacgaaagactcgggtgaaatctttgttgctaggtctgaacaaatatggtttctcaaaaccatttgacctggtcagccaatgagtttgaatgcatgcaaacttagaacccagcaatgtcccgccaagcgataaactgcctgggttcagaaaaactaataaacaatattttgagaacccttgcttattgtttttgtcatcttgcagtattatttaatcatgccagtctgggttatgcttgtaaatttccacttccatgtattttatggattagagcttgcggcatggatctattatggttatattgatggtaatataaccctgaaggctgtcatcttctgttaaatgcttctgcctatagatcttccactttagaatattaccttgttccatgtaagaaatgtcttgaagttttggtggttgtatttctaggttatatgagtatctcatttgtgcgtttccctttctagcttcaatactgtgttgagaggcaatttttaattttatttctgtgtacttttgaatgtcccaatcttaatactttatttcttatgttcacctgattgaacaggttgttcatgctgatgattcagatgctgaacgttctgaagatgctaaggcagcggaagtaaagattgagttaagcaaaggtccaaaaagtcattcagctgaaaacggttcagcatatatggaaacattgctgagtgaaaagaatccttctaacccaatatctagccatgagactccactgtctatgggagaaatactttcttctttggatcctggaatatctttagctaatcacagtggtgaatattctgtagaaagcagacagccagccaaaatcaatggatctcacccacatgtgaaacgcagtaacttctgggggaggaataatgtaagaaaaacctagctatgtttatttcttttctgccttttttttggagctactgggtattaatagtgcattgctgttccaccttcctactccatcgaattatggtttagttggctccatattgttcctgaagttgtttctggaattattagaaaccttattctgttctgagttctatatgcatgt

SEQ ID NO: 46052 - DNA, 2973 bp, Oryza sativa
acctcactgttcactagttacatgcaaaacacagaaatcctggttcttgcctggatttccagcaattcagaatgaggtccaggcagagacttggatcccctcgttgacatttgaactgatagctccttgggccttgcttatcgttgaatcagatcagggttcctaatatcagtaatcctggtattatcgttcatcagtgaaatacagtaaccttctggttactggattttactgcactgataactgtcagaataattataaattataaatataatctcaacatcattcctgttggtgagcatcccctaaccagtcccaggacctggactgcttaccaccagttttttttaaccctgacccagaggctcgataagtttgattaatttgttgctgaggttgccttcatcccttgcattggaaatgctgtaaaattgagggactaaaatgaaataatgcctgcacaaaagtcacttttacccatagcccatagactgaggaaccaaaacgatactttcccttacatttggttttggctgaacacttgtgatatatttgatggtgactgaaacattcagatagtaatttctacaagtgtgatattgataggtgtctaggttgcaagagcaactacaggcagagagagatcttagagctgcattggaggttggattgagcatgtcttccagtcagttttctagttcacgtgctatggacacgaaggtacctctagtgaccgctctactttatggaattactttacggagtctcattttcactcattgtttttctcaagacgagagctgaacttgaggagattgctcttgctgaagctgatgttgcaaggttaaagcagaaggttgcagagcttcatctccaactcaaccaacagcgccaacaccagtatggccctatggtagatgcaaatgatcgttaccaccgtattcctggccatttttcgcagcagtaagtaatcaactttgttgttttcttttttactactgctatttatacggatggatgttgctagttcagtaggtttggcaccttttgattttctgtaattgtgtttattgttctgtttcatccaagtggccccatttctgtaaagagtggctgcaggtatgcagccacagaattatgctgcaactggtgcttacttgaaatctgattgtggacaacatttcactggaaaacaatctgtgcagtactaattgatagctcaatgtatcgagacatattggatatgctttactgagcttaatgatttctatcttattttgactattttattggtgccaggaactttgttcagccaggattcgacatgaaccttgccttctgcaaccaagagaagcagagaaatgaggtttgttaagaactatttactctacacattgtgagcttaataacaacacagaggtgtgttgaatttcaggtccaacttgacccctgtgcacatcagcataacaagaatgctctattatactgttttattagtttttactcattttcagttttggaaacggatattactgctattgatcatgtctcctaaacaaataataattgctctattttgatgtgtgggttgtggtacccaaacaatttcttgcacgataatattgttaggagtttccaccagaaggactgaaggaaacacactcgctttaatctgatattggcatcgtatccctgactaacatcggatcatattttggcatggcaggagagttcggtggactcatcacagtggagaaatatcaagcagcatgtgctaccttatggttcttcaaggccactcacccgcaagctctctttggacgcatcttcaagcgattcaagaggcatggaggcatcgacgagcatgccaacagataacactgctatggctatcaatgccccaaagtttactgaggttagggaaatcacagccactctatttagcactactaatatcctccaaaggaagattgttcttatttttatcgtatggcagggtgttgattatgggaggcaaccaatggtggcctcctccactttggtagaactgacaactaggctagacttcttcaaagagcggaggtcgcaactgatggaacaactccacagtctcgatttaggacatggatccgcttctcagggttttccatacaacaaaccgccctctccttgggacagtccaaggtaggatgttcattcagttccacgattgtatattcttggtagttattcttttcccatccatgttaatcatttgtaggaattgctgttgagaatgtaaatttatttttgttctccaatacgggttttatcgtatcgctttgcacgagttagcaacttgagtgtgatgttatagtctcctgtatgtaatgtgtcaaggtggggtgccattcaaaacaaaaatttccagcgctataacagtatatatttgtatttttgtgtggctactcaaaaggaaggaatagagttacgcgtttgtacggttgtttggtttataacacttggtttgatgaaggtgagaaagaaaatgattaaatgagaaccctgttggtgcataaacaatctgtgtttgaagcttagctttattaccattgcaagtaattttcccttgtccattctgatgccatgctgtgtcgtaccgtacgtagtggaaattagaacacagcgagggacaaaccgaaccgtaaggctcacttggaccgagaaaaatggaccggaaaaaaggaaaggaataagttcaccggctgtcccttaactttacaccgagattttttgaggtcccttaaccataaaaccagaaatctccacccctaaactatataaaaccgttcactcaaggtccctaggcagtatatacaggtggttttgctgacgtggcatcctagccagaaaaaaaaataaaattaatgtgtggcccacatgtaagtgacacaatggtgtgggttccacatttctctgttttttttctttttc

SEQ ID NO: 46053 - DNA, 2950 bp, Oryza sativa
gaaagagctgctgcctccactcgatgaactaccttatccccgacctcaagtgcacaactttcaccgacgacgacgacgagctcaccatcaagctccacgcccttctcggcaacaagtaagcaaaacaaatttcaacgtgttgtcatctgctccggttagctcttcttgtgttcttggtgctgattgattggttctcaggtggaacagcacatcaagcgcaagctcatgagccagggcatcgatccgcagacgcatcagccggttagcgccgggaccagcgttgccgcggcaagcgagctgaccacgacggccagcactgtcggcttcccatccctgtaggcgccggcgccggcgccggcgtgagggagctcgaggaggaaggagggaaggctgggaggggtcttcctcgaagtcgttgtctccggcagaggccgagtcatcggcgaaggtgagctcgagctccgcgtcgaggagcaccgcgaagtcatcgtgccgctcgacgacgacgaggaggacggcgacggcgacttggcggcggggcttatggccgagggcaaagggcgtgctttggtcgattggggtgggctggatgcgcctccgcgctcgcccacctccgctccactgccacgctcgccctccgccgctccacccgccgccgcgctcgccctccgcttctctgcccgcggccgtgcttgcgctccactgctcggcccgccacgattgcgcccgccgccgctccgctggcgcttgccctctgctgcgccacccgcatctgcgcgcgctgctccgcctgccgccggcctccctcactgaagaagagaaatagagaagagagaaaagagaagataaggagaagaaaagagaggaaaaaaaagtgcagctgacatgtgggccccacgtattttttaatttttttttggctaactaggatgccacgtcagcgaaaccactcatatatactgcctagggaccttgagtgaacggttttgtatagttttggggtgaagatttctggttttgtggttaagagttctcgaaaaatctcgctgttaagttgagggacctccggtgaacttattccaaaaagaaacctcgcgtaggccgtaattcctttcggaccagaatttaatgggcctcatgtgggcggcaatcccattccggaccaaaaacacaataggcttcatgtgggccgcagtgtcgttccgggccgaaagtatgatgggtctctcaatactgttacggcaaaaaaatatattttttaccgttggatgtcgacgaaaaatccaaacggagagaagaaacgactctgcggcttcggccagcagagcgggaggtgagcaatggcggcggcggccggccacagcgctggatcgagaggttgcgcggcttttaggccagttccaactcaatgatcaggatggtgtccatagtattaaataagctaccacctatgatgaaagatgatgtggcaagcgaaaaaaatgagaaaagagaataaaatcagatcttgcataagacatactccctctgtactcgtaaaggaagtcgtttaggacaatgcttaagtcaagccttaggaatataaatcatgaataactcttaagttgttgaatttgaaaatgtaaaaattatatgaatagatttgtctttgaaaaatactttcataaaagtatacatatatcactttttaataaatatttttatagaaacaagaagttaaagttgtattttggagaccgtgtcgctgtctaaaacgacttcctttacgagtatggagggggtagtttctacacaatatccaacatatcatgagagataagtagaattaaatttaagtatggaagaatggtgtttatattgaaagagtagtgtctagtagtagtttattgatgatgtggagtttatgaaaactatgtctaatgtcttgggttaggactggtcttaggcggagcttgatcatgaagcgccgcgtgagccctatacccttgacacggagcagccgcgactggcatatgctggtcctctgggacattgttaatttgcttgatggtatgcaagctgttcggacgactgccggcaaggcatcgacggatcactgaccgctggttcgctgcgattgatagcaaagatgttgttgtcaacatgtagaggattctggtgatcccaatcccatgtaattttttattatttccttcttcttatgaaattagggagttcagcatgaatttttgtagagttttaaacacaatcttttttttttgttgttgttagtgagtcagttgttgcaagtcaacatgaagtaatatttgttatgttactgtgaatataaatagctagtcatgctaagtaaatgtcgtccacttcaagagcgtctggccggtaattcctcatgtataatttgacaatgaatagcatttgaattgggaagagtttctgtgtaactgaaaaccgaagaatgaagaatgctcccaattttagcgcaaacaagatgcatctcacaaaatgttgcatctccaatatctatttgccactcttagatttggcatttaagtgtttaactatttggcacctatgtatcaattacgtgtgagccctcattgtttcccgattccccactccacgcacgtaagcgccctgatcgggggcgctagccgttccatggctgtgagcccctctcacgcagcgccacaataaaaggggagtcaccggcacacgcgaagtgagtttttcccatgcacatgtgctccccacaaaccctaagtccctccaatctgggaaggcgttgaagtgaggggattactcacgttctcactgccgccgccatcgtcatctacaccaacaccacaccactccgctacaccgtcgccgtggccgcatcaagctccaagtccgacgcctctctctctctctctctccctccgctcacccctcaagaacaggggtgcaggaa

SEQ ID NO: 46054 - DNA, 2875 bp, Oryza sativa
cactaacattagtggattctatatgcatgtatatagctatatttaggcatagcttgcattgatgtgctatgctagactggccattgtaacaaagtagctgtagataggaagctgtgtctatttttcaggggaagaaaagactgttgaatctgagattattgaaaagcaccattgtcccaatcggagccatctgaattccttgggggtctgcaagcagggccttgatcagcctgatggcttctgcttgatcatatacaagtagaggcatcaaacctgctgaaatatgaccagcatctatgtcggcagctgcggtagctctggagtcccaatgtgttttcagatgtctatcttctcttcttggaacgctttgtacacaaaatctttgaagcgtctggaatactgtttcggatctactgctgaaatagatgttgggtcatactgaaaggacttgtatgcatgctcaagctttttgctgatatcgtagtcttgaaggatgtctataatcccaaaatatagtataacatcgtagaactccccagtaggctctccgatgatctgaggctcgcactcactctttcgtactgttagctcagctcttgttggcatgttggacccaagttttatcttcgaaaacctgtccacccaaagaatcttagtgatgttaaaattagaacttggagacatcaatacagccaaattatttcttatcatatagaagtgcaaggaaaaggaggtaaaatggtggtggcaacgaatgctgcctattagttcttgatgacaagtatcgtatatctctactgcaatgaagcccgttgaacataacattagaatcaaggcgaacatcaaggaagcatatatatggggcatctcaatatggaagatcgtatagcatgtgtatgcctgaaaagtattgacaacaagagcaagagtaatcaagtatcttattttacctgtttggatcagtatctcctctagacaggtgaggcgatgacgctctgctactatcactatcaaaggaaccttcaacccatgcacttcgtaaggtatagaacaaccatgtcaaaaacttaaattgattatatttttcatcttaccttcacttgctaatagatttcttttgtctctgaaatgtacacccaccaaaagactgtagtccatgatgttctcttgctcaagaaagtcgcagtccttatcgacttgtctgcttgaacacatttaacttctacattaacacaacgagtaaaaatgtgatgaccactcactcttgcactagcctcacttaccttaggaactcttggtgccagtgtttttgcaatcgaaagataaagttaagatcgaggtctttcaaagtagtgtattcgtcaatttctgtttgtggcttgtcagttgtacgtccaagtgatgagcctttcagatcaaatcgtctatgaatggaataatcagaacaaaacaagtttcccatgatgacgaaacgaacctggtaataatatagcaaacagatgagcagacatgacatattgatttataagcttaataagaatctattggctaataaattagctttagcatgatatacagatatatattaagtactgaccttcttttggttagctccagctaactttacacaatgtagaccaaaaaatttggtgactagagtgttctcaaatgaccgaacatgattgtagtaagctcgaagcatcttaagaaatatctacatgatggcaagttctttgtagatttagtacagaagtgccagatgtgaattcagaaagcatctggacaaactaaacatgatgcaccaacctttacttcagatttcttcatcgtctttatcatgtactgatcattgctcgtgagataaaagaagcttccactcttaccgggggatgagagctcccggagagcctgatcaccacaaagggacaacatataatctgccgcatcaaccttgaataacttgcgtagtgtcctgtgattcaatccaggacaagttgtaccgctgatgagaatgaattaagctaaatgcaggcataacacacaaataagtcattggagtgatgaccaaccggaacacttgcgggcagtaatctttccatttgaaatcgcaagaactgtgaggaggggtgtactttgatccttctggaggaaaccttgtccatactttctcctttgggtcaaaagctgatgacttcaaatcaagcgtaatcgggccttgttttcctactgcatgtctattgcccagacaaagttattagagcatagacaaattcattctgaaatgttgcaaatacatgcattttactattctagtgtaagaagatataatatctgcttaaatgaaaatatgcaagtatgcttttggcccacagtatgccctgctgttattatgcttgacttcatattaaatttttcaataaaaagaatcccctcttcttgtcgtaaaattccaattaatcacaatttgccaccatttcagcttcgagtcaataaacaaatgcacatgttaggcatagaattttttgttgaatttttcaacgcgtcgcttcctctacgtgcaaacaatgacttcttgtaaaattgccacatccccgtcaggagggggaggtaaaatcattcggcatttgtagctagccattgaaaagttttgcttaccatgagaccagaataatctaattaaaatcatgtaataaacatcaccttctaaccttttttttttttgcaaatttatctgcacggtagattaattggcgatggcattacatcatacgaaattcaaaatgcgcaatcagcataaatacattgaaaaaggagaggaaatccatgtagggaaaatttggatggagcacccggatcgaaagaacggacaaaaata

SEQ ID NO: 46055 - DNA, 3253 bp, Oryza sativa
ggatctcttcaaagcttttccgcctccttttttctctcctcccacccgggagttttgctccccgcgcggacgccgagctcgcgcgccgctcgctcgcttcaaccatggcctcccctgctccccccgccacgtgccgcctccagggcgtcccacgtcaccccctcctagctcactttctcctttagccgcagccagccgcagccagcacatgcacacagatgcaccaaatggatccatatgattttacaatgttaaaaaaatcctccctccgttgacgccgttggtttttttaaacatgtttgaccattcgccttactaaaaaaaatttaagtaattattaattctttttctatcatttgattcattgttaaatatacttttatgtatacatatagttttacatatttcacaaaagtttttgaataaaatcaatggtcaaatatgttttaaaaagtcaacggcgttaaacatttagggaaggagagagtatataagaaactatcgccgcaaaacttgagataagagatgtgtctatacctatattaattgcactgcgtatttttccttttgttgcaattttgtaccgttacccctttttaactaaagtggtactccctccgtcccataatacaagggattttgagtttttatttgcactgtttgatcactcgtcttattaaaaaaattagaattattatttattttttttgacttactttattatccaaagtactttaagcacaacttttcattttttatatttgcataaattttttgaataagacgagtagtcaaacaatacaaacaaaaactcaaaatcccttatattatgggacggagaaaatagcatcgtgaggtaatcttcttgattttggaaacatcttaaattttttaagtaacctctgggttgtcgttgtaatcgtgataccaccatcggataacggtaaccccgtcaaaaatagtaaggaaaatcttgctttctactaaggtcctgtttagatcccacgcaaaaattttacactctgtcacatcgaacgtttgaacacctgcatgaagtattaaatattggctaaaaaataactaattatacagattgcgactaatttgcgagacgaatcttttgagcctaattgctccatgatttaacaatgtggtgctacagtcaacatttgctaatgacaaattaattaggcttaataaatttgtctcgcggtttattgacaaattttgtaattagtttttttattagtgcccgaacaccccatgcaacaccctatataatatccgatgtgacacgataaaactttatacccttggatctaaacacaccctaagaataattaagtaccgccaatgtcaaatataaaatggttagagggagtattacaaaaactttaatgttcatctacaggtgtagtgcaacaaatgaaacttaaatagcaaaatttactacatgacacttaaagtttgtaatttttagtttggacactgcaaagatgtgacacactcaaggtcatataaaatagatgatagtaatttgctaaaagacacgtgaccattattttatcattttcaagccaaatggaggaaaaaaaaacacttagaaaagacgatttatctctcaggccaacaacatgtaacccagctaggtatgtttcacagcagacttcaatttctagatttttggagatggggtcagtggagggaatggggcttgggtctggtttgaactagacccaaccaagttacatgctgctctccggaggggcaaacttgtcttttctatgcattttctgtcttgatttaacccgaaaatgataaaataatagatatggtgtccttccgtaaattatcagttttgggttgtactcgagccatatcatgtttctgcggagtgcaggagcaaagaccagaaacttttggtattctatagaaaaatttgtcaatttatattacattatctataatgtagtgtagaaaaaaaattgagccaccgaaacaatgatcaggtcaaatcatggaacatttcaaacttttaactgtcaaactgtattatttttcccagcaatactcagattttctgtcgttttacctaacaaaatgaatacgcagacagatatgagcagaaaaaaaaaagagaacaaaaccaaggtaatataagtgtattgcacatacacctccaacaaattctttttggctgggccggcaaaagatgccggcttagtttattcagatcttacatatgccttccatgtaatagcagggttgtaattacttttctatttaatatattggatactgttttggaaagaaaattaaaaaaagaaaaacgccagtccagtatattcaaaaaggagagtacaacaacaacgtactacctccgttacaaaatataagacattttggctttgcgatggaagtagtatagttgttccccaccaacaaattctcgcatatagaattttgctacaaacagttcatactctttaaaattgctgattaaacctgctttgagctcacttccccctgctcagaggtcacaacttcacattattatggcctttgaatgatctaacaacctgcagttgaaaccttggacatagctgtttgatctgtctctttcatcgccacagtcaggtacacactgtgcaacttgcttctgtgttttttttggcttgaagcagattgccatcatcacaaacagacctgcaagcagaccaaatgttgatgcccaagctgccaccagtggggtcatctcacaattgcataagctgcctgggattaggcaggtagcacaggcattgtcactgtcaatatatcatcaccagattatattccatctggaaatcaaactgagacagaatgatcatgccccttcaattgcatctcacattctgaacacaccatcagcaaacagttcatcacatcttgccttttgtagcatcaagagagaaattaagagggacgtgatcaatttgttacagaggcactggtagaagaaaggggatgatgactcacaatttggatttaatgtcgcgcaaaatcaagaacagaaaaaaattccttccaatatgtcaaaggttttcagtacatgaaagaatgatctcctcaggcaaaggagcatttacattttacaacctctgactggcttgtgcacccgtggtttacatgtttctatgtgtaattttgaatctgtatgttacatctactcttgtaaatattagtgaactccgtgtatatgtacgtagctact

SEQ ID NO: 46056 - DNA, 27966 bp, Oryza sativa
  unsure (1)..(27966): unsure at all n locations
acctaaaatactttctactccggagaatgaatacccccaacagaatactacagtgaacttgtatatttaaaatggataagcagaaggttacctaaagccttttcataacaaaattactggtaaaaatcattagttaccaaactaagacggctatagcatgaatcaaactatcaatgagtagggttctccactacatacatactaactaaatgattttgaacgaggaaaactaactaaaactaggattgcagtatagctgagagaggaataatttagtactccatatctcggttacctgtttgggtcagaaagaaagtgatccctgtcccatcttgaaaggcgtggtgatgcaggtatgtcaccatcaatatcaacggcacctttttaaccaaggtaaataagtcagccttaagattgtgcaaactattgtcagaagcacactttcttacctctaaaatgtacacccactaaaagactgtaatccatgatcttctcatgctcaagaaattcacagtccttgtctacttgcctgcttcaaaatatttaaaaattcattagcacaagggatagatagcatggttatacagaaattaggcactaaggtgtatgggtatcacttagcacctttggaactcttggaaccattgtttttgcaaccgaaagatgaaattaagatcaagatctttcagagttgtatactcatcaatttctgccagtggcttgttagttgtacggccaagagatgatcctttcagatcaaatcgcctatgaatagtgtgatcagagcagaaaagatttcccattatgacgaaacgaacctaggtagtagtacagcagcaaacaatcaggcatattatgcttgaaaaatagcatattcatgagggcggagtggataatcatatattgttctaaccttcttctgatttgctccagccaactttacacaatgtaggccaaaaaactttgtcaccagggtatcctcgaatgcccgaacatgattgtagtaagctggaagcatcttcagaagcatctgtgtggcaaagtttgtccatgtattcagaatagaacttctaaatatagaagcttaaatggtgctatttgaacaaagacagcaaaggacaacctttacttcagatttcttcattgtctttatcatgtagcggtcgtcatttgtcaagtaaaagaagcttccacttttaccaggggacgagagttcacggagagcatcatctccacaaagggatagcatatagtcagctggatcaaccttaaacagcttgcgcaatgtcctgtgattttgtaaagaacaaatgtgcatgttgacatggatgaagccataaaacagtcactaatctataatgtatctatcatgggagtgataaccaaccggaacacctttgggcagtaatccttccatctgaaatcagaagaattgtgtggaggggtgtattttgagccttctggagggaatttagtccatactttttcttttgcgtcaaatgctgatgacttcaggtctaatataacctggccttgccttcctactgcatgcctatgtacaataagcatactcagtgataataagttactttctgagcttacaaagaaatatggcaatcttactgtcgaataattacatcttctcaaaagatatggaagtgctacaagttctgaaaaaacaataacaatcttggtttctaaagtaaaatatgttgtaaacacaaagattggtaatggagaaaattcaatgataatccttacatgattaatcgttgataatgaactataagaatttcattttataactttgtaagagtactgtctatggagtctatgatatatgatttcattttcaggatttcaaactactgatagaaggactagtgaggcagtgttaagatgataagaatgccataagagtccacaaaaatgcctcagccaagtcatcgaattgtgctcaaatcattactactttacatgcaaggcctcggattctttcttgatgtccacactaccaacgcatatgaattttgtcgctgaaaatgtttgtccattctagataaatgcttcaatgcacacccctaatatttcgcccaaaattcccatttcgttgtttaccgacgagatgacacatgattgttcatgcgagatttcctaatttcacatttttaaattcctcgcatggaaacaaattgaagtattgcgagtgcaatcaaagagacagaaaatcgcgggaaagaaacacacgcacctgatcccgagctgcaggttgagcatgagctcgtagttcttgtggcccttggcgatggtcaccccctgccgcttcatcacccgcggcggcgccgcccccttgtcgacgtgcggcggcggcggcggcgccgccagcgaaggcggcggcggtcccctcccctccctgacgctgctccggcgcctccagtcgtcggcaatgtcgggcttgacctcgccgtcggagccccagaggtgcggcacgcccaccacggagccgatgctccggcccgacgacgagctcccgcggccgctgatcgaccgcgccagccacctcagcgaacgcagcgacggcagcgccgactgcccttccgtgctggagcggacgcactcggggagctcccgcgcgaacacctccctggggtcgcgggactcgcccgccgccgccggggacgggtagtagacgcccttctggtggacggcgccgccgggggcctcgcggccccagaagccgacgtagaggctgccgtcggaccagcggaaggtgccctggccgcgggggcggccgccctcccacccgccgtcgtagcggttgccgttggcccatacgagggcgccgcggccgtggatgaggcccgcgcgccagccgccggcgtactcggtgccgtcgcgccacgcgtagcggccgcagccctccgggaggcccgcgcgccactcgccgtcgtagcagtgccgttggcgtagcgcttctcgccggcgccgtgctcgaggttcttggcccaggcgccgcggtaggtgtcccccgcggcgcccacgtaggcgccggcgccgtgcatgaagccgtcgaggaactccccctcgtaggtggcgcccgacggccacgagaacctcccccgcccggtcgccttcccccgccgccactccccctcgtacatgcacccgtccgcccacaggtacttcccggcgccgtgcggcgagccgccgcgccactgccccgtgtacaggtccccattggggagcacccgctccgcgcgctgctgctcattcccctgcgcctgcgcctgcgcctcgccttcgtcggcaccgctgcaggacgacgccgtgtcggcgtcctcgccggggggcatcggtgacacgcgtcctcctcctcctcctcctctccctcgcccacgccgttcgtgctcgcgcattggtcgcgtcgcctcgagccccacggcgaggccgcccgcgcgcgcgcgcggcgaacgtgggatctagcagcggcgccggctgctgctgccgccgcgcgcccgcgcgcgccgcggcggcattgtctcgggagtcggtgggtggagaggaggcgccagggtgggatgataattttctctcctttttttttttcagaccattcccaattccgaaggcttggggagagggagtggacgaggagaggagggccacaacaacgtgcaaagacgtgtgttttttctattattttttctcatgttctatttcttcattttgaataatatcaatatggagtacttctacttgttatattttcagatctacttggtttgactcagacaagttttgggagtacgcgtagaacattcgatagttttgtagaagaaaaacttacaaatgtaactagtatataatcacaatgcaactagtatgtaactaacacgtaacgtgatttttttttccaaaaacacccagcatcataagtggctagggcagtggacttgcaaagcagcaagtcaaggattcgattctctattcgcgcatgcacaattattatatttatctcggtagcatgaatcttaaagaacatttgacggtggaaaataaatgtgtcgaaagtttttaacaaaacctaagtcagatatattttggtatactcgggccttgtttggatccaaaaatttttgcctaaaaacgtgaaaagaaaccaattgcacagtttgcatgtaaattgtgagacgaatcttttgagcctaattatgttatgatttgacaatgtgatgctacagtaaataattactaatgatggattaattaggcttaataaattcatcgagcagtttacaggcgaaatctgtaatttgttttgttattaatttacgtttaatactttaaatgtacgtccatatacttcaaaaattttacacccaaaaaactaaacacaccctcggatattatttccaagttcatgcataaataatgacacctgtaaaattgatgcatgtgtctgaagaggatggctaaattagtgcaatttaggtgaaattggagtaagccacttggacaggaaaatgaaaaatagggtaaggagtaattaaggtggggcagaaaaggaaatatcaaatatggggcataaatagatgtatctaattttctaagagaaaaattagcaagagaaatagttgaattgttgcgttgacacgtttattaagccaactcaatcaaatattccatccaagatcttctctgttttttttttatttttcgtttgcttcaatcaattctcacacagctatgtgtacagtacatgtgtctgtatacaagggacagtgtgtatgattatttaatatgcattattgagttgcacatgactctttttgcatgtatgtttagacttttgatgaacgtaaagtcatgggatctacaccaaaatccaaattagtggcgtgtatgaataagaacggaatgtgtatcacccacaatctggggcaaaatttttctggtcttcctctccaccggggaaagtgaatgatcgattgatcgggtactggataatatcagactaatatacttttaatgtacaaccttagactgtttttctttcgaaaaacagattataagtatttaaaagtatacttacactatcaaagttctttgcacgttaaatatatataactacatatactacttgcgttcatcaaaatgtactaatttaaaagttttttttaaagtggacgaagatgagactgataccagaataggtaggagcccatggcgatatgttttttcttcctctgtaaatctttcggtttctttatcttaactcgacaaaatcaacttcttttgggaggctgatacatatttttttcactaaacaataatgtttacttcatctatctcaaaatataactatttataagtgttaaaattatcttaaaataaaactatttctccatgtacctctcttatttaatttcctcatatactttctcgtatcaatcgatcacaaccatctctaacgtctaacattaatctcttaaaaaggcacacttagttgtactttgagaccaactctccaaatgtccaaatgcattgcttgtaattaatgcctgaattccataggactctattatgcatgaaatcatatttctatatttttcatgttcatgcgtttttaaaatcttactacgttctaaaagagctaacactaaaacgatgagggagggggtgctctcttctccgctcctaaagaggagtccccgtatggttaccgtgttacatgtctaattcacttatctattttttctttgtccttaatttgaagtacaatagtagaaaccgtggaaacaactacaatagttttcttttttttattattttcttacctcgtaaggaaaaacgatttagttttgaaattttatagcgtcgttttattacccctgctggtagaggattatgggtgcatataacttctattgaaatgttcgtaacttgtacacgcgtgcaaaagaaatttactgagatcaaggaatcatcattggtttcagactgaatcaaagaatttatttaggaatttcatatgattcaagtcctataaaaaattttcctatttgaccttttaatttaaaagattgaagcttttcaaatcttatgaaattcctatggaatggcacattccatgtggattttgaaggaaacttaacaagagctccaacctcttgttttacatttcaattcctattaaaattctttgttttttcaaccctgtgattcaaaggggcccaagcatatgttaataagtgtatctgttgatgtatactgcgtttggcagctggagaaagggagagagcttgtttcgttttccgcgcgcacgcttcccaaactactaaacgttgtgttttttgcaaaaattttctataggaaagttgctttaagaaattatattaatctatttttaaaatttaaaataattaatactcaattaatcatacgctaatagctcacctcgttttacgtatcttcccaatcttttcaatccccttctcctcgttaagtatggtgtgacctatgtttctttgagcatgttttgaagtggacgtattttcgaatatgtgagagtggtgcatgttcaacgccttccgtgtaatttcaacggaacaatagtaccatcccatactgccatacattcgaccgtgtaattccaacaaaaataataatatcaccccatacattagaactttttttttcaaacaaaaattgaaaagtggcttctactacgtactgcgcgccactagtggtcaagatttccggtgggagcgcaccatcatcaattcgacggttcgggcgtctccttctcctctccccacccctctcctccgtctccgttacccaaccccaactctccccaagcaaacgaagacgacgacgacgacgacgaccgcgccaccgtggccgcgcgcgatggtggatggataggaattgttcagggagatcgaggaacagcgcgcgctgcccccgcgtcgggctacacgcggcggcggacggcgtggggctcctctctcgatcgctttcgccggccgaccggccggcttggcccttctgctcctgccctgcctccccactaattaatccgcgttcccccctccctcttaattgatccgtcgatttctcggtacgtactatagcatgtatgaattctgatcgagatcgggatgactgggaggatgcagtgcattagtgcaaccaaacctactggaattaattgatggaaacgctactcactctactctcgatctctgttttttttttaaacactgttacagttctgctatccctttgttttcttttggtacaagcttttctagatcactaattttggctaattggcataactaagggcgtgtttggttatttgtatcactctagccggactcatctccctcatataggttaactggctaagtttgcccaggctgaggatatacatatgcacttgtttggctgctagcataagatgagtcagactacggttagatgttttggttggttgtattgaatatactggacgtgtaagattttgtttggttgattgcgtggactttgagtgtggttacctctttatttagtggtagagtgaagttaccactgcaatatcgtatataaaataaaatcatattaattagtatctgatttgacaagttgtattaatttgtataacatnnnnnnnnnnnnnnnnnnnnnnnnnnnnaaatcactgtagaaactgcgattatctctatattaataagctcaactttgtttgacagtatattggtgtaaaaaaagagaaaaagtaaaacaagatggaggagaacggtgtcctcgtcgtagtcaacgacgggcgtccgccgctcaccagccattggaaacgccacatccggtggccacgagttcgccaccgccggatctagtggcggcgagctcgtggccgccgaatccggtggtcctgtggcagaagatggttgctgacgacggcgagaaagaagtggaggcagcagcagcggcaaggaaggagcggaggtagcggcggtggcaatggagaggtgagaagcgttggcagtagcggagcggtggcgctcttctcgccggatttggcggcgggcttcgagtggccatatccggcatcggggagcttgtggctgacggagctggcgaggcgagtggcgatgtcgatgacgacagccgtgcgcggggtggaggcgaatgacggtggccgtgcgcggcgtggaggcgacgacggcggccttgcgccgtgcagaggcgatgacgactcggaaggtactgagcgggtaaatggtggaaaagaggtgatgagatgcgcgattccctctcgcctcctgcacgcacgtgaccccgttctacacgcgctcgtccccgtgcctgcacgcgctccactccgacgaggagggaagctcgattcgggcgtttccctttggcctggttgggaaggtgattttgtatgcgatgagccaagccctggaggctatggcaggtatccaaacatccctccactgcacgcgcggatgcgagccatgcaacatgcaggtaaccaaacgagccccaaatgaatccatacttgctgaaatgagaaggcctgaaacttcttaagttagtccctgatatttattgggacattttatataacattcgatagaaacccgcttaaaactctgttaaatgtaactataatacgactgcaatgtaattacaacgtataattaacttgtaattataatgtaaatagaatatatataagtgacttacattatgaaacggaggaagtaactattaaggacatgtttggtagtactctaacttctaaatttaactttaaaaattaggtctagagtaaagttgtgaaactatataaatttagctatatatctagtttactttaggagaacactctaatcaaattcactttttctggttgagcgaaaagatggagctaaaggtgaagccatgccagacgggctccacgctagctcagctgctcagtcagcatagatggaaaatgtctaatgcagtagaaccgaaccaactaaatacaaagatatgataattaacagcacttaagagttactccatccgctccataatgtaagactttctaacattatccatatttatataaatgttaatgaatctaaacatacatatatgtctaaattcattaatatttatatgaatgtgggtaatactagaaagtcttacattatgaaatggaggaagtattatactaagatcatacaagatcacagtagacagtagcttattgagaccctgtttagatgagataactttttaagtccctatcacatcggatgtttggacactaattataaatattaaacgtagactattaataaaacccttctataatcttggactaattcgcgagacgaatttattaagcctaattaatctatgattagtctatgtgatactgcaataaacattatctaattatgaattaattaggcttaaaaaatttacctcgcgaattagctttcatttatgtaattagttttataaatagtctatatttaatactctaaattagtgtcagagaataaattaagttactgaatccaagtaccacctgacttaactacggtctacggctaattgcatgcagtctataatcgagccccgttgtggctgtccatttccaagatccatccactgtctccgtgttgtccccgttatagtgtcggcctgtcagacaaggacaccggctagttagtagtacaattaagctgacactgcgctgccgtgtcaccattacttggctggtcgtatgggccccaccttattcctaggtgatcctgatgggccctgatattctgcatggcctgcatcttcccggcccacctctatagctgatttcgtatttgctttactccctccatcctaaaaaataatcaatcttgaagggagtactatacgcatgtgtattagcgtatgcattgtctctccttcctctcagtgtcctgcggcaaagtgtcaccaattaagtgattaattaaatcaccctgttgccataaatcgtgctggcaactttttgatctgaggatcaatgtagcgcgtaagcatgtaaacatgcccttactagtagtacaagcctgaagtgcctcaatggataagtaaatatggccccttacaagtacagacaacgaaaataacggaattattcttttattatattatcgtggtagaattaatttagtactatctccctccgagaaggagttaatttatactagcaatttcaaaacaaactaagtatagaggaaaaaactaaagtatcatcattaatacgagcattgttagatgggtaggtaagtagaattgaagggataaaactaaataagtacttttcgatttgtgaactaggatatatgtaaggggctagagatcaagtgtttttgggacaaagggtgtgcttgttgacggggtatgcccgataatggtattttatggtacggctgatacgaatgtatgcacgagtttggaataaagagataaggacaatggtttttatattggtttagactcctgagaaggtgaatatatatacatttgagatgtatcacaccgagtacaaaggtggagcaagctagctattctaacatatcaaactaatctcgatgagcaaggtgcccggttgtagtccacggttagcagaaaagcggtgggctacacatgctggtcggaatcactgtgagggatgtcggtcttgggcaacaatggttatcggggaagcggcgtccaaaggagtcccattaggcaattggtgcggggcaggccagtccaacgaccatggcaaggagtgccatggctgagatggttattgcatgactgcatgctatccatcgtgtccagcgggacgacttcggtcctgatgatgatgaagacaatggtactgaatcccaccatacagcattggttcgaagacctcatgcattactttggccattgtcttaatagtgctaagggtccaccaaagggcaaatcagtggcgacgactaatgagggagggagatcggtagatcgaggcggcggcgttgtagggagaatcggagtaccaattggctcggcttttctgcttgtggttctggttctgggagccacgcccacaagtgaagcacgagttgagccaagcgaggcacagttgtggataccggccagcgtgaggtacgcttggagtcacgaccatcgtatgggcaaaattgctatttagtgatcagccacgcgcgtcccaatcacgttttaggcctgctttttttctgggttgttgagccccctgacattccaatttaagatttttaagccatccatcatttctgaaacaacatgtatctcctatgcatgatcacaagaacatcgaacattctccaatggcaattcattaaaacaagagataccaccttacacaatacatatggggtggtgtagttccttacaattttcccaaaataactactcctgtcgtgcacgaaccatcatgaactactaaagcctagctgaagactaggcatcattggacatgctaagcatccaaacatcaacaccgacagcactaatatctggtagggggtatgtaggaccataaacgatacagagagtcaagggtacattagcactaagcagggagccgccacattcgaatgcaagcaagaaaatcagaccactctggctgcgtgccatcggtctcccctgccacatcaggtggcagaggcgtgcctccatccatcctggcgagtgcccgattcccttcaccacaaccatcggcagaggagcctcaaagtgcttgatgtactgatcagcaaccacatcattgcccaccagctctccttgttgcaaaatccccatatccttgatgatacggacttgagctcgcagtgaaaccgggaccgaagataccccccttcgagactcttggtctagcagcttgctaccagaaccttcttgcactctctttagcaccgaagcgacgacgtcgctaccacgagcaatgactgcagtgtagcgaacaacactaggtcctcttgggccgtacctatgcctccacgggaaccccgacttgcccaagcatgataagcccaagcggcccatcaggcgacaagaatggcccatcaaacgacccatccaagaaggtgagacctagggcatacgcaggcatctccctcattgatagcacaacagtagccgttgccagctccagaagcatcgggtcgtcgtctcgtgccggcctcctcgtcgtgtccacgtcagagcagcacagggctgggtcaaccctgactggcgttggcgcgatgcagctgatcggcgttggcatgatctggggaaggatgcccgaggctagggaggcatgcttatggagcaggcctttgtcgttttcccctccacaattacaattggatttgggcgaaacagacaatttgggcctaatttttgggggattgggggagggggggtgggtctccgagccaaattctggggtagtctcgagcccaccgagactaccccttggctacgcccctgtattattgcgcagcgtcattcatgccattgcaattgaacatggcatgctactacatactactccctccgtcccaaaaaaatataaaaacttaggatcaaatggaacattttctaatactacgaactacgaatctgtacataatgttctatatggttttagatttttatattaattatattctgagatgatgggagtagctaggtgcggcctgttaggttgcaccattgctagctacccacctcccacccactaagtcctccccctccacccacctctcccttcactccctcacctcactacctctcctcacctcctccatccagtcgggcatcaatagtaggcggaggcggcgcccctctcctctcctcccctccctcctagatccgactggaggaggagagggcggcggccacagcaaccggcggcgcataggcagcgctcccctcctccctctctccccgctcctagaaccggccggaggaggaaagcggtggcggtgcccctctcctctcctcccctccctcctagatccgactggaggaggagagggccgcagccacagcaaccggcggcacgtaggcagcgctcccctcctccctctctccccgctcctagaaccggccggaggaggaaagcggtgccggtggcagtggcggtggagatggaggctagctgcactcccctccctctctcctagatttggccggaggagcaacgacgcaggcccctcccctccctcccagatccgaccggaagaggggagccgtcagcgacggtggaggcgatgctccccctcccctcccccctccctccctcccgcacagatttggctgaaagagggaagccgacggtggcggcggagtcggctctcccctccttcccagatccaaccggaggaggggagccagggagccggccggcggtagcggcagaggcaacgctcccatcgggtggtggcggcggatggaggaaaagagccggaggtcagagggggagggcagcagcgggggacggagaaggagaaccggtggctggaggggggaagggtggcagcgggggattctttttgttccgtgagattgttttttgcaggcgagtggatgtagcagcctacgaaagtgactttttgcaggcggggataacgatcggatgcaaaaatcgtctatttttgcaggttttgaagtgcaagcggggctaatggccgcctataaaaatctttttttcccgtctgaaagaaatcagtcttctagtagggaaatatgggttgattttttttaagacaaatggcctatggtcaggccggtcataaaatatcggatcgatgtccggtactcgatcaggttaatgcacgcacgtactacctccgtctcaaaatgtagctatttctagcacagtactttatcctaaaatgaagctatttttctacctaccttctcctctcaaccaatcacatccattctttttcacctactttctcttttcaaccaatcacacaccttcttcaattattctcacctactttcttaatacctatgccaatctcaaaaatccttacattttgggacggaggaacggaggaagtaagccgtaaggtacgggttcggctgatacactagtagcgccgcccatcgtcgtcgttgctgtaccatgtcaacacgcgcatgcagtgaagtcgtactgaagtacgtggatcggcgtgacggccgggcggctttcatgcgtgccgttgcctcatgggctatacattacccggaccaaaacgtctctttccttgtgggctagctaagctcctcccggcccatcggtcggacgtcgcagcccatcgaatcgaggctcaatttcatcgtctcgtgcactgcacacccgtgatggcaattggcagcagaaaccaccatgcatgcatgacccaaccaccgtgcaccaacgcctccccgcccacccgcccgcccacgcacaaaacacccgagagagtccacgcgcgctcgtacaaatcccccatcccctcctcgccgctcgcgccacgccgcggcctgtacaaaaggcgccgccagtatcgtctcgtccccccacgcgcgcgcgcgcgcgtgcacaacgatcgacttcgaacgccgcgccgcggccgcaccgatcgatcgatggcgccggcatcgacgacggcgacggcgacgtctgccgcggcggccgccagagccatctgcgtgctgctgctgctgctggtagcggtcgtcgtggtggcggggcaggcgccagagccggagggcgacgatcaggccgcggcgatcgaccaggcgggtggcggcggcggcggcggcggcaacaacaacggcacggccggccgcgcgagaggcggcggcggcaacaacaacggcaccgggcgcgcgagggacggcggcggcgaccgcgaccgtggcgcagacggaggcggaggcgggcggagcaagctggcgagcagcatcgactgccagatctgcgaggcgacgtgccgggtgaagtgcctcgtcaacagcctcttccagtggggcggatgctaccagcgctgcaggtccgacaactgcaacgactggtgcaccagaggctaacgtaacctagctgatgaacggatccatccttcggatcggacggcttgcgatcgtttagccctcgatctgacggttacagctgcagtactaatttttttggacaaagatgatggtatataccagcttgttttttttttcaaaagatagaaaatggtattacttatgtgctcaggatagatccagcatgggtgtgccagagggacttgagtcctccgtgcccactagatcatcattgataaaaggagagagagtcgaaagaaaaagagagataggaggaagagtaggggttgaaggaggagatgaatctcctctctagttttattctagattcgcccctgatactcataatgttggaattaatgaatgggccttagcccactagaagataattctttggaaatcacaaaagcccacctcatggaatggcatgcatgtggagtttagtaccaccctgcttattctaggagagggggacctccttaaaagggatgatgcccttctagccacttgaagcatgtgtggtggagagaagagggggaacacacgcgcgcgctcgctcgcctggcctggtaggcgcgcgtgcacgacgtacgcgtcgaatggtccgccaaaattggttcctcgccttgcgcagatgcagcctccttttgcagttttattttgctgcaaattcggattcgtttttgttttggaaacgttccgaaaaatccggtgcgtgcaaacggcgtggagtccggataagttacgcgcgacttatccggttcggttacgcgcagtggagatcatgcgggcgccctgatcaagcgacccttctctatataaaccgacccgccgtcttcacgcaacacacgcgaaatcaatctagggtttgcctcctactctgtgctgcgccgtcgctcgtagattactccatcccgctcgccgacgtgcacctacgatcgggagagtagatctccggaacctctgccttcgacgtcctgcaccgggagaaggcggcaataaagttttttgggaagcgctttgcgcgactgctccctgttcgtccgcgacggcttgtcttcctcttcgctcgcgtgctgcgtgccttcatagatgcctgcgaaaagtttcgaccgagcagccggtctttccgccacctcgatacgtgttcaatatgttgcgcatatttgatctgttcatgttatactgtgtagtttacatgtgtagatctaatgatgcgttcatgctagttttcatctgtaatatcatgatttatttatggaatagattaaatcattatatgcctataatctcaacacataacgtacgtaaactcacccctataaatatatacacatacttctatccttatccaatatatggtaatctcgttaaatgaaaattaaacggtgtgttaattagttgtccgacccagtactagacgagtaaataactgcgtaatttgcatggcagaaccgtgcttagaccaactactcaaattaattaacaagctcaggttgtgcataaatacagacggtggccgttgaacaaggtacagaggtagatgtggttaccggtgtcgcaaggactaaatgcttcatgtttgtctatttaattattggttcctgtacctatctcgtcagacttttcaaagactatacgaataaaaccaccagcatgatctaaattatgaattcatatacatatccggattgaatttaacaggcactccaaagtctaaagatgacgactcactgtttgaatctaacatcttaatttagatcatgccaaaacaaagatcttaagttagctatttaaatatactctttaattagttagtctatagggatggatggatatgatcatagatgctgcgatatagagtagttgtcactgtactttaagtaattgacttgacctatgtagctagctcatccggatggattattatttgtttatatatgtaaatcatactagtatttgccacgagattttctactctcggactagtccatatatatatatatatatatatatatatatatatatatatatatttgcacgttttttctcggcgtcatgcatgcatgaaacggagtttggcgtttttcttcgccttttccgagggccgacttggtgtccacatcagcaatcacatgtcctgaaaagaaaaacaaatagagtactcagtcgtcactgcagtctctgtagtatggacatgatattgaagcgtgggtacacagaatttttttaaaaagcaatatgattttaatggaaaatcgcaaaactataggtcagttaggcaaaatcgcaagtttagcaccctatcgaacaaccgcggttcgacagggatacctatcgaacaaccacagttcgacaggtacatgtcgaactacgtgagttcgacagggtaggtggtccaaaaacaaataaaaaattacatgaacagtatcactacaatactaggcagggacatatcgaacagccaaagttcgatagggttgcgtgaacagcgcgctacagtgatgctacagtgctcgcaggcacatatcgaactgccataggtcgatagggtattgtgaacagtgtgcaacagtgatttttctctttttttaattattttaatcacctgtcgaactaccgtagttcgacaggtaccctatcgaactgtggttgtttgataggtaccttgtcgaaccacggttgttcgatagggtgctaaacttgcgatttcgcctaactgacctatagttttgcgattttccattaaaatcatattacttttaaaaaaaattctgggtacacacatctagtctgagctccacctctccacacaaaaaagtattatctattaacacatgattaattaaatattaattaaaaattaaaaataaattaatatgcttattaaaacaaatattttttagaaaacttaaaaaagatcatttagcaggttaaaagtgtgcaagaaaaaaaaaagagagatgtgagctagaaatgaaggggaagaacatagccgtagacactccttaacttcaagctggctgcttagagaaaggatacgatgacaatgtccaaaatatgtttcagtaaactacatcagcatgatatatttatttatatacatcgaaaataactactgtactaattacctcgtgagcgtatatgacattgttgattattattttacttcctccgtttcaggttataagacgttttaactttggttaaagttaaactgtttttaagtttgactaagtttatagacaaatatagtaatatttataatactaaattcagtgacggacgtagctttaaaatatagatggggcggagaacggagatgttcactcgataagagcattcgaacacaacagatatcatattaatagttcattcgcataactccctcaatttgttgggtgttcacaccttgttatatctaaatttgatggcccataactactataagggggtaaggggggtcttgagggttgacccaccccacctaatgagtagatccgcctgacggagcgtggggctcctcaccgggagaccgcgcaggcccccctttgccgattcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctggagagccagagagctcttattctaaaaaccctcttctcctttttttttctctcgtgggatctcctctctagatcctccccccttccaacccccctcttaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggggatcaccctgtcatctcttcataaatgggcggagatttgcaacggctgctgcccgagtgacccttctgatgggacggcccatacctacctccactccgccggaagcaggtgcaacgtgggaacacggttgtcttccggcaacataaccagtgtcagaccagtcacagaccggtcacctttgtccaccacgtgtcagtttagcaatctgcatgttcgcccttcttcatacaacgtcttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacagtagcccccggcgttatgccagggcgattgccctcctcgagggaagcggtcgggcgtgacgccacttcctaaggcctggtgacaggtggggccggtctaaaaatcgggacaagccggttcgtttttcctggagatatggtgatggcgctttggtcggcgagcgtaattaacgcgcgcacgatatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgtcctaccttcgccacacgcgctcgctctcaaacatctcttcttccggcgtcatggcacggggctccgctccgcttgacggtagcgtgctgccgccttcccgcatcgtgagcgagagacaggccgggctgccgcgccgcttcatgccagaatctgccaccggccgggagatagtctcactgggcgagggatgccctgcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccggggggtcaaatgggactgggtccccgaagacttcaaggtaatgatccaacgggtgctgaatctcagctccgcggaggcatccctcatcccccaaggagtcctccccctctgcagcgatccagatcgcgccaacatcctgtccatcataatggcggcggggcctcagaggaacgagctcctaagggccatgacggtgcgagcgggagccacaagggagatcaatctaccccaggagggggttgtgcttccgggccccgtgatgggggctcggggggcagccgccctgccgacgcccgagggaagaggaagcaagagggtacttcctccccatctcctccccgagggggcggggcggcgcgtgtcagcagcaggcgcccggagggggccgcgccgacgccgcagcccgagggggagcggaagaagaaacggctccgcaagatgggggggacagaaccatcccggggaaacctcatttcccctccaaggtggtcgtttaaccgaccccctcgcaggttcgtcccacgcccattgtggctgtattcattcttccaacacaagttttcattcacccatcttgtttgtcttctggcttttcttctgcttcagcgagatcccgtcgcgtccttcttgccaattcaagtccggccaatctgaggccgagaatgcggcgaccacggaggctcggaggcgggaatctgaccggcgagaagccgcggatcgcctacgggaagccgaggaggccgcccaggtggccgtccgaactcgccaagctgaagaagccgctcgggaggaggccagacttcgccaggccgaggcggcgacgacttccgaggcagctcgcgacgaggccgcgggcgcatcgcttgggcccactccctcgggcgacgctcaggacaagccaggtccgggggacatccctgaatccggcacgtccatcggcgggccgagccgcgcgacatcctcaccgaggcggctctcccccacgccttccgctgccccactgagcgcagagcctcttctgcaggccttggccgtcgctaacaccacggtgttggacgggttaagtgcccagatggaggccttgcaagcagagcgggtggagctcgacgccgcatgggcacgtgtcgaagaggggcgtcgctcggtggaggccatggtggaggtgggccgcaaggcacaccgccggcacgtctcagagctcgaagcccgtcggaagatgctgggggagatcgccagggaggtggaggaggagaggggggctgccctcatcgacactaccgtgatgaacgaggcgcaggacgacctccgccttcaatacgggagctgggaggcggagctagggaagaagctcgacgccgcccggggggtccttgacgctgccgctgcccgagaacggcgggcggcggagaccgaggtggcatcccggcggcgcgaagaaacccttgaggcccgtgccatggcgctggaatagcgtgcctgcgtcgtggagagggacctggcggaccgcgaggccgccgttgctattcgggaggtcacactggcggtgcacgaagccgcctgtgccgaagaagagtccgcactccgcctccgcgaggatacgctcaccgagcgggagcgagccctcgaggaggccgaggccgcagcacagaggctagcggagagcgcgtccctccgcgaagctgcgcaagaggaacaagcgcgtcgcaatctggaaagtgcccgcgccgagagggccgcactgaaccagcgggccgctgaactcgaggcgcaggcaaggaagctggatgcaagggcgcgtagcggcggggcggccacgggcgacagcgacttagccgcccgcctcgcagctgccgaacacaccatcgcggatctgcagggcgcgctggattcgtccaccggggaggtcgaggcccttcgcctggcaggcgagatagggcccagcatgcttcgcgacgccgtgtcccgtttagaccgcgccgggcggcaggcgagtctctggggcgggcggactgtgaagtacgccgccaaccaagggggcctcgcccagcgcctctcggagatggccgggactctccagcggctccccgaggagctcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggcgacccgggtgcatcggagtgagcccccaggcccccgccaatcctcagttttttcttcttttctttcttccaaggccttcgggcctcctttttgtatagattaacttaatctgcaatcaaaataaagaaatttatgtgtcaatttcattttgctatgtgtatgagatgaggatgatctgtgccgtggtccttttatgtcttaacttgattaagggctcgtgcccaggtcccagtcctcaaaaggcgcgggtcggggctagtgcctggggagatccacgtgtcgagactggccaggccgggagcgtggtgaccgagggttatgggtgacccgattgtgggtttttgccgattcccccccggagttcaccacgccccggggcacggctcggttctgggccccttttgacgattttagccgacccgagcccccgagggcaggattgagcacaagtgacctatttcaagtcaagattcttcaaaaggaaacaacagcacagatacagcctttaggaaatcgaaaatgcttttattgaaatacagatagaagaaaaaatatgcatatgtggtagcccccggccaaccctgcacgcctgaagggggtgcggggttggcccgagcccgaaacctgacacccgaactccattaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgtgcccggacgtggcgctgatggtagcgccgcaggctctgctggtagcgtgcggctcggagggccgcgcgccgccttcgctcttccaagtagtcgaggtcatctctgcgaagctgatcttgatcaacctcgcagtacatggtggcccgaggggacttcagggtgagctcggatgggagaaccgcctccgcgccgtagacgaggaagaaaggcgtttccccggttgctcggcttggtgtggttcggtttgcccagagcactgctggcaactcctcgatccacgaatcgccgtgcttcttgaggatgttgaaggtcttggttttaaggcctttgaggatttccgcattggcgcgctccacttggccattgcttctggggtgggcgggtgaggcgaagcagagtttaatgcccatgtcttcgcagtagtcaccgaaaagctcactagtgaattgggtgccgttatccgtaataatacggttaggcaccccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaacggccatgaaagtggtatgatctgcagtgcctgggccggctgatggatttgcttggcatggaactgacacgctctgcatcgccggaccaggtcgaccgcatcattgagagctgttggccaatagaaaccttgacgaaaggctttgccaaccaaggtgcgcgaggcggagtgggctccgcattcgccttcatggatatcagcaagaagctcgacgccttgttcccgaggaatgcacttcaggaggattccgttagccgcgcgccgatagagggtcccttctatcagcacgtagcgtttggagatgcgctggacgcgttcacttccttcgcggtcctcgggtagagtcttatctgtgaggtatgcttggatctcaacgatccaagcaatcaatctaagggagctgggagcgctcccctcgggtcccgaggcctggactccgacgggcctcgggggccggtcaggcgcgtccgtctcccctaaggggtcaggtcgcgccgacgggtgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgctgtacttggcgtacgtaagcatccatctgcgggtcagagcaccggtattccttacagacctggttaacctagctgggagtcgcctaacaccaggaggcggcggatccccagtccagctgccaccctgagtcccgcaaggagtccctcgtactctgccatattattggtcgcccgaaagtcaaggcgaaccaggtatctaaggacgtctccgctcggcgaggtcaatatgacccccgcaccggcgccctgaagagacagggagccgtcgaactgcttcacccagtgggcggtgtgaggcagctgcgaggggcccgagctggcctcggggactgagacgggctcgggagccggggtccactctgccacaaaatcggcgagggcctggctcttgatagcgtgacgtggttcaaagtgcaaatcgaactcagaaagttcaattgtccatttcaccacccgtcctgtaccctctcgattatgcaagatttgggcgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcgatggggccgatcctcttcgccaggggccgcatccctggggcgctcttcgtccaagcggcctcgcggggcgcacttgtcttctgtgctgacgacctcggggtcggaggacgacaggtgcggccttcccacagtggcctcagggccgtcctgggggtcgggggctcctggcgtcgtcggacaagcgggcaaagggtcaaccccggtcatcgggagccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggagcctctcctccctgctctctcccgggccaagccaacacagggtggggattcgcggaatgagggttgtcctcatcgcgctccacaactaacgccgcactaactacctgcggggtcgccgctaagtagagtagcaagggttcacctggctccggggcgaccagaactaggggagagctaagatacgccttcaactgagcgagggcacgttcagcttcctccgtccaggtaaacggcccgaagcgtttgaggagcttaaataagggtagcgccttctctcccagcctcgatatgaaccgacttagggcggccatgcaaccggtgacgcattgcacatccctaagcttgctgggggggcgcatccgttctatagctcgtatcttctcggggttggcctcaatgcctcgggcagagaccaagaacccgagaagcttgcccgcaggtacaccgaacacgcacttatcggggttcagctttatgcaggtggagcggagactctcgaaagtttccgccagatctgaaagtaaagtttctcggtcgcgggtcttcacaaccaagtcatcgacataagcctcaacattacgtcctatttggctacccaaagaaattcgagtagtacgttgaaaagtaggacctgcattctttaacccgaatggcattgtcgtataacaataagttcctatgggggtaatgaacgtagttttttcctcatcctccctagccatgcgaatctgatggtaaccagagtatgcatctagaaaacacaaaaggtcgcaccccgctgtggagtcgacaatctgatctatgcgaggaagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggtcc

SEQ ID NO: 46057 - DNA, 1685 bp, Oryza sativa
aaatcaatcctagaattttactttgaaaacattgttttacttaataatccaatatcaccttatactactcttaggtcttctttgggaccattacaatatgaaaacatcaggtcattcacatattatatctgtggatattaatattagtagtaacttgcagttgcttctgatgcagggaagactgtttctgtcagccagaatagttggtttctatgccaatctgtttggacataaaacgaaattcttctttctgtgggaagatgtcgaggaaatcgaagagttaactccatctttcacaacagtaggtactccatctttgttgtttgtcttgaagagcggccggggactcgatgccaagaatggtgcaaagtcccaagataaggaaggcaggttgaagtttcagttccattcgtttgcttcatttagcaaggctagcaggttgttttatctcttcctagctttattaccagtattttttttttgataaaggaagcttttattaatctcagacgattacatcaagttgatagaaccatactaagaaaaataagataaggagaatctatttgacgagaaaactatctgttcttcattgttaggacaataattggactatggaaaaccaaatcatcagctattgaacagagggctaaactagaagaagatcaagaagatgaaaactatgtcgatcttaatgatgttcaatctgtattgagcattggagatgtgccactgtcaaaggagtatactttggaactgcctatcgatgtgagttttctgcttcattagttcttctgctgatagaattgcgtttgtttctccccctttttagtggaagaggctagataagttatacagtacttgtgtaaacatggatgtgaattttcatccctcgagggtatgtcctttcattgcttgcatgtcatataaatagttataaaaaattgaaaaaaaaaaaacaagatagattaactagtggcgttcttgcatttaacgatcacttgtcagtgtacttcactcctgggattcgtttttctgtacagctgcactgcttgaatattttcgtttatactcgaatttctccaactttggttgaattacattcaaatcagttcaaaattcaaacacatgtcggtgggattttgtccgacctcccaaaatcttgtacttccacagataagatcctaacccatgcttgtcaaccaacacgctgttgtgccaccaccatctgcagtctgcagaaacccccgttttccatcgtccctttgtactttgtagtactacatggttgtcacttgtcagcacgctgttgtgcgccaccgttccttcgatcgctttctgtactgtactcacaattgtgtgtgcatcgcaggcggatctgctgatgggggtgttcgacgggggccccctggaggcgaaggcgatgagcagggcgggttgcctcgactacgccgccaccccgtggcaggacgcccggcccggcgtcctggagcggcacgccagctacaagttcaaccgctacatgtccatcttcggcggcgaggtcgtcagcacccagctcaggctcccctccgacgacggcgacggctggaccgtctacgacgtcatcacgctgcgcaacgtccccttcggcgacttctttcgggtacgcacccaacaaatcacaaccacaaccacacctatga

SEQ ID NO: 46058 - DNA, 57232 bp, Oryza sativa
tgaggagagtggttagctaggcaagtggccgtgagtgaaagggtggttatgctgatagtggttaatattaagatatttgcatctatccagtaaaaagtacctcgagatacaaatcgtttatggttagatctaataatcggaaacgatttattaccgtactagtatctagatttactttttattggaccggagaaaatctctaatattaatgtattgtgtgcgcgattaatttgattataatgcagttgcatttgaggcacaacatatggagcgtggaggccgcgtcgtcggaggcggcggcgagcagcgggagccggtgcgagatactggtggggatcgagtgggtgaagaggagcaagttccagaagaggatcgcgaggaacatctgcgagaagctggcgcacagggcgaaggaggtgctcgaggcggccgccagggagatcgccccggccttgtcgggctagcgagaagctggaggagacggctgttttttctttttcttccagcaaggccgcaacggagaagatctctgcagaggagcagagtgcacgactgaactgtgtcggcttttgccttggctgtagcgtagtagtatctccaaaacagaacgaaacaaataggaatacggagatgtataccaactacagtatatacgatatcttcaagaagtacacatgatcccaaaaaagtgtacaagtgtcgagcccgaaccgagctgtgcgtgcgcgcgcgtgaccagccggccgaattccggtggtttttcctcgtgtcgagccggcacgatgtggtgggaggtggccaactgttggtagatcgggcgatgccgtattgaacatgggcgtgacttctcgttggatagacaagatcatcatctgcggaacgtgggtgcatgcgacttcctggtgctgttgatctggccaccgcagtaccgcaccgctcatggggagagtcatggtggtggcgctcggtttgtatggatttccaagtgtacattcctgaggtgtgcatccctcggtttcatcttaggtgtacaggcttgaatgctaatcgagttactcatcataaaaatgtctaattctatataaaatgttatatttataggtttttatcattgttaatcacataaccagtttctcggcaaaatctatatgattaaggcacgcttgaatagaagttttatctgagataagaaaacgagccttataacactttctcgatcactttaaaagaataaataaatgtatcggatctctaacaccgtgaagaccgtatggatcagtctgcaattgcaaatgaattacaactagaagtgaacttgctaacgaaacgagaaaattggcttacgacattataaagcttcaaactgtactacaagtctacaacaacattgaattgtgctaaaaaatcggatgatataaatttgaactctgatttttttttcttttggtacgaacagagaccaatttcccctcgagctcagcctcagagccggcgctaggcaaaggggagggcacccaactactacagtacccaagtcgtcgccgccgccgcctccccccaaaatcgcccaaaataccaccgagccagacgccactacgccataaaagcagccttcactctcgtctcctcctccggcgccgatcccctcccgaattccgccatggatccggcgccgcaggcccaccccatcctctcctacgtgctctcccgcctccccaccctcgccaaggcccgcccggccggcggcggcggcgacttcgacatcgagcagccgcccgtgcacacgccgtcgccgcggacgccctccaccgcgggggagttcgagctcgtggagcgtatgccggggctgcgccacccgtccgtgctccgcgccatgacccgcgccgtcgccgacgtgtcggccgcgcgctccgcgctccaggtcctcggcccgcggcccgaccacgagctcgtcgactcctcccgcgcgatcgtgccgcgaccgacgccgaggccgggggctcgcggcgggtccccgagggggacctcgaggcctgccgcgccgtggtgcggctcgaggagacgcacgacgcctacgaggcgctgctgcaggaggccgaggggaggctcgaggcggtgtaccggtcggcgatggaggggaaggacttggaagagccgacgggagggacgaatcggcggcggcagccgccggggatgatgctgcggtgcaggaggaggtgatcgcggtgctgaggcaggccgaggagggcaagccggtggagagcgtccgcctcgtggaccggcagctgcgccacctgcggaggcgttcgggaggatccaggggctccgcgtgctcgatgtctcgcgcaatcagctcgaggtgagaaatctgttatctccgcatgctttagatctgcttgtttagaaccctgtaacccaaacaatgcttgtactgggttttgtacgcatttagacatctgaacggatgggatttttctcttctgtactgtgaaattgtgaattgatggattgaatcttatgttgaagatgatcagaaatatagggccatatgcaaaatgtgtacgtgagcgataaaatgcctgttttgtggtgttgcacacattctaccatttgaactgtatgctgaaaatagtttgggcactgaattttcggtaggattgtgttttttgtgtgtgtgtgttatggtatggtcagttcctattatttttagagtcctcaagactgcgcatgtactattttctttatagatttactagtacaacttatttattggtgatgaaacagttactatcttaggccttaggatgtaaatagtgaaacactgtatgttagtatttctttttgctgtttttatttgattactaaattaggctatgggtggatgagtgctgaaagttatggatatagtgacccactagtcttgttttagagtactgagagttagctgttgaccatctacagtctgaaactcagaataactggatactagtatgtagtaagtattgacagaacaaatgtagaactggtaggagcttggcgtgtatgtaaattcctgattagattgtggattcactttctaatatcatcctgtatttaatggttggcttggatcattggaaaatcataggtaagagtagggaaggctggctttgttttgaattttggccacttcctctatatccgtgtttacattgatgtttagaaatttcttagtttatttttgggatattaggttgtgctcatttgagtttaaaaatagacaaacaattaagcacatactaactataattattttctttgataaacctttatactcagttatttaaagatagacataaacagttaagcgcgtactaaatataattattttctttcataacccttttatcctcagtggcttgcctggtcatatttccatagcgacatactgtacacattttgttaagtatgttgttgttgtgtcccttgcttcattggtgaatcaatgtgattgtaggttattccagatgctataggaggacttgatcatcttgaagagcttcgtcttgcttccaatgccttgatttctcttcctgattccattggactgctattgaatttgaggattctgaatgtgggaagcaacaggctaaggtcattgccagatagcatctcaaagtgcaggtagataactttctttagcttaactcttgggttcagcaaatgttactgttcaagtgactgattggtgcaactccaggtcattaattgagcttgatgcgagctacaacgggctcgcttatctgccaaccaacattgggtatgagctggtaaatctgcggaaactctgggtccatatgaacaagttgcggtcacttccatcatctatctgcgagatgagatcattgtacctcctggatgcacatttcaatgaactatgtggtctgccatctgccatagggaaactttcaagtcttgaaattctgaacctgagcagcaactttagtgacctgaaggatctccctgcttctttcggtgacctgctgaatctgcgcgagcttgacctcagcaacaaccagatccatgctcttcccgacaattttggtcggctggataagctagagaagctcaacctggagcaaaatcccctttctatgccgccaatggagatcgtgaacaaaggcgtggacgcggtgaaagaatacatgttgcagaggtggcttgacatcttgctcgaggaagaacggaagagcatcgcagcagcggagagccctcaagcaccgaccactccttcggcctggctggcacgcagcgtctcctgggtctccgacgtttccggaagccttgtggggtacctcagtggcgagaacaagacggagaaagatgcctacctggatcagcagtactgaaagcgctcacctgtgtggtgtttgtgcaccgtgtacatactataagcgttccatgcttaccatctcatctgggaaaatcgttttgtgttcctggtgagtcgagccatacactcgtgctaggcttgcatcccccaaagcaggctttggggtttattttgcccgttttaacttccggacgtccttttcatagcttcacttgttacagtattatattactttgtcgaataataatgtggagacaaatatgaccggagagtgcgctcaagaatatcaatgctttagagctttaggcctcaatgtttcgacctgtgcgttgtgctggaatggaagcggcggccgtgttagtacaggttgccgtcgccggcaattgtgattcacgttttgctcatccgtttcttggcaattgcgattcatattttgctcatcgtttctcgatctcctttctgtgtatcacgtgttttcaaaattttgcaaatactgtgttacacgtcgctatcgcgtacgagaattctcccaaaacccaatcactttcaacatactccccaccaacaaaaggggagaaaccgaaccagcagcaacgtccacgataatagcgcaaagaaccagacgagcaacacaagtttaatacatcatatagcataataaacaactagtaggtacggtacttatttcgattacacaccgatgattagaagtctttaaacaccactactggcactacaccagaccctctaaggttgctggcgagtaggggtagcacagcagcacgaacgccgcttttaactaggtaagctatttataaatatactacggtctatatcttggatactgcaaggtgctcaatagctgaacacgacgaggtcatcactggcccttctaggaggggcaaaaaagattcacggccacatgcttcctcgccgtccttggtgagcgccttgttcatctccgttctgatcagatgccctgatggggaaataagaagcaaaggttcagattaactcttacccgcaatgacaaaatatggtgcataggaatgagacatcctgaacttaccagttcgtgcagttcatcatggagtgcatcccattcgaggatgccacagagttcatcaatggactgctccaggttgtactcgttccgcctaattatttccttgttcaggtcgacttgcccgaagcccatctgccccagctctctcagcatgttgtcctccacggcactgatgtgatcagatgaaggctcggtaggcaggcaagaagcagcgcgagcagttgcagagggcattccaatggcagcagcaggtgcagtgggctcactgataggagcagcagcagctccgacaggtgcagcggtagtcgcactaacaggagcaggcgcaggtccagatgcaggaatgctaacaggttttggcaggggaacggcttgaggtgcaggtccaggcgtggcagcaggcttcgaagccttttcagctccagcagatgaagtgaggagatcagtagctggcactagcactgattcaaatgctctaggtacagaaggtacggcacttgaaacaagctcaggttccatcggtttggtggcttcatggtatagtgcatgtgcaagaggatcagttatggtgcttccagagtatttacccacaatatctgcagactgaatatttgcatcaacagaatgcttccattctgtgttgcttccttctgggggcatgttcaagtttatagcagcactctgcttgttgctactggttttgaccgggtgctccacctgcacatgaatttggaatccaaatgatcagataacaaaggaagtgccaaagccaatgaggacgaaaaagcaatctatggtggaacaaacctgaataaaaacccaaactcgctgaccaaacatctggccagtgggtgatgccaatctccagtacgacacgtacccaccaggctttgcaggtgtgacaaaatcaacaccaacatcgatctcttgatcaatagggaaaccatccaccgagatctgcacatgccgaatcagagttaacattttagtgcaatactgcctaacactcttgaccattcgttggtagttatactaaatacgaaaagggtagggtgtacccctaatttaactgagctgttgcgtgcaaatagatgtccaccaacccaggtaagacatgtcccatatggccacatggaagatccattgttatgtatgcgccaaatctttgtaaatggggttgatggtgccattactgttccatcagggacagtaacatccttaatgaagcggcaatcatgtagctgtcgaagatgtggaaagagcatctggttctgaaaaatggccagatgacagtcagttgacactgttctggaaatgttttacgagaactatatgatcatgaatttgaacaagttgctgctttcacctgattgaggtctctacatcgtctactcccaaaagatggtctgtctattctggtatattcattcacattgcccattcgagaaaaacaggtattgcataaatcataatcatctttactgcacgcaaaaaacaacaaatcatgttagaataatggctttttttccttccattccaattcaacttacgatgatgaactagaacaaccattgaactcaaaactcacatatttgacttgtagcgagaaccagcgataggagtgaccccacagccatcgcactgtatccatctatgcagtgtgtgctgcgccatgctctcgtgcttatcacttagatccctgtatgggcacctattacagctgctgccttcagaataaggtccataaagaccgactggtgagagattatctggcttggatgtgttacttttgcaggtgcatggagggaaatagtgaccaccctttaggcttctgtcagcttggagggactgaactgggtaatgggagagattctcaggcttagatgtgctacttttgcagatgcacggagggtaagagcaaccacccttgatactgcttttatcagctcggagagactgaagtgggtaacggggaaacagtggtggaggagggcatgtcgagttcaaatcaccaccaatctggccattaggcccaaaggactcagaagaaaggcctagttgtgtccagaaaagatcacttcttaacccttcaccgcaatctgaagcaggagcagaatgaacagtaggtgcaccatgaccaatgctagtaacttgtggcacagcagaggatgtaacagacttgcccttactttgggcattggtacttcccttgttatcaacttttacccagcctgaaagggtatccacataataaggatatcccgatacatgttcagcttgagctttgatgtcatcaagaagcacacccttaagaccaagtgatttagttgatccagagttatgcatatccagagggttcgaagctgaaacagccatgagctcagtgtcatttttaatattcaaacttcccaaagtttgtcccctaccactagaggagccagatgaaccatcagcagaaccactggaagactgcattttgctctttggtgccatcagtttagcaagccggtccagcaaatcagccaatgatggcgctgatgatgcagctttagaacgcaagtcatgtgatatttttgcaaggacagtgggaacttgttctggtacaaattttaaagcttcatcgatagctaatttcacctgagccaattgatcttccagagcagtggacattacagatatggaatccaatacctgctgttttgtctgatgtaccccatcactgctgctcttcaactcaacattaatcctaagagggttcagtctctgactaatggcagcatcacataaatcactatcatcatccagtatgacaacatccccatcctcatcagtataggtgagtacaaactcagtatctggattgaacttaaaagcactcgcaatctttgaccgaagagcagccagattaagatcaaagtgcggaccattcacaaaagcagtgaaccgcttaagagtgccaccgaattttacctgaaacatcaagcaaattaaaagagaaatagataagaataataatctagtaaaattgcacgaggtaaacttaaatagaacagtaagtggtttgctttgcaggcaagatgcttaagcaaatgataactcaattctgttcttatcttagcagctgatcaatgttgattcagttaacagtagcgtcaaaacacaattcacggaaccaaatctcagcacctgatgctacataagtaccaaaattacatggcattaatcagttaaggacgactgccaagttaagccgttgcatgttgagggaagtgggttgtcttctacactgaagagatttatacagccatatcatgcaaacctaaacagatttattcaaccatagcatgcaaaactggaacattcaacataccaacaaattacaaaggaacatacatcaaagtgatcaagatactctacaatcaaatccccatagcaagtactcttgtctagctaatcagaaaaacaaaaagccctgcaataatcttgatttcgaaggagtcctcacaataatcgccggcgttaaggactgatatttctacactattttacaatccctgcaataatcttgatttcgaaagagtcctcacaaaaatcgccgcgttaaggacccgatatttctacacagtttcacaatcgcaaacaatacagaaacgatctaatcctgggcgcccaaaaagatgcaaaatccatcctttcaagaacaacactaccacccggtcgcatcgctccacaacccagcacgggcaacagaacccactccccacctccctgcgacaaaacccccatgcgcgagcaaaccaagaacgcggcattcctagcacagaaacaccgcacccgcgaggagccgggaaaataaattaaaaaaagaaagaaaagaaaacctcaccttcacgacgagatccctctcgccctcgcgcgccgtcggcgcagcgtcccggcggcgagacatcccgaccaaacgaagccccgcgatggcgatggtggcgtgagacgaagacgacgaggcggaggggaggaggagaaggagacgggttgagtcaagacctcccttttaatccgtaagcaaattccgtttccttcgatgggaatggaagggattgggaggaggaaattcacgggctttcgcggggttttctgcgtaaattgtactgcgtcctcgacgctttttgggcccacctgtcagtgagaggcgggtgcctcggtggcgtgacaggatgaaaagggttggggcgttttgtaattctggaattagtttaagtgtgtgctcgtggttttgtactatagtgcttatctcattgtggggtccattggtcagtgggatcgtatggataggggatggaattataatattatacttgtgtaaataatccttgtaataacctaacggacgacctcacgagtcacgaccaaaatactcctccttgtgggctgtggcagcttgcttcacgttcaccgtcagcccgtcaccgatctttctatgacctgtgggccacagcgtgaatctttgtcttatccccgttttgcagcagcaagtcagcaaggacgagtgaatgaccattgaatgctgacgagaccctcgcagttgggaactttggggtgctgggttacctttacttgtggatgtaaaagtactacgcgtcgatgcctcgccttgacacggatgaactactgaccacgggaggcagcgagaggccgacagctcggcacccgcgcatctgcggcggccatccgacttcgccgaggcgagccgtcgcgctcgctgcgcccgtgccccggagatacgagaatttccttggctcggtcgcggtccagcagcacaagccgaaatccacgatgcgacggcgtggaaaacccgcatcagcaacacgccttttctcaggctctcgtcgtgctcgcccccgtctccgttccacggatgcccacgacaccccatccgcgcgcgtggcgcggcccactcgcgtagtcgcgtggatggcacttccaccggctctcgcctctcgcgcggccaccaccactcgcgacgcgggccgcacggtgccacagcccacgtacgttcccccgcacgcacgccacgcgagatcgagccgcgcggctcacgggccggacgcacccaccacgcgcgccaacgggcgagcagaggagaggagacgtgcgtcgtcgtgtgtgcctccgtgcgagacgatgtctgaatctgaacaccgatcctttgcaaaggttggggcaagttaacacgcccgcacgcttcggtcggagcagaaaagggcgagcacttggacactttgcacaggcatcagcttgggcgattaacggagaacaaaaaaagcttggacgattaacacactgcgtggtagcaaagcatgtccgtcgctgcgagcctttgctgcatgtatatatacacggatttttctttccagtgggactggaaaaaaggaaacagttcacagggcgtaaagtcctgtgattaaagcgaatacatgcccgtttcttttcgatatcttgagtgcacataataattgttttggttgttcttctagattagtatacacgtacaactgaacacgtagatgaagaaagcttgtgggcttgtgggctatggcatgatggtatatagtcttctccgggacctacaaaataacacaaatacacactcaactgagcataaaatgcaagaggtggaggtggttgcaacttgcatggaagcaaatgagtggacggtggcctgtggggaaccaaaagaacttcaccgcccaaagtagttcgtctaaggccgtgtttagttatttagacaaaaattttatatgtatacagatacacatttaaaatattaaacgtagaccaataataaaataaattacagacttcgcctgtaaaccgcgagacgaatctattaagtctaattaatccgtcatgatggcaaatgtttaatatagtaccgtattatcaaatcatggtataattaggcttaaaatatttatttcgcaatttacatgtaaactacatatgtgtgtgtccaaacatttaatgctctatgcatctggacaagcagctggacaagcagcatcaccgcacagagtcaatcgtcttagaattggacaagcatttttttacacgatggaaacggtttacatcctcagtaagtgacgaacgaaaaaaaaaaactagaacccaatgtatactaattacaaaattattcactgatatatttaattaatatggtataaattagacagaattgaataatctattcaggtcctgtgaccacacgaaggagtacgtagggacaccaatgtctcctacatatgctacaatgcacaaacacttcagtattttggtgtagaagtgaaagcatcttgaaggttactcatggctatcaagtctttaccttcctacacaatgaatctagagcaaaacatgcgatgaattaagataaactatctcgatttcattaagcagtcagctggtggacctgtgataaggagattaagatgctcgtatctagatccgtcctcagtgcagtacggctgaagttatgtcctcatagtatttgacatcaacatttcatctgcctagggaatatgagctctaatgctctcgagtttccttaagtggaatgccagcccaagttgttgcaacttgcaattgcaactgcacagcgcttgatccgagaaatacagaaggtccgagggcccctttgaatcgcagggtagaaaaaacggatgaataggaaaaacacaggattctgacatgaattgaagtgtaaaactgaggattgcaaacacacagtaaaaacacaggaatggtcgtttgattggagcgcaggaatcggatgagagagatagactcaaaggaaattttccaagaggttggagctcttgctaaatttcctccaaaatccacatgcaatgtgccattccataggaatttcataggatttggaaagcttcaatcctttgaatcaaagggccaaatagaaaaatttcctataggatttgaatcatatgaaattcctacataaatcatttgatttaaaggggccctgaatgtagctatgcagggcaatggtcttctgaatattgtattggctagaacttcaggtcaatacataggggaaagtttcaggcaaattttcattaccacggcccattattttgtgacaacatcagaagagaaaaggagtattctgtaggtcagtgcaaaatcgaagtactgataccatgcaaaaagaaaaaagaaaaagaaaggaaacaaaaacagagttctcgggactaattaagtagaagaacttttagattttgatgatgaatatactcccctttttttataagagaactgatgatgaatgtacctgaactggagtattcaaacttttcctccacatttttggaccacagttgatttccttattgttttgtttacaaagaagcactgcagcaaaggctccccaaatttattaaaccgcactcagtccactcaaccttggcccagctccgcaattagttggactggattgcacaactgtcaaatcaatgggctataatgaatttgttatgcacccacacacacaaaaatatgaaaagaatatcgccatttctgaacctgcacctgataaaaacatctttacatagttccagcttggtttatgtagtccatcacaagtccatttcacataaatattccggaaaaatctgtgttttctaaaagataatgagaatcccgccatttcagcctttcactcaacaggagctagaacctattattatttatcacattacatcgtatgtcgacaaaatccacaaaataacaagataaccaaacatttcaactcaaggaaagagataacataatccggaaaatctctcgttcacaagttgaatcgactaggactgaaaccccactcagtgacaggtaatatcttctaccgaatgctgcacaaaagagccaagtaaacggagtggattctaaactcgaaggagatgaaacaatattgttttaaaaaaaatctacaagataaatttatatgtgttaaatcactccataaacatgaaagctcaaatttaacttatgctcccttagattaagtttttttagaacggatgaaatacaagttaaaaaaaaatctaactgcgaaattcagcaaatttttactgaattttgctctcctcttctcacctctcacttgtcatccctaaaactctcctggtccccgcctcccgcaccacgccgtctccgatcaagattcttccctgatccccttgctgctgctgccatcaaatccttggacatttccagttgcaaatttagactcttcccccgcgattcccagcactcccaagtcccatccttcccgctgccccatcccatcccactatctccctaaccactgtgatttaaccaccgaggaggcggcaagaatcgtgtccagctccgcaccgttgttaggcgggagtggagtggactggttatcgtccacgcaagacgacgacgacgacgacgacggccggagctcgccggagcatcggtgtcagagatgagggtcatgaagctcggaaataggccggacaccttcttctcgtcaggccccgtcaggtagttttgtagttttgttcttgttcatcgactgttacttcgatcgtttggttgtcgtgtgaatcgttttttgtttgatcggtgttggtgttggttgcaggtcggtctccacggatttggccactgacatgcagattcttgtggatggttgcctgtttcgtctccacaaggtaagctgcaaagattttcttgtggtttgcgtcgatcaagaactgaattttttttctctgttttttttttggtctgttggatggaacagtttcctttgctttccaagtgcatgtggctgcaagcgctgtgcgtggagtccggcgacggcggcggcgccgtcgagctgccggctttcccgggcggcgcggaggcgttcgaggcgtgcgccaagttctgctacggcgtggccgtcacgatcgggccgcacaacgtcgtcgccgtccgctgcgccgccgcgcggctcggcatgtccgaggccgccgaccgcggcaacctcgccgcgaagctcgacgccttcctctcctcctgcctcctccgccgctggaaggacgcgctcgccgtgctccactccacgcgccgctacgccgcgctctgcgaggagctcggcgtcacgtcacgctgcgtcgacgccgtcgcggccctcgccgtcggcgatgcctccggcgccgttccggccggttcgtcttcgtcgtcgccgccgtggtgggcgcgtgacatctccgagctcggggttgacctctactggcgcgtcatggtggccgtcaaggcgaccggcaccgtgcacgcgaaggccattggcgacacgctcaaagcctacgcgcgtcggtggctgccgatcgccgccaagaaccaccacgcggcagagcgaaccgccggcggcggcggcggcggcgcggccaatgccgagcgggccaccaagaaccaccgccttctcgtcgagaagatagtgagcttgctcccggcggagaggaacgccgtctcctgcggcttcttgctgaagcttctcaaggcgggggaacatcctaggggcttctccggcgtcaaaggcagagctcacgaggaggggggcgtcgcagctggaagacgccaacgtgagcgacctcctgataccggcgccgccgccgtgcgcgggcggggtgctgtacgacgtggacgccgtggtgaccatactcgaggaattcgcgctgcggcaagcggcggcgtcggggagcccgaagggcagcccggcgcgcgcgggcaggcaccggcgatcgatgtcggccgagagcggtgagctcgagggggcgcgccgttcgacgtccatggcggcggtgtcgcacggcgcgatggtccgggtggggaggctggtggacgggttcttggcgatggtggccacaaaggacgcccgcacgccgctcgacaagatgatcgccgtcgccgaggccgtgccggacttcgcgcggccggagcacgacgatctataccgagccatcgacacatatctcagggtgtgcatgcgcgcgacacttgatcacgccgacattgcctcgccatgactaatcttagaattcttgatctctctctcaccgtgtgcctttgcttctgtgccacgtgtaggcgcacccggagatggacaagagctcgaggaagaagctgtgcagggtgctcaactgcaggaagctctcggagaaggcttccatgcacgcggcgcagaacgagctgctccccctccgcgtcgtcgtgcaggtgctcttcttcgagaacgcgcgcgccgccggactctcgtccgggcacggcaaccgcgtcgccgcgcgctttcccggcgacggcggcgacgtcagtgcgctgcttggcactggcaggccaagaacgacggaggagaacggcaaggacgggcagagccccgccgccgccgggagcgtggcggcggacggcgactggagcgtggaggggctgaggcgcgcggcgtcgagggtggcgacgctgaagatgaggctggaggaggaggacggcgaggacgccggcgacgaggcgttcgtgcataggacgcgcgcggggttggcacggagcgcgtcgtcgcgtgtcacggcggcggcggggaggtccaagcggatgctgagcaggctatggccgacgagcagaaccttcacctaaggggcatcaagacacttgagcaaagctgatccgtacataccgtgtacaaatatgcttgaatttgtaagtaaaatttgttccctcgagatttgattttgttccaactagttcttgaagtttggggaagttgtgtgcacagatatgactgcgtgtacactccctccatttttttaaaaaaaacattttgtaaggacgaatatgaacaagggtttatccaaattaatccctaaaaattaatttgttttggacagagcgtgtacatagttggtacagagacacatgaagctatccttcaactgttaaaaaagacttattgctcttttgttgcaacacactacacacccaactcacatccttattagctactgcagagacggaaagttatactttcatcttaaacgaaactcttaaagtttatactctcctaatgcaagatacagaacgcggctaacttaggtcctgattgactggctacagaggcagagttgcagagacaggagaggccaccagtgggaagcggattctctcccgtaactttccttgacatggtcactgacatatgggcctgcgagcgctggcgctcacatgctagtcaccacattcctctaactttacgttagagcatcccaatctcgacgagtgacttggcctgtcttgtgtacgtcaatacactaaagttagtgtatcttaagcaaattttgaaataagaaaaaactaattctattgaccccctcaaacatatatatgtattgagtttttatgactccgtcagtggctggccgcggctgaacagtcgcaacattttttctgtctttggtcttgatcgactcggatgattgcagctgcagcacagccgccacaaaattttgtctcaggtccaggtcacctggttctggttggcgggtgctgtaggcgctgcgcaggaagcacaagcgtgcagggcattagacaacgcctgtgtttgatggcaaaatttccgctatttttttaatggcaaaacatccttgccatctagggagaaaaagaaaattttcgtatcttaaagcaaaacgtagtgctaaaaccatggtttgatacggaaaacacgtagcgctagcgactgatatccaccaccaacaacatcttcttggccgcttgcacaaggtggtacgcgcgaccgacacgtgtgtcacaatctcaggctgacatatgaccatattttcaacatgcgcaacgttatcaatgatcataggccaaaggccagtcgtaatccgtcgctccaaggattggccatgttttagcacaggagcataggacaggagtgcacggtcggccagtcgctgcctcactccagtgcgagagggagatggacaagcacactgcacacagccgtggtcctcctcttgtcactttttagggtaagtttagttcacgctaaaattaaaagtttggttgaaattaaaatgatgtgatgaaaaagttaaaaatttatttgtatagaaaagttttgatgtgatggaaaagttaaaagtttaaagaaaatgtttggtactaaactcagccttaataggtttatcccgcattctcagaaaaaatcgttgttccaaacgccgaaacaatttcgatgtgagggtgaggctacgataagactacagagctgtgtggtatccactcaccagggaatcaaaaaaatctcgcggtgtcaaatcaaatgaacctgatgaaatcgaaactgctgttacaaattgttgtagctgtagcctgagcaaagaaaatactccctccgtcctggaaaaaataaatctagaactggatgtgatatattgtagtacaataaatctagacagaggtacgtccagattcatagtactagaatgtgtcacatataatactaggttagttttttatcggacgaagggagtagtatggcaaaccgggagcagcggctgtagacttaggcaatgaccaacgcatggtataaccccgtaaaaatgtgatgttaagcgggttgaaactacacttatgatatccctcacacagtgcgagccatgccctatcttattttcgcgatacagtacctgttagacagtcgcattttacatttaaaccttggattatttttatttgcatatacgtccaatatttgcagtatacctctaaaaatcacaatcatatataagggcccacccctccctcttctaccacctttctccttccccggcggcgcgacctcccctctcccgtggcctctcccctctctctcgtcggagccgccgcctctctcctcagcgcctcaagcagtggcggtagatcaagcacaatggcggcggatggaggcgcaagaggtagggatcaaggcggtgccggcaaatcgaagcaacaacggcgcagtttcccgagtatgcccttctctccagtccaccccctcgccatcttcttcccctgcgcggggtgacgcctctccccaacgcggctccttgcccgttccttgcccaaagctgatgaaactacacggccctctattgggcatcgtgacgctctgcgagggtgcggtccgggccgagctagcagacatatttggctttgggaggggtgagaccacactccagtgtggagcattggccgtggccttacagagatcctcctcaagagacgcggttacgtgagcccaccgctctcaggcccacatgcagaggcgaagctacaagtacatgtaaatgtaatatgtagagtcagctgactccataggtttttgcaaaacagctaaaaagctattgatatttatgttgaaataatataaaacttaaatatatatatatatatatatatagctttaacctcataggttttagttgctagctctgtcactacccacatgtcagtaacacattgaggatttgcttccggagcagcgggataaaatacgatggtaacagctctgctattgcggctttatcaaattggttcctatctagaaccactccataaaccggctaaatttaagaaaatcaaacaaatttttttattattttgacaaaatgtctgagaatttcagtggttttggccggtaatcgaggagacgaggaagacaaccatgtacgcgcaagacgacgttggcgaaaatttattcctgtgctcgtcgtcggttgacggggtcacgatcactggcggggccacagggagcgaacgacctcggcgtagcacgcgacgacggcggccagtgccagcacgagcagcgccaagccgacggcggccggggcgctctcggccgcccagcacgccatgctcaccggcagcgccatcgcgaacggccacagcagcagcacccgcgcccgcgcccccggcgcgccggcgatgcgccggggcttgccctcctcctccgggagcgcgcacagcgcgagcagcgacgtgaagacgccgaagctgaccacctgcgacgcgaggacggcgaggaggacgtactcgtcccgcgccgcgagctgcgcggcgaaggcggcgcccgccgcgaggacgaccagcgccagcgcccccgtcgccaagggcggcgacgcggtggtgccgcagtcgcagcccgacgacggcttctcgtctgccgccgccgcggacagcagcggctgctgcttctccacgtcggcgaccgaccccatctctgattttgcttccattttacgcacaatggatgattggatgctatgctagcttagctgcactgacaaatccgtgaaataatgcaattacatagctggctatatagtctcaatagtaaaatgaaacaaattcattttaaaaagcagataagctcagcagcgtaagaaccaagaaaatcacataaatattaagccggagctttgatcaaccagcgggctttacaatgctgcaactgcaagagcgtacatacttctgagtatcttaggcggccgctggaaattaattaaggaaataatgacgtcataattagtaagcactataaattgtggctccaaacgactaaccaatagtataaattaacaagaggaacattgttatggttttggaacagaacggtctctgctgtacagtttcaatgaccaaacactctgcactcttacaaagaaaaggacaagctagataaacctatcgctctgtggttcactgtgacagtgaatcagtgatgatatgcatcatgatacataaataattaccaacatagagtatgacaatgaaacatcaaaatcgacaatgatgaaaagcacctcaggaagtaactaagcacatgccaacaaaggccctctttactctatgcaataaaaatgatcttcagtgctacctcttcagatgatacttgcagtagtaatggaaaccaggaccacacaaagtgcagacactgtgatgctgtcaatgacaagtaagctggccagggtgattaactttatccagtctccactttgctgggcaggacagatcattaagatgcgttatgcttagccttagccgttagtgacaagtcacaagctgtctaatcttattgttatcagattaataaagatagtatgacaatgagaaaaccaaataaacagagtgagttctgatatagccaagccgaatcttgagagttctagattggaatgtttgttgtcgggaatcttcaaaacagcatgtgtttccttcttgtcaaaattacaggcatacgtccacagatgaactgagaaaagatggacgtctacaacttgggcaagaacaacggggagacaaaatgtgagtgccacctgatcctcatcgccagatacgccaggcttcaaaatgattatgttgcactccagtcagaaaatggccaggcaatttaacatgatattgcacacatggcagaggttgagcaagtcgttcaagcatttgattttcctccttttttgaaggcatgaagtatttgaactgatctgctctatctgcccaaaatgcctctctgcttaatagatggctcatactttcgcagcatctgctgcagccagtcgctcatcatcaatggcacgctcgtcttcagtggtaagaccctcaatcagtgagatgtatgtgctgtcatcaggggtgatgccattctccaccatctccttcaccatgttctcagcgtcatctccctggccattcttacagagcccctgtatcagcgcattatatgtcaaaagcgttggattgaaccccttattcatcatctcattccgaatcctcagagcatccttgacatcacccttcatgctgtagccactgatcagcgtgttataagtgacaaggtctggctggattcccctctctgtcatctcatcaatgagcttgcgcgcttcatcaacacgtcccagtagacacagccccctcattagcgtattgtaggtcacatcatctggtgcgatccttttcttctccatctcacccattatctcgaaagctcgatcgatgttgccagaagtggagtgactattgatcagagcattgtacaagacaaggtcaggcctaatgcctctccttacagcctcatcaaacagcttatctgtctcctgaacttgccccttcttagacaaggcatatatcaatgccgtataggtcactactgtcgcacggacccctctcctggacatattctcaaaaatctctagtgctttcttcacgttgccctctttgcaatgcccgtttatcaatatattgtacgtgaacacatccggcgcaagaccctttccacccatctcctcgaccaactcatatgcctctgttccacgcccatccatgaacaaggcgtgcacgagtaaattgtaggtcgcgactgtcattgcgacccctctctccaccattctatcacggtaaaggagcgcagtatccagcttaccctggtcacagtatccaccaatcaaggcgttgtacatcacagcttccggtttaacctctcccttggtcagcatttcgtcgaacaccttcactgcctcatcgacccggccaaccttacaccagccagagatcaccgtgccgtaggtgtactggttgggcgcgattcctccgcgttctcgcatctcccgcataatatccagcgccgcctggacgcggccccgggagcagaacccggcgatgacggtgttgtaggtgacggcgttcgggcggggcatctggcggaggagctcgagcgcgcgggcgggcttcccggcggagcagaggtggcggagcatgatgttgaaggtggtggtgcagagcgggaggcggaggcggaacatgtcggcgaagagggcgaaggccggggcggaggggagggcggagaggagcgggtggagcgaggcggtcgagatggggagggatagggacttcatccgcgagtagaggcggagggaggtggcgtgggggcgcacggcggcggaggcggtgagcaggaggttgggcagcgaggacggcgcgccgtcgaggtgcgggagcacggcgagcggcgagagcgccttgtccgcggacagcaccgacttgaagagcgcgagcgccgccgccgacgtcggcgaggcgcgggcggccgccgcgacggcggcggcggcggaggtgggcggcgccatgtggaattggggacttcggaggagggtttttcgtgagttttctacagagttgggcaatggtattgatttttctctcagcagatcgtctaccaaaaggcggtcccacatgcagaggtacagaaactgaacaagacttcaaaaagaaagaaaaaattgaacaagacagagagaaagaaagaagaaaataaactggaaaatgtcatgcagcggcttacatgttacaacaacgcataaacatggttcaaacgttacaacacataaacaaggttcaaaggttacaacacataaacatgttctcacagaacattttcaggttgagatgctacattttttttcttttttttttttttacggggaagagagactactatacttactgctcggctacatagagctggtgttaatacgcaaatccatatacaaaattttcggagatcagttatatgaagggttgaccactccaaatttcgtcactcttataaaaagcgctgcagctctaaaagagtgttgcagctcactagagtggcgaaccctagaccctaaaccctgaaggcgtcttcctgcagcaccgctgcttcccacaactcctcagagcatcacttacgtgtgatcccatccacccagccgaagctttcctgcgacccgaattgaaaatcctattgcaagaaattcaattcaggaaaggcaaatcagattttgttcttaaccgtaacaaaatataagtcagaaaaagaaaggagtattacgagcaaagcacacttacttcccagctgaaaaggtccgtttcgtccgtgtaaagaaaaggcagcgtgtcatcaagagttgggacggggtcctccggaaactcgcagcgctgcagcagatcttcgttgaagtccccggctgttgacgctccagcagaacaccctgcacggtttccagcttctaccatgggccggagagtggatgtgctgcattccccctcctgtgtaaaattcagcaatgcaacagcatgaagtattgtcaaaaaaaaagaaaaaaagaaagagcaattaatttgtttgccctatcctcattatcagtagcatggcttacctgatcatgtgaaatggtgccattctgctccgtgtcacacgggctgttcatcaggcagcgaggcagcggagggttcgttatgggtgtaatgggatcacttcttatggtcagtgcatcagatgcttcttcagtaacagagtccatttcaggcgtgccagtttgcttggaggataattggtagaataccttggaaacaacaagctctccgtcctccccgccttcttccacaccaagattatattgatgcataacccaattagcttgtactatcttgttctttttggagcctttgtaaagaaccagtattttcttccatccttttaagacaccgttatggtaaatctgttggattttccagttttgtgccatcttatgttctcgtcagaagcagcatggccggtgtggctgatctttctacgcttgcgctgaccagaaccatatgcgtttgatattctgtggaagaaatggctgctggtgccgtccagcttgatacctgacagaattacagaggaatgtatgacacatgagctaactaattactactagttcaaaaggcctgataacaacttaaaatatataatccagtaccggggagattttcaggatgtgtatagcagattccttccaccttttctagagttgggatgaagtgatcaataagaccctgaggccctggatttcccaggttaatttttctttctaaatgttcaagtacttcaagatcagatggatcaaatttaacaccgtcagggaattctggccactgtaaagtaacctgcaatgagattttttatttagcaccaacaagaaatgcatagaaaatgtgaaacttaccctactgatatttctgcttaaagccaacctcgtcatacccaaggcaagggagccacaagctttgtggattttatattgaaattgtgacacgtgggagccaggacaataggaataaagtgtagcacacagcacagtaatgagcaaaacaccttttttagtgaataatgaatgatcataaatcgatttagccggaaaaaaaacataaataatagttactcctaatcatagtattagtaaattactaatttacccccaatataccggtagtataatactaccagtagactgatagtataatactaccagtagagagcaccagagcatcgctctttggaagtaatgttgtctagtgttgattttctacacacgaaactttaatggcaaaacatcatcagagtatcagacaactgaactaaaaagttaaatcaagcattcataagtacaataggtagctgaacttacatcgctattatcaatgtgacatttgcagtttgggcattccctccatgcttctggaaccaattctccaagtttacaactcagaagctgagttgcatttcttatttttgtagcaattacctttccaccagctataatccatggcctgcagtaaaaggcagaagtgagacatgttcatcataacaaaaagtcccaacttatctcaaggacaatctatcgccttgtcattcaccaaaaagttcagattttaaggttaatcagcttaacatagtataattgtgctaagttacagatatggaaagacttcttctacatatacggaacttagtctgaacttctagatatagtgacacgcactaattggttcaacagaattaatagcaactaatcatgaatataacaggggttaacataattaattaacaaaccgtacttcgtacagttactaccttgtgccttgtgcatttactacaacaaaaatggtaggagtaagattaaaattaacagctatctaattcagatgtgtcctaggcctgcatgattccaaatgttgagcacatggatggtagcacactaactagtacttagtctagtactacttttggtctccacatcattcgtcatgcaatgctgttgttggaaattcaaagattgacatatctccactctgtttgactttccatgagttccattccctcattccctgctttctgctatagattgctctgtttcaagaaaccaaatgtaaatggacagagcaatctatagcagcgaatggctatatgcctcaaaattttaatggtttaactgcaatccactttggatctgcttacttccctaaactgttgccacattactctccattatgattggctaggcaagggtccaaaagaacagggtaattcaccataggctccacagctcatttactcactgatccagtgttctaggagtactacaaacgtatcgaaatctggaagctgagcccttcaccttagcagctgcaactgtaacaagcctgaccatcagcaacaataagccttcacttagcagctagaatgctgaaaaatccacccaaaccggacattcagagtttcagacagcgtaaggtttcatccaaaatcacattctgacagcgtaaaatcttctgtccatcgattctgaacgccattcctgcaccatcacccagaccggtggcaatccaatcggcaatcagatgacacgaatccgaaatcttcccctctgttagcaacgagcagctgtgaacgatcggaagacgacacatgacccagtctccatagaacagaagcagagtcttcctcctctgcttgtttcttggttgcttccagcgtaagattccccctcaaacctcagtaacctgcaaaaacccccacccccgcatgcaccatccgagaccgctatatccaccgatctcatgcattccggccacgattccatcacgccaccagtaaccagctcgatctccactcgagccacacacaagaatccaaagcgatcgatccccccaccccttccaaaaaccccaacaccagaatccacctctcaccgatcagaccaaccaccactgcattacacctcctcaggtcaacccggaaccacgagccagctggcggaggcgaaatccccaaatcgatccgctcatcagacacggaaaagagaagagagagaggattaaaaaaaaaaactagcccttgcgaacgaacagaagaaaagcgaaggaagaaaaccacccccaagaaaaaggaaccgattaaaccaaaccaggccacaccccgatcgatcggagaaacccccacccccgatgctcaccttgccatgggtgcggcgctgcgacgggagcttgggctgggaggtagagagcatccgaggggggagagaggaggagaagcgagaggagaggaggaacttcttggcaagtgaggcagaggccagaggggggagtggccaaggaagccgggggtataaataggggagcttgcgcgagccagcctcgttggtgggttcgcgtctggaaagggttggggtttctttggctttacccatcgtccgacgaaatccaaaccaaaaccatccatcctgttcgcttggcgggaaaccgggctcgggtgcggcgcggtgcggacgtgcggtgcggctagcccgctactgccttactgtcgcctctcattcagccattctcatctctaattctactgtactctctcaagctgcctaccactacctaccagtgaatgtttcttcaggatgtgttacggccgaagcagctgcagctgctactagcactcttttggtactgtagcgcggttcgatgttttgcagccacaaccattgctactactcctactaccaatcactcccattgaattttcgtgttaaaaatctctgcccacactttgtacagaatccatgtaatctttccacacagggacatgaatattactgtgccactactagtcgttcccatcagacagacacgaataacgctcatcagcactctcctacaggcgcacgtatgcggtatactagtatagtactactatgcgtctatgcggcgagtgttccacgcttccttgcaccggacaaaagcccccgcccgccttggccattggctaggatcaggcacacccgcggtcgtggcccaatggcaatggccggatgcaggagtgagtggggcccacgcgcgccttgtcctttttggttcctgggatgccgccacgtccacgacccactggtggcgcgccgcgcgctcactctcatcgccctgtttttcttcctctccaagccaaagcacgcagccccacactcccgcgagggagggacccagcagaaacggaaactcgcactcgcgcttggtggcacggcgagagctctctcacgtctcagcagccccagccccgaggccccgagcgaagggaagggaaagggaggggagtagtacgcgctgcgctgtagccgcgtgctgcagctggtcgggaaggggagtagccgcgagctgcagggaaggggagtatgcgctgcgctgtagcttggctgtcttggctcggctcgggcgttggctacttgacttgactcgcgcagtgctactacggtctacagtctactgcgggctttgtgtcgaaggcccctgcgcgcgtggacgtggtcgatccaggcgtccgttggatctcgcggtggatgggtggtgcggatcggagagatcggaccacgcaccgctcgctcgttttgggcccatgcacgaccacgtacgccatgttcagaggatgattggaatcagctgtgtaccgtactgtatgtcacaaggaggcggcgcagtgactttgtgacccaccggcaactagcgatacgtattgttgcatgtgccagaagcccagattattcagtgcatatacggagcagcgtatacgtcttaagtgcaggcctgtcgcttgtgtgggcctgcttgggccaaatggagggcccaagtcgactctctttcacgatgagataagcctatgttttctgcccatacaaaagctctgaaaaaaatgcatctttattgccgcgacataggtcatagtacatgtgtatgttttattgccgcgaccgcgcgacgagctggtaaatcctctacagaagtacgcgtacgacttctactgttgcgacttctgcgcaagttcataccactgccaagctgcaaaatctactctactttctagtgctcctattgcactttgtcgtcgtagtagtacgtttacttatctagatcgatatgccagctcatcgtcctaatgaaacatgtagggctcctttgaatcacatgattaaaaaaaagaggaatagaaaaaacacattattctgatagaaatgcaagtgtaaaacaattaattgcaaaacacagaaattaccgtttgattgggctgcacgaaaaacttaggaatcagatgagagagataaacttagaggaaattttccaagagattagagagcatgttaaatttcctatgtttttcctctaaggccccctttgattcaaaggaaattcatagaaattttagaggatttcattcctataggaatttttcctataaagccctttaaatcaaaggaataaaccctatggaatcctatgaaattcctatggaatgcctcttctcatacaagttttggaggaatgttaacaagaggtagaacctcatggaagaaatcctttgagtctttatctctactcaaatttctgtgtttttcctgtggtccaatcaaacggtcattcctatgtttttcctgtgttttgcaatcctctattttacacttatattcctgtcagaatcctatgtttttcctattcctccgtttttttattcctgtgattcaaaggggccctaaaatcgtagaaatacgaaagtttccaccgttttttcttttctcgttcctacgaatcagaggcataaatagtgtatgatttcaatttctttgttttttcttcatttttcctcaattcaaaggggcagtagtattttctatatagtttataatgaaggtaatatctcgctgcagtaaatgaacagaggaaggctcctacggccagagcaaaatccaacggcgagaagtcccacaggtgatccaacggagtagtagtacggggacatgccctgatgcactgttctgatgattggacgtccgggctctccaacgacgagcccgtacattccgccgcgtactgatacagtgtcgtctccaccgcccatggccggaaatcgcgagaccaaatgatggcgtagcctgcgatgagatctcgtcgacttgacgggttgacgagacgacgagaagatggcacgcaacgctatcgcccaccgccgatccctcgagcggtgtccgggtttccgacaggcgcaaacgactcacgacaccacggccagtcgcgagtcaggtcaagggtcaggtcaagggcctcgcatgctgatcaatcgatcggttttgattggactgattctgatatgcgagattactcaaatttgctgctcggcacatcgattcgtcgcaagctcccaacattcgcaattcatcggaggatttttcgaaggaattctatgaaaaaataaattaatttatgtgaaaaatctctgtaaagttcccgtgctcgaaggaaacctgatatgtggcctcaagccctcaactgtgtttcctggtcagtggactctcggcgggtctaccaaaaagggaaaggaagaacagcgacaaataaccattttgtggctggccaacggaaaaaacaactggctacacgagtagtagtagtatccatctcaaacctcttgttgatttgaggcaaccagagcacaatagaacaccgatttgctataccaagtacggagtaccaataatagggtagtgatcagagaatgtttcactgaccgcttcgcccaactgcccaagtcctccaagcctatctatagttctatacgcaatataccttgcccaccgataatagaagcatccacctgtcgatccagccaggccgggcctgcagacagcgagctgtttgaacctagcaattcactaccaaccagctgctaaaccacttggagaacaggtcaagagacggtagattagacgcacaagaaggaataacttagctcaacttgggcattgggttgtgtacttgtgtgtgatattgcctcggattgaccacaggacacataccagacaagcgctcaagtcaatgatggatgaagaaacagaagaagtgctcacgcaatcatgcggcaatttccaacgacggagcaacggaagccagagtttttggtcaaccagaaattggatgcagccatcaaagaaaggaacagaacaccaacgcgaaaaagaaagagagaataaaagcatgtgtggattatctgcagggtaatgctagttctacagcatataaatctgaaatctcacttgattttgcaatctacagcagttctcagtttatgtatcaatcagggaagtaatatgaatgacaggtgaacttgtggtggctaccacagggtaatgagctcctctgggaaggtaaccatgccacgaccgagcatacactatgctgtagcctgtagggtcgtccggtgttagattgcacagtgaaggatgatgaaatcatccatagccactcatcccaagcaatcatccagctaagttagccaatcatatcagatgcaaccgtcacggccagccaatctcggaggtggagaacatggcagtgacaggcctgcacatcagattgaagagtgtagatcatcaaaatctacccactttctctcctgcagtaccctgggagaaggtatctgtaccgatcaacattctgtagcagatagctaggaagatgaacagcagaaaatgtgcttggaatcggccccaacttggcaatgatctcttggaacgtgtactcttcaggaagcatgtcaaaaagatccgcccctctgcatataacatcttgaatcctttcagggttcaggaagtacttaaatctaatccgatcgacatggctgtaagcttgcattttgaaggcaaaatcactaatgtagcgaaagcaaaaactgcagtgccaccctgaatcagcaagaagctcatctgtctgccggaagtgtgcatatcttgtcttcccagacctgtacctgtgtatcgatgccctccaacttttgtcatccaggaaaaattcaaatgagtagaggtaattcctaagctgaagatgaaggatctcaggaatgtcgtcgcaccatctcaggagatcaattgtgtggccacttgggatttcatcaacatctgacatgatcaacaggtcatcatcttctatttttgcaatcttaataagctggtccagggcaaccctctgatatgactcctcaacaaatgggttttctcccttcacgaaccttcccccaatcataccatatgtcagccgtgattcagcaaatccaaatcgatgacgattttccttgaagtgcaggggctttttcaatccagtgaaggttgagttcgactcaagcagcacaaactctgagacataggggcttagttcattccaacgtatttcaagaatatcgagctcattgctgaatagtacagcatcgaagacacgtcgtggggtctcccggactttccacccatgcaacttgcagagtttcgccatggtgacattctcatggtagtaatgagggatagttttgaagggcttgggaggagactcccatattggcctgaggaagtatgtgaccttctgaccatgagcatatatcattaaaattagaattggcactcctatcaatagggccaatagtgctctgaaatcaaatccccgaagtgcacatctcagcctcgacatggtcagaactgcctttgacgcaggctggaaatgaattcacaaagaaaataagaaatcaaacgagcagtagtggacataaaagagttatgaaagaaataagaacagcaaccatctgcatgccaactgctcctccacaaaaactatttaaaatttcagtatgtgcatatattagcaatatttattcctaacgcgggagcaaagtgggcaataaggccataatcaaagcctgcttgccaaaaagatataacctcatgaagcattcgctaaacattagcttttcaaaatacaggtcttgttacagtcagcaaaggcagcatctgaaattcaccggtaactcagaattccactacaaccgcaacaaagtagcaaaggacaaatgagagacctaatgccacagctaaaagcacagatgcaaaaagccaaagacaatttcgctcgtgaagatcagcaaagccatgtaaaaaataggcaacaggaacctggaacaataggtaatcgcaatgcccagctataaccaaattaaactagcttcattaaccaataacacgcaccagccatcacagaagccggtaagatacctaacccaaattatgcagctttaatgggtaaaccaaaaggggtaggcatcccaaattccacaagcttgcaagagcccgaagctttcgccgcacaaagccacgatccaagcaagaaagaggggaagtcccaacctcatcgaaagaaagattctccacagttcgaaaatgccagcacgaaacacgcggttcggccacgtcgcgagattctaccaccaaaaagtcgttactcgttaagaatccggactccatatcgccacccacacctacctaatcccccccatcgcccgcaacggggcagatcgagcgctgcagataagcatgggaaagcaaaccgcccccaaatccgagcaacatcgcatccaaaactcggagcatatggcaatcagcttccacaaaatcggcccgcgtgcggagacggcgacagcgagagcgcgcgcgctcgccgccgcagaccgaacgcgcggcgcgcgtctaggggaatcgaaggaaccgacgcccgcgacaagcggagcatgtctggaccgacggggccatggggagggaagggggaagggagaagggggggtagtaatggctcacctcgccgcacacgccgtcgcagatgccgtcggtcttcttgtggccgtagggcccggtctccggcatggcaggcgcggcctcgcgccagcaaagccccaccaccaccaccagagcaaacgaatccgagcaggagagaaggtcctctccaatggcgaggagggcggggcgcctcccgtggcccgggggtcgccggcgatcgccggtggcggcggcggcggtggttgggtgggggccttgttccgatctcgccctcggagggagggggaggcggacgcttctgggcgttgcccgttacggtggtggcgagttgtgtaattagcgggggagtcgcggggggtcgtgggcgcaaaagcgtgggggcgcgttttggaaccgcctaattatagccgttcgcgtggtggccgtggcctctgcctgcctgcgcctccctcatatccatcgccccggtggtgggcggtgcgtgcgtggcgcggtgcggtgcgagctgggcagttttgtcctcacgcacgcttgggtatttttctagggacataaattaaggggaggccaattaagcgtattgtatatccgtgccatagtcctgaactctgtgtagactctaatgaaaatgggaggctttgcccctcttgataaaaaaaaagtatatccgtgccataatacttaactattttctccgtcccataaaaaacaaacctaatactagatgtgacacatcctaatactacgaatttagatatatatatatatgtcaggattcataatattataatatgtcacatttgttactagatttgttttttataggacggagggagtacgttctttattgcataataagttcatttatgctcattttatttattttaaaataagttaatttttgagtaattattgcattataaagtttgtgagagtgaaaaataaatatatagtagacaaaatgatgaatagttgtattaggatttgataatgtagaggtattgtattttttttattttgtattggtatgtgtgggggtgaaaaatgaactcagtttgagacatatgtagtactccctccgtcttttaatatgtgacaccgttgactttttctcacatatttgaccattcgtcttattcaaaaaaatttatacaaatgtataagatataaatcacacttaaaataatatgagtgataaaacaactcataacaaaataaattataattacgtaaattttttgaataagacgaatggtcaaacatgtgagaaaaattcaacggcgtcatctattaaaaaacggaggtagtatatatctaacccatataccaaggagaaatatagtcagagaatacttataagatatgtgtaattatacactacattttcaacacaaaataaatatttaatattatatttaagaaaattaatttgatattgtagatgttagttttttctatcaacttaatcaaacctagaaaaatttggcaaagaaaattaaagcgacttataatatgaaacggaaagataccttgcaaaatataatcaatgttatatcatgatcttttttgatcataataaagacacacatcatacttatacacatgctgaaccctcacccttattaaaaaaaactttaataaaacagtaccgcaaataagttcgtactccatttgtcctaaaaataatcaaatcatagttatgaatatggacaagtgcttattcaggtttatagcgagcatttgagtttttttagacagaggtgtaggtaataagattaaattttagtggataaagttgtatacctatggtttctcctgatcagcataccatagtactttcttaggttaatattagatattacttggccatgcaaatgacctgtattttggacagctaatcttaaatatgaggtgtgtctttgtaactataatatgccaggttacatttgtactccgtattagctaatcatgtaaggtttatatagttttgagtgtattttgagacgacgtctataaataacattcttagcaaagaaaaatctttcctcacaaagaaaaaggccttctacttttactgttatgacatgaatggttgccaaacgagctacctcaagcttcggaatccaactcacctcaaagtatttgcagtacaactcatcatctttcctgcaaaggataagataaagaaccgcaaacatcacgagaaaaggatatgatatatatatgcaattatgagaggccacccaggtgagatgccaacgtacaaaacggattgatctttccatctatattttgtttcttctcctaaccaatgcatcatctacgctacaaaaaaaaaaaaaggctcttttatcactttcatcagctagaacaaaccatcgtatacacgacgactccacctatctcggcagcatcacattcggagggcatctttcccccaaagcgcccgcgaaaacatgcgtgttcccaacacaactctccaaagatgaattgatcacctgattcccttttggcacaaaattcctctaccacagtatcggcaaatctgtctcgttcaacgcttgcttttgcttactaggccgctattgcaatcgctacgttctcatccactatgcacagtagcaccatgctcctactactgctgtcctagccactacaactgattactctctctatcccagaatatagcaatctaaaatcgaatgagacgtattctaatactacgaatttaaatatgaggtatatccagattcgtattccatctaattttagtatgctacattctgaacggaaggagtaagttttagaagtgatcttaaactaatttaggtgcttttgtagaagccataatctgctttgcttaatcgtttttttcacttctaataaaccttagccataatctgctgttgcgtcggcctcgtcatagccgccccccctccccccccacgttgcagcaaacatcctcccctacccctccccctagtgccctcttccctccacgatccaaacctggtgctctcccattgttcttgggtttgctggtgctattctcatatcaaaaccttctcatttccggcatgctcaacaattggtccaggtgtttgttccaggaactgtgctcctccagcagcttggctggtctatgtcccatgccctccggcgaggtcgcggttgattctctttcatctgcaagttcccccttggccattacccttttgtctacctcctgctcgtttccacccctttccttgagatgtcctcgaccgcaaggttcagcggcactccctcctttaaggcttccttcccttgaagggcgttggagtgcgttgatctaacaagcaatttgatcaagtttgattgaagaagactcattgcgggtggcctttggctgcatctttcagtgtccctccctcctatggggcttccttcccccaaagggcgtcggcgggcttggatccaaaaagcaaaaagaccaagttagcttcttgatggcttcatgcgggtggccttggacttccacagcttttcgttggcttttcttctattccggcatgcatgtggctgtgtgaggaaatggatgttgacaagctagggtgttagctttaggttttggtgtttggtttgggtaattttgcaggtgttgctcgtcaattgttatcttctgtgaggttttttttctttatctgttttctcctctttgtattccccgtgtattctattctcctatcctccagggcccttgcgtttgcgtaggtgaagcctgccctgtataagatcatttggctcaatatattcaggtggggactctctccccccggtgatttagtcaaaaaaaaataatactttgttgcaagcacacaaaaaatttattttaaacatagcaagatgtcgtcgtgataggatactggttgcaagacgatgtctagtgtcttcctgttttattatcaagcatgggtctgtttttttaaccctgaaaaggatggccacaccctatcagtgatcgcacccgcgaaagcgaggagcacgaggagcgcgcgcgcgcggccgttttcttccctgaaacagcgtgcgcgggtcggagcgagatgcgaggggcgtccacgcagtgcagacgcatgcaggccgcggttctctcggctaaaaaactactcgtagtactccagtactacgagttctccgccgcggcgatttgtttcgtgcgtcgcgtgcggcgtggcaagccaaaaagccgctggacttcgcgaggggcacggcggggcggggcaccggccaatcgagccaacacgtcgttgccgtatgcacgccgcggcttggaaattccggcggaaaccgatggttttgttcgacccgtttggcgtttaggcgggcgtcgcccccttcttttatttgtttttgagtagagtgcacggacggtccttaaacattatgtctgtgtgacatgccacatcagcgtcacgtaggatcctgaaggggctgtggctatttgggatttagatgacacattatgacaagttctgagacttggatatgcattttgagagtttaagaacctagatgacacaccgctacaagtttaaggaccgcccatgcactttatactttgttttttttccgttccaatgatggagccgacgagtttctccgtctcaaaataagttctattccacatatatcaatataaaaaaaattaaaataccactatgttattaaatcacaatgtaattagttttttatctacttctaatatatttattttctaatttcataaactccgatgtaataattacttaaaataaataaattttaaaacaaatggaatggaaaaattgatgtattttgagacggaggattatccaagacttatcattgcatatttgtgttaattatttaatgtgtgcgtatcactgtatcagctgagcggagggcgcagtcgatcgatcgacttgaccggttgacttgcaaagaagcacattatataagtatatactacttcttgtacagttcggttggtccatgaagcatgcaaagtaacagtggaaaaaaggccatggaaaatgcgtcgtccactgatgagagatcagtccgtgtcaagttgctagctgctggtcattttcgcgacatgaaacgagaaagaaagggcggcatcgctagtggcccatcgaaaaaatacaaatggacaggcacctctcggtgttttagtgcgtttagtggctcaggggcaaagaccgtgtgaacaagaatcgccctagacttactttgattagacggcgatctgtaccgatccaccacagcttcctctgccgcatgctgagctgaaactaatatgttgggggcgaattcgacacacaagaatttccatagaatttcagtaattactttaaattctacaaaatatattacaggaaccgtcatcatcgatatagaccttagtagctaaatgcgaaagaatatccaaatatgacaagacatatataaacatgatatttattgatgagttttcagttgaaacatatgtaatatccggacaccgattataaacgcaccctcttaatccattataatcctcgaccggctaggccactgacctagtcgtttctctcctatgttattgttactatgcggttatatagcttatgtcactttatttaagactgagagtataggataagagagcaactatatttctattctaaaacctattacaactccaagctatactttgtaaccaactttatacacgtattcaatacaaaaactaacaaatttcacttgacgaatatgccacatcaatctaaacttgttcgtgcgtgaacttccatataccttacttgagtttattcatttttgctacccacgttgagctcttccatgagcctataccaagcccgtcatcttgaagaaatcgacctggatctcctctttcgccgcctcacgccaacgaacctccgtgcacatgccttcccaaccatctccgatgtattctactctgccgcctcctctagcctagagcaagatcgtgttgagccctctgccacttgcacatcacccacactagggtcatgcaccttttacactaattcttgttgctttagatcatcaccgcacaagaaatctaaggtttggtatctcctttttcttcggtgatttgcaatcccgtggttactctggttgaattccatcaacttctaggatctagttgtggctttcgctactattgttgcttcatctcaagctcgcaacccaattaatctatccgcaagacgaagccgacaaattgccatgtcattttcattgccgccaaatgacccaagcgtcatgtctgtctatctccctattaaatacaactcattgaaaagacgtctaggcaacccatccggagtgttcaactataccgatcgatttgtcgattgctttcagccttcaatcaacccgcttgaagtgtccagcaccttgaatcaccgattgctctagtcaccaatcaacatgagaatcatatcgtcttcttgttgattgcaggtcatcgaatggtccgagctacctgtttgaagtgttcaacaccactggttaaaacattgaccgacaccatgctccaccttgcaccaatgtccctccctagtcattatgtgcagattgcacggtgtggagcaccttcatcgcacatctctcccatggatctttcatcatagctaggctctgatatcacttgttataaaaattagcatgacattggcctcgtttccaaacacgaaataacaccataacagacccaatcatgatgaccacaccaagacatgatagttattgacgaggtttagccggattctacgtcctcgaggcatcagttacatgcattcctctttgatctaacataattacaactagcatggtggcccgcgcagcttgcgcggctatcatcattatattttctcacatataatagcatatatgttttctcaatatattgttcaaatatattaaattgacaatataattttaaattttgcaataactttacgaaactactaatgggtaatattcatattgtattttatatacgtgttagttattaattattttaatatcaatttttaattatttgtaaattatatatattcctatatgcactctagactcgtcttttaatatatattttttaattccgaattttctgtaaactgtatttctatatagactctatgctcttcttccaatattatttatttttatttctgaatttttattatttttaattgtatttctatgtggactctaaacttatctttcaatattctttaatttttaatttcgaatttcagttacttctaaattgcattcctatattgactttaaactcttcttcccatgtttttcttaatatcgaattttagttatttgtaaattgtatttttatacggactctaaactctactttaattttattatgtttattccaaattttagttagttttaaattcctatatggactctatactctaattctaatattctattttttttaattccgaatttctattttttttcttaattgtatttctatatagactctatattctatttctaatattccttattttttaattccgaatttcttttttttcttaattgtatttctatatagactctatactctatttctaatattccttatttttaattccgaatttctattatttcctaattgtatttctatatggactctatactctacttctaatattctttattttaaattctgaatttcagttatttcctaattgtatttttatatggactctagtctcctcttctaatattccttattttttaattccgaatttcaactatttctaaattgtatttctatatggactctagtctcctcttctaatattcatttttttaattccgaaattcagctttttctaaattgtatttctatatgaactctgttttttatttttctccgattaatgtgagaatttctagaccataagagcgaacgtgaaggctcctttttctattcctttaataatataatagatatattgggtctgaaagtcccttaaccagctagaccatcggtcaatcattcccttccctatgctactattgtcatgcggttataccggggtaggggtgaaaacagagcggattcggacggatagtagttataccatatcttaaaccattttttaaagcgaatgtagagcgggtgtggatgatgtgcggatgcggatacgaagcggattatttcggacgttggatttggtactgagtctgtgcggactcggttcggaaacggacaaaaagttgtcggatgttaaatttgtattcaatccatacaacaagagggcatcaatacaattagccgcaatacgatggcaaaacaacatctgaacatgatctcagctctctaggaaaaccaatcaaaacacaacaataatataattttgcttaattggtaaagtacagcttgtataatataacacatccagcaaattgtcaattgcttaagggctcaaataatccaagatacatagcacgacagacgacggcaagaagcagcaatggggacacggaacgacagacgatggggatggcgttggcgacgggccgacgttggcgcctggcgacggggatggtgctggtgacggtggcgcctaggcgctggcgctggcgacgggccgaccgccgacggtggatggtggcgatggggacgacaggaggaggcgacgggccgatggaggacgcgctgacgcaggggagtggggacggcaggcgacggtgccagcaatgccagaggcggcgcgctagaaggaggagcggtggcggcgctagcagcctgcaacggcgcatgtgtggagttggagaaatcgagagacgcgtgagaagatgagagtcagaaagatttgggggatggttggattaggttatgatagatgggccactcgatggaaaatgggctaaattgagtagttgtgtggcatgaaaattgtggattatccgccaaatagtacatcggatcggataatccgattaaaatatcgaataatccgcatccgtcggatatcgttgataccacatccggctccgcatccgcatccgccggatatctaaaaacccttaccatatcctcacttcggacggactcgaagcggatcggatcggataatatccgctccattttcacccctataccggggtgtctctttaattaatttaagagaggatctagaataagagtctagctctacttttacgctaaagacctattacgactctaagtctcactctgtactgattttgctagatatctattttgggatggatgtcaactaacactgatggggactgagcttgtaagatgtgtgggtgcaggaattgttgcacgggataatgttagagataaggataatagacatatattcaacttcaacaattgctatgaaatttctccattctaaaagaggcccaagacatttttgaattatcgggaaggagttttcaaatgatacaataatacgtgataaagaatcaatttgctaacagtattcctacataagctagctaaacgagaacgatggaagagtatgggcagaactgcataagtacgtaagacggaatacagcatatatggtgccttgtggttgtggtgatgtcaatgtgatcctgtgatgcgaatatgagcatgacggcattttcgtcagccacctatgaagtatgaactctcctagttcgtcttgaaagagcataagacttacgcaatcattgcattaaggaggagaaagctaaggatgaactcaaagcaaatggaacctagttaaggtgagacaaactaaaccaagtaactaattggagtctaatttatactagtacatctgtacatgtcaagactcaagacacatcattcaggtcaggtagatatctgctggacagttggccaaaacatgacacatcaaagtatcaaacaccattgccagatcaatcatgccatggttaggtttatgctagttatccagaacacgcaatattttttgtttgtgagctgatacctgcctgagataagatgatgagaaacaagttaagccaattctaagcaggttctatctacacacccacatggacatgtacaccatgaagtccacatggaggctgtccattacaagcccttgaaattaatatttttgtcatcttttttctctcctaccaactcttgtgtcatttgtctattgccttgcctgctaatctttaatcaggtctctcccaatgacatcttaggaggctactatcggttcgcttatgcttatgcttatcagccaaaatttaaattttcatccttaaatttggagttgattttgaggttttttcatcgaagtttatttttcagcctttgcttttagatcgctaagaacgtgtatataaaagttttatccacaaattgtttttcgtttataaatatgccgtttcgcttattccaccaataagcgaaacgatggcagctcttagttggttaaaggagttgcaattaatgtgtgcaattacttgtaggttgcgattccgtgctctggttatgccgaagcgtacaagcattttggctgtaatatgctgggaacattgctgtcctggctctgagctagtagctctttcaatccacctcaagaaaagcattactttaattaaggcaattaattaatgcctaagtcattttgaacatataggacatactttatgagtaaaaaataataaaaacaaataggctactcctttatgtgtaggtaaaaaaatattattaaatctcaatttagaatacaggaatttcatttgcgatttaaatttgttctcttgcgatttcttttagccgtttagagataagtgtcacgtaggcagataactgcttttaacaaccgcaatccgtatcatttatcaaccaccaattcatcatcaaagagttgaagattgttcgcatctaaattgttgtttactccgcattattctctctatcatgtcatcagatatagtatataattattggtcaatttgcatcgaacattataaacaaatccatctcatagttctttccgatgtctattttatatccattggcgaggctacacatagttaaaaatttaatcaactctttgaagaaacgaactggccggttaattaaatttttaactaaaccggccaaacgatgaaacttggcataaatttactgggtgattcatcgcttcgttggacttgtgctgctgcctcaatgtctgaattgttgtcttctcttcggacagcgatggctagattgaaattttcgtttcgttaattttttgtttggctcgtggtagaatccaagggcgtattttcccttcagagaaattgtgtcttaacgcgatttggactttgtaagggcacttttaacaagcagagttcaaaaaagtttaaagttatggtttggattgtgtgaaatcattgtcatgattaatatttgtgacgaacaattggctttgcaaaatgatttattcggtgaattggtttggaaagatgtgtggatgttagtgtgagtgcgtgtgactaatgtgggttaggttgtgatatctgtgccaaaaatcggttgttttgtcgtgattgtgtgaaggtgacttgaggtcaaccttggtcaatgatgaggaccgggactatgtttagggaggaacagaggtctagtgcggtcgggatactatgtgagaaggtgactagagtcagaaatcttggaggtcaacttcggtcaacggtggggatcggcactaaactcggggaggagttgagatccagacggtcaaggataccgggtgacgaagtttgatatgagatggcatacggtggatggacattatatgggagagatcttcgcaacgggcttcacgaggtgtgcgtgcaagcgtcggtgttcgcgaagggaattgaaaagttggagtatatggtgctacagtacacgaggtactgtagtgtgcaggtatgcatgcatgtacggtgctgtatatgtacgtgtgcatgaccggttggccgagcaacagcagagcggctcggtgggcttcggtggctgttggcggcatgccaagtcggcccaggagaagcaagggcccagctggcagcgagtcggagacggtcacgcgtggacgtcagcttgggagcaaatcagttttggatttctggtgtggccggttgtttgctgcacgtttggaaattgtaaaacgtatggaaattgagagattgagtcctgttgtgaattggagttcaacacctattttgagtaggaggtttttatgtataaatagagagggagggggtggcctcccggtatcggttttagtaatccgagtttgagagattagataaggtttcgtgagaaacttttgaggggtgctgtggctgcaccttgtaaacaatatacttgagcaataaagatcatattcaatcatcaaggcatcgacgatctattccggtgtcgtaagttttatgtttatgtttggttttagcattaacttgtgattattcgttttgctgcgattttgtccaagttaatccatccaaaatctttctaatacttcatagatcagatttgaaaagtttcgttgattggttcttgttagatttgaatttgcttaagttttaggtttagttcagatttgctgaaattctgagacagctgaatttcgagggtgttttctcttaaaccgtttattagtttgcaaatccctccagtggagttgtttcttggtttgtatagtttattatgtaaagtttgcaactcgatccaacggttggtttaagagaaatcgtgtttttaccgaagctctgtcgtgctgtttttagtctgatggtcaaaccgcgagaggaacagcggtcaaaccgattagagttcggtcagatcgatcctagtaggtcggatagaccgccaaacatgtgttccattggcttttgaggttggggtgtgttttgatctattaagattcgattatttgacttccgctgacgaaatctaccattcaccccccctctggtaggcttggttacttgtgttcgatcctacagattgttcctcgaaccagcgctcgcggttagaggggttcttctttttctccctgctctagcccctagtgtgcaggataaattttcactaagtaagagtttctatataggatagatataggatgtacgtgcgcacatcacagggacggaagtagcagggggcttgaacaccccctaaggccatgttcgattgggccgagaacggccggggtcacggcccaacccccgtggatcaacctggcgaggaagcaatcccagcccatgggaaaagttgcgttcggttaagcccagacgatgattttaacccggcccaccacagggttcccctattgtccaggcccaagaaaaaatcacctagtgcggaggcttggaaaaaacacttagagaggcggcacaacgagaggaggcgctgcggcatgactcggacgcgacgacgacgacacgctctctcctcgggcagctgtctcctccggtggccacatgttaatgaccaaatttggtaaattatgcatcagctgaagcggatttggaaggaaattgacaatcacagaaacagagcaagaatcagcatcgaattgcgtcggctatggtgtgcatcggctaattccgaatcggataagggaagccgatgtagccgattccaacaaagtgatgttggaatcattgtcggattttgttggtgtgcttcatgaggattgccacctatggattaagtctgaaaaaggcaattatgtctattaattaaaaaatagtttgttagtttcttttatctttaggaaagtgtgtttagtgtccgataatgactttaagttttccatttatctttaggatagtttctttcttctcctataaggactagtatctacccatgggtataaatatgtacacccagggtcattataatatcaatctttcgatcaatgcaactctcgacgcatcaccaccctctttaccgaggtttttacttatcaaccggcggaagttggcacatgatgcggggctgcatcggttcagttcgatctccggtgaagcggtaagtcctacgttccgccggcccaggtaaatatatcggttacgtcagcgtcgtccaaggctgcatcagtacatttgacctcttggattgctctggtttggttgatatatttgcctacctgatatctcaattctatctctgattgcattgtgtttagagacgcatcggtttagttggaactgtctcggttaggtccgatcttctgtcttagccgatatatctctacaatcacaatgtcgttctaaatagatttattatatccatcacattagacagatctatcggcttatcgagtattagattatcatacaatctcgtgctgcatcggttgtgtccgacctactagattgttgttgataatataagtcttgttaagccaataggttcatgctagtgttttatcggggtgctagccgataagttatctggacgttgcatcggcttataaggatcacatatacatatgagctggatttagccgatcacaacaaagagtttactgatttatctaatcttgtggattctatgacatcggacctccagccgatgtattatttaaccttcggatcagtacgtgttctatcatatcatattgttagccgattggtttctactggataatatcattatatattttattacatcttcatcagccgattgcctccatattgttatttatataatgtcggaatctacattggatatatagccgatagctcaaaaccctatcaatatcggctggtatcggcatcggctggattactccatcagcttgtcagccgatcgactcattgatctactgtttacatatcttgtcagttgcaggatcaaactgactggcacgtccgcatctcatcaatctttggacctgcactggagctaagcagatctcccaggccagtgtttgttttttgcatcaacaccaccttctcccaagtccccttcccctctcccctcctcttctagggttagggcttctcacgtgcgcgctgctgctgcggcagcgacaacgcacggtggtggcaggtgtggcgaggacgctgctgcatcacaccccctcgccatggctccgttgaagctccgccgctgcggcaaggagaagtaggaggacacggacgtggtgaccgcttcgagtgttctttcttccactggtttctttatttgttcttctttctcccctttgatctgttacctagatttccagatttcctcctcccttagttcttggaggtccttaaatatgattgtttgattctcattatggcatacatttactattatttgtatgcaactttggcttttctgaggccgtgcaaaaagactagcaatatttgcatatttgtttccgactcttgcttccatatgccgcttcttcttcgcgatcaaagtcataagactatctatgttggggggagtagctttgaccttgcccggagaggacaaaggctcccattttctcccaccaatcttgctctcgatgagctcacaagcggaggctccgaggagccaccgcagggccctcggaagccgccccaaggggaagggggcgcttcagaggcttcgtcaggcttcggggaacgtgaccccgaagggggaccccggaggcaacagccaggataacatcgcagagagccttaatctcgcattttaggcggccaactacctttgatactgttggctcaacaccctaggtgaaggccaaggtacatcgttatcacgcctcagcctcgagcagtgcaccccgggaaacatggggtcccccgggaatgctggcttaatgggcgcagtcccatacgatgtcccttggagagttaccagaccgcccttgagcgggggccacttgtcaacctccatccttgagttaagcccagaaggtctatctctgtaatttcccttaccaatgtaagactacataaagatgtaatacgccccccccgggggggagggggagaggggggcaaatgaaataatagataaaaaccacatcccttcttcccttgtgcttgaacccctttggattttattccaacattggcgccgtccatggggatcgagcaaagagagaacaaagcagtgcaagtgaaggatgccttcaaagcatgcaacgaagcagaaggacaccacggcagccacgcgactgtgtagggcaacgcgccccctggtttggctgggtgaactagtgatcgcccctccggctgacgccgacggtagcgccaccgggagtggcaccaaacttgagcccgagaccctctgcgatgcggccgtagaacctatcccacaggtggcgccggcgggtgatctagctacggacattcgcgctccgggggcgccgacgcgcggatatccgtgaattaggtttttcggacctgtcgtggacggttttggcaatatgatgggtgaatatttctgatattgcggtttagagatataaattaaacccgacgtaaagatgaagggatagaaggtgaacttattccttctttttccttgaacgtaggctaaactttttgattttttattgcctaggcgcctagcccctgttctctccggattgggccgaaagccagcccactatccctactcccgcaggcctgtaatcctcaatttgggccgcattcttgttagcaaagacccgacccaagtatagaatctagggtttataacaagaccgaaggaaggacgaacatacagattcctatcctctctcgccatgacaacaatgtcgtcgaggctcgcatctcgcgccgcccgcttagctgcggtggcggcatctcgcgccgcccgcttagctgcggcgtccgcatctcgtaccggggccggggacccctcagcgcgggccaccgccactgccgcatctcgcgccgctcgcttagctgcggcggccgcatctcatgccggaggccccacagcgcgcgcgattgcggctgccgtatctcgcgccgcccgctcaatctcctcgaagctccttgacgacgacatcgctgcccgcctctccttccgctacagcaccgagcccccaggtaaaccttaacacccaatcccgctctcttcatggtctcccagcaaatgagaattttcagaatatgccactcaatttgcaccaccttcaggatttgccattaatccatgtttggcgaacaaaattgcataacaccgtaatctcgagagaatttgtatttaaaagataatgcagatgaattcctaatccccgtgcctgagaatttcagaatatgccactcaattcacaccaccttcagaatttgccactcaatttgcaactttttcaaaacatgccactaaggactctaattgtttcatccccaccaagcacgggaattgtttcattccgtgtcactccgtctctctgaagttacgcgtcgtcgcccgtccgtatcgtgccgtccgttgcgtcatcttgccgccgccagcgtggggaggaaggccgccggcgtgggtgaggagcttggccggtgttggggaggaagagctcgccattccggtgcagggaggaagagctcgctagcatgaacggtgtagaagcttgccgacatggggaggagagctctgccggtgcgggaggaagagctcgtgggcatgggaaggaggagctgccggcgttggaaaggaagagccaccggtgttgggaaggaataactcgcgcgggaaggaagagttcaccggcatgtacggggaagaaacttgtcggcgtggagaggaggagctctgccggcatggggaggaagagctcaccggcgttggggaggaggacccgccggcgtggggagggagaacttgccggcgtggaggaggagctcattggcggcgcccagatgactcaaacggacgtcgtgacacgggcgggggacggcgctctgcttcgcagggcgtattggcacgggatgaaacaattcgcgtccttagtggcatgttctgaaaatgttggaaattgagtggcaaattctgaaggtggtgcgaattgagtggcatattctgaaaataaacagccaaccatggatttagtaacagactaatattcgtgtcatcaaaacaatgttggcatttattgtgtttagtttttacaccattatcacgtgtgatatctctcagcttgaaagctcaacttttctaccaataaaaattttggctggaacctcttgagccaaaggctgggatctaattccattatctgaaacatcatataaattcttctttgtgcttgcgaaaaatcaaatttgttcacactactaacttttgcgaattgaattgtgatagatgatggtaagtgcgttacagccaaggacctcgagtcagatcaagccgtatgggccttatatgagcgctggtgcaagtcatacaacaagaagcgtgaccatgctgagatgattcgccggttcgacatattcaagctgaaagcatcgcttgtgcacagctggaacaattatgttcatgaagacaaagaggaattagctcgtgcaaaaaagagaagggatttaggcaaacctgtcgatccttggtacctacaagaggaattaggcccatccgccgatgggggagacactgttaaccaatactggcggggcatgttgaaggaaaatgaccaagggatggatctgcctgacatccaaggaggaaaaaaaatgagcactgaagattgaacatgttacataagagcgatttaatttgcttatggaaatcccttaccctcaaggagttgaacttagctccccatataaatcaactgtaataataagttatgatttgccgttccatgtgtagtctatgcttatgtcgtaccatcttatctaagtggtcatgaattccatatgcttccgcctgtgggaagtttgtgtattttagccttttgggtttacgggcacaagtgttcaaacagatcaagatcaagtgtgaagatggtatatatgtcagttgtttgtacattaattcgttgagcaataggacgaaagtaaaggtgagtattgtcttgtctaaaaaattcaacattttcaccattatcattcatgcattgtttgtttatatatatataaaaacggaaaagaaggaaggggaacaggaagaggtgcgctaggaaattggcaataaactaataaagaggaaatttattccatattctcaatttgtctgtctaaaaaattcaacattttcaccattatcattcatgcattgtttgtttatatgtatatagaaaagaaggaagggggaacaggaagaggtgcgctaggaaattggtatatatataaagagtactgcttccaatttcctctttattagtttatacaggaagaggtgcgctaggacctttataaactaatacatcaatcttacttgaatacatataaagaggatggaactaaagttgttatttagattagttggcttattgaacaaacagctgtttattacctgtgtaaacaattacttagatattttcgccgggtcaattacttagatattgatcatatggcttttaatttagtttatctagaaaaatatttttgcaacttacttgttaggttgtttggcaattcgttgagttcgacatgcgcagtcttgatttttttttaaaacacaacacactttgttaaaccacagcgtttaggggaattgaattccccaatacatcgcccaggataaacataagagttggaccatatttaacaagagagaggtcaactgaaaaaaagaagcaaactttataatgaaactaagcagcaatgaaggagcaaatcgatagggtactgtggcagggccgcgacaattgcatccaagggcctctattgatatgtactccgcttgacgaactggtaaaccccttcggctgcctccacggaaacgacacatatgagaggtttggtgcgaagccgtagattttggtgtgaacatcaccggactccacaaaagatttccacggggttcatcattgaatctgacaagcttggactgcaaacctgcaaaccaaagttgcaaatccaatctgggctcaacccgaacgataaatcctgcatggttattgctgccaagagataaagaggaagaatttccccaaatccagccaaccaaagacttaatccaaagatggtggcgaagaacatgctgtcttggtaactcgatggagaaggttgaagaaaaggagatcatccgagtcgcatccacgccgccattgcaggacacatccgcaccaccgacgccgtcgcggactgcaacggcgcagccgtcgccgccgcggggtgcatcggcgcagctttcgccgccgggggccacatccgcgctgccgtcgccgccgagggcagcaacggcatggccgccgccgccgcgggccgcatccgcgtggccgccgccgccgcgagccgcatccgtgaggccgccgccgcagctgaccgaaaccgagtcgccgccgccgccacagactgcatccgagcccctgtcgccgccgcaggtcgcatccgagccgccgccaccaccgcaggccagatccgcgtcgctgccgtcgtctcggatcgattctgcgtcgccatcgccgtcacgagctgcatccgcgtcgaatccgcctccatctccaacttccataccacaccaacgaggaggaaacgggaagaacccgacctaacgagactagcccggctacttagctatactaggggaggggggacgacccctctccctcccgccgccggcgacgaggccgccggaatcgaggaggaagaggggtcgagagaggggatttactgtagcaagtgaggtttcgagagagagcgctcgtgagtcgtgagaggtttccgcagccttgatttctagttacacgcgcagcctcaaggcaccatctgattcttttcagatttcagacaactcgaataacttcaaatttcagattcttgcctataattcttttgcaatgtaaagaatttcaataagtgctgtagggccaattgtacaaataccatggcttgctgaactaggagaacctatctcaatctctatgccatggtcggaattgtgtatcaacgcaggaaaaagaaggggaaggagatggcgcacagctgtgattgtgccgaaccgtgaacagtaccgcgcagatagcgtttccgttagcgtgacaggggagttagtttcctttaaatcagtaaattgttagttacaagagtaagcctataagagggcatccattcggatattttggatccatttttactatatctcactcgaaagattttttcttatctctcactcgattttctcacttaaatttacagtccattttcttgtaagttacattgtaatttatgaaacttacactgtaacttgtaacttttgtaagttacactgtaatttttgaatcttcgcatgtaaattttaaattttgtattggatttggtctttttattgaggatatggtaatttagtgtccattatggtgtttcttaattgctttttgctttttattatatctatcggattttaatctaaagattaaaaatctgtgtgatacgatcataaaaatctttcgaaagacgtataggtactccctttttggatatgcaatagattaatcttcatctcatctcctgtttctctcttctcatcccgtgttctctccggcgatccacgacggatcgccgttcgcgcaaactacccaaacctcgtccacccacaactcacacatatcccatccgttcactattggcgcataacaacttgttatcagagactgtggttcaggacgacacatccagcgataagcagccgctgctcgagccgacggatgccgttgccaagctgcaggacaccatgtccgacgtgctcaccggcttggggttgttggcgtccaaaagcgatcttgctgaccttcgtcgttcggtggccgtcgtgacatcgcgtctcacgtccctggaacagcaaccaggggtggcctcgtcttcaacaactccgcttcaacctcgcctcggcggctcggcggcgcgggcatgttgcccaacccgtcccaacccaatctgaacgttggcgcggcagagctggcggcgggcacggggacaggcgcgggaacgggcaccggaggcggcagcgttccccgtttctacaagctcgagtttcccattcgacggcaaagaagatcctctcaactggctgcaacattgcgagcagttcttccgccacaatccgctcggagaactcaaacgtctttcccagacggggaccgtggcggcatatcaggagaaattcctggcgctcgcaagctgcgtccaagatcccctgtcggaagggcaacaggtgcaggcttgcaatggataacaccaacgcgggctgctgctcaccagtcaccagcatgtgagtccgtcgctgccaggtgccagtcaaacccatcttctctcatcgcccacgcccctatacctcctgtccaactgcagcattgttcgctgtccatttaaagtcttacagctattcaccatacggttttgctgcattacggttctttgtgttgcgttgtgcagttcggttggagctggaggacgaccaaggcacaacagagaatgcatatccgagccaaaattatatatcagaaacaccaaaaatggtggtacagtagtttttttttttctgttctccactcaaccagtttggttggacctaactgactgcaactcaaagaagaccgacagttcgacggacggacacaagatgagtctcccactgctaacttttacatggcagacctaacaagatattgttcgtattctgtatggattatatgcaaaaagaatgcttttatggatatgtactccggttttgccattcaatcaaggatgccgtttcgctttcctttttatcctgggcaaatcttctctgctaccctgctggtacctgccatccatacaacacgaccatacataaatcacaatgcaacaagtctcatctcacataaatcacaatgcagcaagtctctcacagaagattatcaggttaatatgttatttgtctgaattggaattgacgagatacaacttacagattagttgaagcttcaggggacttgcgcacctgacgctgtgaggttgttgggcgtgctcgcatcagcagcacaagtgatctcattgagaggattgctgaaaacatagaaatgggcagatcaagcaattaattgttagtggatcaacacatcaacaaatatcagttctggttgacaaattctgataaactaatcgctgacaaatgcagaaagtgcatatagaaagcactacaagatgttactatattgcaggcagcataagtgacaacaagaattctggtaactcaaggatggtaaaattacccaaataataaagcattgtccttaaggagggatagaattggacctgctttatgcaaaatgccgatcgctacatatgaaaaacaaggcccagattctgctgtggtaaataacaacaaaaatgaagcacaaaaccatacaatctacctaacccaaattctggtaactcaaaagcacaagtaccaatagctaagcagatgacatattaagaacaagctataccatataatctacctaacccaaattctggtaactcaaaagcacaagggctgcagga

SEQ ID NO: 46059 - DNA, 5167 bp, Oryza sativa
ctcaacagtaacatgcaaaatttgccactaaggcactgacctcataaatcttgacatggcatcagctacctgaagacagtgaattccttcctcggtcataaactctggaagttcacatatgtttttttctatattcaagtcaattttgatatcattagagttaaaaaaaaaaactggcatccatttgacaaaatatatgaacaagggcattactgaagtttgcatcagacaggttgtcgatggttgggcaagtgcagctcagatcatccctctccactgaggcgtatacagctatctcgatggtgtctaagtggggatctagatgaaaaaaacacagattagtcacatttaaggctaatgcattgctcattgaagtttttttttttttttgagcaaggaccaaggcccccatttctattaccagaaatggatacaagctacaaggttcttacagaaaagaaagggaagaaaagcagctaaaacatttgctcattgaagtatatcatataattacttacgagtccagttcattgtcctggatagacctttcatctggtctttcctaagaatacggtttgattttgatctgttcgcgccagtctgtatgatttgacagttactctgatcatttgggcctcctaaataaattaggtagatcttcagaattatggcaatatatatgttatactaaaaaacgtaaggtttaacgtataagaagaaaattactcttggagtgtggctgtatatgatcaaattcgtagccacaacaaccatgtttgccatttagcgccttcaggacaggatttccgttggcatccagccgccaacgatcaccagatcgtccaatcaccttgggagcattattccagcaagcttctcttacatctgcgctgaatgaacgaggttttgcaggtgctgatgcacgtagagcacgggaaaacttggacacaagacgggaaaacagacccatgtcctgcagttaacatagcaatagcataaataatcccttgtggatcactccatagatttatcaatttagacaggtttgtaaaactgactcataatatttgataacacatctatcggtatctgtattgaatagccatagaattcatatcacaacatctaaaatacacatcaatacacaaacgtgcatcaccactgacccattagagatatgagtcgctaagtagaagatgtaatgtcaaattagctacatctgcagaaaaataagtgcaggtctaacaagccaatttagcagttaaattatgtgaactgtccattacaaacatatcaaacaacaggacatattggtatgccagtatcgcgcaccagcaagttaaacgtgccctcagcattaacatatcatcttccacaaacaaaaaacacaatccaggttgcagtgctgcactacactcactatctggaggaacccaactccgtgaaatacagcagaatgctacactaacataacatactgtaacacttacggcagacaaccgtaatttagaaaggaaaaaaaatcggacagagttcaggatccaatccgaatgggacaatatgcaatttccgtaacaactgatgcgagaaccccaataatgataatttcccggtactaggttgcaacattggtaaagtcagaagcgatcactagggaaatgcacaaaccctgtaaatccaactcccaaaccctataaaatctcgcacgatcaagggagacaaaacgcgcggaaacgttgcagcacacgggaatcgggaggccggtagcccagcaacttaccaaagtcgaacccaaatcggtgacaaagccttggacttcctggagctccgttcgcgttcgctcgcagcagcaggcctccggcgaaccgcggagaggaacccgcgcgcggggacgaatactctctccttctccgacgccgccgtgcgccgtcggagccaagctgatcagagaacaccacggatcaattagcaggtagcaatgaggagggggaggagagaaggggaggggacttgcctgatggggagaaaagttcgcccctcctgcgcggcggacggcggtgagatcgtctccccaatttcttttccccgccctagctcgagagtcgagagcaaatggggtcgcctaaattttgaaattcaaagtggtgggggtgggggccacatacaggcatactacgaggagaggcgcgtgaagctgaaagcagcccggcccaccgaacccaggttcattttttcgagtggagtaagttcactttgagtccctcaaatctctaataccgaattctgggaggattcgcgtgtaaaaaataccgaattgtgggaggattcgcgtgtaaaaagccccgccacatggcaccgcgtggttccaacttcccccccccccccctccgacagtcgtacgatcaggttttattagcaaaatgttaaactccaccaatgataccgacccagacacccagtccggcttgcgcgctggataatctatcctgtgattttttcccatagggcacatgtattctttttagagtaattactttaatactaataaaatctatgtaaatatcatatattgaaaaatatcattcaatgtgtacttggttttatgtttgtataataccttcggagaattatagcatgacagtatacgcaaacaaacggtcactggtggagaaaccatctttcgtcggtcggccgaattccataatagtcccggatgcaataaaaaccggagctaaagatgatctttagtcccggttaaaaagggtaactggcatatttgatttttaatcctggttggtaacaccaatcgggactaaagatgatatttagtcccggttcaaatgctgttagggcctgtcaggcccccccggatctttagtcccggttggtaccaaccgggactaaagatcgtaacttaccaaccgggactaaagatctcggggatctttagccccggttggaaataccaactgggactaaagtcccacccctatatatatgtctttttcctcctccagctgcccgagcaagcttcaaaatttcttcaaaaaagaagggaggtcatgccaaaatttctagtgaatttattttggtgattacatacaaataggaggtgcctaaaaggtttgcaacttcatcctccaatgtttttctttgtcatattacatttggagctatgttttgcacacttttttgtctccaaaatttagttgtaagttgatgagagagaaaatttgtgtgggggaagaaagaacatatagaaatttagttgatttggtaaagaaggttttataaaatagttgagaaggaaaatatagtgaaagttagtcttaaataatagaaaacaaactaaaatgaaaattaaaagaagcaaaacacattaaaatttgtttaaaactttagaaatagtaaataagaattatttagtgtaatattttatgatttttgtatgaataaagatatgtcattattgtatgactgttgaaagagtttgtaattatcttataattattgtatgactgtcattattgtaagaataattatttatgtacgattttttttcgactcatgtagatggatcgtcaatggatgtacgatggccggcggtccaaagagtttattgacggcgtgcattatttttttgagagtggccgaagctaacaggcaaaagggttttatttgttgtccatgcaataagtgtaaaaatcagaaggagtattctgcatccaggactattaatttccacttgtttgagttggggttcatgccaagctataactgttggacatcccacggagagcaaggggttgaaatggaagaagatgaagtggaagacgacaatattccagactttgatcagtacagtggatttgaaggaaatcaaacgggcgagaagaaaatggatgctgatggtaacgacgttgcagatgatcttggtcagatgttgcaggacgccaaggaggactgcgaaagtgaaaagggggcccataaattggacaagatgttagaggaccacagaacgtcgttgtacccaggttgcgagcaggggcacaaaaagttggataccactctggagttcttgcaatggaaggcaaaaaatagtgttagtgacaaggcatttggcgatttattgactcgtcaagaacattcttccggagggaaacaaattgcccgagacaacgtagaggctaagaagatagtctgccctttaggactggaagttcagaagattcacgcatgtccgaatgattgtatcctatatcgtggtgaggagtacaagaacctagaagcatgccctgtttgcaaagcactatggtacaagattagacgagatgatccaggagaagttgacgggcaattaacaaagaagagaattcctgctaaggtgatgtggtatttccctataataccacggctaaggcgtttgtttaggaacaaggggaatgtgtaacactctgaaaattcgaatgacaaaatcaaaactctaaaaatacagattttcaaaaactttttaaattaattgcatcatgtcgatcttattcgtctatttcatctggatttgatctcgaagattattaatcatgagtaaagaatagttaattaggaataaaccttaaaaacaaattggtaaaataaatacaaaataaatattaggtgggatagaaataaataaaatattatcgcgactatatttggatcaattaaatttgaatacgatggaatagaattaaccctaattaaaactcaaataaattacatgaaaataaaatatgagtaatattaatctagggtgaattcattagttgagataatacacatattgagtaaacttcatttatgcaagatttagaaattatagaatcaaattcatatagaaaataatataaaattgggaaaaataggaaaaagacactattcattagcttctaggtgttcgacgaggctccctagccccttcccctcccctgccatgcgcgcctcgcgccccgagccgtcgccgtcgccgcctgccgccgtgccgctgtcgcctgccgcgccgcgcgccgctcggccgtcaccgtcgcatccctcctcgtgccgcgcgcaccgctgccgccccgtcacctcccgtcccgtcgccgcgcgcgtcccatcgtcgctccgagccgcgcgccgccgctgccgagcc

SEQ ID NO: 46060 - DNA, 1368 bp, Oryza sativa
tgtgccgccgttcccgcgccgctgtaccgccgcttcggtgccgccgtacgccaccgtcgccaccgccgtcgttgccgctgccgccgtcggtgagccgccctccttctcctcctctcccccccccccccccgcgtccaccgccgccgccgctcgggtaggagggagagccgagagagagagatagagccgagagagagagccgagagggagaggaagagagaaaaagaaagagaggaaagaaaagagaaggaaaagagagaaaaagagaaaagaaaagaaaaaggaaagggagaaaaaggaaaaggaaaaataaatagaaagatttggaagaaaattagggaggttaatagtttagaaaatttaaaataattagaatttaattatagaataatcatggtcctagaattgcaaaatttaattattcttggtaatttccaaaagaaatcaattcgcagtagtagtttagatataattaacaattagatgaatctttatagactactatagatcatttttggataatcttttaagtaatcgattcacggtagaaattcggacttaatcgctaggaattttagacgtatattatatttaatcatttagtcatagactaaattaaaacgtataatattataagataattttaggattccgtccgacatttagctcgcgatagaaatttctaacctattatatggatataatgctcgggtagattaaattaaaaacttatgacaacaaaatatttatacccgcaaaatagtttaaatcaaaattgggtttgccgtagcggatagtaaagttaataaaaaggaaacgactttcgcattcgactgtcatttggatttattcggattctcatttgaattctaaccgaattcaaatcaattcttgcacgtaactatagagcccgagggagttgcggatccaagcgaaggccaagacccgcaagaccttgagcaaggcaagtcatcactattccttgaacatgttgatcccaattgcgaaattgtttggtttacaaataaaattgcatgcaatgatgaacatcctacttgtgattatgccatgccttgattattgtttacccttaaatctttgtaaccatgtttacgtatgagtccctagtcaactatgacaattgcttagaaacgctatactagaatcatgcatactcatatttatcaaatgctatatgcttgggcaattacctttgggaaggtaattgagatgcggcatgtggagacatgtgcgccacattgccatgatgttgatgacatgatttgtgaaagaagaaataaaattaaacaattgttttcgactggggcggacggaggatttgggtggtatctgggaaaggctagtacc

SEQ ID NO: 46061 - DNA, 4200 bp, Oryza sativa
tgtgtgagagagagagaacttaacttgaaccataattgaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctggtggagccacttcctgagaggcgggaatgtggacgtcctcagaaaaccataacgactcaatggcgggaagctatccttgggatcacaatggatggtggacagaaccgtcattgtttaatatgaacactggtattaaaactggatcagtttatgctaggtcttaggcttgtaaaaaaaattacaaaatttgctttgcgcaaaagaaccatagccatcctctgaattcctatgtcatgtgcatcattgctgtggtggcttgctgagtacggttggtactcatccttgcaaatataaaatttatcagaagcgggagatgaagcctcagaggatccctatgcctactatcaggagggagatgaagacgatggcgtctagtaggtcttagtacggtcgttgcctgtggcaatggcatgccgctgcctgaattccgctgccttatctatttctgcttttggatgtattccggaccgctcggtccgatgatttaagactatgtctgcgggccctatgatgtaataattcgtattagatactcgtgtatgtgcacttggtattccagctatgaattcgtgtgtaccaaactacttgatccagggaaatggtactgtttacacgattgattcctgttataaaaacgggggtcgacagaatgctagaatgatgcgatggcacgctgaagagcgtcaacaggatgggatgctgagacaccccgccgatggttcgcggtggcgaaacatcgacagaaaatttaaagactttggaaaggacgcacgaaacatacagtttggttttagtacggatggcatgaatccttttggagagatgagcagcggccatagcacttggcccgttacgatgtgtatctacaacctcaccccgtggctatgcatgaagaggaagtacataataatgccgattataattcaaggccccaagcaacctggtaacgacatcgatatgtacctaagaccactggtcaaagatcttaaactgttgtggaagaaggaaggtgtccccgtgtgggatgaggacaaacaggaggagtttaacctacgagcgctgttgttcgtaaccatcaacgattggcctgcacttagcaacctatccgggcagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggctgaacaccgtacgaagcctaaacatcgcaacgggaaaacagtgtttgctatggttaaagatcttaaagtagtgtttggaaagggtcctggaagccagccgatagagagcggagatggtcacgcggcgatgtggaaaaagaactctatattttgggagttaccctattggaaattcttggacgtccgccacgcaatcgacgtgatgcacctcactaagaacctttgcgtaaaccttcttggcttcctaggtgtatacggaaagtcgaaagatacactggaagcacgtaatgatctgaagcatatggaacaacgcagcgaccttcacccggaacctaaaggagaaaggaagccattacttgagtccagccagctacactcttagcaaggcagagaaggaaagtatgtttgattgcttggagagcataaaggtaccgtctggatactccacgaatatcaagcgaataataagcatgaaggagaagaagttcacaaacctaaagtctcatgactgtcacgtgttgatgacacaactgctactagttgtaataaggggtatccttccagacaatgtccgggcaacaataacgaagctatgtgcattcatgaacgcaatttcgcagaaggtcatcgatccggatagattagaagcccttcagaatgatgtggtgcaatgtcttgtcagttttgagttgatatttccaccttcatttttcaatataatgacgcatctgctttgtcaccttgtcaaagagatcagtattatcaggcctgtgtacctacacaacatgtttcctttcgagaggtacatgggcgttttgaagaagtatgttcgtaaccgtgctcgtccagaggcaagcatcgccaagggttatggaacagaggaggtcatcgaattttgcgtagaatttattgaagaccttcacccaatcggggtacctgaatcacgccatgaagggagactacggggaaagggaactctcggaaggaaagcaataatgacgatagacaacaatttattccgtaaagcccatttcacggttctgcaacaatcttcattggtagctccttacatcgaggagcacttggctctagttcgcgccaggaacatcgataagtccgatgcatggattacacggcatcacattgatactttccccgcgtggctacgacaacatctcatgggtaacgagtcgatcaaccaacaacttgccttcctggcgaggggaccgtctgggtcgatcgcaacattccagggatatgagatcaatgggtacacattctacacgagagcccaagacatgaagagcacgaaccaaaacagcgctgttcgtgtcgatgccatgggacacgatggaacaactagcacgtattacggtgccatcgaggccatatgggaacttgactatggtcctccgaaggtccctctgttccggtgccaatggattaggttgactggtggaggcgtaatgattgatgacagtgggatgacaacggttgaccttaagaaggttggatactcggacgaaccttttgtccttgccaatgatgtaacgcaaatcttttacgtgaaggacacgtctagcaaaggaaagaagggcagagggcctgacgagcctaagcgtcacgtggttctcccaggcaaaagaaaaatcgtcggagttgaggacaagactaacgaggattacgatcagttggatgggcaaccccctttcacggtgacgattgaccctagcatccttctatcaactgaagacaccccttactcacgtagcgatcacaaggagggaacaatagtgaggagaaagtacgtgcggtcaaccgtcagcgccgatgtattgccgtaattattgtgtacacaatgtaaactattttggatgtattgattaaatcaattgatgtatggcatatgttaattacgcacgattatttgaggttttaacaagtttaaatcatgtatatgctagttatatgcgataattacaatttttaaattttttaaatcatgcatgtggcatttatatatgttaattagagtttttaacaattaattcaatatcattcatatgctaattatatatgactattcgaatttttaaaattttcaaatcatgcatgtggcattcacatatgttaattagagttcttaacaattaatttaatatcctaattatatatgattattacaatttttattaattttaaatcatgccgtatgtatatacatatgttaattagagtttttaacaatttaatatcattcatatgctaagtatatatgattattagaatttttattaattttaaaacgtaatatttgcttattacgttttatccacttaatttattacagacagtactaattttccgtagtgattgtcattaatttttgtactttaaataaatttaatgcattattttctattttagaaacacatatgtaatggaaaataatactcagtgcgcttatcagtagtcccggttcttaaccctaaccgggtttaaaaaatttttggaaatagcgggaaaagatctttattcctggttga

SEQ ID NO: 46062 - DNA, 10070 bp, Oryza sativa
gagcgaacgaacgtgaacaagaacgagcgaacgaacgtgaacgagaacatgaatgagcgaacgaatgtgaacgagaattgaacgtgaaagaatgaacgaacgtgaatgaacgagcatgaacgaacgtcaacgaacgtgaacgtgaactaacgaacatgaacgaacgttaacgaatgtgaacgtgaatgaacgtgaacgtgaaatgcaatataggcaggtgaatgaatgtgaacgaacgaacgtacgtgaatgaaacgtgaccttaacgagaacgcgaacgtgaacgatcgtgaacgaaacgtgaacgtaaaatgcaatatatgttacttcgcgtttatcctaatacatctttttgtatcttgcagaaaagacgttgttggagtcgtccctcaagccggagtggtagctagccctcgaaggaattcgcgcagacaagtgacgtaattatatatatgattgttatatttgtaatgcaattaagactattagatttaatatacgacacttagacttagttttaatataagattattatagtttgtaattagactttagtatataatttattgactagctagggtcctataatatacgtcacctagacttagcatatatcactatttgagttttaatataagattattagatttgtaattagacttagcatataagattgtgtagggttctaatatacgacagttacacttagcatacatgactatttgagttttagtataagattatttacgttttaatataagattattatagtttgtaattatacttagtatataactattgactagctagggtcctataatatacgtcacctagacttagcatttatcactatttgagttttagtataagattatttaagttttaatataagattattagatttgtaattagacttactatataatttattgactagctagggtcctgtaatatacgtcacctagacttagcatatgattgttagcatataagattgttaaaacataaatgtctcatgacttagcagctgtttcatgtatgaacagatggctgatcgcgatgaggaacagatattgtatgatacaatcgcggagggaagcagccagtactggaacgaagaagaggggaacgaggatccaaaccagtatttgaacgaggaagtgcagagggatgcagaggggaaccaagaggggcacgttgaaagggatgtggaggggaaccaggaggaggaggatagtgcaagtcaaccctccgctggacagaagagggcacgcgggcaacgaggtgccgcgaagaagcttgagggtcggcacaacataacggaagtggacgaagacggccgacctagtgccccggcagaagccgccaagaactatgtacgtcatagcggttgggttgtgcgggataacgtgcctgtcagtacggtatactggcgcagaacaagggcacgcggagatcatgagagctttgtcccagattcgaagaaagagatgctgtggaccacaatgctcgagacattcacccttcccgcgggtacagaggacaaagtgaaaaggtggattctgaagaaaatggcagaacagtttcagagcttcaagggagatctgtaccagaaatatatcctgaaggggcagacaccgaacttcgacacattcccaaagctaagggatcactgggacgagttcgttgcatataagacatgtgaacaagggcaggcgatgatggaaagaaacaaagaaaatgccaccaagaagaagtaccatcaccacttggggtcaggcggctatagcgtcgcgatgccgaagtgggaggagatggaggctagcttgcttgagtggggtatcgaaccggccaccgctaattggccggaccgatcgaagttctggtactatgctcatggtggaacgctcaacctagctgatggctccctggtcttcggcgatcagatacgcgaggctgcgcatcgactaacagaagcagtggaagcctcttctcagggcacgttccgaccggacagagagaaggacgagctgtcactcgccctgcaaactctagagcatccaggacgaacacgagggaaatgggtgattccttggaagattgggttcaaggaggacatccacacgtacaggagtcggatgaggagcaagagagataccgaggcgaagattgcagatctagagttcagggtatcgagctacgagctcagcatgcaacaggaggtggcaaggaaggttgatgaacgcatggccgcacatcggtcccatgatccctagccgaccattcctcctgcaatggtgagcccgtcaggaaaccgtagcagctgcgcctcaacgaggcaggtaggatcacagagcatggacgccatgcaaacccagcacgaaaccacctgccccgttgatgacatcactcagcggacaccatgtgagctgcatattcccttcaagaacttatcaataaaggtaagctcgtagtttatagattttagatttggccattccgctagttgctgcttatatatgttgtttactaataaataacctctcaccacatgaaggtggcgtcgggcatggccatcccaacggacccttcaggtacttaccactgcaggccgattccagcaggatactccaaggtcgaagttgagttggtcgaaggcgcgtacgaggacctcgaggtggattaccctggaggagatggtgagacgcatctacgcgacacaagccacgccattatactatggcgcaagcgctacatcatcctccctgggcaacaagcggcgtctcatgcaccatcccctccggctcctgcaccgtctcctcctcaggctcctgcaccgtctcctcctcatcagtctcctgtaccgtctcctcctcaggctcctacaccgtctcctccttatcagtctcctgtaccgactcctcctcaggatcctgcacagactcctcctcctgcacagactcctcctcaggctcctgcgtcgtgtcctccagcaccttccaagtcaagaactcaccaagcaccaccgcctgcccgcacaagggcaacgaagaaggcgaaagttgacgccgccgagaacaaggagccaccgtacgattgcacgcaacaggagcttgacgcttacgtggaagcagaagtgaagagacaattgaagcctcggggtccagaaaagaagattcctatagacccgagtgccaagaagttcttcaggagtatgtcggcaccagccaaggaggccataaagctaacggattatgagcgaacacttaagaaagcatcttctggaaagtccaaaccagtccctcagcttggagagcaaccaaaccaggagatcgagccgttggtgaccggcgaatattttggaatacaagaatttattaatgacaccgggctaactacggatcaattgctaggagacgcaccaatcaaaaaggcggaagtgaaatacatgtacgaactcggtaaatcgcttgtcaagcctgagctgctgcagtccctacccacacaaatgtacaagttccatcagctgtacatggagatgagcgcaaccggtagagagatgatcggagtgaggattagggacacggacttcttgcaaggagatgacattctctggatcaatttcaggggaatctacgaactataccagctggacgcccttgatgtctctattatgagttgctggattttgtaagtatatcgttcagttagatttcttactacgtctcctttaattaattaggtccttgtatataagtagactatatataatatataatcccttttatcgttgtagaatggagattcaaaggggcccgacggcggggggttttcgatactggattcatcgaccctcggaaagtaaacgtcgcaatgctcgaccaatacccgcaagccacagaggacaatctcgtccatctcttgaaggcgcagcattacaagacgttcatactgttgttgtacaacacagagttagttaattttactgtcttcctataccaaatttcattctcgtacgaacattctaagtgtttcatatgtaatgcatcccacgcatattgcagattccactgggtgcttttactcttcgacctggaggcctacaccgtcaacatatatgactcaatggataaaaaagagtctacgttcgacaaggttttcgaacttatagacaggtactgtcataagttcctatgtgttaattaagaatcttgttatagttaattgctactacgaatcatagctttaaactccatgtagggcttggtatcggttccgtcatttggtccgcggcaaatggatagaaagacttaggcggaagttcaattttcctgtgagtacacatgctctacatttatatttctccgattcaaatacatacaagtgtatattaattagatctctcgtcgtttgtcatttatttatagtgcgcaaagcaaaagaagggaactaacttgtgcggctactacgtgtgcgagtattgccactgccttgcaaaccaaatcatcaccacaagagagctcgacgtacgtacaaataaattcaaattttcattacgtatcgatttgttgtttaattactaatcaatttcatacattcatatagtttattcgcatgagggataacctgatcacacacaaggaattcatcgcggcggttcaagaacaactcatgggattcatcaacgaacaaatccttgatcccaagggtgaattctactacgacggaaacacaattcataggtccttagcttctgagctagcgactactactacgtcgaaatcgtagctagctaggacatataatggattgtaattaatacatgactacatatgtttctatatgcatgtgtacacattttctataatgtaaatatatatatatatacacacacacacacatattatatatattatatatatatatatattatgcatgtacatatgtattgaaacatatatatgcatggtttatatatatatatatatatatatatatatatatatatatatatacagggccatgaaaaaaaaggtcagctcgatctttagtcccggttggtaacaccaaccgggagtaaagatgactcagttgatgttaccaaccgggactaaagatcgatctttagcctcgggtatttcacccgggattaaagatagcgatctttagtcccgaattggtcgtcccggtttggaaaccgggactaaaggggggttacgaaccgggactacaaatgctttctccaccagtgggtgaatttactctcacgttagtaattttaaaattttgtatataagctgttagaattagtaaaattaaaacaaaatattttttatttgttgctaccgattgctttaccttttgttaaaagattgtttaacattttctataatataggatattaacatggttaagttacatgtttccagttttaaccaatcacactagcactaagggcgtgaataatggtacgatcaccatgtaggagagaatgccacacaatatatttttttgttgtggaagtgagtgagaggagagagaatacgtatgtctattaattggtagacatatatgctagacacagtattttagatagatagcttatactatatatgcactccatatacaaaatatagaaccaaattactaattataatgtaggtaatatgctatatgaattcttttgtatatcgtgtaaatatgatatgtgactattatagggcaaccactctctgaactatttttcatgtttttattgggacatttcacaccaacattcctataatagtatgtaaatattgatattagtagaactactatatttgtcagtttttaatatttgtttatacttatcttttttatacacaaattttattatttgttgttttatttttaagtaatatatgaatattataacccaatcaaagtgtgtgcatttttttctttattctgttgcagactataccatactttctcttttttgagaaatatatgatgtgtttgtttttaaaatggcattgacactaaaatttgatcatcaatattcatacaaattatattattattaactataaaactaatactaatttgatgccacaaataattgtatattagaccaatatggtttgatttatatattttttttattccaagcttgtcatatgctacaatactcacatgcatgggttcagctcacaggttagccataactgactcggccagcacaggcgcacgggccaatgtggctagtccagctgggatgattgattttttttatagaactgggatgagagattaatgaatgtggttggcccagatggcagggacacgaggtgagacgacatccagaagctgctgttatttttgttttctaccgcaggaagacagcaatacatgcgcgagacactcgatcttttgccgaatgcttcatggacacgtggcgtaaaactgaatggggtaaaacgaaccaatcagcttgcagcggaaaccgccagctttagataatactagtaatcttgtacgtgcaaggcacgttttgacactatatattagtaaacgaagaagaatctatgcaatcatttctatgcaatgcactccgtataaattcttctagtaattaagacaattttacatagactatactaacatgataatttggatggttctctataaaaaccactattttgaatcactacttgcttaccaatgaatgtaaaagtatttagcgggacaaacacaatttatactgtgatgctgctaccttttgaaagcaaacaattaatgatcaaactcttaacaattttcagctagaagtgaaactgcaagtaaaagagaataactatcaaggcattattttcttacagaattatagttcaagtgctaaagggaaaccaggatgatatgttgtaaatgcaagaagtagctagaatataagaaaactacacagaacaaaaggtacgcaaaacttctgttagaaaaaaaccatatatatacttgatacatgtgaccgagactattgtgagtttttctcaagagaaaatgaaagaatacatacatattaacaatcctgaaaacaaattaagatgactaaattatatattcatgtataaaccttcatctcacttttactttcatgcatcaaaacgctaatcaaattcctaagaccagtataccacaaaaaagtatgcacactagacttctgatcaagacattttcaaggaggaattgcgagtacacatgcaaaccacagatgttctcggcaacaatggagatgtcagtcgatggtcaacaaacaatgaaatgcaataagaaaattatgtattttctaccagggagaaaaccaatgcaccagctttgagcttggctagcaggtgaggagtttgattccatggagagttggaggaagagagacatatgttcatagatggcatcaaaaccaacataataattaaattgctatttctttatcactgtggttggaagagaaaatttagcttgcaacagcaaaggcaacatacatctcaaagaacaaaagaaccatcgctcaaactccagcaccaatgagctctgcatagggaagctcttcaatacaatttcctgacaaatttataggcatgacatatgaagaataggtaaaatccttatataatactaacttggatttgaagaatgtcacgatagcaactccacactcccctatgtgcgcacaaaagtacaacagaaatattgttactgcacgaaaagaaatccccaatccgcgtatgccctattcaagaacattttaacttcagtataataaagacaatagtacacaaaaaccattttggagtacgcctatacagtatcacaaaacaatggatatcattagacctatatataacatgacacttaatgtatttactaaatattaaccaaattgcatcgatttgtgtagtgatctaaataaaccagttcatgggtatagcagtaatttcagaaaactgaaggcaatatcatctagctgcagcaacattctaactttaacaccaatctttttacgtttttggaatatgacaagtactgtatcaagaagcaatggatatcattaaacctacatataacatgagacttaatgcatacacctgaatagtgaatactaaccaaataattaaattccaaatcgcattgatttgttgtgtgggctaaatcatccatatgttcagaccggtcgatttcatgaggttggtacaggatcaataaagaacatgctgcactgttaaaattattttgaaataacttaagaattgagtcaccaacattggcattggcagtcatcaactgttgttgttgctagctgagaaaattgccacccattgaacacttgctggatgaaaacaaagtgagttttggacgaactcatcagaaacacattacaaattttcaatgattttggatcctgtgagttgattaccaacatgcgaggaccgtactgctaaggaatagagagcttgagatcctcattccagatagggtcaagttggctttgatcactgtcgccactaagattcctggcattccaatggtccagttcagaggaagaagcctgaaaccagatgtagctaggtttgtcatttcatctgagcaatgcatatttgtatcaagtatggctagcgattattgttggagaacaaaaacatacatatatgtggatcattcttggacaacctctcggctgtcagctttaagcttaccacaccgcactgcgtggccggtatgcgaacatatcctaattaaaacacacaagtattaattcagaactgcaaaaattaccatgtggcccttttttaatgcagcactccatataaattcttcacgtaaaaaattgagtttcatagacttgttgaacacaacaaaccttcaattagcaaccagttgatcattagagcatgattaagaatcaagatatgtgtgcagcgtttcagggtaaatatttccaatccacgtaacattgcatttgcaactgatggttacataatgaatttggtagaactgaaaaaaacaggtcataatctaatacaatcaccttaagaaggtgcagactgcagcctcatcattcctttattttttatgagcactatgctcaataagttttaggacctaggataggaaaaactccccttgctgattcatttgcatccattgccaacaatggcatatcacagtccaagcatttatttgccaataatttaagaactcggcaaagaaagtaagaatcaaatcaagcaagaaaggaaatatcgttgactacttggctcatagcacaacaaagtttcagttaataattagtgcatgaagaaagataaaagaacaatcaatgtgcctgtgcttaccaccatggtgagtgagaccaacaaatcgaagggcgcggccacgacggtaatcacgaaagccaatagagcaactcagtcatcagaagcagtcggcagaccaccaatcacatgaaggatggaagaagcaaattccatatgtttgtagtcagatttctgaaattttccattaagttcagtgcagtaaacattttagatactcaaaccttatatatactgatacatatttagttgtttatatattgcttaatatcttaattttacaattcatctgcacctgtggtcagtacgtgtacaaatccagctggtttgcacatgcatctgtagattactatataactcatatagaaaagaaatggattagggaacaacatgcctgtcattggctcgagcagtctaaatttcaacagcttttcggacttttcctagcacaggaattgcttcaacctcagtccttttgattgctctactgatgtttgtatacaagaagaaggacaggataagaaacatcataagtcgtgaccagactcataatataacagatatagaccagagcacatatatgaacaaaatgaagaaggtgtaatatattccaacctggtccagaacctgcaattgttagtaccagatgattcagatgaatatacctatcaagtatcaacaggagtagcaaatatccatagaactaaccccagcttgagtgat

SEQ ID NO: 46063 - DNA, 1904 bp, Oryza sativa
ggaggagggatgggaacggggaggagaggctgaagggacaacgtggaataatctgaaccgttggattcgttgaatggatggatggatggtaaggatttggctggttgatttcaccagttggattgcaaggggacaactcctcctcttttatattagtatagatataagataccgaattctaagaggatttctcgtgcaaaaagccccccgccagctttagataataagataccgaattctgagaggatttctcgtgcaaaaagccctgccacgtggcacatgtggttccaactccccctcccccccccccccggacagtcgtgcgatcaggtttcattagcaaaaagttaaaactccaatgataccgacctaggcaccccaatccagctttcttagtactagatgttggggcgcgcctttgcgcgctgcctgaaagacatcaacacaataagttaatgatccaagaaacaaatgctaattatacaagaatggcttaagatttggtggaaggaaacaaattcacattgggagaggctagaaacaactagggaataggaaagcaaaagtgaaatgaccaaagaatgagctggggtcgagtttgatatctacaacggctaggtgacgtcatctagccattactcacatatttgatatgaaatactgcctggaagttccagtcctgggcgctaggaactttcggccaacacttaggaaaattctcttccactcctaggcccagaagttccggccaaagcttccaaaacttccaggtaggattctctgtcttgggaggggctattttcaaaaaatagctcccaaaaatatttcactaagaaaatatggctaagagcacttaaggatcctcagaaccacacatatgaaacccctcttaatagtatggtttttcccaaactcaaagtgtaaaatagagctagcctaactcggctccggttcttctgaccactttgaatttgatgaattggggggttgtcgacgtttgagatcgcgactacggtatttgcatagtatggggatcgttggtaccatggtatatgcaagattgaagtaaaagagatgcagacaaggatttttatacaggttcgggccccttatctgacaggtaatagccctactcctgttggccaaagccggtgttgctcttattcattataatcacaccagtacaatatttgggataacacatctagctgtcatcgacttagcggcatggataaccaacccgtagtcgacgacagcgtagttttcctcctcaagcacgaacttgtcgagatcagagatgacgctagatccctcttaccagcctctgtaggtaccggatggggtatgtctaggcttatctctgacatcgatagctggcggcgtgtgttggcttgtgtgtatgttgtgttggtcttgtggcttgtcccctctcctcataggggggcttgtatttatacccatagatgtccctttgtccaagtagaactagggagaccaacatggatacaatccaggtagtccttgtcgttttcatatagaactctgttcgtccttccttatctggaactccttttatatacaatgtatgattccgtataagacatgttatgtggtaggccctaccgagcttagtcaactactattaggtatgtggtatccataaccatgataggggtctccacgcgtcctagccttatgtgatcatggctactatagatacaatcgttgctcatatcatggatgaacaaggagatatcaagatcaagttctccatgtgctggaatccgatttagccacatgctacactgctgacttcaaacggctgccaaatctgcatacgacctccattttcagcccatgagtacttgatggaaagctctcggagtcctctttccaatggatcc

SEQ ID NO: 46064 - DNA, 3599 bp, Oryza sativa
ccaagtgggacccaagtggggtgcgccccaaccaggtggagcacgaccctagagtccctttggtcgtcctcccacctctttaaatagtttggtaccccttcagggtttcttgggttttgtttagatgaaagtttagccattgctacttccttgcagtgcgtgtgtcggctagaccgtccgtctgattgtattcggaaccccaacttatcatttgtattcagttcctatttgcaatatcagattgcttttatcttgttcttgtttgtttcttcgatttgtttgcaggaatagggttgatttgcaccagcaagatcaacaacccacggagaggtgtatcgatcgctaaggcacaacacaacgtcttgtacggttgtagtcgggtcatcaacgtttctttcaaatcgtagttatctcaactcaccgaaagatcgggccaacaacagccttgagtttctgagtggaactcagggtacatcaggtggtatcagagcttttgttgctcggtgagtttttatctacctataaccagaaaatagccatacaaaaaaattgcatccatcacctagacatctttgtgccattgcttcgttctattcagtttttgctttgttgagttttgcgttgcatggttagtcgtgtttctggtcttagcgtctagagtttcaaattctggtcacatttagtaccactgtcgtcgtgtgcttgttgtcgtcgggacgtacaaaaacggaatcgtctttccgccagggtttcatttttcttagttttcagaagtttttctggtcagttttggagttgcatataggttatataggtttttgtcatgtgcatcccgtcatacgtgatggtgcgcctgtgctgctgcgcacgagtaggatggaagcaagggactagattagattggtttctctttgttcagaagaaatagaagattagattagattagattagattagattgatcggtttctatttgaaccggattcggttttccttgcatgcgagttttccttgttttattcggccgtggtggccttcacattaacaggcgagtgagtccgactccctcctccctctccaaatcaccttgtctctctcagttatgagtcctgtcaaacaatttggtgaaattctgttttatgtcggttttgagatctatttgaaaaaatggaactggcataatttgaggtttggacttttacatttgagtccctataatttctgtatttacatttgagtccctgtaatcttacattaaggtccttgagtcggtttttgttaaaaaaatcaaaaaaaagtgagaaaaggcagaaaggtgcgtacaaaagaaaaaaaaagccgcaccaaaaaaagaaaaaaagagaagaaagaaagaaaagtaaaaaaagaaagaaagagagaaggaaaaggaaaaaaatcaattgtatatttgagtttgctttcatatatcagagtgtgcttgagttgtttctagtgctatctggtggtaccgtttgtgtctaggctcgcgtctctagtacgttctagcctaggaccagcacggtactgactttaaacgattattcaacttcgcattatctgatttgagcatttgctacatatttaagcctacccagagctccacatatttgattgcatccgtacagcaagtgtttgccaagacattgatacatccaacctccattggggtgcttggttgagtcggtgtatatcaccattccgcttgcattggtaataatctgtaagagcttggtgaaaagctggagtgtgtgtgactttttcgcctccactacctagtagttaataggagcgtgcatattttgtgtgtgtttcttgtttgctactaaccatggcaaggttacgcaaggagattggagcagctcatgcaaaacgtggatattttcatcttcgacaacaaatggtaggtgatccacatggcgcatataaggtacatgataatgatcttgcaagggtagaatctaatttgccagtttttgatggtaagtatgatttcgccgcttatattaattgggaactagcagtagacaaacagtttgatgagtatgatttctctaatgcttaaatgattaaggctgctagtaataagtgtaccggttctgcatctttttggtggtatactgttggcaataagcttgaaacttgggatgaatgctaaacaatgatgaggaaaaattttgtgttttcatattataaacgaactctccttgagaaattataacatctaaaacaaggtgacaaaactgtgtgggagtattttcataacttcaaattttgtatcacttatagtggtttaaaagaaagcaatgagaacacaatgactagatttttcaaagggcttaattccgatattcaggcttggcttattaacatgacatataatcatataggccacttgttcatgcttgcttgcagtgttaagagcaatattttaaagaacccaaaggagaaacaaactatgcttgtgcctcctattactgacattttgcaggaagctcagaaaattcaccatgaggagaagagcaatatgatcgagatgccatctctatcgcttatgaaggaagaagagaagactgatgcacctacattatctaaagagggtataaaagataaattaaattgtgctgatattactcaaggtgagcgtgcttctgatgagtcacatttgtccactatccatgctaatctagagcaaattttggtggaaactacttctgatttgcctttgtcacaagttgatttacttgttgttccctgtgataaagaagagttgtgtgataatgcttcacttatatccatgccacaattagtgaatgaacatgctatttctagtgttccattgtgtgctaattttaagcatgttgttcacattgctaatgatgttgaggaacgtaaattgataacttctttaaatactttgggctatgttcagtttgatgatttttgtgagctcgataatttggaggagaaattatttgctaagtatgatttgccatgtccaactaatgctatttttaatatctttggcgaatataatgatagaggaatatatttggtgcatagagttttcattttttcggatttagagaaacatgttattgttaatcacactacttcgagtttctctagttttgattggatgaaacaggttattttgaatgaactatgtgaagagcaccatatgaaaaaactgaggacgattttccatgaagaaggggaggatgatgtgaccatggctactacggatacaaccgttgctcacatcatggatgaacaagaaaatatcaagatcaagtcctccatgtgctggaatccgattcggccacctgctacactgttgacttcaaacagccgccaaatctacatacgacctccattttcatcccgtgagtacttgatggaaagctctcggagtcctctttccaacggatctagcctcatcgccaaattccatccaagtcatccttcacctggttggggcgcaccccacatgggccttggtcccaaacgaagttacaagcccaaaggtccatgacaggtgacgcaacaccttgtttcttcatatgcggatgacttggatgg

SEQ ID NO: 46065 - DNA, 15005 bp, Oryza sativa
gcccaatctccctaaaagactagtccaataggggaagggtggcactcccttttaaggtcgtttcctgctcccaagctaagcaaggtgggattattcagatgctcacacggtcgccgcccgactacaactggaccacttggccccttgttgtgtctttgccagcggttaatagtggaggatatcctcatcatttccacccccttaaacaagggcccagctctaataccaaacgatagatccggcccaggtggggttggccaaggcccaataaattaaggttacccgaaccccaacagttcttaggcacacccacttaggaaaatgtccaatcaccctaaaagactagtccaataggggaagggtggctctcccttttaaggctttaaatagctaggtaccccttcagggtttcttgggttatttttagatgaaagtttagccattgctacttccttgcggtgcgcgtgtcggctagaccatccgtcttcttgtatttggaaccccaacttatcattcgtattcaatttctatttgcaatattagattgcttttatcttgttcttacttgtttcttcgatttgcttgcaggaatagggttgatttgcaccggcaagattaacaacccacggagaggtgaatcgatcgctaaggcgcaacgcaacgtcttgtacggttgtagtcgggtcgtcaacgtttcttccaaatcatagttatctcaactcaccgaaagatcgggccaacaacagccttgagtttcgagtggaactcaaggtacatcatagccacctcataagcaacttgggactaatctcctgtactcaagctcaataaacgcattagcccctttaaccatttagtcattaataaccaaaatccactaggggatagatgcactttcaatgttcactttgattcccttaactagtggccagatataattcgtatccttcgaccgcaatatcggatatctcaaacccccaactattaaagccagtgcattttgactttctcagtgatttcactgacatggcacatacatggcggtgttgacatggttttcgttcaacgtgacgcttatttggcattagaattaaaaaaatatgtgggacccatttgtcaaaaaatattgtggggcccacatatcatcatctccttcccttcttcctcctctctctctcctctcttaggacaatgatggcgtatgtttatgttcagttccgatccaccaccatcgccgtcgccaactgctgctctcctctgacccacgtccttctgcctcggctgatccttctcctccgccaccgtcgctagttgttgcttcttggtgaatatatctgtccacctctttgacctgcctcctccacccgacgccgcggcgaccggcggtgcccttgacgtgatggccgcacaggctcatcatcgtatgtgacgccaaggcagctggagaggtgggcgccatggtggggatggaggagggggagagggagggaggacgccgccagagaagagctcgtcggcgcaggagggggaagcagcgggatcggtgtcgaggggccagaagtgaaacttcggggaggatgaggaggaggcgctgctcagtcgcctctaggcgccggctacggccacagccattgaattggtgcatgactgtttcttggaaggaagatggggggagaggggggaatggtgaggctttgtacgggggtgatgtggcttacgggagggaagaggaggaggaagaagaataggggaggtgggacccacacacgccctcccattttctgatgcagttaagagaagattaattctaatactacataagcgtcacgttggatgaaaaacatgacaacaccgtcacgtatatgccagtcagcgaaactgccctatagagagaatcaaattgcaccagttttaatactttggcgtttgagatatccggtattgtggttcaaaatatgaattacattcggtcattagttaagggagtccaagtgaatttaggctcagatctaaagtacagagttggctgggctgagctgaaatggtagcaggctgaataggttgggctgaatggcagtgcattgactccctcggtgcaacagtgctgtggatggtagcagcacattaagtaataagttcatctaaggtcccttatttttgtcaacgaatccgatttacgtccttcaaccgcaaaaccagatacaacaggtcccgcaactatcaaaaccggtgcagattaggtccctcggcggtttcgatggcggttttggctgacgtggcgcctacgtggctaatttgactcggtctcaatctgacatggcactgatgtgggcgcttacgtggcaatttgatccgaaaaaataataaaccctgtgggacccatatgtcagtttcacacacaaattaataaaagaatggcggggcccacgtgggccccacacgtcagtctaactcacccctcctcttctgcttcctctctccccatctcccctctttttatctctcttgcaacgacggcggcagcagaaatggagaagagtggccgccggccaactcgctcttgcacgcgctcggcggtagaccagggagctcgcctagctccttcccaccggtcgtcgcccttgtccccgatggccgccgtccgccgcccttctccccaatgaccgtcggcgagagaggagggaacggcgcgcggcggcgtcagccggagaggagggagcggggccaccactttcaccagcgccccacaacgacggcttgccggcgccgctcgccgcggtgacgacgatgaccgtggatgtggcggcgccagcgctggccgccggcgtcgtcaacaacgactcgttggaggacgaggtgccgtcaacgtacattccgatggcggccttcctaaccttgagcacgaatagcagcagcgtgaaccagacgatggcctggaagacggagagctggacaactgttagcattatttttgtgtggcagttagcttcgtgcatgcggctagctagtggctgccgaattaattggatcgcgtgctgcgtgcgcgtacaatgcggccgaagtttgtttgcttagtggtgtgtctgctgggctataaaagtcatgtaatctcctgagttaagtgtcaagtgaatgagaaaaactagataaggcgtttgttgtcgagaaattcttctgtgtttgtccacaaagatttttgctccagctagttgaagtgtgcgtgttgctgtaatcctgttaacgacccacttcaacaatgcaattttagaagtagtagtatcaaatccaacacaaggagctagtgaatctgttacaatagtggaaggttttggggtggaagatggagggatacaagggttagaaggttctagtaacttctagacaagtagaggaagagggaaggtagagatcgacaaggaggcaagcccgcctccaggttgttgtcgccgccgttcgccgccttggccaattgatcggtcgatcgatctcctgtaggctgctgctgctcatgtattgtttcaattggacttgtttgggctacatggccatgggctgaccagcctgtggtgcagtcagcggcccatgtgcagcccacctgagacactgacaaatccttggccagagctgacaatgacgagctgctacgcccactcgccgtacatggcgcgcgccatgggcacaccgacgacgagcgagttggtcagcgtggacagcgagaagctggtgatggaccagcgatggcgcagccgcctttgctcatgaaccgtgcccagacgccgatgacggcgacgggttcgtcctgactagatccagatccctcgggatccaccaagagaggcttgagctcggcagcggcggcgagggggtcgggtgaggcgcgggcagcacgaagtcgagcggcgaggtcggctacgaggaggcagcggcgaggtgctcctgcctgtcacgcccggaatttctatccaaaattccaaacgcttacatgtgtgtgaaccctcgtccaggaatcagtcgaggcacacaataacaaattgataatagagtacaattattactctaattaataagcgaataaaatgtcattacagaggtagatagttcctctcaatcaataaagatctaagcagcggaaaataaaaaactagcgaagctccggctccactccacaggcaacttgaccaaggctacacctaatcctccactccatcagcttcactgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaatatttcagaatttaataaaacagttaagtattaatcaatattaatccaacgctatacaacataccctgttgtataggcccaaccattctgaacaaccatcccggctgcacagttctatctccaaaccaggaatataccattccaaaccaggagctaatcaaattattaccaattatagcatcatttactaaggtgagaagggtgagactaatcacgaaagacattgttagacccgcccataaccgcgggcacggctattcgaatagttttactttgatcagaggtgtaccactgtacccacaagacacaaccccacatcatgtcaccatgtgcctcaataccaccacggtatctcggaaaggagtcgtgacaatacccctcgcataacacaatccactgcaatgcaccctcccggatcatagtcacccccttataaacaaggtatggactccccagcgaacccccgtgggcttatctccgccacttctcagtctggtgctccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattatctaatcacgattaaccatcgtgaactatcaataaactatcatgaaataatagtgtggcattagttatcccatgaatgtgctaatgtttctaagcagggctaagcaattatatctaatatctagttgaaccagtataaataaataaagctcaactagtcaaattataacccaaggtatcaaggaataaggtaatcaagaacaaaagggctatatcaaacaataggttaaatccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacaaaaacaagcttgaacagtacatgtggatatttttaatgtgtagatctcaattttagaaaaatttagagacttgaaccaactaaatcggagctaagatgaattagttatgaatttttaaagattaaatcggattaaaacacttaaatcggttaaaattgaattatgatgcaataatgaattatttttgaaaaggaaaagagggtttattgcgtcagcgggctagggtttggtggaccgggcgcacgggcgacggttcacgcaaacggacggccaagattgatcccacccaaaacggacggctgagatcgatcgggtccacagcggctcacgggagacgattccgatgacgtcagcggtgacgtcaccgacagcggcggcggctcggcggaggagacggctcgggcggcgcacgttcgccggcgaacggcggcacctcggcacaaacggagggcaccagcacgtagaggacaacgcggcgaacacaccggtgaccaaaacggcggcggaggaggaacggacgacgacggcgacgaggaggaagcggcggctaccttcgggttgtcgacggcgacgatgctccggcgggttccgacggctgcgaaggggcggacgaggacggcgacgacttgacgagcacaacggcggtcttcccgagcgacggcgacggctgaaacgacggcggagcacggctgagattgcggcggcgacggcgaagctagggcacacggcgctagaacgattccggcgacgagaggcgaaggcgagggtggcggcgggtagaagagacaccgggggtccttttaaaggggctcggaggcggcggcgaaagcccacggcgacggcaacggcgaaggaaagctcggcttggagagagggaaaccgatccgaaacgaactcgactccgacgctttccaaagcgatttagccaaagattccaaaggagaaaaggtagaggagatcccgaggatcatttcccctctatcaattcggccggagaaggaaaggaacggccggatttggaaaggaaacggcggcggcgacgctagggtttgcgggcggcggcggccgaaggaggacgatggatccgacaagcgggacccacctgtcagcgacagcgagggcgcgcgcgcggctgcggactgggccggctgggccgaggagagagaagagagcggttttgggccgactttcggcccaaagccaaaagagactttttaaaacctttttcaatttaaattatttcttaaatgcaattccatttattaaaaatactttcttagctcaaataaatcccagaaaaatctaggaattatagaattaagcaaagtatttaatgaaattttatctggcccaattttatattggaatttattaattaaaattagattttcttttcaagacttttaaaataaattctaaaaattccatttaaacaacaatttatatattttgaatctttagggtgtgacactgccgctcgtggagctcgtggcgggcggcgaggaggcggtcggaagggcctggagacgaggagagcagggcgagcgccgaagcgagagaggaaaggggagagagatgaagagatgggagatggggagagagaggaggaagaagaggggtgaaatgacatgtggggctcacgtgggccccgccattttttattaatttgtgtgtgaaactgacatgtgggtcccacggggtttattatttttccgaattgaattgccacgtaagcgccatgtcagtgccacgtcaaattaagaccgagtcaaattagccacgtaggcgccacgtcagccaaaactgctattgaaaccgccgagggataattcacaccggttttgatagttgagggacctgttgtatctggttttgtgattgaaggatgaaaatcggattcgttgacaagttaggaaccttagatgaacttattccgcacttttgaacggggccttattccattcatgggccgatcaggcaaggcccaggaagcggcggggaagcggcggctagcattgaagcgcgggaaatccaaaatctcatcggccgcctccttccccaatccaaaaaccctagcggagaaatctctcccctcaccgtcccgcgcgctgctcggccgccatgagcgcccccatggaggtctccttctccgcgccgcctcctccggatgcggcatctgctgccgccgcggccccatcgctggtgcccgccgtgtcggcggcggcggtggcggcgaccaccgtttcctgctcgccgcagccaccgacggggtcgccctcggccgacgacaggatcctcgtttcaggtaggttgcctcggttacctcccgttctctagctatgcacggttgttgtggctagcgaatgctgaatcatggtggctgtgtttttttaaaccctgtgattgcagttgaagtgcttctgcacgccactagcacagctcgagccgaggacgtctgcgctgcggtggagaggttggtgtttatctcattttctgttaatttttcgggttgttgatgttgtgagcaacgtcaggcgggttggtttagaaaatggtggttttctagaaatggggagcgattgagtttgagcattgatggaaaacggtgaagctgaacactgaagcaacatggatttgggatatagtatattttctgggtatctaatgcataaaaaacctgggtcttctgtatgttctgaagttacagaaacttgtggtactgtaactagtgaaccaatgcaagtattaagagtgagttgtaaaatgcatcaaccgcagctttgtggaagccttggtggtgccatggcagccttgggcagaggcatcaatggttgctgcaagggacttaacatagtttccggaagagagtttctggattttatttattcgctcacataatttgcgtgaatactagcatcttattcatgagccattagcagctgttatttctcgaacttaatatctactacttgctttatcaatcaggatgttagaagctcgaagcttaagctatgttgatggtcctgtcccgattcctaatgatgatccttttcttcttgcaaatgttaaaaggatccaaatctgcgacactggtatggatctacttagcgctggcaattgtgctttctttcttgacctcattgcttatgcatctcttggtacttgccttttatgtagatgagtggactgagaatcacaaagttctgttattttggcaagtcaggcctgttgttcatgtgttccaggtatgcactataaataatgttagctgccaactgcctaaacctcttccacctctttcaagaactgtggttatgaattttgtgttgacatgttggctatcgcgctttattgataaattgcatgtggaatttcttaatactgtacttaattttctcatttgttttctctagagtagagacttccaaaggtacattctacaggtgcatttaactatttgccacccatatctcaatgacatgtgggtccacatgtgtctatgacatgtgggtccagttaattgccacatttaaaagtggcaaatagttaaatatctcacattctacatcctaatgtcttaatactgatccataggaatatgttctttccaatagatggattgctttatgttgtttattggattgaagagacattgatctaattcaaatgtatttacctcaatctggtttgcttatgctgcagttgagcgaagatggtccaggtgaggagccgggtgaggacgatacactctctagcttcaatgagtgggctctgcctgccaaagaatttgatgggttgtgggaaaggtttggtttacattcaatttaaccttaactagtacaattccttgaagaagtacactatccttttctgttgtgttggtaacatcataagtctttgcagcttactctatgaagttggtctcaagcagaggttgctgagatatgctgctagtgctttgctgtttactgaaaagggtgtagacccatgtcttgtttcctggaacaggtaagcgtcttaagaaacacctagggtggaaatgcctgagctctttacgagaaaataggtcatcttaagttacctgtagttgcatatgttaaattgtacactgatttttcattcttttggttgttttgattttctttgtcaacacattgcaggattgtacttttgcatggtccacctggaacaggaaagacttccttgtgtaaagcacttgctcaaaaactttccattcgcttcaagtcaaggtttgtgctgaatgagatacaatactgtataattttggttaatgaatgtgcgttattcatttctataattcttttaggtattccatgtgtcaattgattgaagtcaatgcccattcactgttcagcaagtggttttctgaaagcggaaaactggtatgccttttttgtgctaaccgaaagactgttatatgcatgtgatgattcatatgctgaatgctattatctaatgacacttggcttgctcatgattttgcatgtggtggcttttattcttatgattcatttcgacctttttatactggactttacctggtataattagccaatggatatgcatctttattcgcatcttaaattccgtgtactctgtgcaatccttcattttaggtggccaaacttttccagaagatccaggagatggtggaagaagaaagcaacctggtatttgtattgataggtacgtcagtacgtccttgagcagtgacaagttaacactatatattgacaactaggcaactagcccaaagtgatgaaatgactatacgagtcttcactgtatggtctgtgaagtgattagatgagtccaccaggttcattttgtatatgaatagtttaggaaggttaattttcatgtcaaattgtcaatttggctgagttcaatttaagcttccattatctaaaaatgttgaattgtcaatcacgtttctccttaaagatacacccctatactaatgattatgtatcaaccttggccacctgtttgacatatgactatatgagcgaaggatccttacaatctatattatactctttcacatggagtttgatttgctcgatgttgtatatattgaatcttaaccttatgtgtgttattattgatttttcaatttctagatgaagttgaaagcctagctgctgccagacaggctgccatatctggatctgaaccttcagattccataagggtaaagtttttatttttccatgtaccaatttatcgtgaaatgctcatacctattccttcatcgtgcaacctgcaggttgtaaatgcattacttacacaaatggacaaactcaagtcttggccaaatgttatcattttgacaacatcaaatatcaccacagctattggtattaagttctgcctttttatacctttatgaagttagtaaatcgtccatctcctgatgatctaatttatcatttttgtgagcgaaagacacttctctagtctatagtgatatttgctctacagggagtaaatcctaactcttctctagtttgcagatattgcatttgttgatagagcagacatcaaggcatacgttggacccccaacccttcaagcacgatacgaaattttgaggtcatgcttacaggaacttttgcgagttggaattcttacacatactcaggtatttgttctgtgcttgccaacttggttgatgcctatggtgcccaccttttcattattattatccaagcaccagagttgctctggattactctgtccatggggcacttgattagagcaaacaattcttttggatcttagttgatgaatcgatcaaaacttctccacaagactttcaactttcttgtaacccctgaatgctaaataaactattgtcgcaaattgtagggtggcaattctctttgccttttgagttattttagcctgatggagaaccagcactgtcctgaggtcgcagatcctcatggttcggttcatctctctggcctactccataaagctgcagaaatatgtgaggtaaataacataactgatacatgcatcatcaacagtaatcaagacattcccatcaggctgacagcagcatttcttttctgctacagggattaagcggtcgaacattgaggaaacttcctttcctggcacatgcttctgttgctaacccttcatgctgcgatgcctctgctttcctgcacgctttgatacagactgctcaaagagagctctccgagtcgcgtggttgattgattccatgccggtcacttcgaagagcaaattgctaacagtttcaattccagagatagtttttaagggacctcaaagatagctggaagctaattcagagcctggtgctaaataccggcagacccctgcaatctttaggtttagaacagcagaagtccagaatagatctgattgttgctttgatacttttgtgttttgtagattattatatatatagtatattgtgcctcgaaggatgtcactgagttaaaccagaaacaagacttgattcgagttgctgaatgtttaaaagcatatgttatcacatcttgcgctctatgcttgtggaggtagtgtagtaaccaggacctgcttcacgtgctgcatatacaggaagcacactcaagtgactcaacatggtcatgtctcaagagcactggagctaaagcattcagaaaattgccgggtgtcgttcttaaccgggaattacagagattcaagttgaccgtgatctattcggtatacaactaattaaattcaagtatcgaaccaagagcagcaattcgatatacaactaattttcattgaccgctaaaatgtatagggaaggaatctacaagaaaaacgaactagagccatgctgttgttggcctctccaaggatcttactacagctacaccacaaaatgggtttagcaaatagtgatttgggtctgagactgaaactacgatttcacctctggcctgctctggttgggtcgtatgcgacaggataagtagctggtgcttgtcctgcattggcagctccactgcttgactgaacaactccagcaggatatccagcactactgatcgcgccatacatgcttgcaacatctgtagctacaccactgcttattggttgctgcggtgcagcatacgcactaggataaccgggcaaagcggcctgtgtgtaccctgcaactggataaccaggatagcccgcgtatgcatttgcttgcgcagcatgcatctggtaagcagtagcggcatcataagttgggtaagcatatgccccagcttgggtagatccttgctgatatgccccagcttgggtggtcccttgctgataaaccccagcttgggtggctccttggtgatatgcagagggatgaccggtaaatgcacttgaatatgggtttgaggcagctggcactgccacagcttgtgctgcccctggttgtgaagcagtcacatgtgccacccccgcctgtgctgctactgcttgagccgctgccactgattgttgcaagaatcagatggaattgaaacattagagtgctttacaaagcacaaaaggcataaaatatgtacacattgatagatagattatgtgtatgcatggaaataagccaatcataagcaataaataagcagacactacagcgagtacaaaatgggacatacataagctatatatatgttgagtggcatgaatatggacatgacaaaaccggagtaccagactaacgcgtgtgttgcatattacaaaagcaccgacatatatctatcacaattcaaaatgcatatgcaaatcacatataaaacaaaatgcatatgtaattaaatacatcagaggttcgcaagggaacataactgccgatctatgagtacaggacagtccggttcttaccatgaaccaaacactgagaagttatggtcaaacaataagggaatgaggataccttgagctcgtttttcagcatttgccacatcagcacgcaacttgtcagcctctttggtcatagtcattaaattcatctccatcgtccgcatctgctcaacttgcttgatgtttgtgtttttctcatattcaaaagcagatctatgcatggttacgggaaaacatcatattatcagaggcctgttcgccaccaaagctcaggagtgtatggaaaatgtaaaaaaggaataatatcacaaaccttagactctgatgctcttttcggagcccatctagctcagtcagtaattcaggaagtttcttactgtcaccagagaacttatgtagctctttagttactttatccatctcaacagtgagcatctgcctctcagcaataagtctctttgcctccatatgcacttgatgaagttccttcttcactgcatcaccagcttgtatatctgcttccatcaatctcattctctccatcaaatctctcatatgcatatcagtctctgtctgaacatcacctaggtgagcacggatcatttgcatttctttctcagtatcaacaatatcctgcctcaagacgacatggctagatgccaatcgctgattctctctgataagcttttctgcctcggcggtctgctcagcaagtttcttttccaagatctccagagcggtggcagcgcgatccaaaggttggcggccagaaaggctggctgcagggaaggcgccatcacgcatcaaacctgaagcttggcgtccatccagctgtccatggtatgccattatactgaaatagcaagtaacaccaaaaggagtttaaatcgggaaatcgggagcttcaaccaaaagtgaaaaatgttattaagtagtcatgctaagccatgcatgcataacgacaattaacatggcactcaacattaaataccaggcacgttgcggtctcatcataggtgatggtaatttgaaatattgtactagatactatagttacatccatgaagttgttcaaaaaacatgtggtgccaagaggttaacttacaataaaagatacaaagactccctattaatcaacaaaacaaatagaggagattacattggagttaaaatacagaaacgcaaacggctcacacgtaatgcaggttcgaaatgcaagcacaaaaataatccccaaatccacacaaggctgaactcccgcgaagctgacatcaaatctctaagctaaaacctacatcaacaatccatggccctacactgacagattaacagaggcaaacctaaggccacctccaatgcaaaatacttcaatgggtgcttaggaaaatagaaaaagctaccacaccactaagctgagaacgtcctaacttagggcatggggtgaattcagctcaaccccaattttttttccttaaacaatactgcaccacgcacgtatcaatggacagattaatcgcgaagaaactagatggcttaatcgtagtgaaaagaaaaaaaaacaatccaggtccggatagatttccccaggtcacggagtgacgcggaagaggaggggagactgggagagggggctactagaggagaggtgatggata

SEQ ID NO: 46066 - DNA, 3569 bp, Oryza sativa
gaaagagatggagggagggcagagggaggaagaatgtgggacccggtaaaggcagaggaggccagatgtctcacccctcgcccctcggagtcacgactcgagtcacgaccttgctgcgttggcctactagaccatggccctagccctagggcgaaggccggaattttgacgcgaatattaaggaataaccacgattttgaatccatatcgtctaagtctaaccaccgttttatagagctagccggaatacctgagcgtttctttagtaggctggaattttggctatttatttttagtcttttatttattttaaataactatactaaatgttaggggtatacaattgtatttattttataataaaaatattagtttgaggtagtttaattattcttttgtattgaatattaaaatatgttacgtctcattaagttatcttattttggaacgagtgagtacttatttgctggagggttggctagcgtaacagagttacttcttgatccgatgaccctatttgtgttcataaaagatcagccgagagccacaacccaaccaggaaaggccatctaagtttttcataatcataccgtgtgttagtccgatcgctcagagcgtgcccagtacaagccaggacttgctcaaagactaaatgtaaagatgcaaactaaatgtacgactgcagatagcattgcaaagaatcagatgataattggaaacaacggtcttgaggtccatggagacacagccgcggctgaggaccgataatcaactctcataatcatttcagttaaaggaattaaggctgccagcatttccctttgcaacaaaaggtgttctctttaccttgttacacagcatcgtgtgaagaatactcctcgtgggttcctgaattatttgtggaacagaactaagaaacagatattgcctcacgattccttcctgggaagcgtcgtacaaattgacgatctaaactctatacgaaacaaaaataatcgggagtcgggacaaatgagctagtcccccaaaagaattaatctctcaggcgtgcaccggctggtatctaatccagattggcgattactgcatcagtgacttcctgggtggtgctggtgccgcctagatcctttgttctgtacttgccttccgcaatgacacgcttcaccgccgtctccagccggtcggcgaatgacgggaactgcaaatgcctcaacatcatggcggatgatagaagcagcgcaatagggtttgctttcttctgctctaagatgttctcgtttccgacgtttcctgcagaagcaccttgctcaaagacagcatggtcctgacccacattacctgcaacaggatggcgaatataaggattagtaaaccacgttgaattaattatggtatacaaaaatgaaccaactgggtggtccaaacatataaaatgggtggcaagtgatgactgatgacaagaagtaataacgtaattgttccaaaagaactgatgaaaggtacaaccatgcgtgatgcacagacaacaaactgtctcccagtaagaaaaatattgtcggtgacagaaaaatattgtctcccagccgattgtttagtgtgctgttgcttatacgaattaaaggaacaaggtaaaagttaagatcctacctccaggcataacacctgtccctccagcaatacctgcagccgtgttagcaaccaaattgccataaaggtttggtgtaacctacaaaacgtaccaaagagtagaaagttagaaattctgcaggaattacacggggatacttaacaggaatcatttgggaaaaccagtattcaggaaagtgtcctgcggaacagaaagaaaaagtaaacaaaaaaagggggaattcgacagttgtcgttagctaacatactttatagtacatcatatcaagctaactaaaactgcctgtagctgcatgattgcaacgcttacatactgtcagctggttagaagtgctatagattgtcaaaagattgttttctcaatccttataacaacaaaatttcatttggtttctcttcattttcacattattgagtgtttgcacttttctctcctcccataaagatgatgcaaatctaagcattcccaatttctctgatgttgttcaggacattaaatttctcataatgcttttgaaattctacatgataaataggtcaaatttatagataaggaagcggagcaaaataaatcgtacgatgacactacttttatttcctaatgcaaatgacagaaggaattttaacctggagactatatatagcaaatgtgtatcattagattcattatttatcttgcatcacaagcaaaatttcaatatcctagttgctaaagcatttacaggaatgtatgcttcccaagtacaacaaaatatgttctacaatgctaaaaccacagcatctacaataacttctgataagcttcctcattcagaactgtactttctgagaaagtattacattcattcttcggacataaaacaaacagattaataaaaacagatgtttgaattgcatcataaaatgcaaagcacacgcaaagaaactcagtgcagttcaaacaaggcagctccaaagtactgaacagacagtgatgctccagatagaatgtatgaagtaaagagcataccatgacatcaaattgctcaggctttgcaacaagttgcatacagcagttgtcgacaatgatctcattatactgaataccaggatactttgaggcaacctcacggcaagattccaagaacaaaccatcagcaagcttcatgatgtttgctttatgcactgctgtgactttctttcggttgttaaggtaagcatactcaaaagcatatttggcaatcctctcagagcaaaactttgttatcacctgacaaaagttagtcagtgagactaagatggaaaagaagctcagagaactggaaaaaaaaaagggtgcatttcattccattggcaatcatgtaacacaaaactaatcaatggttcaattgaaagaaaagaaataagcacatatctgatgagtccatgtgccccaaatcaataaatttaaccatcagtctacctattccctctattccattccctacatcccaaatccatgaagctgacctgattacacgtcatataacagtctggccaaataatcacgtcattaaattcttaaagaggccagtgtttgatgcagaataaacaaatcaggaactaaactagcacgttttacaatttaatcaacacgcaaataatgtaaattcatagattgtaccaaacgctttaccaggcaaacagcaaacaacaaaccgtgagttcgattaagctggtctgtactgataaaacgcctgctaatccacatctcaagattggacaaccaaagcagatgccaaacatcaggtcaacaagacaacaatatatattaaaacattcacaccatcccatccttaataagacaacaattctgcagattagatatatgcaacttcactagaaattgcatatataactctaaccgtggacttatcttgtattcagtataccacatattgaga

SEQ ID NO: 46067 - DNA, 22846 bp, Oryza sativa
  unsure (1)..(22846): unsure at all n locations
cccccgtcacgagcggcccgatcccgtcccccgggatcagcgtcacggcgcgcgggttcccgtcccctggcctgggcatgtaggtcaccgtgcggcgcgcgccggcgccgccatggtgcgccggggcgggggccggggaggagaggatgcggcggaggaggggggcggatcgccgcgccatgggtgggaggaggaggaggcgaattgcgatcgggaaggcggaggcgaggcgaggcggccgggaagagaggaggaaggagaccgggagacttggagaggggaagaggagagaggaggacaaagggaaggcggagatgtgtactccagttgttttttgcggtctaatcccttggagatttttgtatttggagaattgcatttcgaagttagacttctttcacaagaataatgaccaggagtccctgccaaatgggcccatcaaaaggccaatctatatttatatatcccgtaataatttaatcggcaaaaaacacataaatgcgtatcaacttgcagaacataagttgagcaatggaagagatgagaggtaaactattgcttgcgtgcttgctggaatattatttttttggttcagcgaatgtatcgatcaattgccactcaatccatccaatattccagtaaactaacctaacgcctatcatcaactatcagttggagactgaggtctgaaggtagcaaatttgggcttttgttagataataatagcagagagaacaagtagaatatggaacgaatttgattcgctgaatgccacaaaagataatacaggagtgtagtatacttcagccattaagatggcagtttcaaaaacgataacgtgtgcgcctcgtctttttagatttacacaaatgtttccacaatttctttcttggtgtctaccatcgaatctgtttacaacgaggagcgagaacaggattgtcagccctgaaagcagcttcttcggctcgagattatactcaaggctcatagctcccaacttttcttataaccaatgcacactagcaaagaaggtgagaagtggtcagcgtgcagtgatagactgatagctagctttaaaacattgaagaattgaactgtactactactagtactagtaacgattcacgaacacctttggtaatgttggcagcacaatggaaccttacaaattaccatttcatacataatacaaagtaacttgctcacaatgagaattcctaaagagatatatacagcctacgcagggatagagcttctactaggctagcaagatccgtatgctctcacccgacccccaccccaatgtttgaagatttttatgattagtacttcatatatagtacataattgggtgcattctcttgttaattcctccatctacttaattgattttattatttttagagatatttaattgtgaaacaagtcgctgcgattagagtgtagaaatcaagaatatataatgaagaaacataagtatgcggtaatgttgtaatttagtatagatgcttttgttttagagctgctgtactcatgtattgcttagtcatgtgttttgtataactccaatgtctataaattccaaagaaccgcaatcttattttggcccctcttgagatttattagttcaagctccactattgtgtgtattgcttaacagcaaaaataattatcagcaaagacaatgcccttataatgcattttaaacaatcgcatgcatacagatagtacaacaaagatgggagtttatcaaatggctgattctatcaaataattacacttacagtcaaggaataatcactataataaggaaatagtgcaacaaaatgagcagccaaaatagtttggcaatttggaatgaacaaacagaaccttattgccttaatcttatcagagtaagtaacagggtaagtcagcaagcatataccttgttgttgctgagaacaaatcactgtccttatttcaatccagcaacctttttcctgagcaatgtattctgtttttcctacaaaacaatatcagaatacagatcagaaataccacatcaaagaataggctagttgttactaacagtagcatatctaaatgcaatccttgcaaaatttgtggccaggcatgactggatgaagtagtagtaataataataagacaacaataacatgatatagaccctgttaaatttgagttgtattataatgtagttcaatcacatgcctatgcaagatgaaaccatatatatgtgcagaaccttaaattctgcgcacagccaatctggatttatcattcaagtattcaatacaacactttgtactgtttctaaagcccttttcaaactaaaaaaacatggataataattatgtatagtccaaaggccccaaacaagttgcatgctcgtgaccatattcatttaccaagatcagcagcattccagggcttaaatcgtgattttgtggcttctgagcaaccaccaaaaagggcataactgctataactgattcttggaagcatatttttcaattctatttttagctttttatatatcataatttattaataatttaatatgagtcttatattgctcaaagtttattacgaagtacataaaacaccttttttacacataaagcatgtcaaaagaaaagaacaacgggtcttaaactcttaactgacagtttagtatcaattcacgtgaaattaagggtattcgagctacaggatttctcaaacagaagaaaattatccatgagaaatacagtatcagatagaggtgctatagctatagcactcacctgtactgctaattgcaattttagttgcctttgcagcttttcacaagatagatagcagtcaccgtctaagaaatgtgtcatggtactatggcggactatctagaagactagaacacagcagcactcaatctcacttagacctaacttgttcagccagactcaaccaaagcagactgcctcctggcaatcagaactgactcatgatatggatgaattacctctttaactattagtctatcaacaagcaagtaaaaaaaacagcactagttaaattagaaatcacaaatttcagatttatacatggttttggcagagctgtcaaggcatagtttcattcacactaggaccaaagtagagcgtggattatacatgtggttactcaaaactcaaactatgcaatttcttccatctcgcatatcaccacagtaatccagcgaaagagctcaccaccttattttggcttatgacaactcaaatagccacacttgtagtcaaaacaaaataatacaacacattgctacaccagaaataggtgttctaaaaagatgtttggtgaatgccttattaactatttagacctcccatagccacttggatcctgcagacctgcatggctggattcacgccctgctccaactcttcatataccactttatctcagcctcaggagatcccagactcccagttacccagcatatcctagctaaatcttattttgaaaatttccttgaagtgggcgatgccacatagcagattaagaaattaaagaagggtaatacaatctgcttccttaagcaaacacggatattcaaaaagaaaattggtttcaggaggcaatgttattgcgttaagcagaacatgaattctttggaaactgatttagcctttctatctagaaaatatttcataccccctctgtccatgatggcagattcatccaaattgttcgatcgtttcttctattctgatgtgaataaatcttgcctaattcacataacagaaatattgtttcaagttagcctaacaattgacacaggatcaatcaatttgtccatagagacaacaatatactccaaaaggcaaaattctgacaacacaaaactcaggatccaacaatcacctgatcgagcacgcgttcgttggtccgctcaacctgccgagcaagcccctccagcttccttagcatcccactgtacatctcctccatttcggaggtcagcgcagaggccgaggtcaccattgcccctaccctctccagcccgaacccttctaccatcccatcaagcgccttctgctcaccaatgctgtaaccctgctttacaggctgctccggcagcgacggcaacggcgactccggcgcgaaggcgtggtactgctccctgaatccgggcccagcgttgacgacgctgagggaggccggcacaaggcgggagtcaacgaggaggaacgcacggtagtcgaacgagtgaacggagaggccagcggcggaggaggatggtgccacgaggaggaagacgagcgggtgggcgagcaccgggtcttcgagagggagcgcgcgagggcggcctcgcgcatggaggggcgcagcggccagcggcggcgggaggaggagaagaagccgatggcggcggaggggtcgggggagtaggacgacctggtgaagcggccgagcggatcggcgagggaggaaggctgcgcgaccgaggcgtgcccacgacggagatggagagggaggggcccgaggaggcgcgggcctggtcgtcgtcgtcgtcgtcgtagaaggacgggggagccgcggctgcgcggctagccacgccgaagaggagcccgtcggagtcgccgtcggccgagccgcagcaggcgagcagcgccgcgagggcggcgccggagacggagagcttcgcggcggcggcgggggccatcgccgtgagatgggattttctgggggaagctttctgttccggagttcggcgaggcttttccgagacgtgacgggcgagacgaaggtacagcgccttccagacttccacggatgagtgatggcacacgtgggctactaggctgggccgtattgaattctttgtttttcatttggattacgtctattttacctccctcaactcttgctcttgattgaatcgcctccctcaaccgcaataccatatataaccgccaaattgagcccctcggcggtttagctggtgctttggtcatatgtggcatccacgtggcatgttgactacgggccaacgttatagagcacgttgttgcctgccagagtagcttatcccgcggtggtggtgagcgagtgaaaggggaagatgacgtgaggctatggttgtggctcggagcggattaggggaaagcggacgctgcatgagggacggacacacctatagtggaggtgtgtcactcccgtgatcggttgattgtgccaccagaaccatcgtttaatcctcatgcctcctcctccgccgtcgacgcctacatcatcctcttgccgttgccattaggaaaaagggagataattagggatagggaaaagaagaggatgtgttaatgatatgtggggtccatcgtttttttattactccctccgtttcaggttaatggtcaaagtggaaatgacttgtaaatgagaatgagtggctttatgaacctctttgtaagcacttttggtagtgcaacctccggatggagtatgcttccagcaaagtttgtctgggtcttcatttggaacaagctgaacattctgaatggcttggattgcttcttggtcaaaaatttgttgcagcttttgtgtcccattttttgttctcatcccataattctgcaaccttagagggcaagtgcatattaatagcccgagagtttaaatgattatcaatgttttcccagattgaacatcaaggttgattccagatgaatacctgaccttgagagagttgccaaatagttgaagaatttagaaattttctaactttaaggatagaggaccagaaggcagatttggaaatgttttcattagctttccagaaagaggtattattcaaatattttgctttgataatagtagaaactagatcattgggattactaacaattctccaagttgattgaataagaagacttcgattaacattgagcaaatctcgtatacctagtcctccttggtctgtaggtttgcatataccctcccacgatcgccaacaaactcattttttactgtcctcagtttgaactcctgtccactaaaatttcctgataatagttgttagtttattaagcaagcatttagaattagaatagtggacatatataataaacatggatggaagcaaaagtggacttaataagagagtgcatgagaaagtttgtttgctttgatcattgtcaactttgctctaaatttattagggggtgtttagatatatgggggtaaagttttagcgtgtcacgttggatatacggacacacatttaaagtattaaacgcagactaataacaaaacaaattacagattcgtagtactagaatatatcatatctctccaaaataacttatattatgggacgaagggaatagtaaatataagcaccagcatggccatgttaaatataagatttaaattcggatgagctaattccaccacagaaaactttactagtcgagctacgctcacttcaatttgcctctagttttattcttggttttttttatcaaaaagagaaaaaaaagttattattgttggtattttaattgttgtcttctgcggtgtgagaaactaaatgggccatagaaaccgaaatatgggccaatacatgtcaagcccatttctcatgggccgccacaaccatcatctcactccctctctcgattctccgttgccacacgctcgcaagcagaggcggccggcgacggcgcgatgccgccgagacgagggtcgcaggcggcaagaacaaccggctggcggcgggagccgggcgggcgatgcgagcaaccggtgcggcggcggtccaacggccggggagggagtggaagtttggaaccactcgaggtaaaccttccgaatcggtagaaaccccccaactctgaatttgctaggcttttattctggggctgttcactttgatgccaaaaaaaaatcttaccaaattttggcattaccaaaattttagggcctgttcactttgttgccattttcaaccttactaaattttggtaaagttgtcaaaaaaaaagtagctacatttagtttgctgccaaattttggaaactatataagaaatcctgctaaaattttgttgccaaaattttggtaactatgccaaaattttggtagaatttcttatatagttaccaaattttggcagcaaactaaatatagccatatttttagcgactttattaaaatttagtaagcttgaaaatggcattaaagtaaacatgctctttatctttcctgtgaataatcgtatataatcttaggaaccgaataagcccaaccaatataatcgatataaaaaccatcatgaactgaggacataaatctcgcacccccaataaaaaagctatcgatcaacagatcaactgatacaacatttcagccatctgataacctgagctaactaggctatacagtattctgaatttctgacacaattcttgcgttaaaacggataaagtggcctaacaaagtaacaatgtaccaaaacaactcatttaaaagttccgacattggagaaaatccacgaaggcgccatccatgttttcatctgcatcacagaagcctgaaactctatccctgttctattagaaaatcatgctgatgaatacaatactagtaataggtgaaatgaaaaagattgaaatacccaaaatcagtgccctcacatgtcagaatgcaaagttgatttttttacactggaagcatgtcttcccattctaattgtcgtatctgatacaaacaacaaggaatttcaacattgaatacgaaaaacgtttaagaaataaaacaagacagacatgatcgaatctcagtgtggaaccatttggcactcgaacatgttcagtctatctgcattgttgcttgaagtgataagtcaaatctcaggatagaaccatttcgcactcgaacatgttcagtttatctatatcgttgctagtgagtagaagcgaatgaattgaacctccgaatgaaccgttttgcacttgaacagtttctgtattgttttgttttttgaccgatttatctgatactacagaaacaaaacttggctcatcgtccatccaatatttataaaactactgtacatttggcaacccaatacccaagatttaaaactattgtacattaggccacagccataaatagtgctacccaatacccaagatttaaaactattgtacattaggccacagccataaatagttcaggaaacaaatcttggttcatctaaatttgtatgataaatcttaagagtaaatcttggttcatctaaaattatatgagaaaacttaagagtgcaaatgttgttggttagacactcccccttcaggttctctcatttgcatgttgaatctgatgtactcattttctctcttttgcttgttgattctgatgtactctctcttttgcttgttgattctgatatattccaccaagtgttcggtttgggcccaggagaaattattcctatctgcagctgcaaattttccattcaatgtgaccatagctggctggttgcagcagattgggcaccaactttataactgccaataacaaacaatatagcttgacaaacaaataataacacatcctgtatgtgaaaatttcaatcttggaccaaaatatatgttgtactacaaataataaacattaaacaggtctgataaatcagagagaaagctttgtccatctaaaattaaatggaactaatgtacattggaccacagccataaatagttaaggaaacaaatcttggttcatctanaattatatggaaacagcattgtccgattgagatgatgtttgcactcttcttctaacatggcaccggctgcaaggttccagaacagtcaaattaactgtagatggaactttatcctcaatgtatgttctgatagccgcgagcccccttggagcttccgtgagaacaccatctatcatgggaaaacaccgcctatacttatcttgatcacacctaggaccataaatggtatccaatgtaagacactcaagtgacaccgcattattgaggatataacatgttagttccaccaagctcttcgcagagctgaaaccagtgatcttcacactcttgaggtggccatggtggtgttcaggtatgtgtctcagttgtgaatccgtgaaaatcgattcattcaccatacgtagagtcacctgaccatgaaaaggatgatatgcttgaattagacccagagtgataaaaaaagctttggaggatgaaatgaatgaatgaacaacactagtgccttacatttaatatcaaagtctccaaggaaggagatgcattgataaaagaaaccagagagaaatagtcatatggccgggaaatggtcgatcctgttatcatacgaatggtcaggtgcttaaggtagatgaatttggtaggtagcattggtgcatcaaccacctgcacaacaaatatggcatgtatcagatttattatacaccaggtattattaatgtaatccgtatataacattccctaatgtaatccatatatatggttatactaatgtaatctgtatatatcgctgtactaaagtaatccgtatatattgctatactacaacacctcatcttttagagaatatatacctcattcactgattcaatgacaagagtttcaagatttggcataatggatggcagattggcacgagcatcatggattgcacatcccatgtctagtttcttcatttgcagcgtttccacaactgagaagttaaccctgaatcctctatggaaaaaactagagagatttggagctttgctctctatcactttcaagcttgagcattcaaaaacactaagtctgctgggctgctgtagggcgaaaggtatcttcaggcaagttatcttcgtgcattgagtgagctctaaatgctccaaagcaagagagttggaaagaaggcactctaactcagcccatgtagctcactaaccacagagacagacttgttaggcttctcaagggggcaagttcaggtgtgggatggagggcacaaaatcgaagtttaatgtaccgaagtgagtctcgaaccccatcagacaaaagtgagcatgggaagttgtattgtttgtttgtgtcaaacaaaaaaagggtgagttcttcgatccctggtttaagagcaatctgaagccaactgtcaagataactagtgccatcgaacccacacatgccactgtagtcaagcttgaacgttttcaagctaatgcctgagtggttcctgagaatgcacccaatttttccgtggaaattctcgccaaacgcatttctcttcaagccaatcgtgtctttattaaagataagattgggatgacacctccaagaacgtagaaaagcacgagatacgcaagcagcacgagcagcttcacgcattgacataaaggaatgtatacgagacaatatgtcctgcattacacaaacatcagataaaagatcaacattgatattgcaaatccatatgattacttcaattggagaaagaaaaaacagaagaatcacacagagtaatgttctgccccaggtagctctccacatgaatgcacagggtgaattgcattacataggttagatagtgcagaggaacataaccgtgctagggaaactcagtactgcatagagaggttttcctaacagtgttattttagtggttttctaaatgaaaaaagagacagttgctaacagctagcaccaattaacaactacatgatatatttttacttgcattagtagttgaccataatgtttccttgttattgcaagtagcacccaattattgtaagttatcaacatggtactaaagcatcccacttatgcatcaaattctggagagatgttagcaacctttgcagagagaacagtcactaatagtactaataatgtaggactgtgatcaaatcgcagcactaaaataatctttgctgtttataaatgagctccctccatttagtttcaaattgtacaaaccaatgccatataaaacaaatggagggagtaatatacagccagcctatgggtgagacgtggtgatattatgcttgcaatctaagcctgcatcatcagaattcaatgcctcgtacctcaggaagatatgggattgaatttctcatcattttgccagcttgagaatgaccatcgccatcatgttcacacggtgatatctttcttttacccgttgaggcaataaacccagctgctgcgacacgaaagggattgttatggtagcagagacatgaatcgaagaaaagcaagaaaaaggcacttcaatcccctgagatctcacaaaaaaaggagctcaaacgaagaatgtggaaaggcaataatctgagctgttcaccaaagtgaaaaatttgaagccaaacaaatgaaaaatgggtatccggctcacatcaaaccagatgagccagttattagttaggcaataaaaagagcagctttttatgagctgacaatgacaaacacatctaccgagccaaacgtgacagaaaaaaagatgggcgaaagagttgttcctgttcagagaggaaggaagcttacagcgggctcggatttgcggccggcgatgccgccgccgccgccggccgcgccgctgggacatgagccggttcggcgccaacatccccaaagacgagctcacgaagatacccccttcctccctcggatctgaccgagaaatcacttccgtttccccctccttcagatctctcctcttctcctctcctgccaatttgcggttcggttttgaactcaaattcgcaccggcgacggcgacggcgacggcgccggcgaacggcgggcggagctatctactcgcctacagaacgacaaaagtaaccaaaccctattcagtgtggggactggggagtggtttgatcttcttttttttttttttttggcttttggagatgatctcttgctccggtcttattggattgcggaataagtctattctgactccctcttgggcttgttgaatcgcatccccaactgtaaaaccaaccaggtataacgtctcccccaactttaaaaaggaataagtcaactttggatccctctattttgtcgcccagtccgattttcatcccttgaccgcaaaacgggtacaacccgtcccccaacttacaaaaaccggacaaacgagatccctcggcggttttggctgacgtggcgcctacgtggcttgtttgactaggtctccgtcccacgtggcattgacgtggcgcttacgtggcaattatatctagaaataataaaaagcgtggccccacatgtcagctgcacacaaaaaatatttttaaaatggtgggacccacgtgggccccacgtgtcagcctcactcctctcttcttcccactcccccctctctctctccttcctgggcagcggacggcgcggtaggcagcggagcaggcgagctccggcggcggcagcgggcatggtcggcgccgccctccgaccggagcgccgcggacagcgcggcgtaggcggcgggtgaccggagaagcgcgcgccgggcagtctgagtcggcgagcacagcgacatcgggcggcggaatcccggggtgcttcccgctgccgtcgcaacgagggcaacgggggtccgcctcggcgatgagcacgtaggtgaggcaggacgggtaggcggccgcacgcatggacgggctcgcgggcgtcgccgcgccccccgccggcggcgagcggtggcacttgccgatggaggaggacgaggaggtggacgccgacgatgacgacgacgtggccggggaggcacacgcggcggcggccgacctcccggccgtggcgcgctcgagcgcggagcggaccattcctagcgtgcagaccgcggccaatgtagacgcggccgcggcggtgtaggacggcggcggaggcaggttgaggtcttggtggccgacatggacgccctggagccgaggagtcagaaacgtcttccctgactgcaagaagaagaacaaaaaaaatcagtaaactccatttcttcaagattaacccaagaacagggcaagatcagagccttctgaaactaaattcagatggaacaagtttttttatgttcttcatatgaagaacagagtgcttaatctcctaatattcggaagaaatacagcatgcaacacatgaaccgatctctgatagttgcaaacattgcaaaattgtttccgatcaaagcaaaaaacaaataaccgaacgaatggaacagttcatctcaaaattcgtcgacacaaatagaggcgcagaaacataaaccgaaactctgaggagcggtggggaaggagcggtgggcgcgggcgaagaaggccggggtcaccgacgaggtggtggaggaggtgtgggggcagagggcgaggggccaggagctcgccggcgccccttgccgccacaggaatatggaggatgccgccgcccccgtccctggtattctccgccggcgcccccaactcgccgccggggcagcctcgtcctcgaactcgtcggcggcgtccgcatctgcgcctaccccgtcctggtgggagacgatgaggtcccacatcctcgcgctctccaacatcctcccgccgccggccaattccgacgtcgcggcgctcgccgactccgaccgcccagcgcgcgcgcttctccgtcacccgccgcctacgccgcgctgttcgaggcgctccggtcggggggcggcgccgaccatgcccgccgccgccgccggagcttgcctactccgccgcctacccacgccgtccactacccagataggagagagagaagggaaaaggaagaagagagagaagggagagggaagaagagaggagcgaggctgattatgtggggcccacgtgggccccacatttttaaaattattttttgtgtgcagctgacatgtggggccacgctttttattatttttccgagatataattgccacgtaagcgccacgtcaatgctacatgggacggagacctagttaaacaagccatgtaagcgccacgtcagccaaaaccgccttcagaaccgccgagggaccttgtttgcccggttttcgtaagttgggggacgggttgtacccggttttgtggtcaagggatgaaaatcggactgggcgacaaatagagggacacaaagtgaacttattccctttaaaaatcggtgcaaattgattcatttgtgggcctgccactagggagggtactggttagcctatatttatacccaaatttacccatcctcactacaatgcgtgcccctgagcgtgcacccggctcatgttgtctgtcgtccgtccacgaggtgtgcccctagagggaggcgcgacccccacgaggggaacacgcgcccttgacccctcaactccgcttttctggagccactccttcgaggctatgcgttgggggcttggggtgctcatggacacttattctatatctgcgatttccccttctacccttggcctcgtcgctgggaggaggtggacagtggtgggaaggaaccagaagcggcgaggaggtggagacgcagtcgacggccctggcgaggacagatttgcgacgacgacggcctggggacgacgcaaccgactagatctggactcctgacacaccgctcgtcgtcggccaccgcaccccacacgccactctccgtcagcagtgacaggagagagaggcggcgacaacaggtggcggcgaaagagaggtgacgggagagagagagaggatgtgagagagtggatttggctgccggcgaggtggacggcaaccggcgacgagagagagtaggagaaacggcgacggccgccgagatagagagggagacagcagtgacgggtgagagagggagagagagatgcgagcgatataggcaggagagagcgggaggcggcggcgcatctgggcgaggagggagaggagaagcggcgaggggataaaggggaagaaaaaccgcgaaaagaaaagacagaaaaagagaagagatgggaagaagctagtgggtgctcggtgggctaggggtagggaaggaaatccatatatgtggctatgggttgagacaccctgttgtgggttggagtaccttcattggttgcttgagattttgaagagcccagctgtgacctacgagtatcccccattgggagatgggtgccctatgaacttatgaagtggctttggttagtgagggcacccatagagtgactttggttacagatgtcctatgtgggtattgcagaagctaacagccgacaaaatgagtgagataaaagaagaaaaggaattgcctgggcagaagccttcttcagctcggggcacctacgccatgatatttccgtaccttcgcagttcatccttgccatagaacaacagcgtcgtcgatctcatgccattgcccctgtgcttcacggatgccaagcaaaaagaagccagcaacaacaaagtctattgtctatttaggcctcctttaattcaaagaaaattcataggaattttagaggatttcattcttatacgatttttttcatatatagccatttgaatcaaagaaatgaattctatgtaatcctataaaattcctatgagatgcctaataccatgcacatgaggttttatctcatggaaacttgcctctgagtcatctctcctctaatccctgcatcggcggcccaatcaaatggtcaatcctgcgattcaaatggcccgtagcatgttaaagtctattgtctatttcacaatataaatatttctttcttttgtgatgataagatagtattttcttttgagggataaagataatctattgttttatagtaaaaatgttgaggtatgacttctttaagttttctttttataaataataataaattacccatgcagatgcgcgagcttctttcctagttattataaagattactagccagaatcacgccctacgctgtgtgcatgggtatgaatgtttcaagctgtgttattaagatcaaaacaacacaggtgacttcttttcccaactttctcaactcaactcaatcgttttccacgtgcccgcttttcaaactactaaacggtatattttttgtaaaaaaatttctatacgaaagttgatttaaaaatcatattgatctatttttcaaaaaataataataaatacttaattaatcacgtgctaatggaccactccgttttccgtggacaggagattggttcccaacacacccaaacaaacacagccacagtatctacagttgtaacttttaagaattatatataaacattgtctaaaagaactttatgtcagaagcatacccacatatgcatgtacacattgtgactatcaccaagatttaaatgtgaatacaatctgtttgctcacataattgtttgtacaatcatgtacacttacaaaaaagtagcaatgacagaggacaatggatcttacataatgtggagtataggttagaaaaaacaacaatcattaggtgatatgagaattgcagcattttctcatagataccttcgtcatgaactaattgaatcttttctcatctatagcactgcagcacaaagaaaaatttagtgctttagctcaataaaaacaacagtacatcacttacaacagattagtagacgattggtacctcctttgcataatggcacagaattttgaggtatcccctacagaatacagggcatctttggatgtcatccatatattgctacacaatgagtatatagtaggtagtacaaatactcatataagaaaccgtgttgaaatatctctgtagctttggagaaggggcaaacataacatttcatgaattaaaaaaagttataaaatcatattttgaagtcagcttataatgaaaactctataagtatatttgcaaagaaaaaattcaattggaaggatgggttattagaaaattccaaaacaatgcagcgctgaaaaaaaatgaaagtaggaataatgcttgtcaagaaaaaattacaccccagtgtgccctattggaacatatgacatgtctcatgtaaaattgtttgaagtgcatgtcacttcgtcacacacaaataaattgaaataatactttatgatcaaagcagaaaagagaataacacagtacgtaaagctagagatactaagggttggattctttggaatagcacatatgtattgttaatcggtatggactacacagatcaaccgataatggaactatgcaggttacaactcagaagtacctgtggctttaattctctcaggcaaccatggtttcagtgtcactgaaacaccctgcaaacaacgctaacctatgaaatcaatgttccattaaatattaaacaatagtagcagatatagaaatgactctagcacaagaaaaatgttagctaatatacatagggcctgcactgattttaaaaatgtagtaattgcggtctagtaaagttcacaaatactgaaatcttcaatcgaaccaaataaatatttgttcgctagatgtacaacataacctgtgattaatgccttgacttatagacccaatattgacccaatgtattggttacaatatgattcgtagaataatggagcttcctccagataggaggctaaaagacccgcaccatgaaatcatatcattaccttaatatcggcacaattatctgtctatactgagccctaaagaccctgaggtttgtctcatagaaaattaactgcatgatccaaatataagggtaatatgccaagattgtcaggcttacagtgaatttctgatgatgtatgcatcacaatagccaatataagtttgtcgacaaagaataccatcaatgcaaatgcgtatgttaccattatgtgtactgaattagcgcacgacgaattaacaaataaaatatgatttgttggagaggaaggaaattgaggcaaaaccttccgatagcataaacatgatatgctatcgtggaactaaacctaaattatctgataagaaatatgaagaccacatatatcatcaaaagaagacaataagaaaacattcatacctaaaaacagaagcatagaaaggtggcagcaagaaaactcattgacatgcccacaaaatattattaccagtattgtacaatgaaggaatactgacattacttcgcactcattaacatttacaggaaaaggacaactaagcaaagaacatcaaaacttgaactctccaactaactttttatattttgaagtatatatcttgggaaaaaaatcacatctgccatgtagtactatatcatatacatttatctacaatcctgaatgagcgtaattgataataataaaaaaaggtttttttaagtatatattcttgtagaccaatttgttaagattccagaaacaattggcatatatatgtaccgatgtacatcaggatttcattatgaaggatcatgtacacatctttaacctgtacatttctggtagttgacatagatggtgcactgtcatcttcaatattttatcattattagtgaaaagttttttacgcagagttagctggcataaaagttatacgacattataattaaaaagttgcaggaacaaatgtatttgagaataaacttagatttgccactaaaaattttaccaagcacatagaaggcttttgttaaagagagaaattttactggcgtcagcctaatcatttcttctccttatctcagaagcccgcataggagccaatcagccgaagagagcaaactgaaaagaaagaaattcagcagcatacctgaacgactatggtgttatgtgcggtgacaacggaggagcagattgctcccagcgcggcgcaggccttgatgtgggcttggatgccgccatcgctgccaccagcatgaacaacacatgcggccatggcatctagtgggccatcgtagcaggctattggtgaggggcacaaatgctgttaggagaagatggttgagaatccataataatatacatttcaaatccattttctataataatattttcatagtaaaattttgctgctcctatataaagctattttgatttagcacgacattcatatagtgtaaaaaaaacatatacagatgaccaagaaaatctgtcaactattacagtgcaaaagatcttaatcatatcatataggcagctgcagtaatcctcaaacttttgtagacataatagcaatcaacagaatgatgtcagcaacctgaaaacatatattaaattccaatacaatatatacaggacagaaggagaggatttgatctgtacctggacggtgatgtttaaactttagtactgaataatctagcattctagcctgcactcccttttttctttccttcctaccaatcatgtgaaactcataatgagcagcaagtcaagaatagagatcaggggctagaacagatatgtatatatgcatataatagggatttaagtagtagtgtaccaaattgtgtctgctgatggcttcagcagaggagtagaacaacaaatatggaatcagcgcaagcaagcaggctggatcgatcatatatattgattaagaggattaggcaaagggagtgtaaagttgacctggggaggagtagaatgcgtggtagcagatcgtcaggtcgccaggtcgcagaggtgacgaaccagtcccggcaactccctacggtggcgaactaatcccagtgagattcggcgacacccaaactgtcaggggaagggaacggagacagtgcctgcggcgagagggcgcggccggggaatgagatggcgcttccgccatcccgcggagagagggcgagtgaaaggagacggcgccaccatcgtcttgcagcgagagggcgaggcggcggcaccagccatcaggcgtgggggtggggcgcgaggttgggggcggctgggcagcgctagggttttgtgggggagggtgaaagcatgagatctaagccgttcattcccaaatcaccgatctgagggcagtgaaacatccgccagctgagccacacggatggtcagatcgagcctcacggcgatcgtacggtgaacacaaactcagacgtgggcaatattttacgaaagtaggagggtttttctgaaaaaatcgcatgacgtggcgcagtaaattccaagcattcccacggcgtttaagtaaatcaatataagttagatgaccttgattttacaaaatcatagcttaactagagaaactacttagactactggtataaggataaagacaaacttcatctacagttggcgaaaatatatttaggctgtgttcgcatggggtggatgggaacttattccctccgcacggaaaacggagcggtccattagcgcgttattaattaagtattggctatttttttttcaaaaatagattaatttgatttttttaagcaacttttgtatagaaactttttgtaaaaaacacactgtttagctatttgaaaagcgcgcgcggaaaacgaggaagatgggtcgggaaaaaggagttgcaaacacagccttaactgtcatttatcctagtgtccttaaagttatatgttgtcattgtctttcttgatgaatccgaaaatataagttcgaaaacaagccgattattatactgattgaatttcgctaacattaccactactaaaactacaacgaaatataataacgaagagtaaccgagctgtatatcatggttcattattagagtgagtagtttacacattcctcgcgagtccaagttcagttgcaacgtcaacttcagagacacatcgctcggttgaaaactatcatttcttactaggactcacatcagctagctacacgctactggccgcccctgatctcagagctaaaaccggtgtgcgagaccgaagcgctatccgggtgggcgatagcctgctgcatcccgcgccggcgccggcgccgtcgccgtcagcttgggttcaattctgaacacatttattgccgctttctgcttgacttttatgcttttggcgacttcgattggtgcagaactaaagaagaatctgacttgcatcgcaatatcgcatggtatggtagtagtacttgtgatctctggaaaagaaaagtagaggagttccttttgccaatgtcaaataagatattatgctaatattaacccctttatggctttgctttacttaccggcaaccgactgactctgtttagatccaaactttttcttcaaatttttaattttttcatcacatcaaaactttcctacacacataaacttttaacgtttatgtcacatcgttccaatttcaaccaaacttctaattttagcgtgaagtaaacacacactacgtcctgctaggcctcacatccttgtcaccgtcttttcgtcctgattagttccacgcattttgtggaaaaaaactggtggcactatcgactcagatatcagaataatgttcctgagaggcttcaacgacgtagtattaaaatcagtgataagttatatgataaactgataatgcgattaattgcatggactgtgtagcaaaattaacgcagcttttataagatctgacaaattaaaggttctgaagtatgcacatttgtgaattgcgatgccctggattcaggaacctctctgcaaattgttggtgaagcagacaaatgaattggacgggaaagggaacaggtgagaggatgaaaatgaaagaaagagagatcagagagagaaggaaaaccacgggattattctgatggtatttcacccggatagaaagaagatattctcctggtagtggattcgtgcccctcttttttcaatctgatgcgagacagagttcttagtttggcgagcacggttgacaaagttattcagaaattataatattctgcttgtgattcgccaactgggcattcatctatgcagacattgaactgataatctatagtatgcacagagataacgtcaacattacgaaacccaaatgagcatcttttccatcccaagctgcaagtctccatccgtttcatatcataagtcgttttatttctttaattttttaaaaaagttttatcaaatttatagaaaaaataacaatatctataataccaaagtagtttgttaactattatattgaacatattttaatgatatatgtttgttttgtgtttaaaacgttactatatgtttctataaatttgattaaacataaaaactatttaactagaaaaaaattaaagcaacttatgatataaaatggagggagtagattagccatgaatcaaagcaacttaacgagaggccatgcaacgtgagcgccacgtcagtgaagaccgagtcaaattagctatgtagacgtcacatcagccaaaatcgccgagggatctcatctgcactagttttgacaggacccattgtatctggttttcctgttaacaagttaagagaccttagatgaacttatttcaaagaaaaaaacgtaaagcatcaagacctccctagtatagatggccataaggtccaaggctcgacggcacggcccacgtcacggcattttggcatggcccaagcacggcacggctcaacgagggtcgggcccgtgccgacccgcgatggaagacgagggagagaaaatagacttattttaaaaaggcatgatgggccacccgggccttcggaccgagaattttttttgttttaagattttgttttaatatttacaaaaataatctatcgaccaaaaaaattgcagaaatagcccctgccgcccaaatggtgggcggcatagctgacgtggcagacggtgggtcgaccgcgccgtctgccgccgtcggccaaaa

SEQ ID NO: 46068 - DNA, 3485 bp, Oryza sativa
cttaaacaaggagaattatgtaacatgaagaaatagtagtacaatttaaacatgatacaactatttgcattgcggttacatagatgatattagattcgaactaggagggaggtagtgcaatagttgaacacaacgacgatgtaataatgggacaaggaagcatgacagtagaaatttcaatatgccaagttgtccgataatagctaacccctacgtgaggatccctctcctctctcaaaccgcgctttagtaacgctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggaatcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatacgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgccacgccagtttggatcctcaacacaccggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacatggtggggtatggtgggtacgcttgattggcaccgaaagatacatgcatgatcggcgccgaaagttacattggtcgtatgcgccaaatggcgggcaaatactcgtatcacacgcgaataaaggaggctgcatcggtgcagcagaaagtagtcgtgcatgcgccgaaaggtatcgtgcatgcgccaaaaggtatcgtgcacatataacaacaacatagtcattacataagcatacagtactggaaagtgaagcaagtaaacaaaaagaagactgctctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgcgcctggtcctgcgtctgcaccggcggtgcgcctcccagctgtgaggggccgatgacgtcctctgtcgagcctgaagcgaagtcgaagtcagtgatgtcaaagagcacggtggaagacaggaaggggtccgacgaggtcccagcatggtccagtggtggaccctgactcgacgtgccggctgcctgtgacgctgaccctgcagcctgggagaagtgggcggcctgcgtcatagcgaactgggcgaaacctacacatcgacaacgggacccttgtaagctaagacataaaatgtatgtaaattgattgtggaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtacagaagtagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatcagcgtgtacgtcgtcaggtgctcctctacgggtaccggaatccccgcgtctaaacgttggatagtcgttgaaccgccaacgacgacccggttgatgtcgtcgacctgcatggttaatttgttcgtaaatattcgtaaaatttgacgaagagaaagacatgaaaacataaaggaatggtgcgatgcagggtactcacaacacgagcgaagtcctggtcgcggtgcctggcgtagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgactgctgaccctcgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgcggcactgtagggctcccacacgacgtcagtcgtcagaaggcggtcgaactccataacaaactcaggatacgaccgcctaacctggacgtgagcccatcggcgctgcaatacgagacgatcgatgtgatacaatgaacttagcaattaacttaacaatacgataagatcgatgcaacgtacctgacgacggaaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcactgtacagagcagccaacaacgcggaaccccagctccactgaggcacctcgcctaccgcggcgtcggcgatgctcgtggcgtagtgcacgagtcccttgtcgaccgcgtgcccgtgaccgccacagaacatcacccagccaaaaagccag

SEQ ID NO: 46069 - DNA, 4129 bp, Oryza sativa
agcagccacctcttcgtaggtccggtattgcggtggtgtgccaccggctcgagcgggaggtgcggtgcgcgctgtactagtgcgaaacgtgccgtcagatcgtcctgccagtccacagccgtggtcactggcccaacagcgtctcccgcgagcggtagccccaacaagtacgatacgtcctatagggtaggggctacctcaccgcacggcaagtaaaaagtgtgcgtctctggcctccatcgatcgaccaaagctgctacgagggacctgtccacagtccatcgtctggccgggtccgcgtcgcaggccgcagcctccaccagccgacacatcggtaggaggccggcctcacgtagcctgcaataacaaattaatatgtcattataaaaaatattacagtgcaactaacttatagtaaaacattgttcgtacctctcgacaaaggagtcgtgaaccgtgagtagctcaccgcacgtccgtgcccggaacgtcccaagctgagccccctgcaccgcagtaaggtaagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatgagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtaaccagacgtggcacgacgacgcctaggacgtggtcgagtggaggtagtgccttcacccgtagggcgagctccatctgctgctgatcctgataatcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccaaccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgtatctggtatgccacactccgctgcggcagcaatgacatgggtgcatggcctgtggagcagcttcggctttgcacaagagcaatgacatgtgccgtcgtctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctagaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggttgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcaaaatgccagcgtgcctatcatgtatcaggcatacatttggcctcataccaacaacttttgttttaaccaatttcaggaaccataccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcattctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacaactgacactgtccaataatccttccatttccccttatacgcgtgcactctccagggacaaccatctttttccttaacacaccgaacttcatattgtgaccggttcgacttggcaaccctaaactctctatgaagtgacactgcaaaatgttttaccgcctccttcatatcttctgctctactataaatcgctccctgaataaccttattttctttgtactcccatctcacactatcctcttcagagacgatcagtccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgtccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagtttaacattgattgttatgtcacttgtctgtggatcaactctcaagcccctcattaaccatccttttatagaaggtacactcctctcagccggtctctcaattcccctttctgttacaataaaatctaacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctataatacgcacttctagattagtacaactaaaaccctaaaaatataatgcatttattcaaacaaatttttaaaaaatacacactatttaactcaatagtcacatataggatctatgaatattacctgaaatcggcgtctgaatccggcagggcttcgccccttcttctcttctcctcccctctcttcttttttttttcactggaattgaggagagaagaatgagggctgggggctgggcaacaggccttttataggcagtgaggcctgccgcccggccagagggcggcaagggg

SEQ ID NO: 46070 - DNA, 8372 bp, Oryza sativa
atttttttggccgatagattatttctgtaaatattaaaaaaaaatctaaaaccgaaaaaaattcttcggaccgatacggcacgacccgactgctggtgggccatgcctggacagaagtgcagcccatgggctggcacggcccatgcagagcgagccttatggccatctatactccctagtccctactcccctcttcccaattttccatacctaatacgtagcgtttggttatagctttagctccgcccgccgccgccgccgcctgcgcgaagttgagttcaaaaccgaaccacaaacagactgggattgcatttgcaataggcaggagaggagaggagtagagatctgaaggggggggggaaacggaagtgattttctcggccagatccgtgggaggaagggtatcttcgtgtactcgtctatggggatgttggcgctgaacgggctcatgtccctgcggcgcgaccgccggcggcggcggcggcatcaccggccgcaaatccgagcgcgctgtaagcctctttcctcgctgaacagctcacccgcccatctttatgttaagtttggctcggtggatgtgttcgttattgtcagctcataaaaagatagtatttctttttaatacctatctaactcgtctggattgatgtgggcctgttaccgatttttcacttgtttgacttcaaatttttcactttggtgaatacggaatagcaaagattattgattctccaccactttctccgtttgagctccttttaagttttaatttatttttttttcgcacaactaagcaacggggtatttcagatgggtgataccctgcataggttcctcaggaaaaaaaagatcaaattaattttgggagatatcaagggattgagtgcctttttctgcttttcttccgttcatgtctctgcaaccataacaatcctttttgtgtcgcagcaggtgggcttattgcctcaacgggtaaaagaaagacatcaccctgtcaacaagatgactatgatggtgattctcaagctggcaaaataatgagaaattcaatcccagaccttcctgaggtacgaggcattgaattccgatgatccagaaattttctttagcctgggcatgcttaggctgcgtttgagatgacatctatgatgagattatggtccacatgcaaaacgagacaagtgattagggtatggttaattaggtattaattatccatagattaaaaaaaaggatataacaaaacagaagagagagatagtgacctctgacaataatctatcagcatcaagagtccaataacatgttctgcttgtttgccattttttgctacctgtcttaaactagtgcacaattaaaaggctgctttggtgctcaaatagtcgtgcaggacaccatactaaactacagactgcaccatatagaagcatgacgcctggcgccgcttgttgcccaggagcgaatgccattggctagcagaggaacagcatcagagtccacagcggcaaaagactgggagcccgggcagctgcccatgctggccgggccctgaatccgccgctgcttagatttcaagcataatatcaccacgactcacccatcggactgattatcttgctgactgtgctaggctggctgtatattactccattttttttatatgaccatatggatttgcaatataaatgttgatctttacgtcctccattttttcttcacgcattctgatgtttgtgtatgcaggacatattgtttcgtatacagtcctttatgtcaatgcgtgaagctgctcgtgctgcttgcgtatctcgtgcttttctacattcctggaggtgtcatcccaatcttatctttaataaagatacgattgtcttgaagagaaatgcgtttggagagaatttccacggaaaaattgggcgcattctcaggaaccactcaggcattagcttgaaaacgttccagcttgactacagtggtatgtgtgggttcgatggcactagttatcttgacagttggcttcagattgctcttaaaccagagattgaagaactcaccctttttttgcctgaaacaaacaaacaatacagcttcccatgctcacttttatctgatggggtccgagactcacttcggtacattaaacttcgatgttgtgccctccatcccacacctgaacttggccccttgagaaacctatcaaatctgcatctgttgtatgtgagcattacatgggctgagttagagtgccttctttccaactctcttgctctggagcatttagagctcaatcattgcaaggggataatttgcctgaagataccttgcaccctgcagcagctcagcagccttaatgtcgttgaatgctcaggcttgaaagtgatagagagcaaagctccaaatctctctagtctatttgttagaggatccagggtaaacttctcccttgtagaaacattgcaaataaataagctagacatgggacatgcaatctgtgatgctcgggccaagctgccatccattatgccaaatcttgaaactcttgtcattgaatcggggcatgaggtatgtattctctaaaagatgaggtgctgtagtatggcgatatatacggattactttagtacaatgatatatacggattacattagtataatgatatatatggattacgttagtgagtgttatatatcgattacattagtgatacctgttgtgtaataaatctgatgcatgccatatttgttgtgcaggtggttgatgcaccaatgctgcctaccaaattcctctaccttaagcacctgaccattcatgtgataacaggatcgaccatttcccagccatatgactatttctctctggtttcttttattgatgcgtctccgtccttggagactttgatattaaatgtatgacattggcactgttcattcattcatttcatcctccaaagctttttgatcactctgggtctaattcaagcatatcatccttttcatggtcaggtgactcaggtacgtatggtgcatgaatcgattttcacggattcacaactgagacacatccctggacaccgccatggccacctcaagagtgtgaagatcactggtttcagctctgcgaagagcttggtggaactgacatgttatatcctcaataatgcggtgtcacttgagtgtcttacattggataccatttatggtcctaggtgtgatcaagataagtataggcggtgttttcccatgatagatggtgttctcacggatgctccaagagggcttgcagctatcagaacatacattgaggataaagttccatctacagttaatttgactgttctggaaccttgcagccggtgccatgttagaagaagagggtgaacatcatctcaatcgtgcaatgccgattccattcaattttagatgaaccaatatttgtttcctgaactatttatggctgtggcccaatgtgcaatagtttaattatcttagatggacaatggaccaagctttatctctgtattatcagacctgtttaatgtttattttttgctgtacatgtataagctgaagatttatatgtttttgtccaaaggttgaaattttcaggtgcaggatgtgttgtgatttgtttgttactagcagttacaaagttagtgttcaatctgctgtaaccagggtttgcacttttaatttcagcgaaaatttcggtagcatcggtatttacaaattttttgcactttttgaccgaaattatttgaaattttaaccatacttgaataaactttaaccaaaatcaacaaaaaaattgaggaaatccaaaattttcggttgatataagacttgctggagatgtccaaaaatttcggttgatataatgacttgctgcagacaggaatctcttctcctgggccgaaagcccgaaaccgattgcaagcaaacttgcattccacacgctcattcatttttctatcattgtatccaacacttgatagagtacataagaatgaacatgcaaaacagagaaaaggaaactttgcattccacacgctcattcatttttctatcattgtatcgaacacctagtagagtacataagaatcaacaagcaaaagagtcatcagattcaacatgcaaatgagaaacgaaaggggagtgtaacagacaacattcgcactcttaaagttttctcattagatcgcagtcttaggtactctaaagttttctcattagatcgcagtcttaggtggagtgctttgtattatgtttggtgtacatgaaacaatgaaacaactaagtggcaatgagaaactattattgcaaaatactctatcgaagatgaatggctacagaaggtcttgttatgagtgtgtgtactgaattcttggccaggattaaccaagagattttgtaatcccctataactcttggttttggtttctggtaaggctgcagcctgatcctctttgaagcaaacaggtctgccagaattaaaacatgcactgagagtcctagagacactaaaatagtcatcagatcacaattcacaaacttcaagttggcatagcaaacctgttggtatgatataccaaagggcatttggagttggagacacttttccttgatggatggcactagaaaactcagtttccatcaggggcttacaaacctaactcttgaaagggaacctgaatttcagccattaaaaataaaataaccagcatttctctgcattttaaactgtagaagaaacccatagaaatatttgccaagactaaatcatgaatcaataacaaaccattagagacaacacgacccaaacaatgacatcaaactaggagaacgaacccaataagaaaagcaaaacttaactgggctggctggggcttcctcaaagaagaaaatgcatttggaaaaatatgttcagtcctccatctgaagtagcctcaaatacacccccccccccccccctaatgtctctttcctgacactgaaacacaaagagaagcataccaactttgatcttctttatggaagctacagcgtggccaggaagcccaaaatgtttttttcactaccatacggcatacactccaggttttgattaaatctattcagcaggtactgttgcagattcctttaaaatgaaagaggagataatgggacaatgcaaagtataaccaatgcaggttttgttcatcgaacacttgcggttgctattctccagaagattaggcactagtaacaacaagcaagtcactcacatttagccttcgcatttcaaaacaaatcaaatcaacaacgatcatgaccagtatactgaagaacaatgtcaggaccccaacacaacagtagccaaaataacaaaacaaaagcttctatggtttcaataaatacctcaaatcatacaagatcaaatatcaatcaggtacaggtactactgtactagtgcttcagtctccaaaattagatgatgcaagaacggtaaaaaaaaaaggcatacaaactgaaaagagaactacgaaaatgaaggtcaaatgtattttccattgcaaatggagaggaagaacaaagagttatcccacagtttatcagctcaaatgcagatggtttgttttggaccatatggtgaaacttgatgccccgatccgccggtagtcagaagaccaacgcagtcggtgcagaatgaaatagcccgtacgccatgagagaaatactagcacgggaggaaatccagccgacgggggaagctcgctgcagcaggatctacaggcgttggtgtcgtcgaaattcatcacataaatcggctaagctcattgccttccctttcaggtgaatttgggaaaaataaatggcacggtaaccaaggaattcgagagaaaaaaaatctgaaccctgtggatccacagtttccgctgcaagaatttccacgaacgatctgatggcaacaaaaaacgaacgacaattgaagaacacgcaacagaaatgcagcaaaattcagaaaggggatttcacgacagatggaagaaatcattcaacgacgtcacaagcaaagtaaaattctgatggacaacacttagatcgggtggacatttccatttcatggtataattgcttggattcaatttacagtgctcgaagcgatctgcatctgctactagaataagcacatggattcatgtactactgttgacgagattctaagaatgttactcatatactactaaggtttcaggatcgacagtcgcaaaagcaagagaaaacgagagtagtctactggaagaaaatgtagcaaacaaccctcaccacacgctcggcgctcgtactcttcacaaacacgccccatggtcatgcatcgtcagcttcctcgttgtcaccttgcgggctgccgaactccgggccgtcctcgccgtcgtcggatccatcatcgccaccgaactccgggtcgtcctcgccgccgtccggtccatcgtcgaggccgagctcggggatgaagaccaccatggtgttgaggtcggcgaccttgtcgcgaactctctcgacattcgcgacaagctagtcccgatcgcgcgtaccattgatcatgtggtcgacgtggtggcggaggaaattgcctgccgtgaccgcgaccgcgtggaacggcccctccggcccatcgacatggcgagcgatgtgggggagtgaccagccttactgaaggaggaggcggccggcgtcgtggtggagggcgttctcccggagcatcggcaccagaacgtcgacgatgacgacgatctcgttcgccaggcgcgcgagctgacgaagcttgtggtcacggaccagatcccacccgcgcgggagccgactggccttcgtcagcaactccagcaaggcgggcgcctggcggagctctacgtccgtgacgatgaccttgatggggtcgtcgcggctggcgtacagcatcgccgcctcgcgaagccccgagattgtgaagagaggcgccgccatgctctcctcctcctcctcttcctcttccgccgcctctctctcctccggacggataatgatttgtggcggtcacggcgacccatctcgtgtggactttatacagacgaggtgagggaggggatttcttccggaagtttcgatctgacaaagcggagatggcgcgggaatatttggccgaaaatttgaaggcgggcgcgcttgcgaaaaaacgaaaaaggaaaagggaaatgagcgcgctcgagcaacgaaaatcgaaaaatgaaaggaataagtccactctgagtcatttaaaaataggtcgaatctaatccatgacaaaaactataaaaccggatatctcgaccctcgaactatttaaactggtgtaatttaactgtcttgtggttttggaagacagttttgttgatttggcactgacgtggcaaggttgaggggttgatgtggcgcttagttggtatttgaattaaaaacgtatacgtggaacccgtttgtcattcacacataaaaaattcagtaccactgagttcgacacacttcaacaatatgccactgactttgtcgatatccataatatactatcgccttttacttaacctctacgatttaccatcaccgtctatagcctgttagtttgcattggagaaaagacaagtgtgcccttactgaagattggcagcactgagaccatgtcgtgcaaggtaccgagagttataataactgtttatttatgcaatatgattataaataattacgagcacatattttaagtattttaattatgagcaaatatctccaaggctacaggagggggcggagttttgttttgccgaggactgttgaggagcggttgaggattgcactaatcacagatgcagctctccagcagggccagggccaccgtgtccccttgcatgcgatggcagcgctgacgacggcggtggcacccgccaccagcaacagctctccaacaggggcgtcgtgtccctttgtttgcaacggcagcaccagcagcagccctccaataggggcgccgtctcccatcagatgtgaccacggcgttgacgacagtggtcggaccgccgctgtggatggcacgcggttgggccagcgctacggatggtgatgctggtgacgaaggtcgtgccggcgctggggacgaaggtcgtacgtgctggcgctagggatggcggtgctggggacagcgagcgggccgacgctagagatggcaacgctggcgaggacatgtgagcggcggtgggcagagatgcggcgtggcgccatgacggcactgggaagggtggcaatccggcgttgggagatgcgatgctaggaagaaaggggccctgggccatgcgaattagatgattcaaagggtatttcggtcattac

SEQ ID NO: 46071 - DNA, 10590 bp, Oryza sativa
gtaaatcgtaaaggttaaggaaaaggcgatggcatattatggatatcgacaaagtcagtggcatattgttgaagtgtgtcgaactcagtggtactgagcagattctctcaaaaaattatggggcttactaacatgtggcaccacatgtcattctctctctttcttcttcctcccctcttcctcccttccctctttctctccccttttctccctttcgaccggtcgccgccgcacgggctggagcgatgacgggcgggggccagagcggcggcggccggcgggagctgagatcagcaatggaaacgatggcgtgggcggcaccggggagcatggggaaggtgaggacgctgaggaggaaccagttgaggctgagcggcgcgacggcgtcggaggaggaggaggaggccggcctccgcctggagcgcggcggcggactcgcggaggaagaagcgcgcgacgctacacatggacatatccactgtggcgaacatctccgccagcaacggcaagcacaacgcgtccgccgcccacaccaccgcccccactgccgtcgccatgcccaggctgaccatgctccaccgccttgccccgacgcatatgccccgacgtctcgaaatcctcctccttcgtggtcacctccgtcgtgccgccgccaccgccctcctcctcctgagcggcggcagcttcgtctgctttgtctctcagtccttcctcttcctcatgttcgatgggcgcgtggacgccgccgagcgccgtcgccggcggcttcttgtcccacatggacttgcccctgtgctccagcccgtgcggcggtggctggtcgaaggggagagaatgggtgagaaagataggagggtggaagaggggaggaagaagaagagaaagaggatgatatgtggggcacatatgtcagtgggccctataattttttatgtgtgtgaatgacaaacgggtcccacatatacgtttttaatttaaataccaactaaacaccacgtcaatcccacaaagtaggtcaaccctgccacatcagcaaaattgccatctaaaaccatcaagggagtcaaattgcaccgatttcaatagttcgggagtcgagatatccggttttgcggtttaaggtcatggattagattcgggttagtaagtcaaagtggacttattccaaaaaaaaaaaaagaaagaaagaaggtaaagggcgtgctcgagcagaccatgccgggctggccagcccgttgctggtgcggcccaaaaacagcacggcctactgcagtactgctaaccggattgtgtcttgtctcggtcgtctacaaagtgaataagtctacttcacattcttcatctcgtacctgatcgaatcgactggcttaccacaaaaccgtataacacatccttctctttccccgcccattcattctctcaccatctctctcatccggatgggtaatgatcttgagagtgacatgctaaagaagattaattaagaagataccattgaagattttatttcgaaatacactataataatgttttagtgcgatgctttccaggtgaagattagaaaaatattcttcttccgttctattttatgttgctatgagtataaaaatataccatgagtaaaaaatacaattgttttattttatgatttactttctccatccatcctaaaataagttcacctaatatatgatgtgacattccctaaatctacaagtttaaacagataaatttttcagattcataatactataatatgttacattctatactagatacatttatatattaggacgaatggagtaagtttcatacttgtttttttcatatgacctccaaaattcacgggatgtcgcttctcctatctaccactccctccatcctaaaatactctctctgtcccagaatataagaacctagaatcgaatgagacatttcctatactataaacctaagatcggatgtgtatatgtcactttaaaatcttatatattataggacggatggagtaggaactatagcctttttcgtgtgtgcggtactcgtggtttagaaaaccatacggttaccatggttatcacgtgcggtacccttctcatttttaaaactatagtatatctcgtgataatcacacggtttttataataaccaggtaaccttttgggttttggggaaccctggcggtagtgcgtgtgcctcgcacgatggaaatgaaagaaagggagagagatggaaaactacgcatttcatggcttcattagaattacacactcacacaggctttgcaagtcaagtttaactgcaacgtcaacttccgagacccatcggccatcgctcggtagaagcctaatcatttcttcatctctcattttctcacatcagctactcaaagcataaaacagcgtgcgagacccaagcactatccgggtgatatcagtagctggctactactagctgctgtatgcatatgccaccgtcgctgtcagctggttcaattctgaacacatttgttgccgcttttctgcttgactttcaggacttcgattggtgcagaactaaagaagaatctgacttgcatcgcaatatcgcacggtatgacgctacttctgatctctgaaaaagaaaaggaagaggagttcgttttgccaatgtcaaatactccctccatcctataatataagagattttgattttttttttcaacgcttgattactcgtcttattcaaattttttgaaattattatttattttatttgtgacttactttattatacacagtactttaagcacaactttttgtttttatatttgaaagaaaaattaaataagacgagtggtcacatatttaagataaaaactcaaaatcctttgtattatgggactgaggtagtaaaagatatattaagctagtattaacccctttacggctttgctttacctaccggtaaccgactacgtcctggtaggcttcacatccttgtcaccgtctttttgtcctgattagtcccacgcattttgtggaaaaagctggtggtacgatcgactcagatatcagaatgctcatgagaggcttcaacgacgtagtattaaaatcagtgataagctatgtgataaactgataatgtgattaactgcacggactgtgtagcaaatttaacgcagctttttataagatctgacaaattaagagtcattttacggtacctcccacttaaggtggtagtagtgtagtaggaataaatctcaccgttgattttgttggtcattctaataatttgtttaagtgaggtggaagggtaatcttgtaattgtgctcccgtgatagatcaaacgggccaggtttgcagacccaattttatttcatcgtgagttgacgaagcagaagagaacaggagggacagccgccgccaaaatcttgcgctcctagccgccgtccgccttcaatctctcctcgtcgcgcaagcatggtcaccgcggaaccatgcataactgtaatcaatcccaaattcatgctttactgtaattaaacccacaacatgcatgcgtgaatgttagttgtttttaatcaatttagttatcccgattggcaattgcatgtatcaatgtaattaatccagatgcatgtgatctgttgtacgctagtttttcgtttatttgatcacgtcggtcatgccggttaccgagcagattcccctcccgtcagtggccggccgtcacgatctcgcggacgccgtgtccatgaggaggaggtggcccttcagggagaagcgaacgcggccggaggaagacggccgcagcggcgaagccgccctgctgaaaagcttttatccctttattactctgttcgtcggacggatctacggaatagcgatgaactacgaaacccttcaacaactacgtatttacatcagtgccatgttttttttttctaaaatacccttctactacactactactcaatctaataggtgcaatctaataggtgcagtagaaacaaatatgatctgttggatcttatacaataaacggctcgcattcactcagaggtactctaaaaaaatccattaagatgccctggatgcaggaacctctctgcaaattgctggtggagcagacaaatgaattggacgggaaagggaacaggtgagaggatgaaaatgaaagatagagagagagaaggaaaaccacgggattattctggtggtatttcacccggattttttttagatgatggtatttcacccggatagaaagaagatattctcctggtagtggattcgtgcccctcttttctaaatctgctgcaagacagagttcttagtttggcgagcacggttgacaaagttattcagaaattatactattctgcttgtgattcgccaactgggcattcatctatgcagatattgaactgataatctatactatgcacagagataacgtcaaaattatgaaacccaaacgagcattttttccatcccaagctgcaagttcctccatccatcttatattataatacactttattttttcaaacttttaagtttaatcaaatttatagaaaaatttagcaacatccacaataccaaattagtttatattgaacatatttcaatgatatatgcttattttgtgttaaaaactttactacatgtttttataaatttgattaaacctaaaattatttaactagaaaaaaatcaaagcaacttatagtatagtaaaatggagggagtagtataatatggtttaaatcttagtgctcatgcgtagatagacttttaatatgatcttagtgagaatggggatgggccattggtttccatttgttagggtcttagcttagggaacatattaatgggatgtgagtgtgttgctgcagctaatgaatggtaatgcacaagaacatattccgtgtaataaaaaaactaaaagcgaagtgagcgtagtttaatttgttaggtcagctcgcttggtttaaattctgaattagatacacgtgctcgcatttacgactaattcagctcaatggcggagccaagaatttttttaagcccggacaagtctaatgaatggtaatgcacaagaatctttcacatatgtaagattgtgcaaataatatttttcactaaagtatcatcatggttccttgtatcaactaaacgccgtgacattaagtttgagctagagctagatatagataaacacagaggatcctaatccagtacaaatctgattgattaatcaaatatagatcacaataaagtaatgactaatagaaaaacaattcttattagcacttcagtgctcctgctgatcggccaaacgctgtgcttgctactgctcttgctgccaaaaaaaagtgcagattttcatgcagcttcgccagcaaaacagagcaaccgatgtactgatgcagaccgaggagcccgagcagctgcccagcctggccgggccctaaatccgcccctgattcaactgatgtccgtgctgaattcgtaaattttaagatgtaccgaacccgtaattttagatgagctcatagaaataagatatgtgtatgtttttaccggggttagtgcgtgcattgtgagcgccacatttgtcccgtgtttttataaaaaaaaaatacgcaatagcttcacgccaaggttctttggttgtgatcgatcggagcatcagacagccaggtcggcgcgccagctgccgccgcgagagcagcccgcgcgcgacacgagaggccgcgcgcgccgccacaagtcgctcgccaaagctgcgcgtgcagcacagcagccagccaagccaagccagccagcacgcaacgcaacgcaacggcgcgcgcgcgggcgcgcggcgatcccacccagtcacccacagctcacgccgccgcgggcccaccccccggcccgcaaccattttgccgttccgcccctggaacccgcgcgatttagcgcgcgcccctcgcatttcttttcccacccaacccacccacacggccacaccactccaccaccagaagcgcaagcgactcctctctctctcacctccgctcgcctccgcgcctccgagcaccaaaccctagatctcgcggcggcggcggcgaccggggatggcgaagccctggggaggcgtcggcgcgtgggcgctggacgcggagcgcgccgaggaggaggagcgggagcaggcggcggcgttcccggcgcccgagccgcccgcggcgccggtggcgccgccagcttcccgagcctccgcgaggccgccgcggcggcgggcgggggcaagcagaagaagaagaacaagggcaccaccctgtcgctgtccgagttcagcgggtacggcgcgcaggggcagcgtcggggcggcggtggccccgcccccgtggatccgagggggctcacccccgaggagatgatgatgctgcccaccggccccagggagcgctccgccgaggagctcgaccgctcccgagggttccgctcctacggcggagggtttggcgccggcggcggggaccgccgcggcgggttcgacgacgaccgccgcgggcccggtaggtcctcggatctcgacatgccctcccgcgccgacgaggcggacaactgggggacgaataagaggttcacgccggctctcggcgactctggccgccgtgataggttcggcggcccctccccagccggccgctccgatgacatcgatgactggtcgcgcgacaagaagccgatgccatcgcgctacccaagcctcggttctggtggtggtggtggtggcggcttccgtgaatcacctggtttccgcgactcaccaggcccctccgactctgaccgttggtctcgtggtggtagctttgcgccgatgccgcacaacggcgagcgtgagaggccgcggctcaaccttgatccaccgaagcgggatcccttggctactgctacgccaccagctgaggtggcacgcaaccggccaagcccatttggggctgcaaggccccgggaggaggtgctggctgagaaagggttggattggaggaagatggagaccgagattgaacagaaaactagccgccctaccagctcacagtccagccggccgaatagcgcacattcctcccgccctgggagccctggatcacaggtctcagcagttgggagtgaaggggcaccgaggtcacggccaaaggtaaatccgtttggtaatgccaagccacgggaagtggtgctgcaagagaaagggaaagactggaggaagatagaccttgagctggaacatcgtgccgttaataggtatgtatatgaagtcacctcttgattgcacttggcatttctcatgaatctcatgatactgcaaacatgcaatgcaagtgtactgatatagcttagcgaaggtgtatttcttgtggtaatggaaacatgcaatactggaggactgatataggttagtaaaaggagtgcttcttgtgataatgtaaaacatgcgtattgcaatactggagtattggtataggttagtaaaggtgcaggcgtgcagccttgcataaagaattgtgcaagttctgcttagttcttttctaatatataaaaaacctagcaatttacgtagcatgtcctaacaataattgccctgctgtttttgttatgtaatattttggaagaattgcttttgtgataacttcataattgaaatccaaaaaatgagcaactagaagtgaaggtttacctttatagtatacttcagtgaattaagcatttaatgttaatgtcgaaccatttattgttatgaagttatctgcattaatcctttgaacggtgcagtggagtcaacaatcaacatttacagcaattgttcagttaaattcaatcttctcttgtgggtgctgaatgtagtgatgcatatgcagttatatgttgtcacttccattcaaacttgattgttcaccgttacgcttagttttgtgggaagtgaaattaactggggtcgctagcaaaatgtagcatgctattgtgttgataaagacataatttgcttttataagtcatcactcatggatggcaaggacatggatacttggattggttccttctgaaattctgttcttttagccagtgcaggtttgttttctattaattcaatatatctgtacctcatttttcaggccagagacgaatgaagaaaggatcttgaaagaagaaataaacctcctcaaggagaaactgaaagaaagtgaggccaataaaactgatggtccggaccaagcttcccctgaggatccagaggatttgtcggagaagataactcagatggaaaagcagcttgagttgcttactattgagttggatgacaaggttcgatttgggcaaagacctggttctggagctggcagggtttcagcagttccaccagctattgcagaggaaccacagattgtggtatccatcgtggataggccacgctctcgtggtggtatggagccatttccgaaaccagctgaggaaagatggggattccaaggtagcagagagaggggctcttttggtggaagcagaagttcagacaggttcgtgcaattcttgctcaatttctttccaggttaatgtttcctattgacagttgcatgtaatttgctggttagctgaaatgcctccttaatccttctatatagtttaattctttttgtaaatgtatgatgcatcacactttcatattgacgttaatttttcatgcctgccttgttgtgtttgtcatgtttagttgaatacggaaccttttatatagttattcttcttgtatggtgatataccatgttttgattataagccaagtagcacttcaactttggacaggtttgagattgaacgtatagtatactgttcgattgaagatgagagttggaatgggatatttgtctaggtaggacactagagattcatagagaggatacaaagctcagaattggggtttcttttttatttgaagataattgtctgcaactttgtataaccttttctttgtattttttttcctctgctttgtatttatctgtaattattctctatttatattatttaataaagtacatgaggagcctctcctgctgtttcttgtaaaaaaaaaaagaaaaggaaccatgatcaccaacagcttaaactttgtgaaccagtggtgaagtgttcttgtatgatggttgcttttttaatgggtagaaataggagcgtagaacctttatatctatcttgttcatcttatttgctttagttcttgatgtgatacaatctggtctatttaaaaatatgatggaagtcaaatcagtttctaaccaattgatgttgatattatcggttcatgtgcagctcttaatcggttttgttttgtttctgttcaggccaatgacaaggcagaggtggtgagatacggcgtttgagcatttgttaaggaaactctgggtcctcgttttttgtttcgaaagaatggggaagaataagtcattttcttctgtgttttgactcccattttgtctgatctagaaagattggagagaagcttgtcaatggaggttactctgcgtgaagctatttattatcgcctcttaagttgtagggtattttggttccctttttgtcatctcccatgccaaaacaagacctggcaaactttgatactaactattgttcctgatcggttcatgtcgcatgtggtctcttaagcattcatggatggagaccttttgtatggatattttgatattttgtacagttgcatgtgttagccatctgttctgttatttgttgctcctactattttgccaatgcttcttaacttctctttactgtgcccgttgtactggtgccttgcaatgacatgcctgaagttctctctcacaccagttccattgcaatagaatgtaggataatccctgcgcgcttgttacttatactctttttttttttacggagggacggtaggtgtttagtacctggaaatatgcaagtgattctcttcgctgttagttgcgtcttgccagcttgtggattactgctgtctttggtcttggtgatttctgccgtactgccgttgcgcgctctgttactggcttagttggtcatatggtttctgttttttatgtcaatcgctacttccaaatcagctgcagcctcacctgtgctattggagaagcaattcgccggagcggggggagtgagggacccagcgctgtggtgaatcaggatcatttacattagaggttctaatgttctcccttcggctaaaaaaaactcaatcttcaggtttaaatctagacacacaccgattgagtgtttttttacgaagggagtagagaataaatagcagagtgtattaggtgagttgtatccacccaatcaagtatgtaaggctcagatgttgcgctacaatattttagaaacatttttattgtgtgttttgcttgtatcacgtgacctgaacaccgaactggaatggtgattactaggagacaaccggccttgttgtggctaccacttcgatctccagttccattttcagcggctagcgttacacgaaactcgtgcagaaagcgtctagccgccagggcacctaaat

SEQ ID NO: 46072 - DNA, 3334 bp, Oryza sativa
gtacagactattaacacaagcaaaccacaatcacttgttcttcttcttgttctcgaggacgaggaagacggcgagcgcggcgacggagaacgcggagagcacgccggcggcgacctcgatggacgcggtgacgccggtgatgcccgcgacggcgaagctggccgagggcgccgtctcgccataggccacccgcgcccccgacgcgtcgagcgcgtaggcgcgcacgtagtacgacgccgtcgggacgtcgcgtgccaccgtgtactcgaacttgccggcgccgtcgtacggctgctgggcgatcttgaactgacacgccttgtccttgctcaggtcgtcgtgggccttgcgccacccgcggcccacctggctcgccggcgcgtagcacagggtcaccttcaccgccttgtagccggcatccgccccggccgccgccgccgccgccgtcgcgttcagcgaccatgtcacggtgatggcgtcctcgccggcgtgcaggactggtcatcaatttgacagcgtgacaacgttacattgacatgcaacatgttgccaacttggagtcactattccacttgagattgtaagaactagacgaattagaaatttgtgagccaaaacgcttttgcaaagtcaataatatcaggctctagagccaaccaagtgaagaaaaccacggatttattcaagtatttgtcctgaactatatttcgcgtgcagattatgctaggatcgtccccattgaaagatcaaatcaaggtgcaaagtcacaatcctcttgatcagttttcaccaaatcaaagtacaccaaacacaaaacagcacagcaagggagaataatatatatcgatatggatgcacgcaccttggccggcacggggcgacgcctcgacgacgagcgccttcgcgagcgcggagaggcgcgcccccgccgccgccgtcgccggcgtgacatggcaagcaccgagaactacaaggagcagcaacagcggtagaaacacgcggtgaattaccgccccaaaccgagccatgatcgttctctgctagaggtggaggccatttgagcggagcggtagcttatatataggcgtggtagcgtcgagtaagttgactcgtggagagggagggagatcgggggagttcaactttgtggggtcgaggagggtagcgatgggtggttcccaaagtcggagcttgatggttcacgcgggtctgactgtcggagcacgtacgtttggctgtctcgtcggctcgatggggcacctcggtcgaccttttgagggccatggcgatgtgaagcggcgaatgcaggctaatgcagctgtgtggtatctgtagtacactgcacagtagtagtagtagactagtagcagtaccacgttaacggtagtagtcagacagtctgttggtggtggtcagaacacggtacactgtttgccggagaaaaatcacgagccctccaatccaagaaataccattaacgaacacagcttcctaaaaatattattgtacaagcgcttttattctaaaaatatcatcgtcgttagattttcgtttgtagccattcgttgagtgctataaaaaaccattttacccctacaaattattaaatgattaaaacttttactctttcagtcaattttcaatattttagtgtaaagagcaaactaattgagtgtaaactaacgaaaagagcaaaatttttaatcaacctttaataatttatagggtaaaatgatctttttatagcacttaacagatggatgcaaccgaaaacttaacaacgatggtaactctagaacaaaagcacttgtacgatgacatttctaaagagattagatttatcgatgatattttttgaattggggagagtctacacatctgtcgacagatttttcatcataaatttgtcaaaatttgtacctttggattaaacccataaacgatagatggatgacacgtgtacagcactgctgaggtcccgcatctactaatcgatagtatggatgggcttccgacgttaattcacactctcgtttcttaatcaaaattagttggttatttatccatattaattattaatccttgagagctcatctgctcatgtatagtgtgatatctactagatattttttagtgcatacaaagatattaccaatccatctactaaagttacattgttgttacactataattacaccatagttacatatgtaattatggtatagttacactgtaattttaattacattgttgttacactataattacaccatagttacatatgtaattatggtataattgctctgtaattttaattacattgttgttacattataattacaccatagttacatatgtaattatagtataattgcactgtaattttaattatattattgttacactataattgcaccatatttacatacatgtaactatagtataattacattgtaattttagttttctaacactgtaacttcaatataaactttattttgtcttgaaccaacttggcttaattgctctgtggtgtacgtttaacagggaaaactagtgctcttggaatcgatcccccgctacgcacagacttgtctcttttatccatcgtattagttagcacaaatctccacgcaaatcatatggcccaaaaatcgacaaatctttaaacgaaaatctgtcgacagatggatagcgaattcgtttgaattgggatatttatcgatgacattttatgaattttctctttttactatggcagttcgcctgttggcaatgcaattttgcccaagtagcccataaaacctccggaccaacacaagcacaagcaacaacagaagaaaaagcccaaaaacaggtaaggcccaaaccgcgagacaggaagccgcaccaaaaacccacacggccccccacgagagatccatcatccaccgtaatcctcctcgacgtcctcacacgcctcacctcacctcacctcaccgccgtctccttcctcgtctcgtctcgtggcgtcgcccaaaaatcccgagtccaaagccacgcacgcagctcaaaaccccaccgccaccacaccctctgatccgacggcccagatcgctccccccctaattcccgccttgccccctcctccccatgtcgccgccggtggccggcgccgcctcctccggcgacgggccgccggggcgcccgccgcgcgagctctacaccatccctgcctcctcgggtagcctccgcccccccaccccgaatcgaggtttcctcctcctcctcttgctccccctcgctctcctagggttaggagaggggaggattgggaggaggaggaggaggaggt

SEQ ID NO: 46073 - DNA, 2561 bp, Oryza sativa
ggattgggaggaggaggaggaggaggttccggcacgagaaataattccgtgtgtgcgtgtgtgtgtgcgcgctctcgcaggttggttccagtgggatgagatccacgagacggagcggcgggcgctgccggagttcttcggcggcgccggggggagcgggttcgggacggcgtcgcggaacccgcggatctacagggagtaccgcgactacatcatcagcaggtaccgcgaggacacctcccgccgcctcaccttcaccgaggtccgcaaggcgctcgtcggcgacgtcacgctcctccggaagctcttcgccttcctcgactcctcgggcctcatcaacttctccgcctccccctcccgccccgaggcgcagcagcagcagcggcagacggaggcggaggccgtcgtggaggcgcccgtggggctgcaggtgacgccacggccgccgccgtcgtacttcgcggaggagaagggaggagggggcaacgagaacggattccgtttgccgccgctgacctcgtatagtgatgtatttggagagtgggcgcctgggatggcgcctatatgtgggctctgtggcatggagtgcagagacgggaatgcccaaatattgaaggtactatcgagttataaagttcctttttgcattagctgggataaatgtgggatatcaaggaggaatgcggtatcaattattaagaaaatggaggtgatgagtggctacgtcatcgaacgcaggctggcgcaaagctcttggcagctatctggcaactgagctgtgcgccattctctctccgtttgcattaggttgtcttctttagcaaattttgggttagtaatcatgtcttgctagatttaggatgctaatggttacagcgctactgtgtggcaatcaaatgattggtttgaactttgtatcatgcatgcaaaaaatgtccaaaggtttaaattctaggctttaggaatgcaagtatttaacattttacaacctacagttttgaataaattacttgtcgtcttgtggagaaatagattcgtgaatatgttatgaaataacagttcttacaaaatattaaaggatatttggctctgaaataggtaaagcgtttagattatagattggatcgccatgtatgtgtctagcatgatgtccttctgcactaatgggtttcatggaatacatactccgaaatgcccattattattattttttattatagtatttcttgcagcatcattactctatttatggcgttctgtgagatgtatctattattgttttattataggatttcttgcgcatcgctactttatttatggcatcctgtttatgttgtcgtactccttgacatgatttttgttgcttatgcttcatagcacaccaagcttcgacgggaataatctgagaaaagtacatgttatatgtttgttaacatttggtatgcttgcttttcaggatggttttaaagtatgctcaaaatgttatgccaataatgataataagggtgaagcaaatatacatccaggtgacaaaaaggagcggatcgacaatcattcttctagtgcatggacagatgcagaaactctccttctcttggaaggtgtactaaaacatggagatgactgggatctcatcgcccagcatgtccgcacaaagaataaatcagaatgcattgcaaggctaattcagttgccttttggtgaacatatgctgggcacagtaaatggtaaattggataacagactccataaaatccaaacaaccgatggaaaagtgaacaagtccactgtgaaggagtcttcaagtcaaccaactgaaacagttgatgacatgcagattgatggaaatgaagatggcgctgataaatctgttgaagaacatcctacaaaacatagacggttgttttcttcaatagatatcactgtctcattaatggagcaggtaataaataaataacaaacagataacaaaaaactcgtgtgtgaggacacatagattttaaatggaacgaactgatgattgctattggtacctcagttagcgcatcttaccacatcgacaagcccagatgttgttgctgcagctgctgatgccgcaattaaagcactgggtaatgaaaacccccaagcaaggagagcttttcaactcagtgagaaagagtaccaaaccagggcattctcttctaaccatgcccggcagaggtaaagatatggtatatattgttcttatttgccagtatcagtgcagtttgtttgtattaactgttagggattattgcagtgatgatgttggtggtggtgatcgggatgtagaaatgcacgggcacccaggtaggccaaatatttggatcatcggatggctaactattacagaattctttctatatctgtaggtgcagttgatccaaccggatctgttattatgttgtctagacttgatctgaatcaccacgaccaactattaagaattacaatcagcgtgaaatttgtcatctcttgttattaacgatgagtagatgacaaatctgaacataaattattactaccagttcggaatctgg

SEQ ID NO: 46074 - DNA, 3098 bp, Oryza sativa
  unsure (1)..(3098): unsure at all n locations
gctagaaagtcttataatatgaaacggaggaagtatttgtgtttatactgtgatcgtctaaaaggtatatcctttcttcatgtaatcatgtttcagataaaaagcaggggaagatgtttatttctaccacatatcaagtaagggcagctgttgctacgtccataggtgtagctgctgcccgtgctaaaatgcttgcagaccaggaagaacgggaaatggagctcctaatggcgtccataatagaaactcaggttaaatctcttgacctattcttatttacatctgcgggtatagtttaagttcgtagttctaacactgtttattcatctgaaagttacatatctgacacatcatgtacattcctgcaaaccatttcagttcatgacttcactacctgaacactaccataattcaatctcctagctgtttttatgttctaaaaaacatgatattgtttagagagggatgatatcgcaaacatcgtgcttaaacggttggggaataaatatgcagcatgttcttctacatcaaatggcagagcggagggacataactctttttttagttctgttgtgcgagccatttcctttctatctgtgtgacatattgtaatgtggctaaagggaagaggtccgtctagttaagtctgttcacctagatatcatttttaacttcgttctggatcctgcaaaacctgatgaatcatgattcaagttatgggtttgatttctgctgctagctgaactcctaccatggtggcacagcacatgccccttcctttcacagggctcaaagaaatgaaattcttattgctacaaattcacaaccttattcttacactattactgctgtcttgatgattgtctgactgttttgtttcgaaacgaaataaactctgacagaccttatctatactttctgaatgtatttccttaatgaccgactgctgtctactttatgttgaccagctaaaaaagatccaatacaagatcaaacactttgaggagctagagttgatcatggatcaggaatacgctactctacagcaaatgaagtcttcccttgtcgatgaatggcaaaaggtcctcaagcgagcatttgagactggagtaccaatatcgagggatgaagtgcttataaagttgttccaaaacaagccaaatctgtagagaaattgaccaaagtcggttagatctccatgagggagcattggaggttgggatatctgtactgagggatgtgctgttcgagtaacatccctattccttagagaagttgactggagtcgattatccctcctctgatctgcctctccatagagcagtcatctagcagtttaacattgtggtgtcagagcgtggctgtaaatgtgctgattgagctttgggttgatctcaaaattttgcgtttgagatcacatcgatcctctgtagtttgtatcatcctatgcgattgcacgtgattgctccgttatactatccaactaggttagacaagtagtgttgctaatagcttcctgtacctgtctacatttcgttgatttcatttgttgggatgtgcaaatcttcctccagctgggagtttctgtatgttctatcacattgtctgattggttactttgataaattgatagccattgtatctagagtaaatttcatgtaacctaaggtgttgagtttgtcacacaaaatcatgtgttttaacatctgatatattactctcggttgtacccagactttaacaaaaccacactatgaaacaattattctttgacccacaataattatgagttctaaaatcgaatcttaattttttgacattattgatctattctataaaaagttttatccaagttaacctttttcttaaaaaaatctctacctatataaccataataagcggggtactgggttgtggttttagttttattttgaaagttcataacacccatacccaggttttataaaatttactccatgacagttctgcacctctaaactgtgaaagtttaataaaggagaattctttctttatctgcgcagcaaagccagcaattcggtgtttggagaattggagccatcctgaaccgtttagggtttgatcggacggctggtatggaatctcacagaagggcaccaccatttttccccaacgcggagcggcggaggcggcagccaaaaacccctccctcctcccctcctggactctcggtttcccctaacctcgcgcgccacctctcctctcctcgtcctccgcctccggacgcgcagttcacgggcgccctaatggcgaaaaagggcaaggcggcggcggcggaggccgcggcgcccgacgcgggggtatcgagcccgcagggcggcggcggggagaaggagggcagcttcctgctgggctcgccgacctgggaggacgccgggggcgggcggtggcggtgcaaggagacggggcacgagctgccggagcgggagaaggaggcgtacgggcggtcccgcgcgtgcaggctcgcgctcatcgaccaagccgtcgcgcgcaagaagccgccgctcaacgccttcaagcctcaccccgagcacaagtgcgtactagtaccggaatccgcccccatcttgtgccgcgctacccatctattattgcctttgctctcgcgttacgcaccaaggcgtatcccacgtatcgtgctcggaatttgtttatgcttaatcttggtttaattggttattttgctgtttaatacgagggttctaaattctagtgtccaacgtttgatcgtattttgtgaaataaagttggaaaaaaatctatgttctttttaggatgcagtcgagatgttgaatcgagtatgttatgttgtaggtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46075 - DNA, 8090 bp, Oryza sativa
cgtgacgcttagtggctagtttgtctctgtcttcatctgacgtgacgcttacgtggcaattcgaaccggaaaagtaataaaactcgtgggacccacggatcagtttcacacataaactaataaaaaatagtgagccccacatgtcatcctcactcccttcttccctctatcccctctctctcttcttccctacaatgtggactggggcggcgggcggacgagcgcaaccgcggccgaagcagcagcgcacgaagccgacggggcggtggcaatcctccgccgacgccgatatccacagcagaggtgcgcgtcctcctcctccttaaacccgtcaccatcggtggccgtcccccctgggcctccgcccgcggctcctctccttccgtcggccggcaagcaagatacacaaacaattagcagaaaggccgaccctatcggcatcggcaagcattccccgatccaagctagcttctaccaaacatcgactcagtggatctcaaggatgtgtccgaccagccagattttacttaggcctccatccaaacagtctctaaaaccaccttctacctatggcctgtttggcacagctccagctccacccctcctggagctagagctcagcccaacagttttagctccaccaaaactgagagtggagctaggtggagctctctcacaaaatgaactagagttgttgagctgggtttaggcagctccacaactttactccagacccaacttctagagctaaatttaggagttggagctaaattgagggcttgttaaatttgtttggtttaaataattaaaaatgtcaaatgtctggtcgtgtaattcggatcaggagcgaatccagaaaatgaatggtaggagggcttgtctcattcctcctctaagggcatctccaacagcttccccaaatcgaactctccaaacactcatatagccaactctccatctgatttagctagtcaaattagatactcactccaacagactctctattaatcctctccaaaataaaaatagaccctcagcctctaccatcttctttctctctctccccccaccttccttctctttccttctttttccccttttccttccttcccgtcgaccacgttgatgccgacggtggctgacacatgacgcgcggtggtgcagcaacgcggggaggcggaaggcggtgcggggaggcggcgctcgctgaggtgctctccctctccctttgcggcgacgaggcgacggcggcggagctcggagcgggatggcgatggcggcggcggagctcggggtggggatggcaaaggcggcggctctccacaacgacgacttggcgaggcgacgacgacggcgaggaagatgcagccacgacagcacatgggcagggatggcactggaggcacatggcggccacggcgacggagtcgagggagaggcgcgggaagccgcaaggggtggccctctgctcctcgccggccttgcctggtcctccgccgccttgtcgccgtggctccgctggttccgggaggcaggggcgagagagaggagggagggagtgaggtggagcgcggggactcggttccaggcgatggtggaagggggacggcaggggaggcagggcaaaagaggcgctcgcgcctccggtccatttcggcggagggcggcgatggaagcagccgaggcagcgttgaagagtttggggacagagagaatgcgagatgtgggaagaaaaatatggttgtgggtcccacaatcccacagttggagagccagttttggctggccaagtttagccacctagggagcccctttggccaaccaaatagcttcgagagtaggatagccagtatgttggagctcgttttttttttcaaaatttctaaattttagtttggggagtgaaatagctatgctgttagagatgctctaagcccctactctttttctccctcttcttcctcctcccatatctccctttctcttaatggtcattcagcggggtagggggcttgagctcctagcacctacgctggatccacctctattcagaccgttacaatctctacggcaatagttaaggggcataatttagactttttctatatttttatcctagttctaggttagaacttagaaccaagcaagccctaaccatgcacgttattattcacgggtaaatcgtaatcgtactctcagctaccaaaacagttaacgtgcagggcaatacaggttcaagaatcaagagagagaagactaggaaatatccgcacaaattttttaacgcgagcgatgcggagttaggccaagtaatccacgatctccacgaaacagattgagcataaatatgggttattatttgcgaccgcgttcgttgaaaccctacaacgatcttaattaggagtggtacgtaggagtagcgcgctaacctcttctcatcccatgcagcacgccgacgacgacatgccaacccaccggcggtgggccgacctccacgccggcctcgtctcgcgcgtcgccgacctctgcgcgctccggggctacgcctcctgccgcgccgtctgcgcctcgtggcgcgcggcgctcccgccgccgacctcgcggccgctcgcccccgtcgccgacacggcgagccgccacgggccactgtcgctggccgtctgctccgtccacgcgcagcgctggtcccgcctcctcggcctccgccagccgtcggggctagccaacgccaccggcgccagccgctgcgtcggcgcgcgcgacgggtgggtcgtcctcgccgccgccaacgcgaagggcgccgccgccgccgccgcgagagtcgtcttgctgttcaacccggtcaccggagtggagatcccgctgcacgcgtcgctgtacgatcccaactgcgagcgcgcgccggcggcgtcgacgtcgccggcgccgaaggtcgtgttctcgccgtgccccacagcgcgtgacctcgccgcggtgagcatctgccggccgaacaggctcgccgtccagaggacaaccgacgggcactcctccgccctcgtcctggacaccgccgcgctcatggacagcgacgacctcgccgacgtcgctttcgacggcaacggcagggtggcgtactgcctgacgaggcacggcgccgtgcacgtgatccgcttcaaccgccgccgccaccgcggcagggtgcgcccatcgagatcgagccactcgtggccggcgccgtcttccccttgccgtacgacaccatcgcccggttcacggacgccaagaacctggtgctctgcggcggcgcgctgtaccaggtgtggaggcggccgagcggcgcgggctccgccgtcgcgccggccgggatctgcgaccagcagctgctcctcatcccggagggcgccgtcttcgtcctgaggtacgagccgccggcgtcggcggcggcgggggggagccgccggccgccgtgctggtcggagtcgaaggatctcggcggccacgcggtgttcctcggggcgaacgacgccgcggcggcggcgcgctgcggcgacggcgcggcggagctgatgagaggcgactgcttgtactactgggccagccgcgcagagggggactacgaggccttcgtgtacagcatggcggacaggatgtccacgcggttgccgccggcgaccggtggcgtgtcgagcccgctttggtacttcttgccggccggcgcggcgaacgtgcaagcaacgacgacgaccgctatggaagctgcatcagaggaagtgagcgtcgcagttattacagtataatttcatggttcatatcacaccggtctctctatataggagtatgtgctagtactagctactatcttagcttagtagcttgttaggatgggtggtttgatcattaattagccaagagttctttgttttttttggtgcgaactatgctagtatatatactatttatattaagcttcatgttgtcattttgggttcgatttactgtatgcttgctcaaaagtatgcgtgagcacgggaagagtttatcccgtacgtcctcgagggaactttctcgtgtttttctatgtcgcccaaaaaatcgtcaaaaaaaattaaaatgatttagtaagatagattagtatagtgtgtatggcttcataaacattcaagtcatatttaacatatacaagtagacaaaaatatgacaaatttgaccctaaatataacacataattcatggttaaatttattattttgcttgatcaaccttatcattttttttcaaattcttttgatattcttttagatagcatgcataaaatagggagcgtcctctcgagggacaaaaatcaatctccacacgagcatattaattgtcatgttgttagtttcgaggtcgattaatatattcttttcttatataaaaaggcatactattagttcacatgggatacccttacaagcatcgcatagatggcgtgatgctgagcgtagtgctacaaccaaaggcatatcactttcgatggtaatactgaaagcaacttaggtgttccaaaaaagggaacgggaacatcgtcttctcgctattgttctttgtgttcctaaaagggaacataaagcaatgcctctctttacgggcttaaggtaatgaggagtgtgcgaaggtagacaccaaaggcagttaagagtgctaaagtgtttaggagtgttgttagtggcacacaattctcgatatatagaatcaattattctctatccacctttgaaactaataaaaattcactgaccattattggtgggaatatctttacaattttgatgactatgatttgaactttacttgtagatccagtgagttgggcttctctagttgaggcatggattagggcatgttggttgcagccctggtggttttgtctgacctgatatgcaagcctgaggtccgcctatagcttgtttggttgacctcctggtgcactcgctcagttgtctaacttgacaaccggtccatgttgattagcctggctcaggccaccaaattgcaacgcctcactcatgcaactaaggaggcaagggagataaaggtgatttggtagctatgggtccaattataattgctttcttactgatctcctcgagcatatgtcttgaaccaaacaatctcaggcaacaagtcagggatctatcttcaatttctcctgctagcttcaggcgttggttttcgttaggcatttctcttaggtcagcaaccaaacatgccattagttttgaacccgtgatacctctttttttttaaaaaaaaaaaaactctggttttggtcttcactagttgaagtcggtcatggcatcaacctaatcaatattttcttcttgaaggcatcacacatgagaattggtaggtaaaaaacttgatctaactctattgattggatcgggcagtgacgatgcaaattatatacttttaaaatgcatttcatgaaaccgagacttcaaatacctctttgttgcgatcttactttccgcttacacttggtgttgagattatagacatataatgatttaatctattccataaataaatcatgacattacagatgaaaactagcatgaacacatcattagatctatacatgtaaactacacagtataacatgaacagatcaaatatgcacaacatattgaacacgtaccgaggtgacggaaagaccggttgcttggtcgaaacttttcgccggtgtctacgaagacacgaaacacgcaagcgaagaggaaggcgagccgtcgcgaacaaacagggagcagtcgcgcgaagcgctttccaaataccttattgccgccttctcccggtgcaggacgtctaaggcagaggttccggagacctgctctcccgatcgccggtgcacgccggcgagcgggatggagtagtctacgagcgacggcgcagtacagagtaggaggcaaaccctagattgatttcgcttatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgagcgagcgcgcgcgtatgtttcccctcttctctccaccacacatgcttcaagtggctaggagggcatcctcccttttaaggaggtccccctctcctagaataagtaaggtggtactaaactccacatgcatgccatcccatgaggtgggcttttgtgattttccaaagaattaatctttgagtgggctaaggcccattcattaattccaacacttggtttcctattggttgcgatggctgatgacaaggctatatattttctttcttttcaagaccggccataactttcggtgttagtgtttatagttagtaatggtgtaacctgtaatgcatgtgtatttgtacttgatgaaccctttttttattttttttatgatgttggttagttttttttagataatagaatataatatcccggtctttacttaaaaagagttacagtcaattattataaagtagcactctagaaaagagtgtagttcaaataaaatagaacgcacaaaacacacaaaagagtgaatcaaaccaaaataagaagaacacatttattctagcctatttgtgaatcaccatctatagttggtaaaaggttgcataacagtcgtctccatcttgcgacatgcaacttttagaaactcccaatcattatcacacctttgtaactgtgcccacaaccggagccagtgtgttgccctgaaaattacctgcatataggtgatagatgttgatttgtcaaaaaccatatcatttctactcaaccatagagcccaacaaattgcagaagctccaacaagtatcagttttttcttttccttgtcaacacccaaaagccaccctaaaaaatataagatatacttgtaggaagattaaaaccaaaagaaaactgaactgctctccatatgaactttgcataatgacaataaaaaaagagatgttgagtagagatatacttgtaggaagattaaaaccaaaaaaaaaaccgaactgctcttcatatgaactttgcataatgacaatccaaaaagagatgctgaatagactcatttttcataaaaaaaacaacacctcaagctgccattccgattccgtctcaccaaattatctttagttaacacaactcctttaagtaactatcacacaaagattttaatcaatggtaaatattttgaatgggagggatcggagtagatgacgagtttataactcccttatatagaaaacaagtttctttgaggtcaatttctgtaacttgcaaaagtatttgatatgcgtacgtgtttcttgtttttatgtacataaccttgctctgacgagttagcttcagctcagtctgcttagataagcatatcgttgctaccacagctgcaattgcagccacaaacagctggaataatattttaagatgcgttgctaaaataacctcttatatatatgcttatcttgcttctaaccaagaaaataagttatgaagaacaaataccaagtcggtttgacttacattagccaaattgtaagaaagtttaacccaaatcaaacaagcaacttttctattagtattttgcaaataaatgtcactcttacatgacaggaaaaaaaaaactatcttataaccgacgttgtcaatatgactttgattttttttcaccttaattaaaagttactactcacttatagactaaatactcctgaagcatttcttattactccttaagggcctgttcacttttggcatgttcactttgataccatttttaagcttaccaaattttggtaaagttgctaaaaaagtggctacatttagtttgctgctaaattttgataactatataagaaatc

SEQ ID NO: 46076 - DNA, 29517 bp, Oryza sativa
agcagcagcagcaagagcccgcccccggcgccggcgctggcgcggacttctccgcgctcccgccggagctcgtgcacagggcgctggcggccgcgggggcgtcggacgtcgcggcggcaagccgggcgtgccgcgcgtggcgggacgcgctgcggccgctccgggaggccgcggcgctgcacgcgcgggggcgacgcgtcaagcacgcggcaggcgcggccgcggccgcgggcgccgaggggcggaaggcggagaggcagcgcgcgctggggctgttccagcgcgcggcgaggctggggtccgcggcggcgatggtggacgccgggctgatgtgctgggaggaagggcggcgtgacgaggcggtggggtgctaccagaaggcggcggagctagggcaccccgtcgggatgtgcaatctcggcgtctcctacctagaaggtacccccggattttggcctacgggatcaatagctttcttggatactcgatcgagactgtagccgaaagctttgacgaatcttaggacgaattgggtttgctcacagcatgattagaaccattcgtgtttagggcaaagttttgaccttgctctgtcgctggcgtttgtctttttgtgattcttttagtaacctttaactcaagtctgattctaaactagcaggggagaaacctactgggttgttgttgttgctgcaatcatattcttcatctcaacgaattgcaactgattgttgctgccaaatcattttttagctgatccacccaaggctgaggaagctgttagatggttttatccagctgcggctgctggcaatgctcgtgctcaatacaacctgggcctttgcttgcagaatgggaaaggaatcaagcgtaaccagcgggaagctgtaagatgcctcctcttgttacatttacatctgcatatcgcaaattttccccgaaacagaaatacgcagttactatagatgtatccaattgttgaaccagcatcatttattctttgttgtggtatcttgtttctactcctacaagctatggactgtatgaactaaattatagtcaggcaatttagagctgtacgatttagggataatttaccaatttatcagctccgttgtggttttttagcgagttttattttgatctcacattccattgtttacaatgtgatctatcaaaactgagataaccagagtttttgacagaaaggagctttttgatctggttgggtttccctaccgatgtactcataattgcaccatcatgatcagtctgaatttgctaaattggcggtctcaagattaccaccactgtagcgcacaaagttgactgtgtgctttattgccttgaatctgcttgtttaaaataaggaactttgcaaatgcaggcaaaatggtacctgcgagctgcagagggaggaaatgtgcgagccatgtacaacatttccttgtgctacaactatggtgaaggattttcacaggatcaagtgcgttcaaagaggtggctgcaattagctgctgattgcggtcacaagaaagctctttatgaatgtggtattaaactttgtgcggtatgtcattccatttcacctaatgaatgaatcatctaactgtgtggaaacaacgtattaattatatattccttttctgttagccaccatgcagttcttccaattgcacattttagtgcataagtttaggccatgtaataaggtaagatatgtaaatacttgtcataacggtttggttaagggcgtttcaagaaacagaatacggtgtgtgtgctattttaaattttaaaaagccaatatctttaataacagaattagtttgaaattgccaaaaacttgtatgtttgtactgaagtagtatcagctgtataacttatgtcatcgtcgttcgtactattcctactgcttcatcaatgttggcgtgttatgcatttacttatgccttttttttatgatgattcttctcttatttaggcaggagacaaggtgaggtctcttatgtatctagagttggcgacgcgccgtggagaagctgctgcctcacatatgagggatgtaatacttgaatcactttcccttgtgaatgcgcaacgtgccctgtcagatgcggataaatggagaccaagagcactgtataccagaagatgagcaaatgggcccatcacacgtataccaagttaataaccccttgatgccaaaagtaaaatggaaattcaccacctgaaggcccaagtgagcaatatgcatctgtggcatactctagtgtatgtggaactgtgtatatgttaactttcaagcccctctctccttttcttttgtacagaaattatgacagcagaaatactgttacagaaggtcaagtggcaataatatccctgatgcagcataggatagaactttatagttgaattgtttcagattgtaataaataggaacaactggtgtttttttttcgctgaaaaagtgtggatgtaggtccaatgcagtgaaaagtaattctgtgatcagctgttctaaattgatggttggtggaatttgcctttgtgaaatttgaagggttaagggaatctctgtgcgactgtggcccatacattgttgacggcaatgtactagtgaacaaattctaggtgattttatcgtgctatatagtcatctccagatggatgttggttatgatcgcatcaaattcatcctttggtttctattttgaacatcagtcttccctacggtgcatcagttccaatttagctcaaccgttttatgcacatggctgcttttgatctgcagatgttattgatgtcacaataattgtactactaaacggtaccgtatgtctagttgagtctgcagttcccatcgcaatcgctgtatacatcagcaaccccacagaatctgcaaactgcatctagtttcttcacagagaaaatgataagcacatgacaaggctgtctaacacgcgcttttattaatacaggcattaacgtcagccatcccaaatttcaccagacgtggctcaagttcacaaatcaaatggcgcaacaggacacatttcacaaatcaaacagcgcagcaggaaagtcataacagtacagaacacaggaataacaccatgggagtagcttttatttggggcaatatagtgacgagaagcatacgtagcagtgacatgccacagttgcatttcttcgaaacgaagagcagcggaaagctcttcagagcttcgagatgaggccgttctggatggctttgggcgactcggcttccttgatgtcagcgtcggaggagccgggaggcacgtcgaccgccggcgagcagttgaagaacccatgtggctgaaaagaattaaacaagacacaaacaggctttgagctgatactgtaaaaaccagaacggtggaaactagagaagtcgtctgccaaagaggagatatgaaaggctacaagagaaggtctttgttctaaaaaaaaaaaaaggtctttaccatgagcatgaagccgatgcgttccactggcatgacaggccagtcctccagccttgggatatgggtgagcccaaacacatacctgcagatgcagtgtatagttaacaacaatattcccagtcgtgaaccgaagaaagttacacagatgcatcgtagtagcaagtataccagagaacaatgtcagtttcctccaggggcctatccttcttgacccaggtagctaagccctcgtggatacgtggattctgattggggaactcccctccagggaacacctcgtcgctcttgtactgcgtgacccagagattgtgcttcaggaaacccgctctcctcagaaactttgcctcgggtagagccagcggcaaacagtttgaaccaggcacgagcctgtagccggttggctgcccagtacgattaacagcccttgtgttccttacctgatcagatgtcaacaatgttaggtaggaaagaaagatcggtatgtatgatcagctgccacaacacaaaataatgttctttactctgagagttagagttgtggcctaagctatctgttattaggtcaagagtaatgcagctaataagtgcaaaataatagcactgctataaagcagcaagtcaatgcgtcatttctgaagaaagaaaacaatgaccaggtactggaaacgttatcatggtacatcaacaccggcacaatataaaagggatgatactgaaagatgatgctcttacgatccaatgccgtgcagatgaagggtcacaatctcgcattgcttgcagctcagatttcagtagtttttcctcggcatagaaagcgttgttgtgcacattatgtgtgcctgcattttcaactttcacatttacctcaaccacctgtgatagaaagcaacatatcagactatcaatacatgccaagttcaagcaaaaggccctactactactagaactaaacttcacccactgtagacaagttacttgtacaaacagcaggtctaaatcaaagtaacattatgataggccttattgtggaactaggtggaaaacttctattcagtatatccagcaaaactttaattgaaatgcataaaaagcaacccacctgattatgagcctcgttaggtttacaatcaacagccatgtccatacgggcaacaaaaaagtgttggtgaacaggtgcatacagaccaggagcaatggttgtaccatattttcttgattccccaggcatcagagctcccaaactaagaattccagtaagttttacttctgcttctatcttgccatcctatatccaacagaatgaacaaataaattatattgcaaaaatatgtggtagcagaaaattaaagcatcaaaaaattcattaaggaactaaattcagatatgtattcactatctcaaaatgttggccaccgcccgatggaatatatttaaggaatcccgggcccaaagagcacagaaggaatatcagcctttataggttacagcttaatcgctgagggcattataaggaatagtcagttgaaacaattacctgataaaagtgccagtaaaaaccatattcatagttggcaactgtgcagataaatgaaacagtaagcctccttgacctcctaacttctgctaaaccagttctccaatcctggtgtttccaaaggattccgtggtcttcctcatgcaaacatacacaattctcaattgtttccacaccacccgtaaaattcgtgaagtgtgcatcaaaatactttatgaaacctaaacagtcacatccctacaaaaaaaaaggcatataatagtcagatgaaagttaaaactctctggaggtaaaaaatcattaagaactgagcaagcaccctcttaagagaatgagcattcttcccaagtccatcttctccagcatcaaaagcattcttgcgataatgtggttcattgggatctccataaggaacaaccatctcaacaaagctgagcctatgagctatcggccgacgtccacggctgccatcaacatatgcaacagaatagatgaccaaaccctctttaggggtgaagccaatacggaagttccactgctcaacatcattaaaagtgttattaattccagggggaaatatttttttgtttatctcatcataatagagaaaagctttacacaacaatgcaccttctgccattccacaaaatatccgttaatgcggaagctcgggccctcaggttgattgataataagaggtttcaaatcacttcgatcaacaccacctctcgtttccccaggagtgtagtttctcagatgatctggtggggggagaggaaccaacttcctatcttcaaattctatgacaacgttattctgcatatcaacaataacatggatcccttccacaggacgtgcataaccattctccatgggactatcactgtcagttctgcaaaagattagaggcttgccaagtctgcggctgggagcatcagcatcactgtagtagccagcacacctgatgatttagaacaatgttcacattatcattttccatatgatgattctaagacaacaaagccagctatgagatataaaacaaaagaagtttcctaaagcttagcttaccaggcatctaccatgacaagttccatgtcatctacacctcttctcttcatagcttcaataaatggaggatagcttttgacagtagcttcacattcagcatactccatagcatcctgtgaaatatagaaatttgaactgagcgctccaaaaggttctaaaaaacttcaaaagaaaaaacagttcaagctgtaatacaagcataaatatcggaaaactaataaattgtgtcctaaaagcaatgacagcaaacaattcaagctgtaatgcaagcataaatactggaaaactaagaaatcatgttctacaagcaatatttgcagagtaaatttaaatgttgtcttgaagaaatttcacagactaaatgattggaaaattgggacaaaacaatcaaaggaaggaaaaaaaaaactaaacaaatttattttaggcaataccattgcaggctgaacttctggaacaacttcagatgatatcactttccctctgtgatgtccacccctagtagccgcatgcacctcagagagttctactatccaaatgctagtctcatttgattgtctattgtagactgtgagcttggccctcctagggggcaacctgcttggaatgacagcagagcctttggttctaggaagcagtgatggttggaatggtgggaaaaagtaggcatcagctaatgccacgacattcttttctggctccaatagcaccacttcaacaaaacgcatgccatcacgttcctgcaaattcagaaacctctatgtcagctccttttttttaaggttgtagacaaaagtacatggaatattattttgacgaacctcaggcgattttccagcagctcttacagttgctatagccactgcaatttcagcagcagataatggatctaaagggtggcttctctgggctctggtcattataggtatccctgccattttgttccatccagcagaacattagaaacgggtaataataatgaatataattcaattaagacatgtatgctgaacaggtcactcaaacaacttccaagaaattacaaaaatatacatgcatagaccaacaacaaataaccaaactcctgcatgaacatacagacctcttcaataacataggtcaacaatcgataatagataatttggcaggtcaagtagaccatgctagatgtgcttatcaggaaggctaaagaagcaatacataattttttttgaacgaatagaagcaatacataatagttaataaaaaagcagttgttgacctatctgaagatacagataaacaaagcagcggtgacatgaatcttagtacattacagtgcagatatattcattattgttctatcaacttatgtcccccatcttagatctagttgttaacaggaaataaagtcccttatttatacaccacatagacatgattggagaattgtttgatctaattagacgaacacgtaggggtatcaactgcattactgtaaatcatcccttcatgtaacacagttaaaattaggaaggcacgatctattttgaagttaaatttgacgaggtagagtcttaagagactaataattcttctcagtaacccctgccaacatcaggtgaagtattacaccagtgttcaaccgttttcagaaagtatatctgttcaaaaaactgaaaatgactgtctgtctgtctttttagcttataaactatgaagcagaatttgtctaatgcgtaacgatattttggatgagatgagaatcaaagattatgctcagaatcttaataacatttggatggccttttctacggccatcccggcaaagaatagaagatcgtgcccagtgagtttcaaaggaaagcctatttggggtttgctacacaaaaattaagcgttcaacttacgtacactgcacttcttcagcatcccgcaagcattactactttgtgatggccccgtggaccagcctgcatgatcagcttacgaccagtgcctagtggcgcatacagataaagtgcagattccatattgctgatggccccatgattcacatagtcaacaagcctattggtccatcgctgtacgggcatcgttatccatttcagacattttactcgtttccctatatcaaagaatttattggcccatcactaaacagacatcattatccatattcagacattttccttgtttcccatatcaaaactcaccatcaaccaaaaactatggaagaagaaagatagaagcgatcgctgctactagtgatcaaagaaaaagttgaaggttgcaacgcacgacgacaaagcagaaagccagaacagtaaacaacaagcccggactaccggaagatatgtgacagcaagtcccacaagtaggtgtcgcaacatcacgtcatgcccccatgatccattcaccaatgatgttgacatggagtggggacaacctcttcttaattttttctttgcgggggacaacctctttttaattgataatttgtttaaggcagattaatgatttagtgcacctatagatctaaacaaatacatatgaacagttcgcaagctataatctgcatactctgcctgcatgcatcgatcgagaactacgattgagcaaacgtacgtaacgagaactgtccgatcgtacgcgcaaataaataaatctgcatcctctacttgcatgagcacgagaagtccagaactatgcactttgcacaaaactaactgactacatttcccgaactcacacctgagctcgcgaggaaatcatgatctcgagttctccacgaataccactgtcacgtaatcacgtccttatcctactgtcttttacgacccatgcacggcacggcacggcacttccgcaacatttcccatgacccaatcgccaaccactcacacaaatccaccacgcatcaccagcaaaatagcgcaaaatgcccaatccaactcaatcgagagagagagaagggtggagatccccgaatacctttcgaggagaccttcgcggtggtgggctggaccgcggcggcgatctcctccatcacggcgccgccgccacccccggccgccgcggcgacgcggggatcatcgcccgagaccatggagaccttcccagcagcagcagcagccgcgggcgccgcgacgatcgccccgcgtgacgacgacccggggccgccgtcgacgcgccgagcagccgcagcgccgccaccgccgcagcagacgacgaccggcgccttttcctgagttgcggccattggagcggattcgcgagctgaccgtgtccgtattctccgcctccgcctccgcctcgccggctcacacgatctgacatacagcacaggcctccgccctcccgcgcgccttcgtcctcccctcccctcccctccccccacctcccgcttcctcctcctccggcttttggggtttctacgggcttagggctaccgcgaaccctaggacgaaggggaaggccaggccggcctcgtgcgtttcctcctcctccgcgagagaagccgacgaggaatggggaagagagagagagagagagagagagagaagccggtggcgagtttggaatggtggtggtggcggtgtaggaggaggaggaggaggagacgggggctttgggttgttttggagggcgaacgcctcggggctcacgtgcttttataaaggcgaacgggggaaaggtggctgggcgaggccgcgaggggaggggaagtgggtgggctggattcttctgggctccctttcccgcaaatgctacatgcacgggtaaagctgtaccccacattgtgttgatcccggtatgtaagtttttcttctttttcatttatttccttttgagacgatccctccatgaaaagttggcattttcgccaaaacgccaataagaatgccttttctgtggtggtggtagttgatttttgttaaaaatgtctagcgacagctggaaattgatttttgtttttttttcctgggggtggtttttttttatcatgtctcgaaggaaattgaggttgatggcttatcaatgtcattgcaattgccgtgatggtatcctagtggtaatttttgtggtatcttttgtattctaaagaattatggggtgctttgatatgtccctatactcgccggtagctatcaagggaaataatgcagaattgtgataactttttttcataatcaccaagtgctacttatggatttgtgttattttataaacatgtcagctttggatactttagtgatgtgattgaaattattcctttatgagatactagaagagatcattcgatcattccggatcctatgcaattgctagatagtgtgagaagtgatgagcctgaggtcgcatgaaacgctctatcaacatcgtacaataaaatcgggtagtacaaatggtggaatcatttgaaactattggatagaaaataaatggtcataactatatggaattgctattatatactccctacaccggatctccatttcaaaaaagattaccgtgtactttgacaatatttactatggttgttgaagtgtatattgtggctgcgcatccacaagttagaggatatgaggatcatcaaacttttctatagcccttaatcatttgtcatcttcattgccattgccgtgatagcatgttaatgttgtgtatcacataagttattgaaaaaactatttcgacgataataccataaagacgactcgattgtttttttagaataaagtactcctattaagcgaaagtatttctatgaactacttccgctcaataagtactcctacagagtactccttacaactattttagcgacatggcataaagtactcctacaaagtatcatttcaaaatgtattaaaggactatctcaattttaggttataagactttctagcattgcacacatttatatagatgttaatgcatttagtcacacatatatgtctagattcattaacatatatatatgaatgtggacgatgttagaaagtcttataatatgaaacggaggaagtaggatttatcacctttaggaagatatttggggatttgccgcctatatatctgtggtatattaatatgtgatctcaaaacattgcagatcttgaataaataatagaaccttacctttttgaaacagctcataaaaatcacaagagagcgtgacaataaataatgagtgaaaatacttaattggtctctcaaattaattaaaaaaaccggcaactaggtagaactggtcatattcatgcgccagaaagcacttttgtctgcgctgcttgtcatgtatcccaagaggaatattgcagcatggcgaacgcagacaccgcaacctaatcctaacccgttaaagtgctgagtgcttttgcttcacgagattactgcatcgatcgatcccgttaattacatactccttgtatactaaattaaaaaggttaattgggtgtgcacctgacagggtacgtgtgagtacgtgagccgtgaggcgcgagagcacaagcatgcgcaccgagctccgatgacaaggacgggagatgaaggcgttcttatcatctgagccggaagcaaaacgaatcaggatgctcgagcccttctcacgttggcatgcattactcagcgtagtactccagctaggtgccgagcggatattttgtaatgcgggctgattaggatcgactagcaaaaattactacgtcgacattacttcacgacgaaaatttttgtgattaatttatcaggtgccagcaccgtatcaatcaaagactgaatcccaggggagaagtatgctgtggtacgggtgagaattaccaagtatccacatgccaaccagcggcggatctaaaaattttcttgagcctcggcaaacctatcaacgggtgaagcatgcacataaaaccttgaccattaatcacaaacacaagtagatttggcatgtaaaatcttgctttgtgctggttgatcatgcgtgttgggctctattagattgaacgaagcaaggtaatagccaattaggtatgtacttaacgagcaatatgttgtaggccatggagtaatacgctgtcgcaggtctaggagcctgggcacccgcccatgctggccgggccctggctccaccactgatgccaactactatagttgatacggagtatgataatttagtgggactatcaatatggtatttgacagaacacacatccattaaatgtaaattatggatcgttgaattgcttttagatttatgcagcaatgcctaaccctaatactttattctcattccctcagtcccaactcacaccattgtcgcttctccttttcctcgtgtgcacactccactcgccaccgcaccaagccactgccttgcctagttgactgggcggaaggcttcaatggtgtcggtgaggcccctcctttccccctccctcttctttctggcgtgagctgttcgcatgtcatcgtcttccatgtctctggcagctccccaccaataccattggatccaccaccaccggtcatcaccacttaaccaatctttctgctttgtccccaccgtcaacaccaggtccccactctgcttctaacctcgcggcttcggtagcaccattaccatctcatcgctcgcccaatccaccgcccaccgtggggctatcacctcccattgccatctccctagagctaacgaactccttcatcttttctcgttccccttcctccaccctgatcccaacatgggacctaaaagtgtaggtcccctactgaagtttggagtaccaccgatgccgaaaaagatcaggagattgtcggacccgaaggagaagggcaagagcatgaatcacgaagatggactttatgacgaatgatatattagcaattttgtgatttaatttagcaatttatttttcttataacaatcttgtttgtataggtggaccaaagcccgagcatcatggagccacatgtaatggctcactgttgcgggtaagaggacactagcatgtctaatgcacctttcagtcgattgatgctgacagctagtagttgtagcgaggtttgtttgtactcctattcataaatatattccaaacgtactagatacattttgttaccaaacgttgaaaatggtttataagaaggcaatatcattttgtattgtacttcctccatttcacaatttaagattttctagcattgcccatattcatataggtgcttacattatgaaacggaggaagtagcatatgtgatgtgaatagatgcttgcacattggaatatatgaaaagaaaaaaagagaccgcccaccaaccgattacactatcccaacttaaaatgagtgtgctaacttaactcgtagcgcaattgaaagagtttatttcaaaatgtttactagatatttttttgaaaatataaaattatattttgtccgcttaaattcctgcagtaattatgcgggagggatggcgaggtttgatggctacgcgtctatgaattttgaaaccatatggtgtattgtcaacaggggtgagatgaacaccatgggttggaattttggataacgataagagagctgtctgataggagtgggtgtgtatgataggagcacgcactactcgatcacctgctacaacctctcaacagctcagtgttactggagcactcagcttgaggagactgccacctccatcgtttgtttattttttattatcagccataaccataaaattaattcaaaagttaaattctggttaagtagtatagtagataacaatacatatataaaaattttacttataaactattatttttctcaacttacaatcagctatagacaaaatgatgtgctcacccacaacaactatttttcacagctgccgtaaatattttggtgactggatggctccacgtcaccatgggcccacatgtctgctgccttttccgctcacgggccacatcaccagggtccaccagggcttttgagaaaagcgtgggctccagcctccatgtcggtcgcttttagcagcagcagcgcgccagcgcactccggtggctttggcttcgcgcgagcgaggagaggtgcagcggtgtacactgtacagtgcgctacaggttaacgcagcagaagtgcaggcgaggcagggcaggtgcggccgccgtggtggtggtatccagcggtggagcaaccggcggcggcggccgattattggttcctcggttcacgggagtggtgaagcgcagcgtggccaccggccacgtactcgcgtacgtactcacgcccgcacgcacgcacgcctgcgtgcgcttgtgccactttggcgacgagttgacaactgtgagtccgcgacagcgatcacccttcgagtgtgttgggtggtgcaccgacgttgctgtccattatatcggccaccatttgccaatttgctgattgccgattgctacggatacggcactggcttttcggctggttaatcgagatgctctcctttaatttgtgattcgctaaaaaagatgaagaaaaagatatgcttattctgatccatgattaggatgcacgaacgcttaacaaatgctactgatcacttgtgtgtagtgcggtacagcggtaacacccttgccgtgatgaggaggagttcagggaggatctacggctcatacgtacggtcgtggtacatcgtgaggtgaagtcatccgctcaggccaaatctgcgtgcccgggcagctgcaactgcaatatatgatcactcaaaaaactttcaacaatgtcagctcgtggaagctgacgtgtccaggcgtcaaattgatggaattccatttccggagagaccaaagcgagatccccataaaaaacgtctcatcatgcgtccacgcttgcatcgacgtacagtactacgatcgtaaaatattatgcttctttttcgaaagggcccggctaatgtcaccagttcaagtatcctatccaactccaagtcatccaaccttgctaggatgagaacgacacggattagtgcactcagcatggcatgattatgtaggaatccaatgctaactatactcgtctgttttatgatgccatcgagcctagcttgcttgattgatttcgatcaggatgatatgccccttcaaccactctatcctgcatgcttagtttgcccacactccaccctccacagtggcaaagaaagctgcgtgagcgtgacggcctgaatattcctttttaatttggccaaatgaaagctcagattcgcgatatacgtagacacgtagtgcgcctcatcatgcacgattaagaaaaggaaaacgccgagggctggtggtctcaaacaaaacggtgtgcgtgatggaacacgcatacgtacgtactactacattatactcgcttgctccagctttagggcctctttaaatcacagaataaacaaacagagaaatagaaaaaacataggattttgacaggaataaaagtgtaaaatagaggattgcaaaacacaggaaaaacataggaatgaccgtttgattgaaccatagaaaaaacacaggaatttagggagagataaagactcaaaagatttcttccatgaggttctagctcttgttaaaattcctccaaaacttatatgggaagaggcattccataggaattttatgggattccatagggttcattcctttgagtcaaaaggctttataggaaaaattcctatagaaataaaatcctctaaaatttctataaatttccattgaatcaaattgccttaatttagtcccatcgatatccaaaaccatgcgtacgtgtgcatcctgccatcagcccattctgatgcacggcgcaccgtcgtccgtcgtcgcgacaagccaatatgcacatataaacgaatccaccgagcaagccggagcacgacgtcgtgctgcatagctggatgcatcatgcctgagtgcgtttgatacgtacgtacgctcatccaccaacgggcccacgacaaaacgactcgatcgatcggtgaacattgctcgcgttgccgtacgtgcttcgtcggtagtcgtgggtggggtcttggtcaccccgcatgggtaggagctgacgcgtcacgcgtaccgccgtacgtgtcgtatcgtgtagacgagaattttttttaatgttttgaacttttaaaaacattaaaccattccaaaacttattattagaatttgaaccttttttatcacgtcaacctgctagatacaacgagcgtgataattttgttatgccacgcaggatggcgtggccagataatgctgtcacgccaaacagaccgacatgacagtgttccaaaaggtttagagtttttgaaaatgtttatttttaaaatttaaaatttgaaaagtttaaaaataaaaaaaaattgtgtagacgataacgacggtcgcgcaggcttggccgatcccgacccgaccaaccgggggcgctgtcgcatgtgaagtgggctgcgcgcgtgggattctcagtggccttttctggagtagcttctttcggcccgctttgctgccatgggccgatatgtttatttccgtcttactcagagcccaattcgggatatgtggtttcgtttccgcgggcggaagcggagagaaacggcgcgggccccggggagagaaccggcatttcccgctgcgcgcattgccggcgaggcgccaaaaccctaccgcgcgataatcctcttcctctccgctgcgctcccttcccagccggcggcgccaactttagtagccgcaggccgcagccgcccacgaaccgccggcgacgagatccgagaggaggctggccggggctgtcgatggcgtcgtggtgcggcgacctggctgcgccgccccgcctcctcgtcgcccctcgtgagtgcccctcctccgcccccggccatcgttgtgctgtctggtctgtttaggctcgcatgtttcagggcggtagtgcgattagtgattctaattccaaatccccaattggaagcatctggtagcagtagtttgttttcgtcttcaattttcaagattcctttgagctcggtggatttatgtggcttggtcgaaatgccagcggacttaaaaattgtgcgaactgaagattaccgcctgagttttttggttgggccttgggggtcttttaaacactggattacggagcaataagtgtatcacatggaggagcatcacatgcataaatgtataatcagttaatcacatcccattttgtgttttccttgcaggtccttgtgatggcaattgtcaagggaatgttttgtctctccgccacccgagatcaggtgctcttattcctccttgcttctgttttctttgtcggttattaaatctgcactagtaatgtagactaatttggtagcctgttagcatctgaagaatagccatgcagaagtagattatcagcattcaacagttttgcattaactcttgcctcatcatcaaacagatgaagaaacagggtatctgttcatcgacggtcaacttcacgagttcaattggtttaaggagcgatttggatcttggttcttgggtgattatgtttgtgaaggtatggcagacacatagctatgcagttgtcatttctaagaaaaactttgtattttgcctttatggtaaggtttgtctattattatcttgtgtgggctataggaagacattttgataggaattattgccctgcctctgaaatcacccatttagattttgttagcaagtaattaaaatatggaatcagacagacatgttgttaaaggagtggtgctattcttgttctaacacagcaacataaataacttccaaatggcacaatctattccagataaagtttttgaaaaatatcgtactgcggagaaattcaatacctgagtttattgacctgctgtccttcctgacttcttgtagatggcagcctctactactgcacagttgttgatcccatttttattcttctaccaattttgaaagctgcacgtatgtcggtatgccaaatcaaatcagaaatatttctaatatgaggttcacattcaacatatttgcgtgttgaaaatttgaaaagctagtccctcaacagctttactgtgctgcagaatggtaaagatccaggaaaatttaggcaactggatgaaatattgtatgttgaaggatatcctggatatcaacacctcatgggtatagcaggaaaccatattgatctggtctgtgaagttaaaggtagatgtttgacttgtatgtttgttctgaagttaaatgttatatgtagttaaatattatagcaaactgctgtcagaatgctgcctacttgtatttgtagtccggtgattgtgcggtgcatttttaccgcttcattaccttgctgaactgaaacacttattggatatggatgtttatgtttcatccgtgctttcctgtgtgttttcatggaagagaagttttacttaaccatctcgcatggatgttttctttcctgcagaagttgctaatgtgaagttctttaggctggacgattccaaggtcttatcttggttgtgctgtaaggttagcttgtgtcagtaattacatctactaactcgatttgcactatgctattccgctgatacttattcttatcagaagctaacccaccttttatctttacttgtccttttcatattacaaaagcaaggatctaacatgaagttagggtggaatgttgcttatgtgggttaggaaaagaggcatcttattgtttttagactgtttgccttgaataaggatgcaacaatccaacaaactgagcacaacattgagaatgttgatgggctaaaacttaattcttccacaccatgttttaatttatatttgtatataaactatgtgcaccaaacattagtctttaagttcactttggttttgaagatgataaataaagcatgaattgggaccctagtgaatttcctatatatttaagaacatgaatgcacatggtcattcttgtaaacgtccctaaataggtgtcagagggtagtggctgctattccttgactgctgtttgtagcattctgcctaccttatgttacaaccttctacaaccattataatgtacggtgtgttccagtactgtttatttgttgcatatttcctgccattttccagttgaacaattttacttcataaatttcatttaactatgttcttgcaaaaatatagctagcatgtgttgtgcccactataacaccactgctatctgctgtaccaacactttgccacatgctacatgcaactcaaaacatcatacaatatttttgcatgattaacctagtaatggctattgttatctgcaagaaacaaatgccactttgggatatcacttagattttttaaaaaattatgctgccttgcaaattcaaaataacagtttgtcttggtagcatcatgagaacataccagttcatgtgccctcataatttatgttttgatacgtcctttagctgtacttaatattcatgcctgtgaatttcgaatcatattgatctcacttcacttgttactctgtagtttcgaaaatactcttatgaatctcatatacaggttcacaatctaaaagaggttttccccaagctaggcaaaaattatgctgcccaaggagaaaaagaattatgtatgttgctgcaactctttttgttaagtctaatacaactgtattagtctattataagaaggatatagctccttgtaaacttatgtttctgtttatttttatgagtgttttatcaaccgatatccaaatgtacataaacattttaccattgctaactttcacaattatatggtaataaaaactgtttgaaaatggatcgtcagtgtgatttacatcctattggatcacttttgtcccaaccttaattagtgaatccactttgcattacaaaattgtctgagtaaacttaaaggagattttgcttgtggaggtggatctcctctaaagaaaaggatatatcaaattatttttaaacattttaactaaagttatgtaacttcaattcaagatattgcacagggattaaattcctgagttacttttgaagcacaactcaagaattttatgaaaatgtaaatcattgttctaatggagcggtttccattgttttggttacagtgaaggatgccgtccaaataattcgcgaatacctgaacgacgaaccatggttaacgttactctgcaagaaggtgcagtaagacttctccttgcattatgttgaagattttagttcagtacagacttttaattgactatgcattttttttctgagcgaaatccgatagactatgctcacattggtacaatgcattctccacaggttggatatcaaggagatcattgaagcgaacaaaactagcgaagcttccttctgtgcggagaattctcctgtacctttccaccctgctgaggtaaactccttgaagatgatcagggtgttctacaccggatagctcatgtgctataagcttattaatcgtgttaacgcaggagaagcttggaagtagtagcactaggtcaagcaaagggaggccagcaaagaaacaaaaggctgaggtagaatcgaagaacatcaaagacatgttccggagggtcacaaggaaaggaacgtgatcccatattatttatagtatgacttggttctgatttcgccatcgagacctcgcaaggcgcttcatattattgagggaaagctgaggttttcagattaaagcattgtttatgcttcagaagcattcgtgcagctaatggaattaactgtttaacaaatttactccaagtctcaactttgttaggtttgaaatgtagcattgcaggcgtgtatttaagtatttgagcaaagagtcttgtactatcctactgatttgtatcgtaccaaccaatttccttgaacatcttggccttgggtcactagagtaatctgaaatggttgttaatgttatttgtgagcttcaacacttcctatttgagaacatttctaagttgttccggaggcccggtgtctgttattatctccaaatagtctgtgttactacagatagtctacatgtatgtacgtgcggataggtgctactccaaatagtctatactctaggtattttagacaggtaattctgtacccggtatttagaaagtactcgtatgacctatcacgctagatggcgaaaggcaagtcactacgtctgaaaacaaaaaggtaaaatgacctagcttttttgtcaatcaactgattatgtgctaaatagagtataatcactttggatgcttagattgctctacattagtttgcccgttgcaccctccagaggaataattaacttatttgccactattatgagtggtgataaaagattaccattgaactcacgtgtcatagatacatgagaactcacatgtcatagacaatgagtgataaatctcggaaatacttctctccggacggccgattctatgcgagaaatcggatgccctttatatccttatgtctctcccacgcgctcttgtgctgccacgtgtccccaccacatatttcgttgcaacaaatcactaacatattttggaaaccctctgttaagggaatccgttttattttttgttccactaaaaatgtttcacctagtgtactcacaatgtttcactatgtatggatctcatgttgtagtgaattgaaacattcttttgcaacaaatcacccacatattatggaaactctctattaagggaatttgttttattttttttctacaaaaaatgtttcacctagtatacttataatgtttcactttgtatggatcaaatgttgcagtgacttgaaacattctttcgctatttgctgaaacattgtttttatataaggtgaaataacgccctatttaaatgaatgaaacatttttatctacccagtgaaacaattctgatatacttggtggaacagcgtgcaacatttaaaaataattcaataataaactatttttttcattggaatatatccatgtgtggtcttgttttaaaaatttaattgtaacgaatttaatagtgcaatcgaattatgatttggacaaataatttaagataaaaaatagtttaaaatagttttgcatacatacatacttgatgacatcatactgacatgggcgtccgattcctagtcgtctctaataaattcttaattgccacctcttaaaagtggaaaaaaaaaagaaaagaaagttaaatgtcccaccaaaggctccgcgcgccgcggccgcacccttccgacgcgggctgaggcgagcggactccagtggaggcagagacgtgggctgctgctccggcccatgggcttccacctcgagcctgggccgtcgctgacgtcatcaactcccccccgtctccccacacacgcactcccctgtcccctccccccgctgctgctaggcccgatccactgctctccccaccggtggtgagtcaccacgctgcgtggcaaaccctagttaaccggcgcggcgtccggcgaccgtacactcggcggaggccgcagagcggcagcggcaggcggcggtgccgccgagggcagtcggctcggctcccgcggcaaagcgggaacgggagagagagcagggcggcacacgcgcgcgctgaggctgcgcgcggtgggcgcggcgtccggcgatgcccgggcaagagctataggaaggcgaagtcgtgggctacagccccagtccccagtgctaaggcagtaagctgctgctcactcctaaccatctccccctttttcccttgcttgatttgttgggggtactgacccttactagtagttttagaaatgagaagattgctgaaacgattgcggttctcaacctggctcgcgtagtctcatgctgcttgagggcttgcccaggctccaaaatttcctggctccgcactttttagagggatgaatccgatgaaacccaacctggcattgtctcgtcgattctctagtggtaaataggagtttaccataatgaccgagcttgtttgatgattataacttagtgatatataggagtttcccataatacctagttgatttgctgattacaaattaattttatggattggctgaacatgggaatgaaaattggtggcaaattcttgcaaattccttactttctgatccgctccatggttcgtgcttcagtgacccttcccctccatctcggacaagctcatggaccaggcagcggcgaggatgataagttaggatttggggttggggcgggggcagtttcctgggtttggagggaggtctgggcagtactggcacaaccagagtcactgagtcaggagagggcagtgggagggctcagcagcagggacgaaggggaacgagaagttccgaggtggatgacagcactagccgccgggtatggggaaggaggtggcgtaggggcagcggatgcaaggaagatggatcggtgcagtgggatatggaggaaggcaaagtggaggggagggggtggggtgcatcgtctgtagaggtggcagcagttggggatggatttgctgtcggcgacctgacgcctctaaggtagagggtatgcagtggtggagattggttagcaggggtggcgttgagtgatggctgggggatggtgtttacattattggaggagaagatatgggcctttggatctcaatcaaacagtcaaaaagcgtaccatttagtgtaaaaaaaaaacttaccaattatatatagtcagccccataattttaggcacatatattggtcatatattcaagatgctgataccaattatttgcatttccccatgtcatatttagtaattacaagttacgtttatggtctatcaataacagttgtatcagcaaaattacatgtttatgatctgttgtcaattttgtttcggtggtctgtattccaagatgcttacactctcgagggtgttcaatttctgtctcgatataggtttctgattacccaagtgtagatgtgatggacacccatcacagcgatcaatatgcaaagagcagcctgcagctgcaattcagggacacctctgtttcctttgaaaacaacaattctgttttggataagcatgatattacaagccctcaagttggcatgacttttgagacagccgatttggcatatcggttctacttagaatatggctaccgtgcagggttcggggtctcaaagaggacttcccatagtgttgatggggtgaaataccgtgcaacatttgtttgttacaaaggcggcattgctaggatcaagcctggtctcaaagctcgaaggaggcttgttgcaaagactggttgcaaagcaatgatggtagtcaagtataacacaactgaaaaccagtgggaggtagtttttgttgagctggagcataaccatccatgtaatcctgaaatggttagattcatgatgtgctttaaagatctccctgactggcagagggagcaccgcccattcaatgccaagactagattgaatccaaagattcactctggcagaggcaggccacccaaccaaaacaaagacttcatggtgaaaaaaaccttctcacaatcaaattattccattgaagcagcaggcaaggctggaaagctgagatttgcagagggtgatgttgaggcactcttggtcttctttgataagatgcaagctcaaaattcaaactttttctacaactgggacatggatgatgaaggtcggctcaagaatgtttgctgggtcgatgctagatcgagagctgcataccagcacttctgtgatgttgtttgctttgatactgtttatttgacataccaatttgtcattccattggttgcttttcttggaatcaaccatcatgggcaatttgtgttgttgggatgcggtttacttggggacgaatctccagagactttttcttggttattcaagaaatggctaaaatgtatgaatgataaatcacctgaagcaattattaccacccactcaagaccagtggtcaaagctgttgctgaggtatttccaaatactcgtcacagatacaatctttggcatatcatgaaagagcttcctgaaatgtctggaagagttgaggataaggaggcaattagcctaagaatgaaaaaggtagtcttcgacactattacatcaactgattttgagagggaatgggttgagatggtcaatcagtataaccttcatgataatcattggcttacaaccttatttgaagagagggcaaaatgggtaccagcatatgtcaaggatactttctgggctggtatatccactgttcgccgcagtgagcggttggaggccttttttgatggatacattacaccagagaccacaattaagacatttattgaacaatttgatactgctatgaagcttaggtctgaccgagaagcgtatgatgattttcgctcatttcagcaaaggcctcaagtcttgtctggtctactctttgaggagcaatttgcaaatgtttatacaataaatatgtttcagaagttccaagatcacttgaagcagctgatgaacgtgacttgcactgaagtcagtaggaatggatcaatagtgacttacactgtgaccgtcattggtaaggagaggaagtatgactacaaagtgatgtataacagtgctgagaaagaggtgtggtgtatctgcaggtccttccagtttaaaggtattttgtgtagccatgctcttgctgtcttgagacaggaacttgtgatgctgataccttataaatatattctcgatcgctggaggaaggactacaaatgccccgaggaatccaaggaaactcccatctcaccaaaagcgatcaaagctacagggaagggcacaaaaccggaaaatgcccgtgaagataaagtggacaatctgtacaagcatggtcaccagtactttgctgacattgtggaaatgggagcaacggaccctgatgcaatggagtatgttttgtcggtcatgaaagaagccaaagagaaggtacggaagttcgaggaatctcgaaaagatagaaggcctggagacagtccagtttctactggtaagagaaatggcaagtcttcaagaccatccaatgaggatgggggcaatggcatatcagattcaacacctgcgactacaacagtggcgacagtcgcggtggccacatctacaacaatgcaggcaacgcctacaatggtggctatagcgcctacttcggcaactgtgcccgccggaatgtttttggtaccaatgcacccacatccgatggttttcccacctttcacccctgcagtaccaccagtggtagcacctgcagtgccacctccagcaccagcagccaatgtgggtgatgtggcttccaactccacaaggaagagaaagaaaagaaaggggaacaaatgatgttcctaatactgattatgtaagcgcttcactttgccgcttctccttttgtgctgtactttgctttgtggtgttgatttattcagataatctcatcgtgcccttaccccgtattttttgttccaggcctaactcaaatttagtcctacaagctgcaccaggccctcctgtccatgtgtaataatggtttatcatcgtctcctgctgcaggatgatctgcccctctgaatgctttctgtgaattatcccccttgacttggaactgtccgtgcagctttggactgtctactgtaaattgatatggaaagtaatgtattatgtatgtagtgcagcttaggaatgttagtctctgtttctgctcatgtggattgcgacctggagcagcgcagtaccaagactaccagtagcgtagcagtaccccttgctggttggtagagtaccattttctttcctttctggagtttgtcactttatgtaatgatgtaatcacactgaactttattgccaaccactaatgcttagtttcatcttatgccgttggctgttgcactgagccctgagcattattttcatcgtatgcaagctcaccatttcttgtcatactgaaaatcgatcgtgcatatggtatgagaatggtttttcagttttctgaaaattgatcgttcacatgttatgagaatggtttttcagcaagcatatgtagaattgtagattaccgatacaaggagttgacccaggaaggcaggaatagtatttcagcatccgtggtgcgtaggatacttcacttcaccctaaggagttggcccaggtgactcaattatcaagccatgttttgacttgcccgattatactcgtaacagccacagatacgacacttgacgcggctccaagaactcctgtgtatattattctcctgcatcaatcctccagatgaagaaaccaacagtcacatactccatccgttttaaaatattgcaatttagtaccgtatttgacataacctaacctattaatctagacatctctattacaatcttgatcagagtcgtagtagattatatcaaataagataccacattgctatattatagaaaagatgatgtgcttattgtctttaatccttgttagactgtctacgcagacgtagatttccttttaaatacgagggtagttttttaaacaataaactacctttcatagagttctcataaaattctaagccaaaatataaatattgaaccttaattttagattaatctaaagcttcttttaatcattttctttttcaagccttcaccttgaaaccgctagagtaaaaatataaaagtttcattctaaatttattgttacctttatttgaattattttattttctatggcatatcagtcacgaaataatatttctaacctctgatgcattatttacgtagaaaaactgcaaatgtaccatactcactccgtctaaaatataagagattttggatggatgaaacacaacataatattacaaatttggacagagagcatgtccaaattcgtagtattaggatgtgtgtcccatccacccaaaatcttttatatttttagggtggagggagtataatccatgtctcgatgacttcatatgctacccctggacaggatgtaccctcatttttttttgcatgtcactcaaataattatgaaaaactttgagaagatgtattaatatgtgatatatccacaaacattttcaaattcaacttctacatttcgcaacgaaaaaaaaacaaatttgactatgaatatatgttaattagctgtagtttaatttgtttttttcgagatgtaaaagtttaatctgaacttgcatgtatatggagtgatatacattcatattcgtatctttttcataattatttgagtaatatacaaccaacaagagagaacatcctctcgagggattaaaatagtttccatcctaccagcttgttaacgggccaaacgtcaccattatgagtcatgacatgggggaggaagaagggcctattcacttagatgctaaaaaaacattaccaaattttggcattgccgaaattttgcaactgtgtttgccaaaatttttgcaggatttcttatataactaccaaaacttggcagcaaactaaatataaccactttttagcaattttattaaaatttgataaggttaaaaattgacatgcagtgatcaggcccgaaaactttcgacgacgaagccgcacaacctgcctcgccctcgcgccctgccatgccatgccatgccatgaacgagcgggaagctctagaagggccggaattcaaagccgcgacttcctccctaaacctggccaaatgggccgtgccaagccgggccggcccgagcacggcagtactgtagccggcccaggcccggcacggcacgccagcctgtgggccgtgccggcacggcccgttatcccgtgccgtgtttgggccgatgcctcagcccgtgggctggcacggcacggcacgtttactgtagcgtaccggcacggcacggcccaggcatggcacggcccaccggcccatttatttttcctacgattttctaatttttcccatatatttctcatattttttatttttttccacattttatcctatttgtaccatatattttatgatatatttcctaaattttcctcacatttatcctatatttatcattttttcctttatattatgttttttctgcctttttctttttttcccctcaaatttcaatttttatgggccacatgtactagtgggccggctaccagcccacgtgccactacagtagccgtgccggcccggtacggcccagcaccttcttgggctgtgcttgggccgtggccttggcacgtgggccggcacggcacggcccgctataggagccgtgcctaacggcccgtgtcctagtgggccgtgccgtcggcgtgccgtgtcgtgctgggccgggccgcccgtttggcctgctatatcctcccccca

SEQ ID NO: 46077 - DNA, 3153 bp, Oryza sativa
cgccgacgtggttcacgctgcagcccaagcaccaccgccgctggaagaagggcgcggcggaggcggcggattgcggtgcgtacacgcattctctagctttgattatcgaagtaaattacgtgtgattccgtccgtactttgggttaatccgctcccttctcgaatcggtcggcgcgcggcgcggcggccgactttttggtgaagctaccagtatctttgttagctttgccaaatgcagcacgcaagctcgtagtaagagggattagcatgctgttatacggaatgaaaacttagggtgcgttcgtttcatggacaatgagtggagatagcacatcgttttccgcgcgcacgcttcccaaactactaaacggtgtgttttttgcaaaaattttctataggaaaattgctttaaaaaaccatattaatccatttttgcaatttaaaatagttaatactcaattaatcacatactaatggctcatctcgttttgcgtatcttcccaatcttctcgatcccctatccctcaaactcaccctagtagctttcgaagtcattcgtaattgttttttttcattccagcgtagttcgacgacgtctctttcacggctgttcttttactgagactcgtgctgaccagcaacgacatgctcttttaatttgcactgtttgcacaattaatcatgtagccagcttaggccttgtttggttacacaagaattcaatccgggtcaggaataataagtatagtaagaaatttatgatagatataacgagagaccgggatttattctgagtcgggaaccaatttaatcatgatagagacaataagagaccgggaatcaatccactagtcaagaggtgtggaactaatccggatattttgttgtacctaatatgagtaaattggtttccgaccgggaataaatcacggtctcttgttgtacctattataaatttcttgttatacctaccgttcccggcctggaacgaatgcttgtgtaactgaacaagggcttaaggtcttcgcagcatctgtcctaaactagggtggtgtttggattcagggactaaattttagtgtcattagtctacgtttaatacttctaattagtgtccaaacatccaatatgacagggattaaaatttagtccttggatccaaacagagcctagatttggatacatactagtgatctatgatcagcaagggacttgagcaggctactgcgcacataattctcgagagttatttgaacaaatagtcttaatacgatgcaggaaaccaggatcaaattcagtgtttgccagacaattaaccattgtgtctcagtttatagtagtgcagtgtgaggtgtgatccactgattccctttcagctgggaacggcctagtttcggttgtatacacacacatccccgtttggtgtacacattaactcctctgcttttttaatatatgacactgatgactatttgtcttaataaaaaaattatgcaaaaaaaatgtgcttaaagtatgataaaacaagtcgcaataaaataaatgttaattacgtatttttttaataagatgaattggcaaacgtatgtccaaaagttaatgacatcatatattgaaaacggagagggtgttcttctccttcaggtgaatgttctgctgatatgttgttttttgtatggttgtgaaccagggaaaattcttctcaccttttcactgcatggagaaaacagcgacaatactgttatccactcatcaccttgttcgagctctaggagcgacactgacattgaatttgagagatcaacttattgggaacattcaagttccaacagtgggacggttgattctcccaggagttttgcaatagaacgatcttctttagaaaattctgaccgttcagcccaagcaaattccaattccaactctgaagatgatgatctaacagagcctagtgcagcaacagcaaagggcacaagtgacatcgaaccaatggttccagatgcaagctttgaagaagctatggaaatcatgaagtctaaaagcatccctgacatgccagaagatcttaatggtggtgtcatgttcgatcacacttaccttgtggactcgaagaatttgaactctcttatctttgggcctgattctcagttctccaaagagttgcgcgagttgcaaggaactatggactatgaggaacagccatggacatggaacaataataatcctcctagcttaaccaggacatgtcaatacaccaaagggtgaacaaaatttatgaaagccgtcaaaactattgaagagcaaacatatcttaaagcagatggcaagagttatgtaattatgactcgtgttcgtactcccgaggttccatttggaaattgttttgaggttgttatgctgtacaaaataattcactaccctgagttgtcgtcaagtgaaggaatgtcacatctgactgtatcatacaatgtagagttccttcagagtaccatgatgaaaagtatgattgagggaagtgttcgggatggactgaaagaaaattttgaaagttacgcagaaattttgtctcggcatgtaaaaattgctgattctgctgggatggataaagagcgattattggcaccgctccagactgatcatcagtcagatatcagacttgcttacaagtatttttgcaatttcacagtcatctctacagtgataatggcactgtatgttcttgtacacatctttctgtcaagaccaggccctcttatgggtcttgagttcaaaggtcttgatttacctgacacgtttggagagctgatcatatctggcatactagttcttcagctagaacgtttactgagtatgatatctcgttttgtagaggtaagggtacagcgaggtatgtttgttttctttgttgtgcatttactgtatttctcgtgcactagacatgcaaattaacataaagtcataactatgctaactatgtatcttcttttgtcacaggaagtgatcacgggattaaagcaaatggagatggttggttgttaactgtagctctgctagaggccacaagcttgccgcctgtctctagcggttccgtagatccttatgttgtttcagctgtaacggcataacacgaacaagctctgtgcaacttcagac

SEQ ID NO: 46078 - DNA, 31666 bp, Oryza sativa
  unsure (1)..(31666): unsure at all n locations
nnnnnnnnnnnnnnnnnnnnnnnnnnnnnnnnnnnnnnnnnnnnnnnnnnnnnnnnnnnnnnnnnngttggtgttacagtatagtcctagagactatttggcgcgcggtgattttacctatatgaggtattttttggtgattgatgtttttatgctacaagaggaaattcgtctcaaggtggagattgttaaatatgtgatccgtattttggacccacaatatattcggattagtttcctagtaggagtcctatgaggtgtctttctattatcccctatatatataccctggttagtcgtacaggaaggggtgacgttcccattgtgattcccctaagtttgtaatcatctcctctacagtgatcattgccggtcggcgcccgtggttttttcccgcatatgttttccacgtaaaaattcgtgtctctgttgtgcatctattttcataacacatggctagcatctgactcgggttgatttctttcttatttgatataggaatggaagccatgaggaataaaagcataacagtcgtaggatcacaagtcactcgggtgtatcatcgaggaaggtagcagtgaaacagcacctgcagtaaagagaaccaaccacccatattactgcttgcaaacacacagtcttcaactagtgatatttacgatttaccgtaggaaatagaagccaggtccggaatggtaacgatgcaacggcatcaatttcaagcaatcctattgtaagtgcttcgatttaataattcacattatactacttttactacaaaatagttatcttaattccatgaataataaaaccagtttattcatgctttgatttaataattcacattttacagcttttactaaaagttagatactttaattattgctctttcggatgaacgaacaaattaattgcaacaatatgtcattttgagctctacctcatgcacaagttgtatttttctactggactagtaagcctgcccgtgtaatccacatagctaaaagaagtctgacattatatttattaataaataaattattaaaaactacattatctttaatgagtaagtttatctcaaagaggcaaaaaaaatgatgtaacatccatcaagttgtgactgaattcgtacttctttttttttttacgtcgggcgtgttatactatttagaaaaattcagtgaaattgaaataggctcctctaagcctaaaataatgatgaatatgctatagttaaagataacaaattaacaatggttaagaacatttcaaactggatgatccagtcaaataatatgagaagggtactaatgagagaagtgcacaaatttattctatgacaatttatataggtacaaataattttcctcctgtttggcctcccccaactgaatcatcatctacaccttgtccgctgaccacagaaagcagatactcttttctgtatgcctatgaagatatggtcagttggtcagaaacttacaatgctcaaaagaatttctatcactacctaaatcaatgaaagttggtcacaaactcaaacaatgaaagtcacgaataatgcttatatataagaggtcaaaaagacaaggtaaatggaatttgttccctatcagtctatatattaggcaatgaaataattgtacactggagcataaatacatacttgcaaggcctttaatttttatcaccatgaaaaacctgcaacgcaacaaccctttcttcttctttttttttaactacttcctgagcccttcaattatgaaatggcattatgatagtggctataaatagaggctaaaagagatcacctctgctgaggtacgtttcagtttgaaggatgcatagactatatatgcgagagaactatacgtgcatgttgcagagatcccttttctgatgtccaaactatatggatggaaatggaagtcatcaaagttttaaaaaaacaatattttgctgaagatgagaccatggaagtatgagttttatagttactatgattattatgcttcttcaatatttcttatattgtgaggtagcagtactaacggatagggatggaagtgggccaatccacgaatccacttataagcaaaattagacgggttacctactaatttgacctataaatgggttatggatcaacccccttgcatttctaggtacgacgataaactagaccacaaagcaaaaacccacgagtaaccacttatttgatatattaggtgataccacgcgctttgctgtgggatttattgataagtatatgttaaatatcgccgaaatgatgaaagttgaaatgttgagaaaataatatgagaaagatgatttgacatatacttgttgatctctataatataatattgtagatgatgtgtcatgcttacatgtgatttaaaataggctagaatagtactaattgcgaagatcgatgtggcatgcttacatgagattttaaatgggctagaatagtcattactagtgagtgatgatgtgacatgcttatatgttgagctttagcttctaataattgttagtgggtatcaactatatagaatgtatagataagtaggtttgtaggttgacccgcttgggtccctactaacggaagtccttcagaaaataaaatgcaattttcagattcgcctgctagctgttcacctatatattctgtccaaagatgcaacagagatagcatccttgttccagaatatctaatctattttgtatttgagagggtgcaaaaatggtactacagtttagcaagatacttcccattttgatccattatccaaaaaaaaaaagcatcccattttgatgagtgtgattgagagagttaaaaacaaagtggagttctgatgagaagtatatatgggattggaagctgttgggattcaattgacgactcaatcaacggaagaccatagcaagggagaaaataaacaggccgggagaagcaaatcacagaacattgaaacgaaaccagacaaataatcaacgcccattcgaaattcgccaggattttagaagcgatgggagctgaaatattttttatgtgtaatgaacacagcgccacatcatatgatgcgtgcccctctgttctcctgttctttgttagttttaaaaaacacaccttgtcatctgtgatgggccaagactctcagctgtgacgggttagaacctcgtcacatataagtggtcactaatgactctgagtcatctgtgactggcgaagacccgtgagaggaaagagttagctttgatgggccgcaaccaaaacccatcacaggtaaccttcgtttgtgatggctaatcattttaacctatcattggtggcctttatctatgatggacacacctttcactactaaaaaacgatttttcgtgacgtcgtcctataattttcattggcggtcatatgcaaaaattgccactaaaaatgtgaccaggggtgagggactacggattgccagcgaaaatcggttttcgctggcggccacgctaagacgcccgtcataaaaaatagctctattttcgctggcagcggctctaaaaggcccaccataaaaatccgggttttcgctggtgctcaattttcgctggatgcagataacagcaccgtcagtgaaataaaatttgacgctataaaagcaccgcccccacaccagtgaaaacccagttctctccgccacgtccttatcctatctcctcctcctccatccactccctctctccctccaatcctcgctccctccaaatccataggcacgggcaacggaggagtgcgctcgtgaaggcggtggcgaggcacgggcggggagggctgattcgccaccgctgggccgcgggaagggcagatccgccgccggaccacggggagggcggcaccgaccttgatgccgtcgaccgtgctgcccgactccctcctcttcgacctcaacgccgtcgaccgtgctgcccgtctccctcctctccgaccgtgctgctagatgtgaattttttttgtgcatgttgttccagatgatgcacatgttttcagctgtgtaaatgatgtttgatctgtggacatatttcattttcaaatttcctctgcgcaccagtgggcatattcatttttgcttttcaaatttcctcttcactagcagctagggcagctgcatgggtttgatttttgcttgcggtcgatttaacacagctgccagcgaaaatgaattatcactggcggtcggtgtaagacaaccgccagcaaaaatggatctttgttgacggctggcttaagacgaccgccagcgaaaatgaattatcgctggcggtcggtgtaagacaaccgccagcaaaaatggatctttgttggctgctggcttaagacgaccgccagcataaatgaattatcactggcggtcgataaccgccagcaaagatcttgatctacactggcctttgctttgtggtggctccaaattctgccagcgaaaacctaaaatggcaaccacgaaagatggttttcgtagaagtgttttgaccaacttttatttgtgatgggacataattgggatccgtcagatacaagaaaaatagggaaaaaattaaaaaaaaaagctatctggttagctagtcacaaactttcatctgggaatccaaaataaaaaattcataataatcacattcacattcatctaggcacaaaacaaaatcacagtcacattcacattcatcttggcacaaaatagaatcataaaaaaaaaatatagacactggaatggaaagcttatgctgttgatggacttcactgcggtggtgcatctcttgccatgcttgacgctggaggaggagtgggtcgatggccatcatcgtagccgccaccgcggcctctgaactcgaggagttcagatcttgtgctcacgagaggtggcagcgactgcatccaaaggggaagggggagaagaatctgtcatgtagctatggtagagctcatccggctgttcttctggtagagctcgagtggatctggaaggagtagaaactagtggagatctgctcgttgttcaccaccaccagatttggctatcggtggttggatccgcccaaaaggcggttcggggtgttcagatcccaaggccggcccagcactagctgcggaggcagagaatgggtctatgatgctgtggagttgtgcccctccaaagctcgtcactatccacgccagaggagaggtcaacagctgcacaaccacggacgcttccatcaccggtccccatggtggatggccaaatctagctaccatgaactctgggaaaagcttgatcccacaatggtcggcccgagagtggagatggaggtggcagccggcactccgtggcaaaaaaatgcagcctctagtgcgtggttaaagacgtatgtagaggcgtccgtcgagctagggttgcaagcgcttggtgaatcaaaagagagatgatgttggggaatcaaggttaggcacagtcagcaggagcaaatagataagattgaacttgttaatagtgatgggtaaataaaaataaaaagttgtttgaggggaatcaaggtttggtagtattttcaatccgttagagataatagtgctcatatgtgataggtaataattcaacatccgtcacagatgaatcttcacctatgaaccgaaagatagcatcaatgtcaggtctacacattaactcgtcaaagataacgtaacacctatgacgggatgtatcatccagcctcatctacaataggttttattttagcccgtcaatgataaagtcctgtgtgacggggcaatctggttcgtcacagatgggctgtcataaatgagtggacgcgctgtcctttaattttgatcactgtatatgataaaactgtaaggctgcaaccatcctttcctcttaactatttcctgagcaaaaacaaaattttggcccttccactatgaaatcacacaatgacagtggatataaatagaggctaaaagagatccctgtgtgttgagactacgtataagagaacgatatgcatcttgcagcctccatcgtatatcaagttaacaactgcgataaatcatcatatgtgatccgaacccatcttgattctctttcttatatcatctatgaattaatggaaatggaagtcatcaggaaccaaagcataacaccgttgctatccatgccaaccagaaattctctccagtggagccatcatctaggacgcccccgaaacaccgggccacttttcacggtcgacaagtcaggctgctacggtgatcagcgttggaggaggttaatctggttaacgatcatgctgtcgtcgctaattctctcctgtagcactactacagaaagcgtttttgcatacgggcggaatcaattttcacatgcggttggccggcccgcatgcgtgaaatggtctgcaaagatcaccatttgcgtatgcggccgtcgcagccgcatgcgaagatcgatcttcgcatgcggtcacttaagacggccgcatgcgaaaatagatcttcgcatgcggtccatctaagaagccgcatgcgaagatatattttcccatgcggtcaacctaacaagaccgcatgcgaagatctattttcgcatgcgggcgtcttaagtagaccgcatgcgaaattcaatttccgaatagctaaaataatatttattctagccttttagtgagatgtgtctcgtaattaatattaaattattgagggatttattatcgtatttcggagtagtaagcatataagataagacaagtgccgcagtaacaaacatgtaatacataaccattaattcaatcgtaatttacatacgaaatatataatacaagtggcacagttttttcatcatatgtataagtagtgtacatgttattgcatatgttctttctcccactctctgagaggtttaaatttgtcgtccattgcgagttcactctggctgtcgtagaagagacctcttgcgtcccagtcagcctgcgatatatgtccataatccgtaaatggtgggagcttcttctgaacataatcccgatttagatcggacttccactgtcgccatcgatctcccatctttttaagtgcgtaatctctccccctgacctctgatctaggagggaatacaaaatacttctgcaactcattccagagaagtgtctttatgttgtcgtctaccgtttcccacaactttacattaatgggacaacacgtcctgactagagtgccacaggcgttgctgaacttggaccgcactatcggtggctcgacgggcttcccatcctgatcgagagcaatcacgttgtaagtttccttgggtaatttattcttgcttctctcaccacgtctttttttcccactcccgcctgcacttgtagatgtctccgtacgttcaggtgcagacgtagcggtatccatctcaacttcttgctctgtcctgttcctcccggctttacgtttcgagcggcgtcggactaccatctgcacagaattggtaactctatacaccattaggttcatgtcacatcatagttagggaataatacatggctaacgattttcagcacttacgccctgttcgataggtatgtagtccggatcatcatcgtggggggcgacttgtgttatttccattggaaacgggtcacttggtgtgcgccacgtttcttcactacaaaagtctagctgcttattgctaccggaattttgaggagcgttaccttcttgaggcgctattggtgagttcgatggaaccttttcgttcgacatcttccaacttgacgtaaaaaaatttgacataagtcccaattttactaagtcccaatttaacgcaatgtcacataagtctcaatttgacataagtcccaatttaacataagtcccaaatatacataaatctcaatttaacataagtcccaattatacataaatctcaatttaacataggtcacaatttaacttattttcacataagtcccaataacttaatttcacataagtcccaatttaacataattctcaatttaacataagtcccaatttaaacataagtcacaatttaacataggtcccaatttagcatcagtcacaattaaacggaaatctccatttgacataggtgccaatttaacaaaagtcccaattatacataaatcccaatttaacataagtctcaatttaaacatcaatctccatttaacaatctacaattaaaccttctcaaaattaaacaatcaacaattgcacatatcacaatccacgatgcacaattaaacaatccacaatccacaattgcacatttcactttttttttaaagtaaatgttaccgagcgacagcgagggggtagaagtcctggcagcggcgtcggcgacggcgagggacggggacgacctggcggcggcgatggcgacggcgaggggggagaggtccgtgcggcggcgacggcgacgacgaggaggtagaggtcctggcggcggcatcggcgacggcgaggggcagggcgacttcggggaggagccggcggtggcggggacgacttggcggcggggacgacttggcggcggcgacggcgacggcgaggggggagaggtccgtgcggcggcgacggccacctggcggcggcgacggcgacggcgaggggggagaggtcctggcggcggcagcggcgacggcgtggggcggggcgactttggggaggagccggcggtggcggggactacttggcggcggtgacgacggcgacggcgacttgggaaattttggcagcctggcggctagggtttcgcgggcgccaggacttagaaaattttggctccccgcgctccctatatataggcgcagatcatcgcatgcgggcggcttaagggaccgcatggaaaaaatatctttccatgcggtcgacatatgccggccgcatgcgaaaattatctttccatgcgggctattaagccagccgcatgcgaaaaagatatttccgtgcgggccataaagccggccgcatgcgaaaaagatctttccatccggttggcttaagtcgtccgcatggaaagatctttttaccaaaaaaactcatatttttttatttcctctaagtaaactgtacatatatatttttttcccaatatttcgccacaattatacattccaaatgtttttggcactaagaaaactcatgaaaattgctcaaaactcgtaaccaaatgttacatgctaatgattacaacataagggggacctaaattcatgcacgtacatttggaacacaatgagaactaaaggttacgaaataactatgacttaataaccttggcaacaccatctgctcgaacgtacgacatattcacttcatcgattgttcgctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacttgagccacacgctctgctaaaacccatggatcatccttgtggcctattttactgtgatcgactatcgttagcccgtagtcatcaacggaaacccctgttgtgtctttaacccattcacaacggagcacagggatctggatgtttaggccatagtccagttcccatatttcttgaatggtcccataatacgacctcttttctccactcgtgtcaatcgcttcgacacggatcccactgttttatgcggtgcttttcatgtctttcgtagtcgtactcaaggtaaatccaatgatgtcgtaaccttgccatgaattgacaatacttgaaggcccacatgccagtctttgtagagtaagttcctccacagaatcaccaactggtaggtttagatctttcaaccccagaggaaagcgacgcttgtgctctcttgatacccaatcattggaccgccctgggaagcaggctttgatttcttctaggtgtcgctcaatgaatggctcaacgatagcgagctgttgaagaacgctgttgtgtgctgcggacacctttttgtaatcattatcgaagaactgcttcctaccaacaataccccttccagacaatctaccttcatgtcaatgaacaggaatgccaatggcattagcatcctttatgtagtccatacaacactcgactgtctcttcagttgtgtatccctctatcattgatccttccgggtgagcgcgattgcgtacatagcctttgaggatcgacatgtaacgctcataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctgaagcggacctaattccagaggatcaaataccttctgcgaaattcgattgaaaaagtcatggactggtttgttataaccacctttgtatggactggtttgactgcccttatagcaattggtaggaataccgttagcagcctatgacagtcatgcgcattgtatcccgaaatggtcaaatccttcatggatactagcttcctgatgttcgatgcgaaaccagtaggcactctaaccccttgtaaacatttacagaaggcttttttctcttcaagtgtcaacgagtaacaagcaggaggaatctcggtcttcccatttggcagcactactgggtgaaggtcatgccgtatggacaaatctacaaggtcattacgtgacttcaatccatccttcgttttactcgggatgtccagcaatgtgccaacggtgctatcaaacacgttcttctcgaggtgcataacatcaattgcatgtcgaatctctaggtccttccagtaatctaagtatttaaagaaaattgagtgcttcttgaaaggcgacgcagtaccgttgtcaccatcagctttcttccactttactgtcttcttctttccctttccatatacaaccttaatcttctttgttatctcatacatgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtacgaagttttctccagacatatcagacatccagtcttccctttaatctgcccagataatgaaaagtttgcaggtaggtcattgatggtaacgaatatgatcgcacgtagattgaagtgctcccacttaaactcatcccatagtcgtaacccctctttccaaagctcctccatgtcctccatcaaaggcttaaggaaaacatctatgtcgattccaggttggtttggaccttgtatgaggatagtgagaagaatgtactttcgtttctgacatatccatgttggaagattatacattgtgagaaggactggccatgtgctgtgcgagctgcttaagtcaccaaacgggttcattccatcagtgctcaacgcaaaccttacattcctaggatccttagcaaattctgggtgttttgcatcaaatgtcttccactggcaagcgtcggcaggatgtcgaatcataccatctattttccagctctcttgaggccatctcatcaactcagcatcagtcgggtttgagtacagacgcttcaggcggtccttaattggtaggtaccacgtcaccattgaaggaatcttcccgcgcttacccttatcagaatctggatcagtacactctgaatctacgggcccattccccgttttataccgacttgtgccacacgttgggcaacattccaagtccgcgtattctttacggtataatatacagtggttcttacaagcatgaatcttttctacaccaagagataaaggacatatgagtttcttcgcttgatacatgttcgatggtacaaagttaggcttaggaagcaacacacgcaataaactcttcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcctgccaattctccaatcctcgtgacctgcccgctagcacctctggttcaacatggcgtagcatatcctctaaatcaaaaccaccatcgaaatcatcactatcggtggaaacatcgacatccattctttcacgcgacatgtcttcgattataaaattctctgcctcatttatctcaaaacttaactcttcatcgtcatcttccggattggcgaattccccatgataggtccaaaccttgtagttggcggtaaatccgtactccattatgtgacccaatatttcaccaggatctaccaacaatttctgattcttgcaatgacggcacggacaaaagatctttgtcatattctccctcaaagcatgcgccttagcctgatcaataaatttagatgcttccttaataaatatcggttgcgttctccgcatctcatacatccatgacgaccgatccatctaattatataaaggcaaaaaagttacagataaaaaaatagaccgcaggtatttcatacaaaagtttaaatgcatttgtctcccaaaaaaaattacaacaatacatgtaactagtatgtacaagtgattacatgcaaaatttgcccatcaaaacaaatattttgaagctagattttgcaaaaaatagttagaacaaaccttgtcaaaatattaaaaaaactccactttccaccaacgaaatataacaaaaatggagccaaatgaaggaggatagagagttcttcacctttcgtatagagttcaagcaaaaatttcgagttgaaaacctccccccctaattggtgcttgctttaggagagagaaagcttcgttttcaaatggtcaagctcgggcctggaggagcatatatggcggatcttcgcatgcggctaatcgacccgcccctgggggggcggtttttgcaggcgccgccacaagcggcccgcatggaacctaccgaccccctcgtacagaaaaacgaattttgtagtagtgtcgtctgcacttcatctcatataccaaattcgcacctagatcttggatttgagaatcaccatacggcctgcttggagttcaggagattcctaacttctattgttacaaaacgaatcgatgagggataaaccctgtgtatatatgctgtagaagaaccggcacgtgctcaaactctgttctgagttcaatcaaaatgacagatgcttgaaatctgaaactgtaattctgaagaaattcaaagaaacaaaaatatcagcagtagtcataaatattagtctgtactatggagtttggaccttgacaaaatgggtttgtttattgcattgttgatcaaagagattagactataacatagaatacgtattgaccatggatatcccaaccaatcaaaacatatcgaatacaatacaaacttatcaaaactgtcctggcctatctttttcgggtatcatatccattcaatgtttcatataagagtttcattgtccatcagaaagcaccagtgatacgtactaaactctatactaaactaaatgttttggtaccttgagatatatagtatcttaccaaattttacattagaaaatatggtaactgatcctgatacgatctcaaggactatcaaagtactcttacttgtaagataacatgcctattcaatgccaatcagaatatatattggacgcaacaaccgacatatgtgagcatatgaatgctcagagatggacaagaaagtgcaggctctcgctaccagaaaagagcaacatctatatgtcgtgcaaggacacaagcacatacagtgtgggaatcgaaggcatcagaactacaggacagtataacatagtgcgagacatctttgctttaaaacttcgcgatattctctcgcgtcgccctccccaccggcgacacaagaggcgacgccgccgccgtcttcttcctcctccccccctccttctctgcctcgccgccacctgagcgggtgccggcaaagccgcgcggccgcggggacggcggcggcggggcttttgcccagcacgcgctcggcggcccggggagctggccgggcggcgacggtagcaaaccgtccggatctgcacccgcccggccggatccggcggggtggcgcttggtggcggggcggagtggtggcggcggcggctggaggtgcgtggtggtggtggacagggccggcggcggcggaaacccccgcccagatccgcgccgttttggccggatctggtggggctaacgccgggcgacggcgggcggcgaggaaacaggcgtgctggcggtggggaagaggtggcggcggcgacggttgcgcgggtggcgcagctgggcgaggtcgcggcgcggccgggcgcgtgtgagcgtcgccaggcggcgattgaggccgttgcccggaggccagtgaggatggcgatggtggccagaggtggatcccccccccccgagggcggatccggtgcggggcaagctcgcggcggtggcggcaccgcggagctcgcggtgacgtcggcggtggcaacggcgcgtgagcacggggcgccggcgacggtggcaatggtatggatttcatggcgacgatggcagcagcggcttgtcggcggcgaaagcacggtggctggttgacggcattggcggctgtcggctactatggcattgcggccctcgcggcgaaggcagcggcacggaactcgtggcgacggttacggtagcggctgggaacggtgatggggctgtggctggccgacagcgaggtggtgtcggcagcagcggctgtggtggtggtgggaggtggcatggtggcctcggtcggctagctgagggtgtggcatacggttgtatctggccagcgcgggagagtacggaggtggggtcggagattggcttggcgcagagaggcgcagccgatggcagcggaggctgactcggtgcaagaggcgcgggcggcggagatggaggccgatggagggaggccggattggcgcgagaggcgcgtcccgtggaggaggccggtttggcgcgagaggcgtggccggcggtggaggaggcgaccctggtgcgaggaggagatgccggtgggtgtggcgctatcttcggcgcacgaagcctagccggcggggggcaccagtgcagggttccccatgtcggcagaggctgagtggtggtggagcatcggtgcgttagccctggattcgcaagcgtgagcggcgggtgaaaacccagcctggccttggtcgggccgacaacaatggttttccccctcctgatggcgttgtcgtgctgtctcacccctcaagggcggttgctgggcataagcccagtcctggctcttttgagccccgacggacggcggcggtggttttccatcgcttttcttcttgaagatgtcgttttggcaccccctagctgtagggcgatctcgtctatgttcctttattggtctagcggcggccggtccgatgctagcctcctcctggtcatgtgtgttggcgctgtcggtgtgtgggaggcggtatattttttctttttcctggttatgaccctccagggttgtaatcttgtaattttttactgctttatcaatagaacttcacaccgtacttcacaccgtctcgtgcgagtcgttcaaaaaaaaaagaactacaggacagtcattccggctaaatttgttttgtgcgtcatctgcgggatgtccaagagcttcctttgttttaatcgtgtccgtagattagtcgttggattatacgaaaattgatacaattctcgtctcaataaatttagtagatttatctatgcatttccacaatttataggacacctctgagtatttgtcatcagtatcaaagtaaattgaaaaggagcactttcatgaattttattaggagtcaatatatgttttaattaggattgaaacttcatgtatcagtggataagtcgagatgatacaatcacagtgaacaaaacaaaaatttgcaataacataagatcattaaataattgattctgtagttagtataattatcgtttattaatatttcttctattgtcaagtagtagtagcgccaaagaaatcattttttaagaaaatataatgcaattttcacgttcacctactttcagaatatttctctatttgtatagtaccttctaagttccattctttgctaatcccttctgtacttgagacggagaaaagatagtactgtaacgtttaggatgttacttgccactttgatgtttgtgaatttagacagctaagaacgaagttgagtactgatgagaagaatgaatgcatgtatgactattttttttaacttatactccctcgtatttattttaatgtatgacgcgttgacttttttatcaacgtttgaccaatcatcttatttaaaatttttgtacaaatatagaaacattcatgtcatactgaaaaacatttaatgataaatcaagtcataataaaataaataataattacataatttttttaataagacaaatggtcaaacgttggtcaaaaaaccaacggcatcttacattaaaatacggagggagtacttttttatatggttttgaagttattaggattcaaatgatgactgcatatcagaagattttagcaagtggaaactaaactggatttacaggtggccaagcatcccttgacggggaagcaagagggacataagactggaatcaaagtacacaaataattaaggcccgttcaacctagaattttagaaataatgggagctcaaataatgttttatgtcaaatgagcacaactatttagaaaaggtagtgagtgtatcattaggaatcaagagtaagaaaactagtacatgatgcaactacatatcatgtattattaggagaatcaagactaagaaaactagtacatgatgcacagtgcatcattgatcactgcaaaatcactgtccatcagaagactatatcaattcagactcaatcatcttttattttgaggaaatcaaaatcatctttgaaggtgaacaagattatgtcttttgacccatgccggccagcatccccacccacatttccatggatcaaatgcaacttaggttgtgagcattttgcacgttttgacattctcttatgcgttagtttcttcatataacattttgatttttttttgcttgcataaacacataaacgcataaatgcatgtcgtttatactacctccatcccaaattatatatcattttgaatttttgcgtgcaacatttgaccgtttgtcttatttaaaaagttagtgtaaatataaaaaaggataagtcatacgtaaagtactttttgataataaagcaagtcacaaacaaaataaataataattccataattatttgaataagacgaatgatcaaactgttacagacaaaaactcaaacgacaattattttgagatggacgtagtactaccaaaaaataaaaaagaagaatagagcacatgacatgaccgccatatatacatgaccctttcttcctttttttttatctcatatcaaacataggtattggtttcttttttccttttcattatgaagaagagccagccaaccatttcttgtttttaattttctgagaaaaacacatggtccttgcatattgataaataacattgggatataaatagaagccagatcacccgtgttcagatagagttgaaggatcgaggagaggatgatgcatgctgcagagcttccattaatcaagcacggcaatcattaaacatctcacttggttgatttctctcacctactatatgaatgaaagtcatcaggaacactactactgcttctggagcagatcaaggctgatgaagtcaatgaagaagtctgtgactttactcagtcataatgtcatcagaaacactactataagctcatgtccagattcataatattaaaaatatcccatccatccaaaatcccttatattttaggatggaggaggtatattgtccaatcgtgtacatgctttttgcgagaagaacgtcaacattgtctaactcttattcgagtacaatcaaattcagcaagaccactacactgtgcactgcggcttcaactctgaatgctaattattcgaaactgcaatactggagaaatcgacgggaaaaaccaggtgaaatcttgtttaaatcatcaatatgggtccaggactccaggcctcagaaaaaaaaaagagtttgtttattgcattattgagaaaatccacttttgaagttcataagtaatatcgggcaaagtcatcaaaatgctcaacatctccctcttctcacaagcatgtccattccatggtaatggtacatatatgtgtttttcagcgagagtataactccatatactctgtacataatacacacttacacctgattgtgttcttcacataagcataaaaatatattgttggaggcatggataattctaaaatgattgggaactagtgccacgatcttatttcacctcattatttgcctcaagctttttcttatgctcaaatagttagtcgcaatgacaacaaagtagtgaggtcaaaggttaatttaccagtcatcgataaatgaaggcgtaaagagatttcatgttctgtggtggagctgaagaaggagaggatgatgctgatgattccatgcatatatagatcgagcatggtaaccatcaaattcatcgtattcaactcatcttgatttctttcccctatgataatatgaatggaagatattaggagccaaagaattaccaatgacttgatgatgttgtaaaatcaaagtgagtttgattcttattctgtgataaacaattggcatttaatatttggaaattattggcaaagtggttttggagatgattggattttataggtgactgacagggattgctgtttgtcgggaccggtcagaccgggtatgggttgccggtcagaccggagtgtatcgagcggtcagaccggcctgcccacagtctgaccggggcgactctgtgttagttacaatttcgggttgttttattggatatccatgattgttttatgattatggcttctagatggatactatacgcactacaacaaaaacctcgtatagaggcactttcgtagaggcgttttgtaaattgcttctaatatcataagttttattgtgtagagacactttatagaggcactttaacaatttcctagaaaaacttttgctctagagatattttcagctcagtttattagattttatctcgtagaggcattctttcggtactgtaaaatatgcctaatatgtaaaggtattttcttgagacattttaaactatttagagacactttttagaatgataatatgtactaaaagactaaatataagtaactaaatgcgcaaacatattagtaatgacaaggagttgagttggttagttgtcacgctctgaagttcccctccttgctttaaaatttgttaaataaatcgcccgaagaaattgtttaaattaacctggcgttgaatccaaattaataaatgcaaaaaaaaataatcgaaatcggcatgtggaatttttcttcgattctacgtgtcaaaatatgctaacaggatctttagtggaattttcagagccttggaaataattttaaccaattaaaataagcaaagtacaatatttaatccgtgggaaaatcctttttttcccttttctcttttctttttccctcctttttccttctcttgggccgccggcccatttcttcccgcgccggcccgctcctccctcccactcccgaagttcacccggcctccctctccctctcgggcgctgacaggtggggcccacctgtcagccctttccccaacctctagccgctcccccaagccggcaaccgccaccgcgcccacgccgcccgccttcctcgcgcctccgtgcccccactcaccgccctctcccgtgctgtccattgcgcccgcgccgctcaccccgccgtccgccgctcgccaccgcctccggtcgccgctcgccgctactagggccgccgccgcaccaagccaccaccgccgtcaggttcgcaagcctgagggccgcctcgtccacccctcgtccatcgcaatccgtcgccggagatcgccgtccacctcgcgccggtgagcaccaccattgccgccgccttaggccatggtttccgctcacagtaaaccttctctctttctctaatccccctcgttgggctccttaggcccacccggagttcgttctccactcgtcgccgtctcccggtcgctcgtcgccgccgttcgccgtcgcctttcccccggctggccgaacccctcggtgagaactccctcctctttccttcctctcacgcgcgccgctgctccccacatgcgcgtcgccgcaatgcaccgccgcccgcgccgccggccgcccgcgtcgtcggccactgctgtcttctcgccggtcgccgccgtcggtgccgcttgccgtcgccgcatcgcctaactggcctgccggtttgaagccaagccgagccaaccggccgcctccccctccccttgagccactgccaggtggggcccacccaccagccggtgccacctcctcccccttgagccgctgacatgcggggcccgcttgccggcgccgacccccttatcgatgacgtcagccctgggaatattgcgcaataatcgaataaggacttttctttaatagtaaaaacacagataatcttccaaaaatcatatctaattcatccgagctccgtttaagtccattcaagtctcagtaaattcataaaaatgcaaagaatccattaaaaatggttttgtttcctggttcagtagactaatagcatgttttgcatgtgtgctttgtttgtcacgtagatttcggccgttccgtcgatccgcggtttctcgaagacgttgttgtggtctcatcagtgtgagagcaaggcaagtcatgcattacaattgatcatattgtacccaatttagaaatgtctctcatttctattaaatgttgcattgttttacaatatcatgttggatgggtcctactactcagccatatattgtttaccttatgccattgataacttgggtattaaaatgcttagattttggtttagggaatgcttagccatgcttagttcaactagtacacgaagggggaatcacattaatgcatagactttgattattggcaatagctttggattagtgccactgcaatggtgttagtgaattaaaatacactacattgtgggctgtgggtgcatggttttgctagtcgtgcccatggcgattaaggaccggttcgcgggatgccctataagaacttatcgtacttaccacaagccagcgtgggcaatggctgggcttgtagtgtagctttcctctagccgacgtacccaggtgagggtgggcgtgatggagttggttcagccggggtgtccagttgatcggcttccggattcaccgcggcacgagaggggggctgcccgttgcctgctggggacgggggtgaaccctgaggtgtggtgcgatcggttagagagggttatgcgaagggtcctgtcacggcctctttccggtatgtcgtggtggcatgtcggcgcacaggaacgtgtcgtgggactgtgtcttgtgggtacagttgtaaacctctgatcagagtaaaactattcgaatagccgtgcccgcggttatgggcggtcaaccagattcaccgtgattagtctcacccctagttagctaatgaactggtgtagttcaggtggtttgttgggcctgttgcaacgtggtgtggcgttggacagtgattggttaatattgattaattactacaactgttttactgctttcaactactgcttttaaatgcccgctttatgcaaaagaacctttagcctcctttggatacatcttgcatcataccttctcttccggtatgacttgctgagtacagtgggtagtactcagtcttgctctcttttcccccacaccagagttgaagttcttctcagttggggatgtctcgaagaagttggtttcgtcgctgccgtcaaggatgcctgaggaatggagtcgcccgctgcagtagtcaagtcttcaggcttagctcgcttttatcttttccgctgcatttgtaatcttttatgtttttgtaagacgtggatctgtatgtcaacaattgtcgtttgtgtaccctggctggtcctggacaggggtttaatgcatattcagcttagaaattctggttcgtgaatttctaggcgtgacattagtgcattgaagataaaattatttgttcaagaaatcttgagttcaaggcttgacaaatgcaagaagaccattttattatctttttgactggtttcataagtctgtggtacaatttaatgtctctagaaaatgcctctaccatcttatagacattttacaaaatgtctcttcgtttgtagagacaattcaccataacacaattattagacattttttaaaatgtctctacagtattgtaaaggcatttgaaaagtgcctctacagtaatagaaaaatgtctctacaaagcatttttttagtgaagtatgtaatactgttgtttgctaacaatgagtcaggttggagatagcttggtctcggaatatggtttctttgtttgattcatgtgtaggtgacttgatgcctcgggagagtattggcggtgatggatcgggagttgacttggagataaggtgacgtccgtgacggtcagatatcatgcgggatacttaggctagagtgcaatgcatgtggttggtgaatattccatatggcatacgatggagatattgtgtgcgtatgggatgcgaagtcgaatttggaaggagttcaaatttggtatgattggagtttgtaaagttggtttcttgtacgagaaggtttcctaggtggattaggacttctagtatgagtttggttcgtggctttaggctgcctaccccatgtataaatagagagggagcgtgaggcttcccggtatcgcttttgagagcattgagttgatagtttagttagggtttcgagtttagtcgagattttcgtaaggagtgctgttgttgcactttgtaaacatagagagaagtaataaagttgtcatctactttgacagatcttcaatctatgttttctcgggtgcggcggtccaaccggcaacacaccaccggtcagactgatggcataggctcagtcagaccggtggagtaacggcggtcagaccggcgatggctacaggcgacattggctaatctcggtggttataccggagcaacaactgcggttagaccgacggcttccaggcggtcagaccggctcggctacttcggtcagaccgcgatccgtcgaattgagagtaacttttatttccactaaaagttttggtttttgggtacaccaaccatttatccctctctggttggcttagttcttgtgtttcaatcctacatatgtgtgctgaaaattaagaaaacaattacgtgatcttctggtagacaaaacgactaaagtttacatggaggcgtacaatggatgacaaaattgttgtttgttagagtttttatttttatttctttttttgttctgtgaggaagcagggtacacctgaaaagcatattatatgaaaaatatcttattgatgctgatgttgatcagttcccggaacataaatttattgatgcccacgagcatggattaggatcgcactggagaaggaaatacagaggtgggagaaggaaatgcagaggtactacagtattttgcattagcttagattttaatgcgttcaacagtaaaactggtaactgttagagcactgtgctaatgaagatcattatagtgcaaggctcagatctccaaagacaacactaatacagagtacctcatatgtgccaatagagagccccttatatgtgcataggtgccaatttaaaagtatctttacccatccgcataggtgccggttgtagaatcagcacctatagagattatagatgccggttctacagctaaaataggcaattatactctttgaacaaataaaaaaacccgagaacccacccacaaattcaaagcaatatcacctcgttggggccaccatcatcacagattcgattacagaatcaatctcataaaacattcatcacataatcaaacacaagaagagggaaaatctagaggaaaaatttgcaaaaggaaatctcttaaaacattcatcacaaattcaatcacatgaagagggaaaatcacttggaccggcggctagaggccaaggcgcgcagccgccgccatcactgcttgtcgtgggcagctcttgttcagtaaccgatagggacctccagaatcagtcggattcgtggcccccaaactccaaccgacgaatctagcgaccgaggaggaggagggggacgcgcgccactttgcctgctgccgcttggagagaacaggaggaggacgcaccacccgtgacgaccgagtggtggcggcctcagcgtgcccactgcgcgcaaccgctcattgccatcgcgcccgctactgccacgcccgctccaatcgccacctgcccctgctgcgctcaatacatgatgaagagagggaaagaagaggtggcaatcgccactattcgcaaagggggccgccgctgctgcaaggagaggaggaggcatggcgtgggagtcgagaggcgataaggacggctgggcttggccatgtggtcgcatggataataatgatgcgcggcatcgacaggagtgtcaatttttaaacacatataatatatattattatagctgatggtttttcctctgtaaacgctatctatagtgtttaaggtgttggttcgatatatatatatatatatatatatatatatatatatgtttttttttgtcatgtaaaggtaggaaaatgaaccatcacctatgagccgtcctttataagaggtttataagaggttttagtagtgcatgcatcccacgaggatatataggatggtgcaaattactgtaattaaacatggttgcgtatggagattgccgatcgatctagaaattaagatgcgatctgttttgtggagtaaccgtaatggctgaactatacaatgagggtgaaatagtattaaaaaaaattatgtaagcgtgaagtgagcgtagtttaactggttaggtttcttgtggtggaaccaacgcacctggattcaaattctagatttaacatgagtgctcgcatttaattattctttctgtggcagtgtgcacacgttgtaagcgtctgcatttgtacactgtgtttctaacaaaaaaaaaagggtaagaaagagcacatgacattatgtcacaccatacatgaccctcttgtttttcttcatttttcaaaatacagtacaaacgcatatgctcataacacgtgcgtgttcacccctatgaatacacacgcacattactctacccctgtaaacatctccggaagatttggccggcctatgatttcttgagcaaaatacttgggcattccattatggcaaataacatgagcctacaaccaatcacccccatgttgaggtggagtggaaattaaaggatcgaggagaggatgttgtatcttgcagcttcctcgatcgagctcaggaatcatcatcacatctgacgatcactttgtttttctttcctatgtcatatatgaatggaagtcatcaggatcaaaagcctaacattgttttgttctcacctcacacaactattgcttcctgaacggacgcaaccccgaggtggccgcgggcagagtgaaccacgtattctggcagacaagtcagttacctacgccgtagcacttggaagagcttgggtttagcagcaattaatcatcgcgcgttcgtcgctgtcgtctttgatttgtttcatcttctcatggaattcatcctccttcatgtaatccaagttatgcgcgaagatgtattggagatgtaataataaaattaagtctctaacttctcgaatattagtaagagcgaaaccctccgcgtatttatatgttgttgcagaaaattaaaacatcaacatgtccaatcccggttttgggttcaatcaaacttatcatgatgtactgattgtattatgtaccgagggttcaaatatgaaacatcgattttaaactataatactggagaaattgacatgaaaattcaagttaagtcataaatattggtctggtactagtcaaaatgagtgtttagtgcattattcatcaaagtgcttagtgtattattcattgtatccctacggtccatcaggtataaaagccccgcaggcatccactgtccattaagctagaaaagttggacttgctaaggtttgatactaaatgtaggatcttaaagggtttttgtcaccccaaaagctagccaatgagatgagaggctccccacctatatatattagatcatttgacctttcacaaccaatgtaagactattaaaaaaaacaaccaatacaaaatgactatgcatggaactgataagaaatattgtatgaaatcatcaaaacagtcctagccttattcgttcgatgttttttttaacgataatatttccattcaatgctgattaccatataaattgaaggcgacagatgtgagcacatgaatcgtgggagttggacaagaaagtggaacatctttctgtcatacatggaaacaaacacacatatagcttgggcatggaaggcatcagaaagaactatacagtctgtggacttggcctggtgagccatctgcgggatccggcgacggcacaacagcatttagcttgcagggattagttgttgagttatatggaaattgatgcgaatatcagcatatttgataggttttatatgtgtacgagtattttgacaactataataagatatccatgtgcatttgccataattgtcactagtacaaaaaggatttttgcggacaccccaaaaggggttttctcgtgcacggtagggctagccgcacgcacaaaatggtctgtgaaagtagctatttctgtgtgcgggtggcgcacccgcacgagaaaatttaattttcgtatgcgggtgcttatgttgcccgtactaaaaaaataaaaatccaaaaaaaactaaaaaaaatcacgaaaccctaaccctgaagtagccacgccctcctcgtggttgcagtcattgcacaaagccgccgttgtcgtcgtcgcggtcaacattgtcctcgttgtcgtgggggcgtaaggggctaggggcggccgggtccgcccgctcccattgccgtgccgccatcgctcctcaccacagctagatccaccgcggccgcatatccccaccaccagatccgccgctgtcgcccatccccaccaccagatccaccgccgccatgtgtggtgagagcagccgtcatcggatccacgcgggtgacagccgccgcgccttcacaccgatggattttctgccgccacacggccacgcgggggagggcggccatcgtcggatccccgccatcgcgcacctccaccaccctgccccgcggcctgagccctccattgtcgccgctgctcgccgccgtcaccaccgtgccatcgccggagctgctgctgagagggaggagtggggagaggagtaggggagtggggagagatagagccaggagaggagaggatcgagtggagtgggtgatggagagagagaggagttgagattaaagaatggaagtgggaatcttttcgggtctttttgcatgcggatgagttaagtgccccgcacgaaaaatatccttattttcacgtgtggatattttaagcaggccatctgaaaaaaaaatggatttttgcatatggatgtctcaaggagctgtacagaaaaatgagggtcgatttttgcaaacgtggaaatttatggtccgtttgtaatctattgggggtgctcacttcatgtctggtgagtttggtttttctatttgtgatgatatcaattatatggccatggactagataaagccaaatttaacacagaagatgaagatgaatatggtctatgatgtgatagctagaaaggaatctaatttttcttggtaaaacgactatgatgatatgatagaaggtggagcactattgtaagtggagtcaggatgaagaaattgcggagatagagaagtctcttgtttacggtgagcttggtgaaggtttgtcggggcggctccatgtgagcggagaaaaaggaaccaactcaagtctgggtgcagagagatttacacatggagcaaattcgggttggtgtggcatatttgtcaaggtggagtttgttagagtttgtatcgaatatatgcacgtagtcagttactgttaaggattggagttgcattagatgtaggaataaagtaaaagtcagactatatatcctaggatctctcttaaataggtcggtggtccttttgtaaccgcatatggcaactttacatagcaagagggagaggctgttagaggcgactggccgtgagtcattgtaactataatacgctatcatatactggatcggggaggagcgctcgtaatcagtatcctgatgatataggcttcggctgaaccttgttaacagatatcatatgtcattgtcattatcgtgtttggatctcctatgacgttttgtcctcgtttgatttccgatttgattttggggccggttttataacagaagtaaatcgcagaggaggaaaaaaagattccaagttgaaagccgatcaaccaggattatttgccattcatgtaaacgcaaaggccatcatcatcgatcgatcaataaatagaggtgaaaagaaatcacatgttctgtggtggccagctgatggagttgaaggagaggatgatgctgattcttccatgcataggtcaagcatggcaaccatcaatttatttcccctaacctatgatgatatgaatggtagacatcagcaaggaaagagtaacatggtcgattgatgttacggaaagaagaacaatttccggattttatggtagacagctacgtctaaaatttttatggaggtggcaatcaaaacagattatgtcctgaagagtgaaccacacaactgcgacttaggcccgttcgaactatgaagatcatgtaaagacagaatccatggacgcatgattaagtgatcgttcaaattattatgaattttaaaaatatatctatttaatattttagagcaacttctacgttgaacgtgtctgccatactgtgtatgataaaaaatatttttcgttagagtttttgtgattcgatcctacaagtggtatcagagccttgttttcttctttggatttttatcgatctagagtttttgccatggctactcccgctaggttttcaactaagcctcatgtttctgatggaacggatttttctcattggtgtagtaggttgcaatcttacattatggctgaagattatgatatttggataaaagtttctcatgcttatgtaattcctgaagctattaatactgctgctgaaaaaactgcttttgaacaaaattgcaaagctcgcaacattcttttgagtggtatttctcgttcggattatgatcgtgttgctcatcttcaaactgctcatgagatttgggttgctttaagtaattttcatcaaggaacaaataacattaaagagcttcgtcgagatctttttaaaaatgagtacattaaatttgagatgaaacctggagaagctttggatgactatctttctaggtttaataaaattttgagttatcttagatctgttgattcttcttatgatgctaattatccataatctgagatttctcgtcactttttgaatggtctcgacatgtctatttgggagatgaaagttatatctatttaggagtctattaacatgtctactttgactttggattcactttatacaaaattgaaaacacatgagatgaatgttctttctcgcaaagttgattctaaatcgagtgctttagtttcttcttcttcctcttttgatattgatgcctcttcatctaagtcgtcttttcttgctgtttttaatgccacaaccgatgatcaactcgaacaaatcgaggaggaggatttggctttggttgctaacagaattgctcgagctatgaataatgccaggaacaggaaaagaggtagtccaaatcgttgctctgaatgtggttcaattgatcatcttcgttcgcattgtcctaagcttgggagaggcaaaagagaagacaaagatggtgagaagaccaacaataacaagcccaacaacaacaagtcgaagggttcttaccaagggaggaagatggagaatcttaggaaggctattcaacaagtttgcgccgcctttgagccactaagtgatgtagatggtgaaagtggagatgatgataagggaaagaacgtctccgatgtttgcttcatggcgtgtggtgaatctgacacagagtatgaagacaatgaggtgagtgcttttgaggaagctattaacattttgagtgcaaaaaataagaagtgtgagaagatgtatagaaaataggagtttatcattgaatctcttaaatctgaaattgataggttaaaatctcttatttctaatgatgatgattgtgaaaattgtgaggttttaatgaatgagatttcaaaaattagagttgttaatgctgcacatgatttgaaaaatagatcttctcttgcttgtagttttgctttgcacacacgcactttggatgagttgtttttaactaaaaagttgttgcaaaaatatcaaattgcttttcatgctagttagtttgatgtttaacatgatttctgctaaaaagttaaaataacctcatgatgttttggattgctcaacatgtaatttgaataagatgaaactaaaagatgctttaggtcgtgttgagtacatggaagatgttgtgaaaaacaatgaagtgctttcttgccctaaatgtcgtaaaagcaaaggtgtcatggtagattgtgaaaattgtgctaatttggaaaaagaggtttcgtatttgaaaaattctttgctatgattttctgatggtaaaaagaacctcaacatgattttggatcaatcaaaggttagcacacataactgtggtttaggttttaatccttatgctcataattctagacatcctcctgttgtgttaggtgttagtgctagaagtagtgagattttggttaaacctgatactaacaaaactgtgtttaaatctgctggtatcatgtctactatgaatgcatcttcttcaaaatccaatgttatacatgcaaaatctcctgttgttgctcatgttgctaaatctactaatgctaccaatgtgcctaatcatcgtgaaaaatatacttgttctttttgtggaaaagatggacatattgttggtttttgtttcagat

SEQ ID NO: 46079 - DNA, 1284 bp, Oryza sativa
tgcatctgggatgttgacgggagcagaaacaggtatgaaacagttttaaaacttacaacaaagttcatagttctttgtggtttccaatgttcatttttgctagtgtttctgatcaggccagatttgctaaatggaatggaaaaccacggagtctgcatctctcttgcgtgcaatcctccatcaagtgatctcctagtggcttccttccggccaaaagttgagctgtccgacgacggcacatctcaagccggcaaatcacagtcaccgacaccctctgcatcagggaagctaggctgccatgcactcataaggaggacgagcaacacgtccttcgccagagaccaaatctgcagaggcaatgtgagtggattgcgaatgtccaaatccgcaatcatacccttcaccggaagaagcaatcagcaacatctcttcgcctatggcgacgagtcgctgcgcggagtccggacatggcggctgccttcactccagacgtttgctgatctcaggccacaccggcaaccgatccttgatctgaggtttgcagagagctcgtcgacaggggaaaggtaccttggatgcttgagcgaggacaggctgcaggttttcagagtaaggtagcccgtagcaacaacatcagagacagtcatttgacttcagttcattgtctctgtctgttagcagctgttccctttgctgctgtgttatactatagtataacacatcagcactttggttaggtttgttgtacaagcacaagcaagtcttgcaatctttctctgtacagtactgatctctagagcagatgtctagtgcataacatcatgtgtgatttgttttgggtgataaaaccatgtattaattttgtactagtatcatgagtggttgaatctgccacaaaaatcaaaggtacagttgggtagtgatatgtcataccattgatgctcagggcactgatattttgtccagttcttatcaaatcataatcacctcatctgtcactgtattgtaccatcacaaattcatgtttgctctttgtgtaccttggcaagttcggtggactcagcattctcaagtctatactcattcctctaccaacacaacaaactagtcaaagagggttgatagcatagtacaactagaacttcaattctgcaaaatagacaaataataatctgtgatactgcatcgcttcaaagttgataaaacacttacggggctcaattaagctcatgatataactaatgaagaataaagaatttgatcaacttatgagacagtaaaaca

SEQ ID NO: 46080 - DNA, 722 bp, Oryza sativa
ctggtactgcgcgcataagctgttgcgtgggcttaacgaactaaactaaagaccaggcctttaagcaacccatttaaatgatcttgtcatgggctcatggccggtatcaggtgagcccacgtatagcccataaagaacggcccactcaagcaaaatcagcaccatccacagtccgttttacaatcatcaggcccgttatggccctgtatattcgaactacaagcccatcatgggcccaactttgcccttatatttgaagaagaagcccattatggaaatcagagacccacatttggcccatttatgatccgttcaaacccatatattcaccgaagtaggcccatgttgataacccatttccggcccatattggagcgtttaggcccacttacggcccattggcggtgtgttggaatatgtaggcccattaacagagttttgtacgactgttttgcggttggaataagatcactttgactccctcaactgaccaccgaatctaaatcgtatccctcaaccgcaataccagaaatcttgaccccccgaacttgtaaaaccggtgcaatctgactcccttggtggttttggatggcggtttcgctgacgtggcgcacacgtggcagtgttgacctggtctttgttctacgtggcattgacgtggcgtttatgtggcattaaaataaaaaaatatatgcggggcccatttatcattcacacaaaaa

SEQ ID NO: 46081 - DNA, 2176 bp, Oryza sativa
aaatctatgcatactattccaagaacaaaagacatactttaagaactatcactccatagtcagcatttgcaaaactagcatgcagaattacacggtcaggcaccaaaaatagagacatgttggaatctgatttgcagatctaaaggttctgtaagataatctaagatacaaataaagatcagacacaaaacatatgtactttaaagacccatcaacattacattcgcatagaacgaatatcccaacttagacgcaaacatcaaatcatgacattcattaagaacatgtccaattaacaagttaacatcaataaaatagaacagcaagctgattcccggtactattggataaaaaagaatgtgtaattgagctgattcccgatactattggataaaaagaatgcgcaattgtgttaaaccatgtcctgtcattatgaccctaacaaagtttcccttacccctggctcaaaattacaactaagattacaacagcctcaattgaatcactatgcggaatgttacaagttacaacaagaagcaagctcataactaaattcaattagctaaacatctgcaggagctgacaccctatttggcagatatgtgataccactagatgacgagatcatagctgatataaaaattcaagtgttaataagggaaaatacaggcaagctcacattgaagagatgatggtggattagctggaatatctgacacaaattgctcaaaatttatagcattagaacaatccacattactcagtggaaggagtataccaaatactattgcttaaaaagaataagtataatcgtgttcaaccgtcactcagtcgttattccctagcaaaatttcgtttgccccctggctcatggtactactagaattacaacagatccaattgaatcactcatctgaaatcccaaaaatccatttgggcaatcaaatctatctgtgcctcagcgaatacgcacttaagatctagatcttaaaagcagaatgcaaacaaaaccttatgagctcgacttggctccatccaaagcaaccgcggccgtcgccgactcttgagaggcagcggcggcggcggcggcctcctcctcgagcttcttcttgttgcgctcgagcgcctcgccgacctccttgggcatgtacttctcgtcgtgcttggcgagcacctcggtggcgctgaagaagcactcgcagtcccgggccttgtccgagaccttcctccccgcggtgtctcggcggaggtcgtcggtgaacggcttgaggaagccctcgacgacgacggagtggccctcgcggaagaggtcgggtagcgcgccctcgtagcggacgaggacgtcggtgatgaggtcggtgacgacgaactcgatctcggaggaggaggcggaggggtgggcgacggagccctctaggacgagccccccgaggcggacgcgggacttggaccggtcggtggcgtagcgcgcgagcgcgtcggtcggggtgaggtagaagacgagctggtcctgaaacgtggcgagcacggtgaccacgaacccggccgcgcacccgaaggtgagcgcgtacgtccacagtcgcctgctctgcagctggcgcgcccgcgccccgatgtccgtcgcccgcggccgcgccggcccgcgccgcgccgcggaggagaagaaccgcgcgggccgccggaggaaggaagccaccggcgttcccccaacctctccggcggcggcggcggcggcgcgtgggattgggacggggctgggcgtgtggaggagggcggggaggaggcggcgggaggagaggaggcgcgaggacgccatgggtgggggatctggaaggtgcgggaagcggagcggaattggggaaagaggcgaggcgagggcgaggcgtgcgcctggtttggcggcggatcggcttgctgcccacgccacggccgcacgccggagcaagtggggggaggtcaaaccgtcaaagtgggctggctcttccgggctgcggcgtctctcagggtgggcccaacccaataagcgttgaccagggtctggtttgaactgcagtaatctgaacgaaattcgattgaaatgtttcagttccggtatagtttgactaagaccttgtttagttgggaaaaaatttaggtttggttgtcacattggatatacggacacacatttaaagta

SEQ ID NO: 46082 - DNA, 939 bp, Oryza sativa
aagatgtaaagagtttttagtaatcagtaataattcagtaccccgtggtgtgcctgacactacagtggggtagttaacttatgctatatctgatgaaattgtccacaaagtggcatttcagtccaatacactgtgacgaatgatctcatgaggcaaaatagaccaaattcagcattggagatcgactgccaacattgctgatcattcaggaagcgagtagagttacaactcaggttcttcaggtgagcatgtgcctttgcaaggggcatcagtgcaccggcaaacgggttgtcccgaaagctcccatccattgaacccacgttccagcaccatgatgttctttgttcctgattcttccttggtctcagatagatagtcggagaacatcttggcacacgatggacctcgcacctgcagcgtgatttgatctcactgtgtaagaaatatgcacttttgcatgttatctcaaataagaatatcaggcgggagagcacaacgatatgcttgattattatataataatgagctaaaaagagattagaaaacttgccctttccatctgctattaataaatgtgctgttacaatataataaaaaacatgagctaacgcaatcagcaatgacgacagcgttctagatgcaaaaatcgaacatggtaccaactcagtggatgtggacaagtataagttaacaaagaacactctctattattgataatattagaagataatgcaatgcttcaaaagtattaactggggatttccaaaatctttactatagaaagcatcaaaatcagagtttgaaagactatctgcttgaaccagaaataggtagcctttcatttattttagataatggatatcaatccggcctctacatccctaaaggacgtgaagcacatcaaacagaaattgaccccagaaaggtaagtctaagtca

SEQ ID NO: 46083 - DNA, 966 bp, Oryza sativa
cctctattttaaagaagttatagcgatatatttttcttagataatgaaacttattccgacttttgtttcaaagaagttatacccagttatcacaaaagttacaggacgaatgaatgcggaatatatattcacggcttgattacaacgacaaaactactgaagagactatttctcgtaaaaatattgtttcatattcggaaaagttccatattatatcgctcaataatgatcttggtctagttttcgtcttaacgtgaaaatcgtctcaatttgatgatttgtcactcactacggagatttgatgatctgtcattctgattttgatgtcgttcactcgaggatcctacgtgttattgtcaggggatggcatgtagtagtagcaaagagacacgaatcatcaaatttgactttctaacttgttaacggaagatcaaacggcaagttttgcaacttatcaaggcattgtagatactattggaggtagtgacatgacttgcatgaagaagtttacgttaccagctggccataagtcaattggtatgaaattcaacgtaggatactgttgtagggtagacaagaaaatactaaaataattacatgtgtaatttattttccaaatttccaaatctttttaaccaatgtcggtgtgcatgagtttgtcgacaaatccaactcgtttgtagctttgctgcttggttttcgactatacgtctactatccaggatctaataattgactttgtattacgaattgtgatgccagttcacgtgttgaatattaacttgtactgatttgaaataaaattgaaatatcttgtgataaatactagcatatagccggttagtagcgaattagtgtctagttagcggattgcggatagcgggcactaaattccaatagcggatttttttcaaataactataaatttacattgtacatcaagtttaactaaaaatttataattta

SEQ ID NO: 46084 - DNA, 1370 bp, Oryza sativa
ttgtacaaatggacaaacatattaaatatgtttaaaatactttcgataaaagatctagtcatacccttttccaatttacatgtggtatatggttacactttgacgtatcttaacttacgtagttttgactaagttatccatacgtttgatttattgtcacatttatgacaatattttcttttcaacgtcttaaatccgcacctcattgtctaaaaaaaagattgtagtttgctagcaaaagtgtggtatcaaatttgactatctaactttaggcaatcttaaaaagaaaagctatggcatctctaggcaatgttagtattggaacccgtacgcaactaaataaataaatattattgatcaaagttcgagaaaaaaatcaattgtgtcatatatgaaaaaaaaatagaggttatatgtgtcaaacatgtaaaatcacagcacaatataatggcatatcgcgtaataaataaataaataatcccctaaaagagatgatgaagaaaagaaggccactccaactagagctaaatttacaacctcgcaaatacttcatccgtttcatattataagactttttagcattacccacatatatatgcctagattcattaacatatatatgaatgtggataatattagaaagtcttataacctggaacggaggtagtacgtatcaaaagtatagtagatcgtgtgctgtaaaatataaacaaatccaatccaaactaaacgatcactttggtcggacacggaaacatgcatgcatttggttgcctcacgagatctcgacgtcgcacggcacgctgttgaaggaccgcgccgccgacggcgacaagccgatgttcaccggcgagcaggtcacattgacttggtagtacctggaggcgacgccgccgactatgaaccggacgcccgtggtcacctcaacgtccacgctcagctcgccggcggcgaggtcgtgctccagctcccaggcgaccaggtccgtgaccgggaccgggaacggcgccgagcgcgccacggcgcgcaccggcagcgtcgtctcgttgcggtggggctggtggaaccccggcacgacgtagccggcggcgagctccagctcggagccgccgtagagcacgcggagcgcgacgctgtcttcgtagcgcatggagacgcggcggttggggttgtcgatggcgagggcgaggtagaaggtggcgttgacggtggggccgctgcagcccgggcggcggtcgcgcggcgtgacgttgaggtagaaggtggcgttgacggtgggggcgctgcagcccgggccgcggtcgcgcggcgtgacgttgaggtggcgcacggcggcgctggtgacggtgtactcgatgggcttggggcgg

SEQ ID NO: 46085 - DNA, 3439 bp, Oryza sativa
ttgtgggtctttttactaacgttcattttatttaaaattattttataataattatttttatttttattagatgataaaatataaatagtattttatatatgacttgttttttatttttaattatgttttaaaatgaaatggacgattaaacgtttaacataaacttggaatgagacggatgagtaatatactgcgagtttaggcgcacgggcggcgggggtgggcatccgatgcggtggggttgggggtggggggcaagcaaagactggggcaagtacagtggtgtggcgccgctccggaaattcgcttcgcttcgcggcgcggcggctgaggatcagcgtcagccggatgggaatcccaggcgtggaagcgcgatttttaatttgggcggcccccgaggcggtatccgatgatctccttgtcggctacccgcgtcaaacacactggtatagtgcggctaggtacccaacttttctgctgttttacacaacggtccttcctctatttgactatgcctacccgtatggtagcaacttatttcctcctattgtagtaattcttaacattttcaataatgatactgtctctaaaatatatctttaacaaattttctattattacagtactttgtaaaataaatttatatgttgttctagtacctttcaactatatatttttcaaagttatttatagtaaagttataaaattttaacctcaactttgggtgtgtttagttcacgtaaaaattggaagtttgattgaaattgaaacgatgtgacggaaaaattaaaagtttatgtgtgtaggaaaattttgatggtcagaaaagttgaaagtttgaagaaaaagttaggaactaaaccaggcctttgtataaaacatcaagaattatagatttggagggagtactccatatccgttttatattgtgaaaaattttgggtttcatgctgtgaaacacttcaaaatgttgatgcatttcttttattgaacttggacaagaccaaaataacttatataatatactagaatagagtgaaaactgtttctacgcaaacattattaggtaccaagatgtgtacaatgtggaaagctatggtatgtattaataattcatccatttcatatgtaattatcgcttttccgtgattatctttcatgcaactttttttgttattatgtggaaagttagctttaagggcctgttcactttgatgtcattttcaaccttaccaaatttcggtaaagttaccaaaaagagtggctacatttagtttgttgttaaattttggtaactatgtaagaaatcctgcccaaattttggtaaggtattttttttattaaagtgaacaggccttaaaagaaaaaaggcttgcttatatcttggaacaaatttatactccagcaaagtcaaatacacatggatcgacctagctagccttttcatactgtgcactcaaaaccatacctttagtgtggagataacatagtatcccactacaattccactgctataaaacccctagtttattgaaataacaaaacaaagttctacaattagcaagccttaactagggaaggcaatgaaaacaaaaatcaaactacattagactaggtcaaaatgcacccacaaccacaacggttatgtgctcgagccagtatctcatactaccaatactacaccaacaccaacactacatactactactagcggcactgtacatacaaggggaataatacaagctaaaataaagctactccactcctagagaaggaggacctaaacgcaataaccaagtcaattaaacacggttggtacaaaaaggacacccgcccaatacaaaaacgccactacaaatgcaaccgcaaatgcacggccctttcccccaaaacccccactgcattcccccccaaacccacaaaccccgccgctggatcaacaccacctcaagctcgaagtgagccactgtcccaagcaaccttccttcttctccccacctcgttttctccaaatcgccattcacaacccatacacactctgtgcgcgtgtgtgtctctatgatgtcggcgtcgccggagttctacaagccggcgccggtgttctcgccgtgcagctcgccgctgcggctgctgcagcagcagcacggggaggatcatcaggaggagtacggctacggcagcagcggcggctgctgcaggacgccgacgggaggggagagcaacctgaaggcgccagggacgtgcccgccggcgccgaggaagccgcgcgcgcccgccgcgccgtgccggaagcggctgttcgaggtcgaggtgttaagcctccgcctcgaggagctcgagcgcctcttctggcgccctccgccgccgccgccgacgacgcagccgcagccgcagccgcagcagccgccgcagaagcgccggagggtggccaagctcggcagctagctagctcgccggagtagcacacgtgtgcgtggatggccataagtggtgttggttgggttagttactagagctaaagctagagtagttcggagttggtaggatttaggcgtactggcgtttttactgctgtacttgcactatatttctactgctcaaattatctccatggctagtatagctggttgtacactttgtactatacctgcctagctaaggttgctactactactactgtagcgtatcagtgcagtttatactagtatctgtgtatgtgatggcattgggggtgtgtactcctggtacgtattagcaatcaataggagcttagcttgaatttgcttccatgcatatatggcagttgcagtgcagcctgtgaagtaatgacaagttgtatgatccgtgtatacatccatcaatgtatcagtgaatcaatccttgcaacgaatacaatgagaagcagctcaatcctcatatgttctactattgcttccgtcctaaaatatagctacttcctattacatgttttctctactttgtgcaacagataggagtagttctcgaaagtatggagatactgatccatctgcgtagcaactggcaagaacgcaagatggatggattcagtttcagagtgagctgcacctcccaggcacagcacgcagctgggctgcaggaggtgcagggggagaggaatcattcaggaatgtgagacgagagcagaaggccaaagcatcgagtggtagtagcaagcagtaatgatgtgtgtcgctgctgtggctggctttgtagtagtagtagtaccgaaaatttttctgcaggcttggcacccggcaaggctgcagcaggggagcctgtgctggaggtacgagaaggaataattttggccaccggtgccagtaaatgtgaggacgtgtggtgttgggggtcttggttggggatccgagtccatctatcatcacaggagcatcgcaagcagcagctgtccatgtgttct

SEQ ID NO: 46086 - DNA, 715 bp, Oryza sativa
ccagccgcatgcgataataggtttattttcacatgcggccgtcttaaggggccgcatgtattagggcatgcggctccttaagatggccacatgcgaaaataggcccattatcgcatgtggctgtcctaagcagccgcatgcgataatggatcttcgcatgcggctggcttaagggaccgcatgcgatgatcggccatatatgctcctccaggcccgagcttgaccatttgaaaacgaagctttctctctcctaaagcaagcaccaattagggggggaggttttcaactcgaaatttttgcttgaactctatacgaaaggtgaagaactctctatcctccttcatttggctccatttttgttatatttcgttggtggaaagtggagtttttttaatattttgacaaggtttgttctaactattttttgcaaaatctagcttcaaaatatttgttttgatgggcaaattttgcatgtaatcacttgtacatactagttacatgtattgttgtaattttttttgggagacaaatgcatttaaacttttgtatgaaatacctgcggtctatttttttatctgtaacttttttgcctttatataattagatggatcggtcgtcatggatgtatgagatgcggagaacgcaaccgatatttattaaggaagcatctaaatttattgatcaggctaaggcccatgctttgagggagaatatg

SEQ ID NO: 46087 - DNA, 7123 bp, Oryza sativa
  unsure (1)..(7123): unsure at all n locations
nnnnnnnnnnnnnnnnnnnnnnnnnnnnnnnnnnnnncaggaatatttggcaatgtcagctgcagataccttggagcatcttaatgatgagagtgatcgttggacatatgtttggggcaacggtattttttcttcacagaaaatttatgccatgaatttttctcatgtctatgtgcctgtttatattaaatggatttggaagagcagttgtactatgaaagtcaaggtgtttggttggctcctcttgattgatcggttaaatacttatgacatgttagacagaaggcgttgctcccctcaaaatgcttccttgctctgtgtactttgttcaacaggatcaagggaaacaactctccacttatttttccagtgtccttttagcactcaatgttgggtgcaatttggtgtggtttggaatctttctttaagctttggtgaaatgttgatcacggccagaaattcatataactctacccattttgttgagaaggtgctttatgctgcttggaacatttggaagcagaggaatagtttaatttttgaaaacattgttccctctgttccctcttggagagttctctttaggaatgatctctcccttttagttcatagagtcaaaaattctgagagagatacattattacagtggttaaatttgttgtaattttttcccctttattaatataaaatcttaacggtgggggcttcccctaccgtagttctttcaaaaaaaaaaaaaagtcactgccaggctggttcggaaacgccatgttagctgagaattccgcagaaaaagaactttgcaagcttaattcgtgtcacaatggcatggtgtagtgcaggatttagacagctgcaaagataaatgtgttatgcagaaaaggaaaataatatcttgggaaaagtattcttagcaacagcactgtgtttcgcatatttatacgaacttaatttactatcttgtagctcggatcaaagatattacgaatacgaagtgacatgaatgtactagatttacctaataatagttctttcttagcgaagcatttgtgtaactgtactgactcgtgattgatatattattagcaaacaacatgtactccttacttttcatcaaaatctcagcacaaagcatatagaaatatactactattttcttctgtttataccctcaagataaatgaatggaatttcatctcagcaccagcacagcactatatggccattttcccatcatttgtcattgcagtttttctcccatattctaaacaggtcactctaaattcgatgacacactcatacgcttagaaggcatatatggccagctttgtggctcatgtcaaatccctactatcaacgtcgaagtactgtcaaagaacatctcgacccatccatgtcgtaggagcattagttttcccaatgcctttcacttccatttctaaattgttcatgtatggaaaaaaaaaactaaatcttcactggagcaatatatataggcacctgctgcagtaatattacaactaactctagcatacatcacttcacacacacatatatatatagcttaggacctgtttattcccaaaacaaaattttcacgctgttacattgaatgtttgtacacatgcatgcagtattaaatgtaggcaaaaaaaaaatcaattacacagattgcgtttaaattgcgagacaaatcttttaagcttattaaattgcgaccaactgtactatagcttattaatcaagctggctatgcagcaaaagttcgaagccgagaagatgattctgaaatcatcgttctctcgccaacgaatgatattttaggatacattaattacatcatcaagaactaatgaattaactagcaaagtgcttttgtgttacaacggaaaaaaatacttcctctatttcaacttactttgtcattctaattaattttgtcataagtccaattttagtaattttgattatatataatctgcatgttcttaaactatatgattttctataaatttgtattgctattagcttcagtacgaggaaatacaaatttctacgtacccgagagagtaagaaagttggcaaaatagagcggatttggttggtaaatggctcagtgaggcagtgtggagggagagatgggtggttgttcagcatggagggacgacacatcacaacttaccggagagatctagaggatcacttcaatatgcaattagatcgatgagataggaattcttgacttttaatttttatgaccccctaagttgtatgttctggatgattgattgtttccttctatttcttgttttaatttaaagtatgattatggacttactcatacatgaagatggagtagtttgacatcgaacgaggagtttgattggcagtaacatattacgattgcagctaatctatccacatgagatggcagcagtggcccatccatgcgcggcccgctgccaagggtccttgtgccacctgaagtatgaaatgccctggcacaatagaatcagacgtgaatcgaaagacgtgaaaaaaaaaccatgtgctctccaacgacaggatcgatctagacagcatgtcggtggatgaaaatcgggcagaaacactattgctttttataagtacagataaggattaaattgcatccatactggcatttttgttccagccccccaaaatattcggaccggcctatctttcctacatgttgtcggagttgaatctttcgctcctagttctttctgcttatgtgatatacctaaaaagtactcgatcatgaccaatgatatgcgacatgggacaacaaacactatataacaccaccatcctccacaagcacacatccttttatataggctcactctttacattcatcaagcttatgttgactggcggtataaaaattgtaatatgttcactaaatatggttcagttgcctcctaccgttgcaggtgtatgagtaggatggagcaaacagatcgttctatatatgctgtgttaaactggcctgcaaaccatgtacttgcatgttcagtgctcatagaaagaggcagttgtcttagagtaaagccagagcagttttgtattgcgtctaaggacgttggctacctagacgttggttctcttgtttaggcttgttggttggccaactcatagtggtctcctttggttcctggtgtctccaagtcctatatgcttaggtcgctacatgccacatcctagtgaagcaccgaaccagtggcttcaaataggaatgcaaatgattggaaatgatctgaattggtagcatctctttgcaaacgacgctcagtcggccagtatttgaccatatttatcatttaaattactcagtattagcatgaatatgatgcagaaagaaattagaaaaaaacaaatttcatatacaaccaataatggtaatgttagaaacagtaccccttagacgaaaacaacactgggtcgattgggaatttccatgaccattttcgcccctacccattcttatggccacaatgtgaatcatgatctccggccacttcacgatgctcaagcatatttaagttagatgtatcatgcatcttcatagaaagaaaagttagatgcgtcatctaggtgaacctattggttatgatattagagtgaacctattgtaaaggaatcaaaggagcccagattagcctcaaattaggtaaaggcccaaaaagggaaatgtgcctatgtgcaaaaccgaaaatgggaaaagaagaaatcatcatacggtcctaaaaaagggaggaccgcttgatctcaccctctcactttcgaattagcactagaacggataccatcatcttaatcgggcggtaagccccatctcaatcgggcatgacgtccgtcatcacaggctataagtcactcaatcgggccacaactagcgcccgtcacagatgacctatctcaatcaccatgccgtcccacccctctcccaagtgggtctttttttatcctcactcgtgtgcaccagggaagaacttcccgattggtcacccatcctaaaattgctccaggcctaacatgcttaacatcaaagttctttggagatcggcttccggaaaagtggctgtaacttgttgatatgagtattctattaatcttattaagccctagtccgggatgtcacaacatcccccattcatatacattcattcacatacacaaccatcaatatatttaacacaaccacattcacctaacatccattttgatcatatatttcatatccattcacatatttcacatatttcactagcaaaaccgagttaattggatcaaatatatatttagcaagtattatcatgaagaggaagcaaatcagacttctaggaaaatgaattttgaactgaattttataataaactcatatgtaaaagcagtcaaaaacaaagttgtagaactcattgagatctgtaaaaaataaagcctgtcacagatgagaacattaaatttaattttaggccgatttttgtgtgtcaaatgcaaaaatcataaacaacaaaattgtataacatttttattttggtcatttctccatctgaaaagtcaccaaaaccaaagttgtagaactcatcgaggtgcaaaatttttattttggtcatttctccatctgactctatttaaacaatttgaaatttaaaattcaaagtttcaaaaattcaaatagaattttagatcagtgaatgactttaactgaaaaagtcatcaataacaaagttatacaactcatcaagatctataacttttattttggtcatttttctgtataacattttttgaaccgtttgaatttgaatttgaaaatatgacaacttcaaacaacattttcaaataacaaatgatatcaactgaaaaagtcatcaacaacaaagttgaataactcatcaagatctaaaacttttattttggtcatttcttcatacgacaaagtgatagtaacattgttcacaaaattgacatatctcttatctgatttaaaaactataacacatatatgtaaaatttgcgaataatattactaacattttgttggatgaaaaaataacaaaaataaaagttttagatcttagatgagttattcaactttgttgttgatgactttttcaattgaaatcatttagtatttgaaaatgttgtttgaagttgtcatattttcaaattcaatttcaaactattcaaaaaatgttatatagaaaaataaccaaactaaatgttgtaaatcttgataagttatacaactttgttgttgacattttttccatttgaaatcatttactacccgtaaaattattttgactcataaaatgaattattatattgcacttaattatttagctatagttcaacttacaaatataaatatttcatatgaaaaatggaaaaatactcatcgttgacgggctttagttattgcccgatagagattaagtcatctcaatcgggcattagtatatagcccgtcactgatgagtcatctgtgacgggcctagttgttatctcaaacgggcctcaagttggtacacgtcacggatgatggtcatctatgacgggccccaacttgaggcccgtttgagatatgaaatgttatctcaatcgggcctaaagttggtgcccgccacagatgatggtcatttgtgacgggccgtaaatttaggcccgtttgagatatggaatgttatctcaatcgggcctaaactatggccagtcactgataggtgtcatccgtgacgggcttaagtattatacccatctaacatgtctgtgtgaccatatctcaatcgggcacttttcggcccgattgaaatgacttccttgtgatggcccgctatttgtaggcatattagaggccccacagatagaaggatctgtactagtgtagcattttttcaccagatgtcaagttttgccaagtcggctttgtccatatgctgcctcctctgagcctagttggtgactcatgtcccctgtctatgctagactcggcagcatcccagcccgcaaggccacttctgctttctccatatcctcccctcgatgtagggctgtcaaaaaagctcgaggctcgcgaggagctcgagcttggcttgtcttaggctcgattcgagctcggctcgagctccaaacaaaccgaacccaagcctgagcaaaagctcacgagctttactgagccgagctcgagcttctaccgagcttgaccgagcttgattgtgtatagtttatattacatgttcaccttattgatataataaactaatagataaatatatatattagtatctatttacacaacaaattagcatgttttagcacaatatatttattttaattattttctactcttttattagtgtgattaactagaaaataattatatttatcaagttattatcattaaaatattgtaacaccctgaaaattcgaccgacaaaaccaaaactctaaaaatacggattttcaaaaactttttaaactaattgcatcatgccgatcttattcgtctattttatctggagttgatctcgaagattattaatcgtgagtaaagaatagttaattagaaataaaccttaaaaacaaattggtaaaataaatataaattaaaaataaagattaggtgtggatagtaataaataaaatattatcgcgaccatatttggatcaattaaatttcattgcgatggaataagaattaaccctaattaaaactcaaataaattatataaaaataaaatatgagtaatattaatctagggtgaattcattagttaagataacacgaatattgagtaaaatgcatatatgtaaaattaggaattgtggaatcaaatttagatggaaaatacactaaaatcgggataaataagaaaagtcactgttcattgcgcctaaggtgttcgatgtggtccctagccttccccctcctctcccacctctgcccctagccgccccgagcccgtccatcgcgtcgccgctgccgcgccgcgtcgccgtcatcacgcgccgcgcgccatcgccgtcgccatcgtcgccgtcggcctcgcgccccgtgccgccgcctcgagccccgtgccgccgccttgcaccc

SEQ ID NO: 46088 - DNA, 40076 bp, Oryza sativa
ccgccccgtcctgtcgcctcgcgccccgcgcgccgcctcgcgccccgcgccccgcgcgccgctcgcccatcgcgtcgccgcctcgcgtcccgcgccgctgccgcgccgcgttatcgtcgcgtcgccgtcgccgtcacacctagccgcgccgagccccgcgcgccgccccgagccccgccgcccctcccctctccttctccccctcttccctataaatattccccctcccccattctctccactccatctcccccttcctctcccctctcccctctccactgcgctgccgttcccgtgccgctgcgccgccgttcccgtgccgccgcgctgccgttcccgcgccgccgtgccgtcactcctgtgccaccgtgccgccgcttctgtgccgccgtacgccaccgtcgccaccgccgtcgtcgccgctgctgccgtcggtgagccgccctccttccccctcgcgtccaccaccgccaccgctcgggtaggagggagagccgagagagagagagagccgagagaaagagaggaagaagaaaagaaaccgagggagggagaagccgaggaagagagaaaggagccgggagggagagaagaaagggaaaaagaaagagaggagagaaagaaaagaaaaggaaaagagagaaaaaagagaaaaagaaaagggaaaagagaaaagaaaagaaaaaggaaagggagaaaaaggaaaaggaaataaataggaaattagagggagtttggggaagtttagaaaatttaaaataattagaatttaattatagattaattatagtcgtagaattgcaaaatttaatataaattatggattattcttggtaatttctataagaaatcaattcgcggtagtaatttagatgtaattaataactaaacaaataaatgaattcttatagattattatagattatttttgggtaatccctataagtaatcgattcacggtaaaaattcggatttaatcgctaggaattttagacgtatattatatttaatcgtttagtcatagactaaattaaattgtataatatttctaggatttcgtccaatatttagctcgtggtagaaatttctaacctattatatacaatgctcggggagactaaattattgacaacgaaataattatacccgcaaaatagtttaaatcgaaattgggtttgccgtagttcgcagatagtaaagttaataaaaagaatcaactttcgcgttcgactttcatttggatttatttggatttttatttgaattctaaccaaattcaaatcaatttttgcacgtaactatagagcccgagggagttgcggatccaagtgaaggccaagacccgcaagactttgagcaaggcaagtcatcgctattctttgaacatgttgatcccaattgcgaaattgttttgtttacaaataaaattgcatgcaatcatgaacatcctacttgtgattataccatgccttgattattgttcacctttaaatctttgtaaccatagatacgtacgagtccctagtcaactatgacacttgcttagaaatgctattttagattcatgcatactcatatttatcaaatgttatatgcttgggcaattacctttgggaaggtaattgagatgcgacatgtggagacatgagcgccacattgccatgatattgatgacataatttgtgaaaggaaaataaagtaaaacaactgttttcgactggggtggctggaggacttgggtggtgtccggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtggggcagccattggtaggaccgcgaggcgggtgtctacagtggtgtcgccatcggtaggactaccatgtgagaatctaaaacataattataacttaatgcatgtgtgagtcttcccttcccgggtgcgccagaactcctctcactgctagaaaccgtgtacgcctagagtgcatgaggatgaaaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtttgagtaaaccaaatctattcgaatagccgtgctcgcggttattgagcaccgggacatgtattacacttggctagactctaaattcttaacttgtgtgggaggggatattgcatgatgaatcttatgctgttggagccacttcctgagaggcgggaaggtggacgtcctcagaaaaccatgacgaatcaatggcgggaagctatccttgggatcacaatggatggtggacagaaccgtcgttgtgtaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatcccttgcctactatcaggagggagatgaagacgatggcgtccagtaggtcttagtacggtcgttgcctgtggcaatggcatgccgctgcctgaattccgctgccttatctatttctgcttttggatgtattccggacctctcggtccgatgatttaagactatgcctgcgggcctatgatgtaataattcgtattagacactcgtgtatgtgcacttgatattccagctatgaattcgtgtgtaccaaactacttgatccagggaaatggtactgtttacacgatcgattcctgttataaaaacgggggtccacaaatatatattatactacttattgccgagctcggtagccgagctcgagctcgtagcttgcctaaaagctcgaaggtgcgataggctcggctcgagcttggctcgaacttgtgtcgagctcgagcttgggcagacgagctcgctcgagcttggctcgttgatagccctacctcgatgtcaccacacctcccagtgtgccttccttatctcgccaatggcatctgcccaccgcgtacatgattattcccgacctcaaaatagactaatggctagctagtctacagtatgtacaccctcactggtacagaaccttacatctgtgacggactgaaaaagcgtccgattgagatatggtcgcacagacatgttagagaggcataaaacccgggcctgtcacggatgacacctatcagtgacgggctgtatttaggcccgattgagataacattacatatctcaatcgggccacaagttggcgcccgtcacggatgatggtcatcacagatgactcatccgtgacgggctctatactaatgcccgattgagatgtagaatttttttccatttgtcatatgaaatgtttatatttgtgagttgacatgtagcaaaaataattaactgcagtataataatttattttattagtcaaaataattttttaggtagtaaatgatttcaaatggaaaaattgtcaacaacaaagttgtataacttatcaatatttacaacttttattttggtcatttttctatataactttttttcaacagtttgaatttgaatttgaaaatatgacaacttcaaacaacattttcaaatactaaatgatttcaaatggaaaaattatcaacaacaaagttgtataacttatcaagtgttaaaacttttattttggtcatttttcaatataaacttttttttgaacggtttgaatttgaatttaaaaatatgacaacttcagaaaaaacattttcaaatactaaatgatttcaactaaaaaaatcatcaacaacaaagttgtataactcatcaagatctatagcttttattttggttatttttctatataacttattttgaatcatttgaatttgaatttgaaaatacgacaaattcaaacaacattttcaaatactaaatgatttcaactaaaaaagtcatcaacaacacagttgtataactcaccaagatctataacttttatgtttattatttcttcatcagacaaagtgttgttaacattgttcacaaaatttacatatatgtgttatagtttatgaaaccagatgagagatatgtgaattttgtgaacaatattactatcactttgtcggatgaaaaaatgaccaaaataaaggttatagatcttgatgagttatacaacttttttgttgatgactttttcagttgaaatcatttagtatttgaaaatattttttgaggttgtcgtattttcaaattcaaattcaaattgttcaacaaattttatatagaaacaagaccaaagtaaaagttatagaacttgatgagttatacaactttgttgttgataatttttccatttgaaatcatttactacccgaaaaaatatttaaatttcttatattttgaaattcaaattttatatagttaaatcaagaccggatggagaaatgacaaaaataaaattggtagatctcaatgagttctacaaatttatttttgacatcttttttatataagttcatttagtattgtaaaattcaattcaaaattcgtttttgtctagaagtctgatttgcctcctcctcatgataatacttgcaaaatatatatttgatccaattaactcagttttactagtgaaatatgtgatcaaaatagatattatgtgaatgcgattgtgttaaatatattgatggttgtgtatgtgaataaatgtttatgaatagatgggatgctagggtgtgtcatactggcccagggctttataggattaatataatactcatgccaacaagttacaatatattttccggaagccaatcttcaaagaactatgaggttaaacgtgcttgttctagagcaattttgggatgggtgactgacatagaagttcttcccgggtgcacacgagtgaggtcaaaggcttgaggcgaacaaaaaaacaaaatttattttttttgattatactcatccgtgacgagctataatttagacccgttagagatgagagtcatccgtgatgggctataatttaggcccgttagagatgagagtcatccgtgacaagcttttgtgttggcacgattgagatgtgtgtcatccgtgatgaccggttgcccgattgagatattttctcacgtcactgacctttgcttagtcacgggggtcatgcccgaaagagatgatgtttaagcccgttagagataaccgatcccgttctagtaacataggtcatgattgtgatggattttaacaaaactaaatcaggataccatgatgttacaggactaatcgtattgcatgttacttttgtcaaaataattgtcctcttttagaacatggtttggatattagatctcttgaagaagagagggtagccgaataattacttttgtttgctgtgctacaggaacctgaaaatgcctgatagccaaagtatggaattggtaagctgatcgcctaggatgtgggcaattgaaataagatacatggcttccctccacatcattgcatgacttgttcatagacacatacggctcattggaacagagttttcgcgatggctatggatcattatatatcttggtgcgacgggatgttgtaaacaaacttataaacgttttctgctcctactaatacaaaatcaacaaattgttcaatattgcgaagaaaaagtattgcgtggtacacggtactacactctacctacaaaaccttttggtcctaagaaaggtccttggagtcggagtgtccatcgatatcaccggaaatccaagctgaccataaccccagccttcccttcaccctggcagtgtgcatcattatgttttgatacaaactgcacaagctggctagtccagtttggtgtgtgtcgtctgctctcaattgccctccatgaggtatggtctcctcgttcgagtggcaaagaaagatgcagttgttaatcatagagattttatcgcacctcgtgttggcaaacacaatgctgctacttatttgggcttggatgattcgccaagtgatactgcgctccttcgcttcctggtgcctcccaatcatataagtttggttatgccaccgaaactgttgttgctatgaaaatctcatatataaagaagttctcagctgtcgtcactggtggagaaatgatttttactcctggttggtaacctcctatagtcccggtttttcaaccgggagtaagatcgttaccaaccgggattaaagtttttttttctttttttgctattttgtatatctcacgcccattatcttaaatcattcaaagcaacgtatatagttcatcccaaatcattgacaacaacatagttcattctcaaaatcattcacaacaataatacagatcaaattacacattaaggaaaaaagaaaaaaaagaaaaaaaatcccgataggcgcgccgacctccaccggctgccgccacaccggcctccgtgccggccgccgccgcacgaggccgccttcgccgctgcgcgaggccaccgccgccgccacccggcctcctgagaatgggaaggagaggggagggggcggatccggaggaggaagaggaagatggggtgagtgaggagatgaggaagagataaaggtgagggatgaggagatagaacttatgtcgtgcgcctcctcctcctcgatctcgcgcgctcgcctcgtcttctctgcgcatgccgatctttttttctcgattagtaatatcaaccgggactaaaaataattaatagaggggtctgacatcacctgccgtttttttttgaaccgggggtaaaaatgatctttagtcccggttggtgttaccaaccaggacaggactaaagattaaaaagtagctctaaccaattgaactttagtccctatttttattgcaaccgggactattgtggaatttgttcgaccgatcaaagatggtttctccagtagtgcatattcttggtcgtttatctaccctcattttatattctgttgaagaaggattgcaacaatgctacagtgatgtaccgtcatagaccctggttataaattccataattctaagtccttaatgtttttgaatctgagcaaggggcatgctgacaaagcgtgtggaatagttggatgaaaaatgattgaggaattaatagctcaagtacatttgaactacttatgaaaaaatgggtaatggcttttcattcgtattttaccgtaaatggttatcggtaattcattagacacactttgattttccgactaaaaataaaagttacagctagcttacctgctgcccatatatgatcttctcagtttccctttttctatttccttgtttctttatctaataataagcatgtttatatctattaatacgtactttagctagctaggggacatttccctttatagcagcgccaatttttcaaatacctcgctatatgcatatagcagtagcaatgttgttaatcacaatcttgtttatttaagttcaaggaaaaaaatgtttgaaatggattgattccccaacattttagtcagacataactcatctaagcttttatttgtggaaatgatttttcttttgcttatacctttaaaaatgcatgtttggcagttcaggcaaatacagccagccgaggagatagcaatattatttggaaaatttgacacttagtagaatcttcctaattaaccagcatgatctgtcaaaaatccttgttacaaacaagtttggaaatcatgtgttccaatgagataatagtttctttgatttgcttggttatatgcttgcataattgatctcggaccgctcaaaaaaattacttgcttggtttaggccggctgcagcgaaatggcctgccaaatcagtttgtcatctttgttcaaagctaaaccacaatgatcagtaatcacgtataattaatccaattaagtttgagacagatccctgcttgttagcatattgagctcaaacgaattttgatcacttcacttttcgtaaaccttgatcaattaaggaacactatttgatgacgagcgtagttgcatgtctccgtttcttggattcaaatgacaaatagaacacatgcaagtcccaggaaacctagagaagttggtggaggccctttgatcgagctttttctcaaactctggtcagtattggctttccaaatgccttccatttctctgtctcgtctcatgagtacatattcagaagttcttaacttcagaactttttcgcagcaacattttcttcatcggtcatcactttaaatatttgcttgctcctgatcatcagtttatttgcaaggccaatgtgaatgcatgcataggttggcttaggttgggccggaatgcgcaaaccagaaattgtagcaactcctgatcatcagtttatttgcaaggccaataaatgcatgcatgggttggcttaggttgaaccggaatgtgcaaaccacaagttgtaacaactactagagaactgatatttagtcctgatttacaacccccattttctaccagttgtagcaacagagctggtactaaaaatatatagcaagtgaaaaaatatgtgggatgtgggattcgaggtcaagatctctcacctcagccctcacacgtaaccatcacacctactacacacatctaacttgaacagagatactttccttttgaacttaccttgaaggcatctttaacaccggttgataacacacatcagtactaaaaatgaatctttaataccagttggtaacaccaacccagactttttgatcttctatctttagtctcggttggtaacatcaaccgatactaaatatgcatttttaatatcggttgataatactaaccggaactaaatatatttccaggggcttggactttaaatgcaacagaaacaggatgtagagacgatttgaaaattttagaaccggtactaaagcatctctagtattggtttttaatctaaccgagatatttatgattttaggtaccatgtcaaaagatcagttctctaatactgtgtggcataggttgggccggaatggtggtacgatgaacatgtggcccatattggacaggatatttgaggtacgatatgaagaatcttgggacctactgatattctgtgaggctttggccatacaaataaatgtcggcttgcatgggcgggattgggactgtagtggagcacatcaggccacttggtttgctcacaccggatgttcaatgttgcgaggttggtttggtcacctcaaatggcagagctacctctcgggcaggttgagcggccgcacgggggtttcaccattgttgtttgcactacggatatttattaacacctattaaaattagtcgatcatcaaaaaacactattactcgtcagggtttaacggtgccgccggctctatcactgtactcgcctcttatgcatgatcatgtcgcccgtgccaagaccgttgatcttcctcgttgacagcgtcaataatctctcgccggccaagtttttgaaatctcagattttttaaaggttaggtgtagtaatcccatattttgagggcattaatgttgaagacaaatgcaatatgcacatcaagtcatgtggataatcaatatagtcacctcctttaagagcaatagaccaaaacaaccattcaatttatagctatatcacaacacaataaattttatgataggtgatgctccatttacatcacaaaaaactaaaaaaacatgccacgttccaaaacctatgatgttgacatgacaaaaattctttcgtcacctatcatgtgtttttaatcatgttctgtgatgaaaacacttttttttccattatgaagctagtgacgatgtcatttagtttatgtctcttagttttctcattgtcgaacctaggaaacgtcacacattatcttgtgccatgtcaagagccatgctattgtcaagttgtttatgtgctaagcccaattataatcccggttaaattttggcctacccatctaaagagtagggatttacgcattattggcatgtgaaggtccataaaatgagcaacctgtttatgagctcgatataattgcaaacctagttagatataaatctagttaagatgtagcaatttacataatatgttcacccaacttgttaattcatttgaagtggtaaataacaagtggactaagggtgtgtttgaggagaaggagattggggagattgggaagatacgcaaaacgaagtgagccattagcgcatgattaattgaatattaactattttaaatttcaaaaatggattaatatgattttttaaagcaactttcctatagaagatttttttaaaaaatacaccgtttaatagtttgggaagcatgcgtgcagaaaacgaggtcctttctcaccctatatcacacaagctaacgcagcctaagtccatttcaaaatactacataggtctaaatattatacccagtaacaacccatatggccatatagcacagaggttattgcacaggtaatatccaacaaaacccagtggagatctaatacagtgtaaatacatatggacaaacccagtcacatatccaaataatagaataactgaccataaattaattataggtcactaaccaaacaagtacatgcaattgcatcacaggttcacagccctaaaatacattataggtttactgaccaaattgaccaagctactgcagaccagggtctgttacacataaatgtgttgcttcggcctgggctttgttacttgcaattaagacaaccatcaagctactgctgactggtatatataaagatatagtattatgttcaaaaaaaaattgaatctttcgaactaacaacactaataagtgattcatatatgataacataatcatatgagtgcctcgaaaagggattatctgacttagctattgtgcagttgagtcactgacatgtggattatagcaaagtgggattcatattcatatgactgtgactcaattgcatgtgtagttaagtcagagaatcctgtcaggcatttcccttaatcccggcagtgggcactgttctattttgttacatctcctttagtacaggttgctccgttggttggtgatcgttttgctgtcctaatctgctattcaaaccaaatactcgcttgttcaattgatactcatcgatcgaaagatgcagacactgctgcggggctctcagcatagcttggatggcctactcatttggctgtgttagagtaaaaccagagaagttttatgttggctacctcaacacagattcttgggtaggcttggttggcctaatcacagtgcactcctttgattcctggtgtttcccagtcctatatgtgtaggtctacatgccacatttcccatggtttccgttgctatggtctcaatgcaaaatcatgagtttccctcttcatgatgctcatgcatgttggcacggctatgttttatttataaccgtatgtgagcagatatgcagagtttaaccatatttgagttagatgtatcatctccacagaaagcaaagttggatgtgtgtcatctggatgaacctattagcagtggcattagttacaatttgttatatatatatgttcgtgcaaaaacatttttttcaactagcgtagctctgcaaattgtgaattaagcaacactaacatctgagctgttaatattgtacgacgtaacctagcggaaaaaaaaatcttagaacggaggaaatgaaaatagtacaaggctttttattttctttatacaacgaaattcatgtaacatgtttggcagtttgggagaatgcagccagaaaatatagactagacagcgacacagagatgaaattaactaaactgggaaattgcaaatttgaaaactaaacatggacgaaacaatgctgcagtagctcacatttctaccataactgaatttgcacatgtgatccttctgtgggacccgttgtctctcttcctcatggtagagtttgcagccatcatcgtgcatctttactttatttctgtccggtggcattttagccgactgatctggagagtagactagcactgatatatgtgcttccataacgctttactccccctagttgtgggacactttgatgcaggagactctatatcatccggtttaatttcaataagacgcaccattgatactttttgaaggttagacggttgcgcaagtagatttgccatcgtttgggtcatgatgcttcctaagcctatgtatacgtgtgcctacatcacacaattgcgaagtagtaaacctctcattggtatgtacaattttcatggacgagttgtaggttccgtaagtctgcttcggttatctctttatgctcatcttttatatccaaattaggagatagtacatatgtacaacggaaaaaaagtgttgtaccttttgtattaattaagtataaatatgtgggtccgcatatggttttcatctgctataaattttaaaattgagtcaataaagcatatgtgttaagataaatggtgcccatactagataagtcgcaacaggttacaataggcatctatgccatttcagatggatgaggacaggatcgcaacattatgttgcctatattaaattggcctaaacatattatgaaggacacgcagcacgtatacttggctcgccagatatcaggtttcgctaagtcggcttcctccatagcgtggttgttgactcacgcccatgtccctgttgtactctgtggcatctctttgggctccctcttccatgtcgagatcctctcctcggtgcgaccacccccgtctttgtgtgccaccatcgcgttcttcatctcgccaatagcacccgcccaatgggtatatgattattcttgacctcgatatggactaatgggtagctagctcaagaatgtgcacacttcatataggatgcgataacaatagttttgacaaaactaaatgaggacacgacgaagttacatgacagatgatattgcatggtacttttgtcataataatagtactgttttagaacagggtttggatggcggatcacttgtagattagatgatgagcaaataactactttgcctgctgtaatacagaatcctggaaacggctaatcaccccttcaaggaatggacccatgtagccgcgaagtacggaatcagctagcttaattatcacctgagattcaggcaattcaaacaagatatagatgtctttcctcgacagcagtgcagttcatagacatggcgaccttgtcggaacagaatcatcacgattccaaaggcaggatttttttcagaaataatgatattgtctggtacatgctgaatcgtatgagtctaactgcattcggcagcaggtgatagagaatatttctctcgttgtgtgtttgttgcaaaaaatttctatcagaaaattgctttaaaaatcatattaatctatttttaaaatttaaaataattaatactcaattaatcatgcactaaggctcatttcgtttgtctaggttcccaaccccttctcatcgttttccgctcacacgcttttcaaactgctaaatggtgcgttttttttaaaaagtttatatacgaaagttgcttaaaaaattcatattgatcaatttttttaaaaaaaattgctaaaacttaattaatcacacgctaaaggctgcttcgttttacgtgctgggaaccctcactcccaaacacaacttaataggccacctcgttttacgtatcttcccaatcgtatgtgcacacacccctacagtcttggcatacatcctgacagtgggcatcactctatttttatagatcttcgccacgctggttagttaggtttggtgattagatcctctgcttgctggactgggattttgggatttgactaccacacaaagggcccactagttgtgttatagtgaaaaaaatggaggctatatatcattaggtttcaataacactctgtggatgaaatggctcatcggtgattgctctgaatgccctttttggcccagatgaaaaaaaaaagaaaaaagaaagggacacccctttcgttctttcagctaccagcgaatgcgtagttgcttttgggctcatgttttcaacacgagtggtgttagaggtattctttggtcaggcttctgggcctttgtgcaacttttttttattgcgttaggtttttgttttctactagcccacgtatgcaaaaaaacaaagcaatggcccactaagtagtaactactccctccgtttcaaaatgtttgacaccgttgactttttagcatatgtttgaccgttcgtcttatttaaaaaaaaattgtgaaatatgtaaaactatatgtgtacatgaaagtatatttaacaatgaatcaaatgatatgaaaataataaataattacttaaattttttgaataaaacgaatggtcaaacacgtactaaaaagtcaacggtgtcaaacattttgaaacggagggagtaggttatatggggcctcatgtgtttaggcatgaataatactacctccatattttaatgtatgacgccgttgactttttatccaacgtttgaccattcgtcttatttaaaaaaatttatgcaattatcatttattttattgtgactagattcatcatcaaatgttatttaagcatgatatataaatattttcatatttgcacgaaaattttgaataaaacgaatagtcaaatgttaatcgaaaagtcaacggcgtcatacattaaaatacgaagcgagtatgtagctcggaccttggccttgttgcatttggtaattaattaagaccttcaatatactgctgtgagtatttaaaaatactattatgttcagtaacaaaactaaacgggaataccatgctgttacatgaataatagtactctttcataacatagtttggaaggcatatcagttgcagattagaggatggccgaataaccacttttgtctactgtgtgctactataatgtgataataggcgccatctcttcaaggaatgcactcatgtaggtcgaactcactggttagccaagacaaccacatactgcagaaacaacaatgtgtgccggttggaaaaccctcatgggtgccagatttcctaatctgcatctagcagacagccaatgcattgcaaaacaaaagtcggatcaatgcatttgcttgataatagccaatgcattgagtagctcctcatcccacatccgcatatcaccatccatccatcccacatccatctagagcaaaatcgaagaaattgaaccacaaatttttcgcacaaaaattcatcactccaatgaaaattcattacaggaaatatttgcatgcatcaaacataaagaacaagatgaagaaatcagaaaaaaaatagaagttagtccacatgccctggtaattcagccaccatcgtggagaaacctctttgcatgccgtgctgtgccaaagagggggtggcgccaaaaaaggaggcgccggaactggccacccccgagcggcggtgggaaggggccgaaaggaggggttgcactggtgggaagaggcggagaggaggtgcgacgctggtggggggtagcgccgtatccagccgctccatagcaccggtcggggggaatggcaccagatccggtagcccccaagcaccgggtgggaagggtggcactggatccggccaccaccgagcatcgttgcggaggggcggcaccagattcggctgccgaactcgacgttgcaggtgcgggagccatactcacatggctgtgttagagtgaaaccatacaagttttatgttggctacctcaacacatattcttgagtaggcttggtttgcctacctatagtgcacccctttggttcctggtgtttcccagtcctatatgtgtaggtctacatgccacatcctagcgaagcaccaaaccggtggcctccatttgctaaggcctcaatacaaaatcttgaatttgcctcttcgcgatgctcattttgacacggctctgttttatttgtaaccatccaagtggcagcaatgatgtagcatgccaattgtgttgtatatatggagtatctgtcatagcccatgtgagcagatacgcagagcttaaccatatttaagttagatgtatcatctctggctctctgcagaaagaaaaagttggatgtgtcatctggatgaacctattagaaatgactttagttataatctgttttatttatgttcgtgcaaaaacatttgttcaactagcgtagctctgcaacttgtgaattaataagcaacattaaatctgatcgagctattaatattgtacgacctaacctaacgggaaaaataatcttagatggtggaaatgaaaatatagtgcaatgctttttatttccttatacgacgaaatacatgtaacatgtttggccgtttggaaaaatgcaaccagaaaatatagacttgagacagcgacagagaagaaactaattaaacagggcaatcacaaatttgcaaaaaactaaacatggactaaacaacgctgcagtagttcacatttctaccataactgtacttccattccattatgcttactcccccaagttgtgcgacacttcgatgaagcgtaccgtatatcatccagtttaatttcaataacacgcaccgttgatactttttgaaggttagatggttacgtaagtggatttgccatccttcgcttcacgatgcttcctaagcctacgtatacatgtgcctacaccacacaattgtgaagtagtaaacctctcattggtatgtacactttttatggacgagctgtaggttcccttagtctagttcgattatctctttatgcttatcttttatatccaaaggagatagtacatatgtacaacagaaaaaaagtgttgcaccatttgttttaattaagtataaatatgtggatccgcatttggtttccatttgttataaattttaaaattaagtcaataaagataaacggtgcccatactagataggtcgcaataggttacaatgggcatctatgccatttcagatggatgagaacaggactacaatattatgtcgaatatattaaattggcctaaacatgttacgaagcacatgtagcctatatagttggctcgccagatgtcaggtttcgccaagtcggcttcatccatagcgtggcatctctttgggctccctctgccatgccgagattcactccatggtgtgaccaccttcccataattgtgtgccaccgtcgcgttcttcatatcgccaatggcacccgcccaacgggtatatgattattcccgacctcgagatggactaatgggtagctagctctagaatatgcacacttcacataggaatgtgataacaatagttttgacaaaactaaataaggacaccatgaagttacatgacaaatgatattgcatggtacttttgttattataatagtcctcttttagaacagggtttggctggaggatcacttgtcgattagatgatgagcgactaactactttgcctactgtaatacaggatcctagaaacagctaatcaccccttcaactccaatgaatgggcacatgtagccgaagtaaggaatcagctagcttatcagttatatatcacctcagattcaggcaattcaatcaagatatagggcctgttggcggagcatctcccagaatcagaagctcccccaattaaaagcttcaaacaagatggctttcctcgacagcagtgcaattcatagacgtgatggccttgtcgaaacagaaccatcacagttcgcaaagacaggatatttcagaaaaaaatgatattgtgtggtacatgctgaaatatactcttatctatcgcaccttttgatcctatgactctatgagtctaagtgaccagtcaaccaacccctacacagccttggcatgacagtgggcatcactctatatttttaagatcttcgccacgctggtagtcaggtttggtgattagaacatctgcttgctggactgggatttggctagcacaaaggtcccattagttgtgttgtagtgaaaaaaatggaggctatatatcattaggtttcaataacactctgtggatgaaattgctaatcggtgatagctccgaatgccctttttggcccgatgaaagaaaagaaagggacagcccttaatttgtttctttcacttaccgtgccgaatgcataattgcttttcgggctcaagtttttaatacgagtggtgttagaggtatttcttgatcaggcttctgggtctttttgcaattttttattgcgttagggttttttttcctactggcccacctatgcaaaaaacaaagcaatgacccactaagtagtaactaggctatatggggcctcatctgttttatttattttttttaattcacttgcaaaaaattatataccaaaactttacacatatgaagtttctatatacaaagttttcatgcatcgtgtttcgttgcatatagtttatgtgaaaattgctatgtgtaaagtttcaacctatcaatttctttttctaggccagaacattgttcagtgggaaaaaatatgtgaattaaaaaaggtctatgaagaaaagcaggttgtgtcaatcgtgggctcccaaataagaaggccaacaacgcatagcaggctattactccctccatttcaaaatgtttaacaccgttaactttttaatacgtgtttgaccattcgtcttatttaaaaaatttaagtaattatttattcttttcatatcatttgattcattgttaaatatacttttatgtacacatatagttttacatatttaacaattttttttgaataagacgaacggtcaaacatgtgctaaaaagtcaatggtgtcaaatattttgaaacggagggagtattttgaaaattactcccgcacgtgggttctctttgttcaaatgcaacagtgtgagcacacaatgtcacgcagaacaaaaataaaaattcaatgggacggacgacatctttatggtggagacgtcttatagaaaagaaacaacatgtggagagacctggacgtgattatgtgcggcgaggtctcaggatagcttgtgaactagacctaccctatgatggattcattctgaaggtttgacgatcagcaaactagctgtgacattctttacttcacgatgcttcctaatcctacgtatgtacctacactacacctatacggatggacaaaggtaccccaaattggtttgagtcagaaaaccggcatctattgtgggttcccaacctgttctgtgtgtagtgaaacctctcatttgtatgtaaattttccatggacgtgctgtaggttccccttgtcttgtcttcacctctctgctcttctttcatattcagagataatagacatacacgatgaaaaaaatactgtatttttatataaatgcaacatgtgggatcaaagtagtagggagaatccccataccagatagaccctcaagcttacatccgactcctagcccattttagatgtataggaaaagggctgcaacattatgcagcatgtattatgtattaaatggacctaaacatgatatgaaggacgtgcaacatatagtagtcccgcaagatattaggtttataagtttttagtctaaatactcttatattagttttggctgtacacatcttttgggtatatacagaggctggattttaaccaatattcctattaaaaaataatatgtttgatcaagttgccttcgtccataactccatgtaccgtcgcctccctctaagcccggtcgccaaccggcttggctctccctatgctgctgtgatcctcccctcgccgcgaccaccaccctgccaacatgtgccagtaccgcactcttcaacgcgccgatgacacacgccatgccgggcatgcacatgatagataacattgactgtgttctttcctagacgaattttacgaaaataagatagcacacaccaatcaatggcgagaaggaagattattgacgatgttcctaggcagtgcaacgagtaggggtgggcattcggactagaccgaagtttcggtccggttagttcggttttttaaaaattcggtctttggaaacaggaaaccgaagttgttaagcaaaaattactaaccgctacttcggttaaccgaaaatttggttcggtcttcggtctaaaccgaggtgctcgaaccagaacgtgcgtcctcttcaatcttctcgtcttcttgctcctgaaaacctccatggctccacctcagtcacatgggacggatatccactagcatggattgcatggtgacaagtgctggcgggacggaaggcgacgacgcggcagaaatcagccgcgcgacgcagacggcacgcgatggcacagcggccggcatgcggctgtgcagcaggatcagcaagccagcagcctgtggccttgttatggcttccacgtgaccacacgattgcatgcgacactgcggcgacgccggcgagtagcagcatgcggcagtactgcagaagacagcggcgcggaaggaaggagacatgcgcgtgggctaactagggttaggagtgcttcggtcaatcgaatggtggggtcatagggattgggtcattgacgtggatttgggcctcaccttgttgttgggctgttttggtccatgggatggtcacgttgtctgtttagtgattggtattgatttggtttcttcggtcctcggtttcttcggtcctcggtttcttcgggtagtattgcacgatgaccgaatctttcgaagtttgttcggtctttcagatgtcacacccgaacaaatgaccgatgcccgagagttcggtcttttcgggtttggtttcggttttttcgggtccggtcttcggttatcggttttaatgcccacccctagcaacgagcgtgcaccagatggaaggcacctcctctgccaatggggatactcgtacaggaatagtagatgggggtaggggaacctacaggggtgaattacctaaagattgttgaactggaccaggccactggccgtctcccaatctatctccaccgcacggctgcaatcatactgattctgactggtttattatttgcaaacaacacataatacctatctatacgtcagaatatcagcattcggtataaaaaaagtatgataaatacttttattctgtttataccaagatacataaaatttgagcaaatgtgcaggtagtaattacaattagagccattttacggtccttgaggaggtactatgagataccactttttctattgtaaattgatacctcgtggtacctaggtactacgaggtaccatgaggtaccaaattttacactaaatttttggtacctcatggtacctcctcaaggaccgtagaattgctcttacaattagctgtgcagtcagaagcacagcgttgcccgctgttctgcccatttgtgttggcactaatttggcattgttgttttagatgcacacgctacatgtcatgctaatcgccttcaatagcacacgcctctgctttgaagatcataagcaaaagcggtataacgttctgtcctattagagatcttcacgtacgggcagtaacaggatatcgaagatcaccttgtaccatctctgactcattgtgggtgggaggagtatcagtattcccaatgccttccacttctatttcttatcgcgcatacttgaaaataaaaacctcttgaactttgatggtgttgtccattgcttgcaaaaatatccgtcctcttctatgcatgggcatccactacttgacatatatagcagtttcaccattaataaccaaattattagccaagactaaatgtacacacattaaaaaaaataacatcactttagatgtagtaattcctgcacatggtatacatatagcaattacttcctctgtttcatattataagactttctagcattgcccacattcatatatatgttaatgaatctagatatatatgtgtgcctagattcattagcatctatataaatatgggcaatgctaaaaagacttataacctgaaacggaggtagtagtaaagagtaccgtttgtacttgccgaatggaaaaaccaaaaaaagatatgaagcccaaaaatcctttgaatgaaacaaagccggcaagtatgtgcacaagaaaagtctgaagcccaaattaaaatctagaatttatatttaagatgacaactaatgatatatagttttctaataatagttaacatcaccacaaaaattctatctcatccaatctccagaatgttttggccgaccctgtcatacattttcccatcgtcggcatcatgacctaacctcttctgcccctagagcaaaagactagtccccctcccgtcgcgctgtcctttcatgtcccatttgggcgcctacttcgcagtgctattggttttcccaataacttccaaccctatttgcatttgtctatcattctatgtgatatgccttaaacttcactagatggcctgactggtgccatgcatcagcagcaacaacactacaacagtaccacatcctcgagaagcatcagcgcaacactagctagcttcatatatgatgtgcccaatttatgagttgggcattgcaaaaggtgaaaagaaaatatatcactccccacatcactgtaactcttgcacatggtgcaatttaatcaagtgtacaattgtacttggtgaaagtaaaacaaacagagaagctgtaccgaaatgagtgaatgcaattctggtttgaaatttcagtaatttcggaacaccccaaccaccccctccaccaaagcaagtcattatctcagtcgaaattttcgggttttcataaatttttgttgaattatttagtcatattcagttaaattgggttaaaaattaaaaaaaaaggtccaaaagtaccaaaaaatcatgaaattgcaggaattttggttctactgaaatggcctaaattttcggtgaaatcgaaagtgaaaaccctgggcaaaatggtgaataggaacatgactttaatttgagtcaaaatagccccacaacggctagcttattaaggctgaagtggacatgaaaaaccagaagtttaaatgatatgctgttgtagctaacacaattttattatatcacaatactatgacacagatttcgtaattgttttcgtcatcgcttcttagtctataaggcttggacaaatttagtactagcatcaatcctcaaagagcacgatggttccaacttgcctaagctaacttaagctgcttccaagatcaccaaagccctgatggtggaactctcctggattgtttcacaactagtatgggttttcctggatgccttccatccctattatgtctatttttcaggtaaaagacaggagcatgaggtctgttcagtgctatacttatagcaactatttatacaacaccattctcatagtcgggcaacactttcaatgttaaagtttatgtcaaatatgtgtatgtatatagtcggttatagtttaggacttgaagttgaaacatgtatatgatagagttaggtttggactttatcctatgctctctcttaaatagagaggcacatctattgtaaactcgtgatgacttggtataggcgcgagggagcgtctgccggcaatgactggctgagggtcgttgtaaatctaatacattgtaattatgatggaccaaggaggagtatccgtaatcagtgttatgtatatataggctacggctgaaatctgttattaagtatcgtgtctcggtatcatcaccgtgtttggatcttctatgacgtttatttcgcgtttggtttcaatggtgatttcggacgagttttacaacatccaatttactaacggaccatttgattgcataccgaaaagaaaattgcacaatgaaaagaaaaaaaatattgatatcagaatgacgagtacaatttcagggattttagaaaatttcggtacaaaattatttaacaatttttttaagataatgaaaatctaataaagttatgactgaatttgaataaattttgaccaaattaaaattttgaaaaatacaaaaattgtggataagatagtttatggctgggggttcaaaattaccaaaattgaccaaaatttcatccctactggtaagacgactagatgagatagcctcgatcggaatggaatgattcttgtgctcctttgtcatccttgaccaacaattttgaccatctatcctcaagctagaattcataccaatgcttatttgacttagtttttcttcggcagcagctaaaaaggttgtacaagcattttcttgtcaaagaaatcaccatgtttattctttgcttcaacctctgtgaattgtgttgatcatccaatctcaccatgctactgtatggaaaaaaatttccttgtctaaggagcaccaaacttggttgccggtgcgttcaatccatatcggtcatcaactgctaactgaaggcgttgtacatgttcttagtgactgacgccctcgtggttccctcaaaccacctctaacagatgttaccttgcaggagtattagtttacccaatgctttccacttctatttctataatatatatgactctaaaaaatattgaatctctactggtgaactgcggttgtaactataatagtacaacactaccttcttccccgtgcaactatcacttcatatatcatatatgttcatgatatctgatctattgtgacgacttcttccttgtgcagcctaccagtaagacagtaacacagcttttcaagaaacgactcccacactgagggatttgctctgcaatagttctcacctgcatgttttgactagtactacagttcttccatgtctttcactcctataaaattcacacacatataaatatattggcatacaaagtttttgcgcattcaaaaaaaaaaaacttcattctctgccatgagtgagttcacacatttatatgctcaaccttgatgttcatttattagaatggccagtgtactgaacagtacttcctctatatttgctgaaaagaaaaaaaaacagtagaaaataatttggccaaaaatgtgaatctgagtgtaagaaaaacaaatcgagttaaaaagcactactggcattcattaggcaaacatacccataagtattaattttattcgagaaatcaacgtctggaagtttagtactcgagcttgatcaatggtgcctagaagtgtttagtgcaaaaaaaaatgtaaatagaatcaaagagaaaacatgtgtgccattccattgtaggctcagaatttcaactgaaatcacgtgtgtggacgtgctacaggatcgaggtggaagggttcgaaatttcataaacccctcacaaaactagttcacctgaaaattttcactttttaagccaacaaattttattcaaattcagtcaaaatgtgtgtgtgtttttttttgttctaggtctttgtatttgcattgccaaaatttgttagttttataaataaaacatattactttcatcattgtatatacatttataattccaaaacatccactcgcagaaccacatcgaaataaaaatttggtaaggtgtcaacgatgttattggccaagcaaaaatttagctttaccaacaaggcaacatatcaggtggacgatttgagatggagtttgtgcatgtgtgcacgatttgctttgtattcacctgatgtgttgcctaccaacaaatggtaagttttattttagcaacgaattgaacatgtccagaatgttgttattttaaattgtttatacctgaacatagatggctatttatttttttttaaaaaaaaagaaggctcgattgttgcatttcaattcagcatgggcataattagatggaactgcacgagaagaagtagaacaaaaagatgaagctatggcttagcagtatactagtctgaagggaactcttgtagctagctcagaccaatgcagccagtaaacttaacaaaatggcagatcgaactcgttaaaatgtcatcctgtactttgtgcactattattgttttccctgatgtcttccactcctattttatctatgcgtcgcgcgccagcaatctccacgaggcacttcacacatacgctcaaccttaattaaataaagttctatcagcttggcatttgcaaaagaaatatttgtatcactctatatcgcaatagctacagtttttgcacatgagatcggtgtactgaacttataatcatgcacaagctagattctatttacattagtatcccaaggtacctataatcatgcacaagctagattgcccgcaccattaattaatgttgtgtgatacatgtcatctttttatttgcacaggattgtgtgagattgcatgtttttttatagtaaaagaaatactaaatgcatacgctcctaccaatactgtactgccaaaacggagtaaatacattacgaagttataaaccaattgacagtaatatttttactaagaacgaaaagtaactatattactggaaagaatgatgagtaattattttattggagcaatatttatatttgcatagaccctaacaaagtggaaacaaccaccgttagtaacttttttgttcggctaccactgatagtaattcttttactggatatagatggtgggagttagtaaaaggaagtaatttcggcagtagggagggaggcgatccagcttggttgcgctatggaaaaggtggtgaaaagaacaagaaaacacgtaaaaggtggggataggaccacagatctcttctttctataaagttaatgccactaaacacctaaagctaaacatataaacataatatttattagcactcgtaaaacctacatgtaaacatgccacatcaaaactcaacatgcaaacatatactaattatatcacaatttatttcattcaaaaactaaacatctatatgctaaatcatcattctcaaatcattttcataatatttcaatccaaatcatttcatcatttctcaactatctaacgtatatctcacagcaaattgcggggcatcatcttagtgatttaaaaaagggaaaactagaggagaaggagcttggaggcacgccattggattcctagcacgctacatgtcgtgtagcataaccgtatatataatgaaattagcgaaaagtgataaggtacaaatgaggaagtgtacaagttttttttcctgtattgagatgtcactatcaagtactaatacaattcgaatgactcgctgccctgttctaaactactctgttaactttggaaaaagaaaacatcgcttccattgcttctgaataagctacaaattttgcatgactttttgttgtttcactagtttcattctgatctcctctgcctcttgtcccatatcaccgctggttctttttagcccagccatactcattcagctcattgttcttgagggtacaagtcaccatcttctgctgtggcattctctaccctatgcacctatcaccaaagcagcttcctaaaagtgttctgtctctcttggcgatcatctccctgcagcctcggatgcatgagaaacactacagtacattgaccatcattaccaacacaaacaacacggcttggctgggtggaggagccaaaactattcgtgcactccaatatggtcaagggcaggagtagtacaagtaattatcctgacgcctcccacttccatctctacactgtctgtgcccagaaaatttaattttgaatttcatttgaaactgtgtcaaagtgcaacacattactgctggtaacaacattacaacatcatccccctttgccaggcacatatctccttacgtatgtagtgtcctcaccctcgaggccttgatgtgaacatatgttagccagacaatgaatatgcatcgtaacaaaaatatataaatatcaatgttgctgtgacgtttaattgcacatggtgtacgttgtgaagagtaccattatagtacttgattaaaatatataaatactagtaaaaaaataaaatatacttcgtttagtcatgtcagaaaatgttaagactaggcgttcaatgtttcttcggaattaagtcagtgcaatatgaaaataaaatattacttttgagtccaaattaatatatagatctaccaaagctcgttaatcaagaggagatgatgcataattaaagcctgaagtggagatgaaatatatgaagataagtgtaagaaaaaacaacgaataagacagtaggcgagattgttacgattttgcagttgtggaattggcattcgtaccgctgagttgagcttagtagcatgccaaattgcttggctgttgcattggtaagaccatcgaaccatatataaatcttaagcatatatatgttaacaaattataattgcacttcttaaggagcagaatggattagctgattgtgtaggatcgaacaggaagaactaagccaaccagagaggtgaatggttgtaataccccaaaatcaaaacttttaccagaattaaaagttatcctcgaatcgatgtcaatcagtctaaccgaagttgatccgctggtctgaccaagccgatgtcgtcggtctgacaggagtagaccacccggtctaacctccctaaagaagtcgtagtcgcctgatctgccatcggtctaactgccgctctcccgctgatctgaccggtgcgttgccgccggtctgaacgctggtatcccgttggttgaactgccgaactcgagcaaacacaaatcgaagatctctcaaagtagatgacaactttattacttctctctgggtttataaagtacaacaacaacactcctcacgaaaatctcgactaaactcgaaatcctaactattctctcaactcaatgctctctaaagcggtaccgggaggccacaccttccctctctctatatacctgaggtaggcagcctaaagccacgaactaaacttgtacaagaagtcctaataccctaggaaaccttcccgtccaagaaactaactttacaaactccaattgtaccaaatttggaattcttccaaattcaactccgcatcctatacgcacataatacctccatcatatgccatatggaatcttcaccaaccacatgcattgatctttagtgtaagtatcccgcataatatgtaaccatccggacgtcatcttatcctcaagttgactctcgatccatcactggcaacactctcccgaggcaacaagacaacctacacatgcatcaaccaataaaacatattccgagcacaagctatctccaacttgactccttcattagcaaacaacagtattacatacacaaatttcactgttaacaaagtcataaacacaaattatcaacagatatccaatgaaacaacctgataccgaaactgatatagagtcggccggtcagaccgtgggctgaccagtctgaccactcaaagcacgtcggtctgaccggcaactactgcccggtctgaccggacccgacaatcagcagtccttgttcatcacctgtaaatccaatcatctccaaaaccacttcgccaataatctccaaatatcaaaaccaataatctcatttgccaattgttcatcacagaataaaaatcaaacacactttgattttacagattggtggtaacttttcctagctaggacattcctgcatggcttaacatccaaaggctctgttcggagttcattgttaatggagctgagtaattgtattggatgttgcactacaagcaacacgattttagatgtcccaagtactattcttatgtttcaggactaactgacagttgaggaaagccccagcatttatctgcaacccacaaaataggagctaaaatataaacatatggcactgtcgtcgagattccagggaattcgcattagatcatgtcctgattagttccaatcctataaaacttatacataccaatcattaaagatacattcatggagttccttactctcaatcagtactcaactttttaattttgtcgaatgtttcatgctaaacactattggaatactatggctgcagttgcgcagtttcacacactgaatggcaaggggaaaacaatatgcaaattgtctcaactgcatcttcagagctgagtatatatgagtagctagctcctctaaaggtacatagtgaactaagatgcttattatgtgcattgtttggggagtgtctccggatcgagggaagccagcctccgaagggctgcggcactccggagaaccatcctcccaaggagatgactgtgggtcgtgtaggatcgaatagcaagaactaagccaaccagaggggggtgaatgattggtatacccaaaaacttttagcggaaataaaagttaccctcgaattcgacagatcgcggtatgaccgaagtgaatgcgccggtctgaccgcttgatgaacgtcggtctgaccaagatctaactccggtcgaaccaccgagatcgcctgccgcagactcctgtcgacgccggtctgaccgccgtattcccgccggtttgaccgccgcgatgccgcctgtctaaccgccggtatgtagccggttggaccgccgaaacccggtgaaacacaaatcgaagaactcttaaagtagatgacgactttattacttctctctgtgtttacaaagtgcaccaacagcactccttacaaaaatttcgactaaactcgaaaccctaactcaaaactcaactcaattgctctcaaaagcaataccaggaagcctcacgctccccctctatttatacccgaggtaggcagcctaaagccacgaaccaaactcatactaggagtcctaaacaccttaggaaaccctctagtacaagaaagaaactttacataaccaatcgtaccaaatttggactccttccaaattcgactccgcatcccatacgcacacaataactccatcgtataccatatggaatctccatcaaccacgtgcatcaactctagcctaagtatcctgcatgatctttgaccaccacggtcgtcgtcttaccaccaagccgactcccggtccatcaccgcaaatactctcccgaggcatcaagtcacctacacatgaaataaacaaagaaaccatattccgagaccaagcaatctccaacttgactcattagtagcaaacaacagtattacatacgtatagtatccatctagaagtcataatcatgtaataattacggatatccaaataaacaacccgaaaccgaaactgacatagcatcggccggtcagaccgcgggctgcgccggtctgaccgcgcaatacacgccggtttgaccggctaccagagcccggtctgactggtcacataaaatgatagatcctgcgattcacctgtaaatccaatcctctccaaaaccacttcgtgagtaaattcgaaataataaaaccaataatctccaatgcccaattgttcatcacagaataataatcaaaacacctttgattttacaggtcaaggccatgtcggtccctggccgaggtggccgctccgaaggcctccagggatcctagagaatcggatcccgcggacggcgagtgcgatagagcctggaagggcttcggagatcggcggaagggctccgggattgctccaggaggccatagcacccatgggccctagagccccagaaggcatctcgagctccagagcgtgaagggcttttggagcccggcaagggagctccggaggctgccagaggcttcggagcttgggaggcccccagagttcaagaggccgcccggagcgattcaagcacttgatgtgcttccactggctaaagtcaggaaccaggcgcgagtgggctggaataaatgcgcactacgcgccccaactgcctctgacaccattaatgacgaccaagcggagcacgctattacccggggcatgcctttatccgtgtaataacaggttccctcgggaaccagcgctgcctcccctatgggcgcttcctccctctcacctgtaagattaccaataggtccgagggtggcccactggccagccactcagattcctcataggactaggggcattaaagccatttccccttgtatactcctgtataaatatgtaaaaaccgctctcatttggggcagatcgaatacagaaggaatattgatacacttgttgagcttttgcaacaacatgcagtacagtatgtgacttcctcaactatgtgagttaaatgatcagttggatttctcacaatcagaagaagcaatcacattgtaacaaaatacttaaagcagaaattgagttctgctcgaattctactggaaccagagcaattttgtaattgtaaaggtaaaaacatacaaaagtttaatgtctccaaattctggaaaatgctatcccacaactgaaaattgtgaactgtactgcaaaatatatattaataataattcaagtatagctagactctcttaaattaatatttgatcataatctgactaacattagtagctcatgatatctggtattttattttacaattactgctgtctgaaagatttagcaaaaaaagggatgagatatcaatgaaagtatgttctgaattaattattttgttagcaaggtcagcaaacagagaaagtaccgggttttctttgttgctgtcgtattctcatactaatgcaattgccaagactcactaccctgttttcaactgctctgttcacttgataaaaaaatacatcgtttaatttcgacttcctttgcttttgaaaattccagcgaattatgcatgcatgacttcttttattattatttcacttgtttcatttcaatcttctatgccttgtcacacaatgagctagatcacgtgtttccgcagtgtagaaacaaagtaccatgttttgtagtagttggtaattaattcctaaacgaggagcacaataatggtttagcgagattagctaccaagaaaaagagtagggcttggatgggaggaggagccaaaaatatcataattctaagctataatgtaagattgcatcctactacaccaatgagaaaaatccgttccatcgataacatgaggcttagttgaaaacttattagaagtagccatggcaaaaactcaagattgataaagatcgaaaagagcaaacgtggctctcataccacttgtagggtcgaatcacaagaactaagccaaccagaggggggtgaatggttggtatacccaaaaaccaaaaacttttagcggaaataaaagttaccctcgaaatcgatggatcacggtctgaccgaagtagtagcgccggtctgaccgcctggatatcgtcggtctaaccgaggttgtaacaccggtcgaaccgccgagatcaatcgccagctcctgtcgccgccgccggtctgaccaccaataggtctgaccgccggtgagatgccggttagaccgccaaaacccggtgaaacacaaatcgaagaactcttaaagtagatgacaaatttattgcttctctctgtgtttaaaaagtgcaccgacagcactccttataaaaatctcgactaaactcgaaaccctagctaaactagcaactcaattgctctcaaaagcgatacaaaagcgataccgggaagactcacgctccccctctatttatacatgaggtaggcagcctaaagccacaaaccaaactcatactaagagtcctatacaccttagactccttccaatcatactaaatttggactccttccaaatttgactccgcatcccatacgcacacaatacctccatcgtatgccatatggaatctccatcaaccacatgcatcaactctagccttagtatcccacatgatatctgactaccacggacgtcgtcttaccaccaagccgacttccggtccatcaccgtaaatactctcccgaggcatcgagtcacctatggatgaaacaaacaaagaaactatattccgagaccaagctatcaccaacttgactcattagtagcaaacaacagtattacatacgtataatatccatctagaagccataaccatgaaacaatcacggatatccaaagaaacaacccgaaaccgaagccgacacagcgtcggccggtcagactgcgggccggccggtctgaccgctcgatcaccgccggtctgaccggcatacacaacccggtcggaccggtcacataaaataacagtaaatccgatcatctccaaaaccactttgacgataatctccaaatatcaaaaccaataatcacagatgctaattgtttatcacggaataagaatcaaaacacacattgatcttacagatcctacaagtaatttgtattggatgttgcactacaagcaacacgattttagatgctccaagtacagttcttatgtttcaggactaactgacaattgaggaaagcccaagcatttatctgcaacccacaaataggagctaaaatacaaacacacatggcactgtcgtcgagattccagggaattcatattagatcatgtcatagtctcaatcctgattgcttccaatcctttaaaacttatacataccaagcattaaagatacattcatggagttccttactctcaaaaagtactcaactttttaattttgtcgaaagttcatgctaaacactattggaatactatggctacagttgcgcagtttcacccactgattggcaaggggaaaacaatatgcaaattgtctcaactgcattttctgagctgagtatgtatgagtagctagctcctctaaaggatagtgaactaagatgcttatgtgcagtacagtatgtgacttcctcaactatgtgagttaaatgatcagttggatttctcacaatcagaagaagcaatcacattgtgacaaaatacttcaagcagaaattgagttctgctcgaattgtactggaaccagagcagttttgtaataaaggtaaaaacaaacaaaagtttaatttctccaaattctggaaaatgctatctcacaactgaaaattgtgaactgtactgcaaaatatatattaataataattcaagtatagctagactctcttaaattaatatttgatcataatctgactaacattagtagctcatgatatctggtattttattttacaattattgctgtgtgaaagatttagcaaaaaagggatgagatatcaatgaaagtatgttctgaattaattattttgttagcaaggtcagcaaacagagaaagtaccgggttttctttgttgctgtcgtattctcatactaatgcaattgccaagactcactaccctgttttcaactgctctgttcacttgataaaaaaaatacatcgtttaatttcgacttccattgctttcgaaaattccagcgaattatgcatgcatgacttttttttattattatttcacttgtttcatttcaatcttctatgccttgtcgcaaaatgagctataatggtttagcgagattagctaccaagaaaaagagtaggccttggatgggaggagccaaaaattcatgcactccaacatgtccaagaaacaggagtagcagtaatttccctgatgccttccacttccaattgtaagctgtctgtgcaaagtacatttaaacatgaatttcgaaactgttgagtggtatgcgttttccaaggttgggtctcctcatgtatgtgggtacagaagtagcagcaattttcaccccggaggcaatatatatgtaatatagacaaacagagcgtgcatcgcaacaagaattattcatatcacttgatatatatcactgtagttgtggtgtttaattggagaaaaacagagcgagatgcgaaggctaggcattcgatggttcttcaagagtcaatggaaggctttcaataggtagttggttctgttgattaattaagcacttgggctaccaatttaaaactacgggtgtgtttagtccacgctaaaattggaagtttggttgaaattgaaacgatgtgatggaaaagttggaagtttatgtgtgtagaaaagttttaatgtaatggaaaagttgaaagtttgaagaaaaagtttggaacaactctattgggactttgcatgtataaggatttaagaggacaactctattgggactttgcagaacctcttgcgttggaggacacaactcttaaataaggcgctagattattttctctctatgtacattgcaataacattgtcgcactactgtcttattaaatgggaaacacttcacatatgctcagtctccacatcccattagttagctaggcactgcgaaagaaaatatacaacttgatatcactgcagctgcgactttgaacacggtatatcaatacccaatttacttggtaaaacaaacaaagagagaagagctgtgccataaaaaaaaaatcaaacattacttttgagtcctatatatagatagagctgccaggaattgttttgtgaaaggttagataagtaatttgctccaaaactcaattcaaaaggataagagcaaatcattatgttttttggttaccaccattgcaatgcgcgattatcattcacttgtttaattggctaaatggcaaagcgaccaggacagggtttgtaattttggttgccaccgaaatttcggtggttgccgaaaatttaaaaaattcatgattgccgggttattttggactgaaattatttgaatttttaatatattttgactgaatttgaataaattttaaccaaatttacaaatatttgataaaaactaaaaattttggggagatttgcgcttgctggtggggccgaaatttcagaaaattccaaaccatggatcaggatgatgcattattcttcatcttcagtaatctgagttttttttttgcaagggcagtaatcggattaatcgatttgtgaggattcttatgtacacccacgacttaccaactccaacataagttaatttccggatcctaataatctgcatcacccaattacttgtatttcgtactgatgataataattctcacatcaaatgaacatatagtccatacatgaaagagaaaagaatagataaaattatataccaataaggaccaagaagataggaattaggacaaacaacaccgaatagttgcagcaaggctaacgcgacgcaatgatgcctgatgcaaattaaggcccctttgatttaaaggaaatttataggaattagctctttgaatcaaaggaatgaaccctataaaatcctatgaaatctatctatctattatataataaaagtccattaaacttcctacaaatgctcccaaactgccacgtgtaccctacaaacgctcccaagctgccacttggcactatgataaattatagaaattcttaaaattctaaaaaaaagacaatacccaaccgttgattttcatttaatctggtcgacccgatatttttaaccattagatcaatctataaagaaaaaataatcctccaatccctatcagtattgtacctacgtggagtcgtagtaggtatacgtacgtacttggacccgtatgcctcctctcttcctcctctgttccctctcttatttcttattcctattcttatgcaatattaggtagaaagcacaataggtgagcacaattgacaattaaacaaatataacatctaaactgcttatatttaatctttcaaaaagaatgtcatgttttggttacaatttctgacttttacgtgccatttaaataattccaaaatattatgaaaaaataacgatatagattttatcatcaaacataattacacaataattaaattagaaaataaattactccccggtaagtcaaaataatataattatacgtgtcttatattatattatatactataaacgcttataaattgccacatgactctttaataaattagaaaaattcctacaaattctaagaaaaaaagaaaaatatctttagcattgattttcatttaaaatgttagaccaattaattttaaccattagatctatataaaataatataatggtgtggaccatgcgtacatcgatctaatgtaaaggatatgagaatggttatagcttccttcgtacacttatggaagaagaaaacattatatagtagtctaaaaaatcgagattcatttttctttctgaaacttaaaaaaatactaaaagtccattatacttccaataaacattatcaagccaccacatgcatattctacaaatgctcctaaatcatcactttacgctataataaattaggtaaaatcctataaattctaaaaaaaagaaaaatatcttaccaacggttttcattcaaatcggtggacctattaattttaaccattagatatatataaattaatggtgtgggccatatacattgatctaacgcaaaggaaaagagatcggttatagcttcgttcgtacatatagagtacaagacattggatagtagtctaaaaaattgagattcatttttttttcttgaactgaaaaaaattaagactttgatcggtcacaattttgcccccatcgacattactcaggacactgtcagcgtgagggggcaaattagcttgggactacatgtatgtatcatgcatgaccgagctaaaagctttatctaccaattattttagaaacttaaaagttaaaaactatttagtatttaaactacaatggttgtataaatggctaattctttcaaacaacaaagataaaataggataagcattgtaggcttcatatttaggattatgcaatataaacataatccataaaggcctaatgcatgttagctaaataaaatcacaaagtgattgtttgcattatgtaaaatcctaatgtttaatcataaattttagagttaaaaatatttaaatcatgacaacaatcataccacactacataataatcacacatgcggagttatttttcgcaatgaaaattatgttcctgctaagctacatggagtctcacacactctacacgaaacaataaactatctcctacgctgcaaaatcaatttagactcgagaaggctttttatttgaaatatatattgtgtcacatggaccgaaggcatccattaataaacaatgagacaatcaagtatacagagaaaaaaaagcaagtgcatctcagcaaaggatacagtaagttgtaaaatatgtagccaatttgctacataccaaaaggaacaccaaaagtaactatcaagttcgttgattgttggcaaacaatgatatcggcacaaagatttatatataccattattttcataaccaatcaatgtgaaatgacaactttaagccacttttctaacgtttttaattgaatatacaattatgttcatcacattctaaacaaatgatttccgcgagaatattgttctcatgttcctcaaatgtgcagcctcctatgtgatgagccttttgcctcggactcatgggctacctttagaaataacttttgtaatgtgtttacatataactactttagtggagtacttaacccagaaggtagagttgaagcttttacacagtgaactattttagtggagcacttaacccgcaaaagtagtattgaatcaatctattccattggttacagaggaaaaaaaagttcattttacatcctaacgatattttattcttttaaactttttttcttctctacatacaagtcatatttcactttgacacatcaggagatgaaggtcaatgataattaaacgaatacactaaattccacgacctg

SEQ ID NO: 46089 - DNA, 29392 bp, Oryza sativa
aatgcgcgggctaccttcctagtttataagaaatgtctcttcacatgcaagttttgaaagaaatttaacatgaggtatatcctcatggaaaaaatctttttgagtctttatctctccttaaattcctgtgtcttttctatggcccaatcaaatgatcattcttatgtttttcatgtgttttaaaattctctgttttacacttatatttctatcagaatactatgtttttcctatccgtccactttttaaaagattgtcttcggttagaatgctatttttttaatatcaaccaaataaaaactttaactctcggtgggatcttaaacttccatatctcttttgaaatctaaaaccagtgttctgtacgatcagagttcaatagaaagatttaactgtaaaaatcccattcattgtatgtttccagattaattgatctggttcatctgtcataacaatgttctgacactgcttattcaagcttccccagtttttttcattttcgtacatagcaaagccaaacggatgctgaaacgatataagctactactccctccatcccaaaatatttaacgccattaacttttttaaacatgtttgtctgttcgtcttattaaaaaaatttaaataattattaattcttttcctatcatttgattcattgttaaatatatttttatatatacatatagttttacatatttcataaaagtttttgaataaaacgaacggtcaaacatatttaaaaaagtcaacatttagggaacgagggagtagcatggaatttctcgcctcagccatgtatccaaaaccgttacctgctcatgtcctcgatgccgatttgataattgatactgtaggtcctcaagttttatgtctccacggctatgtctgtcgcagctcttgctgagcaatgaattgtgtcatatatacttgcactggaatcttggatacctggacaaatgaagcctgtaatttgtagaagatggtcaattgattcccttaatctctcgaatctgcgtgttgtatttctcctggtaccttccactcctatatttgtatagtgttagtgtatgactaaaaggggcgagaccgtgactgatgctatgtgctgccggcaaaaaatgttagacatgcctggagtgtcagttcactcatatatatgctcacctacagtgtccaaatttattagctgcccatttgtaacaagcagattttttttatgggacatcgtaggggggagaactgtctacctgaatatatattacgtcaagaggtaccatgagataccattttttctattgtaaaggtacctagatattataagatacctttttttaataaatttttgatatctctctaagaaccgtaaaattgctcttacgtcaaacgggcatacacatggagagctttgatcgtgtaaaaggaggataatcagaggattacattggagattgcagagaggtgaaaactaagcggatcacatcatctgaagtgtgcaatccgtagagagtacatgagtactacgtatctcaggtacttctgagcatgcaccaccattatatcacgatttatttcattctaaaactaaacatatacatactaaaccatcattctcaaatcattttcataatatctcaatccaaatcatctcatcatttctccattatctaacgtatatcccgcaggcattatctagtgatttaaaaagggaaaaatcagaggagaaggagctcggaggcacgccactggattcctagcacgctgtgtgccgtgtagcgtaaccgtacatgcaatgaaattagcgaagtgacaagataccaatgaggaagtgtacaagtttttttttttcctgtattgatctcaccatcaagtactaatacaattggaatgactcgctgccctgttttaacctaccgttagctagcttagaaacaaaaaaacatcgcttccattgcttctgaataagctacaaattttgcatgactttttgttatttcacttatttcattttgatctcctctgcctctttagcccagctgtacacattcagctcattgttcttgaggtacaagtcaccatcttctgctgtggcattctctaccttatgcacctatcaccaagcagcctcctaaaagtgttctatgatggctgttcattcgctccctgcagacttgggtgcatgaaaaatgtactagagtatagtgttcttcattaccaagactaacaggacggcttggctgggtggaggagccaaaaatattcgtgcactccaatatgatcaagggcaggagtagtacaactaattctcctgacgcctcccacttccatctctacattgtctgtgcccagaaaatttaattttgaatttaatttgacattgtgtaaagtgcaacatgttgctggtaacaacattacaacatcacccccctttgccaggcacttatctccttacgtatgtagtgtcctcaccctcgaggccttgatgtgaacatatgttagccagacaatgaacatgcatcgtaacaaaaatatataaatatcactgttgctgtgatgtttaattgcacatggtgtacgttgtgaagagtaccattttagtactggattaaaatgtataaatactagtaaaaacaatgaaaatatactccctccgtccccaatataacaacttttagcccttaggatttatccaaaaatataacaatttctccatcaatatttttttcccaaccaatcacgatcctccactattcatttttcccacctacctccactactcattcagtcacaactcactaacattcacttttatctactttcttaataaccatgttaaactctaaaacttcttatatatattctcggatggagggagtagcttttagtcatgccagaaaatgtttaagactaggctttcaatgtttcttcggaagtcagtgctaaaaaaaatcaaagctcggtaatcaagcggagatgaaaatcaaatattacttttgagtccaatagtactaccaaatgctcgttaatcatacgaagatgaaaatctgagacatgcatgcatgaataaagcctgaagcggagatgaaaaatattcggcaatttatttagtagactagaaaagatgcccatgtgttgtaataggtagagctaatttaatttgtacatattttgtagataaataattacaacccattatttcgtttattcatgtccttatccaaatcacttattagcaaataaaatactatttatgtgcaaatcttttatatacatgttcttagcgactcaaaagcaaatgctgtaaaataagataaagtatgacaaaaaaccaaaaagtcgaattcaaaattaatttctaaaattttaaatttggcttgtaggaataattataagcaactccaaaaacacgagatcgatttatcctccagctttatctcaagtaagacagctgaaattgatgaaagatggaatcagcaatttcgatcatcctttatttcaattgccatgttcttttcgaaactaaaaccgatttttatggataatccctggtagcacgtacgatagtacgagtatgcgtggagactgacttgaaatcatgctaatatgtcataggaatcgtacagtgtaatacgaatagaatcgtatgaactgggcaatgatgtacgtgatatccacacggactctgcgagtttcatttgcttggtatccacattgcacggactctcttttgtagttcgctcgcgagtcgtgacttctaaataaatgttacgtgtaatgggaatcggatacggatgacgtaccatagttttgacaaaaacatcttcatttttcaaatcgcgggtgaggatgacgcagtcccaatcagacatgcggcaagggcaaatcgcgcgcatatcggatagaaaggacatgattttacaagaatataaaattaaaatcaatacataaaattaaaactgattcaaacacggatgacgtatcaaaattctagcggaaacatcttcaatttttggaatagtaaagattttgagggttgtatacatccactatatattcttctattaaattcacagtttaggaggttttatagtttaacagcatacaaccctcaaaatatactaaataaattgccgaatatagaattatcttctatattctctggtttgatttcgatctcctatcacattttccaagtgggatagcaaccgcctgcccacatgtgtatgtaaaattaagaatttttgtaggcgagcatcacaaccgtgtgaaaaaaggattttcgcaagctagaaaggaatgcagctcctgtgcccggggttcgtcatcatcatgctccctatctagcaaccgctgccatcgtcatcatcgatgtcatccccggcctcccatcgttgccgctggcggatcggcccctcccatcgccgccgccggctgatcggtgcacaagggagcttgtaaaaaaggcggcaggatcccggccagccggatgcatgcacgaggagggtaggcgacaggatccgcacgggagggggagagcccacggcacctctcctatctccccaaaccttgtttcactctccggcggagagcgaggaggccaaggccatggtggaagcgaggaggtcggcgcttcagatccggtggcaccgtggtgaagctgcattcgatgacagcgtagtgaagcgtgcgacggcatggatcgggcggcgggggcaaatgagctcggtggaggggccttggtggtggagccctatggcgaggtaaggaagccagtggctgctgttgcctcatcgcttcagattgggcaatctcgctgctcgttcaaggaggcattggctcgacagtggcctcgggggatggtgtgttcttgctactagatggtggcggctcctccccgagctccacgggtatcacagattcaaaacttcttctgcctagatttttcttatttcaaagattgtagtgccggttctggtgtgggtgggcaactaggcaaaggtggcctcaaatttgtaccggttagaaaaccggcatctatataggaaggcctatagtcgtgtcacctactatgatatatacgtcgtgttctacgtgttgttgtatgcagggccggccctaggcctatgcagacgaggcaatcaccagggggccatgatggtgagtgggtccaacacctaatactagtagtctagtaactgcctatggcctacctagaagaagaaacgcgcgaaagacgagaggagttgcaacgtcgtcggcaactcggcagacggcatcgcatcacacagggtatagccgcacaggcgcacaacatcgtcgactcgtctgcaacacagcaactcggcatcgcatcgcacagcacaagtcaacacttagccgcctgcctgcatggcgtcagcccgccggctgccaatcggcagcagcctcccgcctggagccctggacgcaatcacgcaagacagcaactcggcaagagtgcaagactagccgtccaggcatccagctgaaagaattctcttaactatacctgtgatggtagcttcaactgaaagaagtttctcaaaattgaagttgttgaataactatttgagatcaactatgttgcaagaaatgttaaatgatttggctacatgctctatcgagaaggatatcttagacactattgatcttaataacgctcttgatgattttgcatcaagaaatatccaaagaagtatcttcattaaggtagtgatattagttccaaggtacaaatatattgatattttggtcgactttatttctcaataattaccagacatgtatttgttttcattttgtaaataaaattagcgtctatatatcataaaattttatatatcgtttagagggcccatcacgatgagttcatctagggtacgatgtagtgaactcaataaccaagcaagaccgtgcttccgggttgggaggaggagctgaacatttctggactccaataaatcaaagagcagcggttttatgcactttcctgatgtcttccacttctattttctaaaccatgaatgcttacaaaaggcactacatcttaaccaatgttacaacatcttccatgggcatatatatacattgcctcacacatgcttatgcccatgaggccttgagaagggtacttataagcccatattagttggaccagaggtatgtttttcgtctggtcagctagctccgtttttgttcgtgctctcactccttcagtcagcccaacacacacctggtaagacgagttgacgataatgctttgcaattgggatactatcgctgcagataggcatatttgcacacattaattattttcttattaagattgcttcaattactgggtaataatgccccctgtcaaattaaaaccgaatgcctgtgtaatatgaaatggaataaattgtttgtctgtaatttctgtatggcataatgttttgccctttttttttcttcgtgtttatgtacctcaaaatatatctgtagtctagaaaaagaaatcacatgaacttcggttttgaaccataatctcatacagactgtttgcctccacaatagcttggctatgtttagactgtgcactgtacatgtagttgatgttctcatactgggaactacctggtcttgatcaagatcttcacggactctgccaaaatgcttgtgatcaccttgaaccatctctgccacatattagttagtaggagtactattagttttcccaatacctcccacttctactactctatattgtctgtctacagaaaacacaaatcttattcaccggtgatatgtttttgcttgcaataacattacaacaccatcctcatcctcagggaatgcatctcttcacatacgctcacctttcttttccaatttatcaacaaagcattgattgttttctgcaaaacaaatatatatactgcccttctccggatataaatgaacattgcacatggtgtaagagtatattcacgtagttgtatattctgcagtgaaaaaagcgtgaaggaaagctcaaattgatggaactgctaagtaagggagacaaccaaaacaagaacggcaaacagggcaacattagaaggtgaaaataaaaatgacaaattgatgaagacatgttggcgcgatatccgtgtaagacatgttgcaggcttgcagctcggatatcggcatatcgttgtacttaagcagcatagatgcagcaatactgaattggtcggtgaccatcgaactaaatatgattgttaaacaaaggcacatgttagagtttatgcactacgatatgaaatgatttttcaggacgatatgctctttaagttgcagacgggctataactgctctcgcctgcaaaatcactcccccaatcacggttcaacaactacatgcgaaaatcaattttcgtaggcgggcctcttaagtggcttgcatccgaaaatacccctccctctgtccacatgttttttcctcccctcctctcgcttttcccactaagtccaactcgacactcccagtaagtctaacagttctctcaaactcctccaactctcccactctcgaagaagcgatggcgagcgaaggtgccgggctcgggtgagagcggttgtggcggatacggcagtgttgagcaaggcggtggcggatccagtggcgggggaggagggctcgacagcgggtgagggctctggcatggggtgcagatcagccacggccaacctcctcccctgacgaagcgacggcgagcgggggccgtggtgagaaggatgtccgctgccggcatcaattggaggggtggatgcccgacgcctccttcccctccaacgcggatcctgccgcccctccgtccccacacgtgtggatccgtcggcggcttcgagcgatgacgatgaccaggatgccagcggtagattcaagcgacaacgacgacgacagcaatgacaaggacagcggcgacggcttatggattctagggttagggtttagggattttcaaatttttattttatttttttccttttcgtcgtcgtttggctgaagcgtctgcttgcaaaaatccagatttttgcatgtggctgctctacccacttgcaaaagtctaattttcacggactattaggtgcatgcaggctgcccaaccgtctgagaaaatcgtttctgacaacatgcaaaaatcatttatgtaatagtgatggttgatggaactatggatttgagcactattagcaaaaacagcttcagattctccatggttaattgaccggaggacccaacgttgattatccatggttaattggccgctcacaactaaacatacaacacaatctgcgattatgtgtaatgtgaatcacgtcgagtcgttgaaatcatagagttccttctttactgccgtctcactcaattctcaattgtactatttttgaacttcactgatgtcccaaggggttaaaaaaagagattttttacgatccaacggtaccgtcggcaccaaatcctggtcgttagatctggcccgatccaatgattggtagtgtttggtaccacgaggtaccaaatatgtccctgttttggtacctcccgtagaagagaggtgaaagggcaaaaatgtaacttcgcgtgcaatagatgggaggaatagatgggcggaaccaattttatcgcattttacatcctcttctacgttgccgtcatgtttctctccccctccccccctcccaccgctgccgtattcctcttccacccagccaccaccattttcctcttatgctgccgtcgtgttccacctccagcgccgcaacttcgatctgggccctagcgccgaagcgagattgattgcggcgtgtagggttgtgccctctctactccgggattcgtggtcttccgccaatcgtcgcctagatcgacaccatcaatcgccactgcctagacgtcaactccgccaccgctgggatcgaccgccgcctcctcctagatcaacgccgccacctcctggacgtcaactccgccgccgccactaggaatgacgacttggacaccgctgccactgggaacaacgactcgaacgccacatccacctttgctcatcttttctctctttatcctacccttcctggattcaacggttagatgtgttttagttctgagctgtaccagtaacgaccggtacaacctgctggaccatgaagacgatcttcaaaaaaacatggcaattatttcttctgcatcctcagacttgagagaatatatcaatagctagttctttctgtgagtaggtgaaagtgaaaatttcactatattctctgaaaaggggttattatttcgctacttctacttgtcaggagaagaaacatcaatgaaacatagagatgctgactacaagacccatactttcatgatctctcgtcttgtaggaagaagttgtatggtcatttctgacggtctcaactttgtgatttatctatcgatacatcatgctccatgccgaaatgtacatattgattcccactacatttcgtgaagtgtggcttttagtttgaggtactgtaagtacttactaaatttttggagtgtgcatggatgtgtttactgaatttatcgaaatcacaatagcttatgtgtttggaaaaaaaaactaattttcatagatgattcttacaaggggaacttgaaattagctagtgcacactgcacagactgacactgtagattggcatatgcccgcagaagtcttgagtatcacagactggcactgaagactgacagtgcatgagtgtagtagcaatgcatgacagataaatgtcactcttttgctggtgtgcaatgcaacaccctgcagttgtttgttcactctgacgattgacacattttgacgattttgctcattatctatttaacaaggtcactcaaaagttgtagtcgatgttgtggtctaaacttttctcgatgaattacgcaatgaacgaactctctttcactgaagaaatgttatgccttggttcctgatgacttccattcatattatatcaggaaggaatcaacatggatcggatatgatagatggtgttgccaagattgatcgatcgatgctagcttcagcaccatatatatactcctcaagatccaccttatttaatttcatgatctatgggtgaagacttacttttgagtgacatagctaacatatttcctactccctccgtcttaaaaaactcaatctaaataaggatgtgatccttcctattacaacgaatctgtatatctagagattgttcagatttgttaaccaggaagagtcacatctctgtctaggcagaggttttttttaggatggagagagttcgattgacagagagcaccaacatcgatcaaactttatgcagaactaaaatcggcgtagctcagatgtagccctggttgaaatattgctgggtacgatttttgctgtttgtgccgtactgttccataacatctagcctgttttgattgagctagaatgaaaattaattgatggccttgtttagattcttttggattggccaaaatcctgagacatccacccatacgcgctaggattatattcctaggaggcagtacataaattagtgcatatcgcatataattaaacactgattgcaaaacttggagcaacaagttctaagtaattttgtagttcttgataggtaaaattttaatgtaaattttagcaccttctagtaccctatactactagagaatatggtatctcgtgataccttgtcaaggtttgtaaaatgactgtcactccaacgatactcgtgtccattgcttaattttcagtccttttgacagtcgccgatttgccatcgccttatttcagtaataatctgcagtgttcagtagttgattcttaatcttagagcatgcccaacagcttccttttccaattccctattctatgatttagggaattttgatcaagaaacagatccaacagattctctaactgatatcccaatatctctggttcctcagtccggatatatcgttcctcacaaacagggagcgattttgttcccaatatttcctcgtcggtctctctcgcgcgcaaagggaaaatgttcccgcgcacttctccgcgccctcgctcctcggcggctgcaccttcttcctcggtcgcggcaccctcttcctcggcggcggcgtcctcttcatcggcggcagctcccttttcccttttgcaaggcacggggtgtggtgtcccgatgacggccggaggtatgccgtttccgcagtacggcgagttctggcccggcggccatgcgcgccccccaccgccgcccgccggccatgcgcgccctccacaacgctactccggtttttaggcatccgaggccatggagaagctgacatctagcgagccactggatcccctctcacacgaagcttctatcggcagttcctccagagtatggactgtaggtgacgaagaattcctccacatgagcaatttcggtaagtccaatcctgatttgttcagtgtttagtttacatgctctgaattccttcacatctgaagctttcttaattgtgctttcttttttttcttcaatctggatagtattgtcttatttatactatctgatagaggttgcattttcagaaattttcatcatgttcttttgtgtatgcttgcaattgtagcaaaattgcctgacttgaacaagggtatgtctgctgtatgtgctgatgtacttcactgtggtgtatatcctgcatttatgtccagaagtatatagggtatgtacagcatgcaggaaagaatactcagtggtgttgtgctggaatttcagtttgacactatgtagtgagtataatatgctatcaaatttatgctctgagtttgacacagtggaaattcagtatgtactgagtttcatatacgatgctctgaaatttgacctgttgaacagttatctgaaccttgtcgctgtcaggatcgatataggaacatttctatgaaccttgtcattttcagtatccaaattagcaacatttgtgtgctctctccatgcgaatgcacagcttttgattaatattatgtgtacacaaagttgtcaccatccaatacatgtgaaatttcaaataacagaatgcattttttgtccagaaattatcacttgtttgtgttttgttagtctttttttttctcaagtacaaggttatgattttttatctatggacagatgatatggagcgagagcgatattacacaaacttgatcaatgatgagagcaaccattttggctcgagtgagatgggaagccagtatgatgatgaacaagaaccagttgtgaatgaaaatgttgctgtgagaccgaaccaaaaaagatcaaaaaatttcagtttggaggaggacaaccttttggtgtcggcgtggataaatgtttctttcgatccggttcaagggatggatcaatctcacggtacatattggggacgtattcatgactactttcatcagaacaaggaattcgaatcagatcgctcccaaagttcacttgtacattgttggtccactatacaagaacatgtcaataagtattgtggtttcttaagtcagattcagaatcgaaatcagagtggtgtcaatcatgaggacatgataatatattgcttgtgttgcttattttccaatcgtctcctttatgtttctgacttcagttcatttatttgcagcatgtgcaagcaagcctgatgtacaagaagaaagaggaaaagaagtttcagttcatgcattgctacaacgttttaaagaatctgccaaagtggaatgataagcggaatcagctggcagctagtaaaacttcaagcaagaagcagaagaagaccgccaatgattctcctgcgatatctactcctgcatgtaatgttgatgagaattgggctgctgatcctgagaatacagtaggtgagggaagacccatggggaggaagaaggcgaaacaacagatgtgcgaacgctcggatctatcacggaaagagtccttagactatctatgggataagaagaaagaggccgatgcggaggagcgaaagtttgaggagaggtaccaaatcgcttttgcacttgagcaaaagcggattgatttggagagagacaagttcgagttcaagagaatgataaaagaagataagcttttgaggactgatactagtgcaatgagcatcgaggagcaggagtactataaaaatgtgaagaatcaaattctaagtcatcgttcagctcaagcataaattagtcttattactcatcaattagcattcaaaatttgttagatctttagctatagagcctacttaatggactagtaaattgtactatcttgttttggtactgttttatgtagccggagcatttgctactactacaaaattgctggaaattgtttttttgttgaaaattgctggaaattgttgttgatggaattgcttcttcatctcaaatggccctgttactgatagtgtgcattttcagttcatgttgtccactagtgctgaaataacccggttgttacagagccattcaggcatcaattttacaagggttgaaataagtttcagtccattaaagtaactgtcagaactagtagcaatgttcgatgatgattggcatgtaaaaccttcagttcatggacttgcatatgtagcaaaaatgccagaatttatcatcggcttgcatatgtagcagtgcatattctgatgtacacccttgtggtgtatatcctgtatatatatccagtcctgaaaaaggatatgcactgctgtccttttcagtctattgtactgtatcgaattcaacaataaatcacattgtcaataaataattactataagctcaatatgtactaatttaaaaacaagctgtgaatctccaattattacaatctatgacattatctataagaatatataatgtaaaattaatatcggtctgcatgatgattccacaaatgttcgatgaggtcttcccttagttggttgtgaacttccttgtcttgaattttttcgtactgactaataaaatcattaaagttggtcgtacgttcatgggaaccacccacctgttctcccatctcatcataaactaaatcaaaatcaccatcgcgctcgtcctccacaatcatgttattcatgattatacaagctctcattatctgattcagagtaagtgctttccaaaaacgagctggtccacggactatagaaaagcgagcttgaagcactccaaatgcttgttcaacatccttcctagcagcttcttgtgctttgctaaaatattttctcttatttccttgtggcagcttaatgctcttcacaagtgttgcccatgaaggataaataccatctgcaagatagtaccccatagtgtagtcgtgcccgttaatactataattaactttaggagccttcccttcagctagctttgcaaacagcggtgagcgttgaaggacattaatatcattgtgagatccaggtgaaccgaagaacgcatgccaaaaccgtcggtcacgtgaggcaacagcttctaaaactatagtaggaactccctctttccctttatactggccttgccatgcagtcgggcagttcttccactgccaatgaatacaatctaaagaacccaacattcctgggaaccctctttcttccccctgagcaagtaatctagctatgtcgttctcgtttggtgttctcaaatactcctctcccaaaaacttcatcaatagccaccacaaacctgttaaaactctcaataacggtactacctccaatacgaacatactcatcaactgcatctgccgctattccataacttaacatacgtgacactgctattaccttttgcaaacatgacagtccaagcacaaaatattcatcatgtgcttctatagcattcattatgcgtaaaaacagaggtcgtctcattctaaacctgcatagtaattaacgatattaattatctttaatatcaattttgcaaacaaatattgtcaaaacaaagcactgctaaaaacctgcgtctaaactgaacatcgaggtacgtaggttcttcagaaaaataatcattatataatctccgatgtccagccaatctttcccgattaattactgcatgacctataacagatccaccacgctttggaacttcatcatcgtcgaactcatcgtacactatatcaaccgccgaagaaataaattcttcgtagccatccaataaagactcctcatccaatagcatttggaggagggtacttcgacgactcatcttctcttttttattgccacagggttggagcgtttaccacagggatgaagtgcaatggagagaaccgatggcaggaatacaacaataatcaatctataaaattaattattagatcaaacttaatattttccaacaatagatatccacataaccaaatagagacagatattgactagggcacaagagatcaataggatttgctagggattacctccttgatgacacgaatagctatggcatatccttggtattccgtttttgtagaaaccgcagcactcaggacactggttggctggtgatgatgcgatttactcagatggcggcgctggtgtgggagggagaaggtgctgggagggagaagtctcggcgctggtgcgaggagggagacgattgatcggtaccgaactaggcccaccttgcttatgtggcaaactaacaaatgatagggaattaatttttgggcctctcttggaggagggggtgattgttgggcctaattcttattttggaattcctaattcagattttttgggaatcaaatattgagtgactgttgggcatgctcttaggaaagcatatttatatctatagtgcttatgcataattgaatgctagcaaaaactacactacttaaagatgctgtatatgtcaaaatctcggcacagtagctagctgctgaagcaattcaaggacatttgtattgccgtacttatccgtattttttttttttggaaacctacttatccgtaattgaatactagcaaaaacaacactactcaaaagctttaattgcatatgtcaaaatctcagaacaaaatgacatataaggaaattcagtaactgtttttttccgtcaaaatacattgaaatttgatcaaatgtgcagatttgaagttttagtttgttgggtgccacagtgagagtcttgaggtcgtcgatcgtgccaaaacatatctgaaataggcgccttgtctttctatctgtcttaactcaagttaatgagtaatttgtagtctataaagagttatttgtaaaacatctcgatggggccatggcccagtttgattagtctccacagtctggactgaacgaacgaggatcctattagttaaacaatttcagatgcaactctcatgacggttttactcattttcccgatgccttccatttcttcagtagagattaggagaacaccatcgatcattcggtcatctcatcatcctatcctatattgcacccaaaagaactttaggtaaattttccttagtctaagaatttcgaacttggctaccagttaagcggtgagctatgtatgctttgcaaggtaaaggtccatcagttcacatatatatatatctatgctcacccatcgtctatttgtctctaattaatatgttgaatgtgcttggaatgttcattgagtacaaaatgggtataactctgaggccctaggccctgtttagatcccaccataacatttttcaccatgtcacatggaacgtttgaataactgcatgaagtattaaatataggctaaaaataactaatttcatagattgcaactaatttgcgtaacgaatcttttaagcctaattgctccatgatttgacaatgtggtgctacagtaaacttttactaatgatggattaattaggcttaataaatttgtctcgctatttattgacggattctgtaattaatttggtaccaatgttccaaagtaatctaaccataggacaatcaaagaacaggtgttgaattgtttcctctctatcacaaaattgacaattcgtaccccctttcctccaacaaacagccaaataaaaactttgatcttcaatgtttttttttctgtggaaagtttacttgttccattttcatagcactataaaaggacttcacagtgaatctgccttcttttgtcaagttccaccaaatcttatccctatcattttcattcagctgcagatcacccatctatttttaattttgttccagtctctgagtttctcacaatacaaacatctcctgaactttacggaatcaatccccttctgtttcaaagttgcaatagttaccttctttgtcactgccacattatataactcaggaaatcggtcattcaggggtctacccccaaccatcttcccagaataaagtgttcctaccatcacctacaattttattacaaaatttgtaaaagctctctttcacctccaagatttcttgccagaagtgtgagttgccaaatttatcctcatatctgaattaggcgccttgtctttctatctgtcttatataaagttaatgagtaatttgtagtcgacaggaagttattcgtaaaacatctccatggggtcgtgcatggcccagtttaattagtctccacagtcaggacgcggcgatcgaggatcctcttagtcgaacaatttcagatgcaactctgatgattgttttactagtcttcccgatgcctttcacttctattgtagagattaggagaataccatagatcattcggtcatctcaacaagctatcctatattgcacccaaaagaactttaggtaaattttgctagtctaataattgtgaacttgcatttggccattggctaccggttaattacgcggtgaactatgctttgcaagggaaaggtctatcagttcacatatatatatctatgctcacccttcattgctaatatgttgaatgtgcgtcgaatgttcattgaatacaaaatcacttgatatcaggattcagaaatgcgtgtacttcttttgtacatggtgtacaagtggcggacctaggatttgaacccagggtaggcctagcgaaaaaaatctaaatgcaatacatcatgattcgatataaaacctagtaaatgatacaagtatataactctaaatggttcaatacaagtggataataacaaaaaagtttaaaacttacctaaatgacaatgtaaattgccccttcatcaacaagatctgtaggtggaggtggttcttgttcttcacatgccccttcatcaactagaattggagcatcatctacagcaggaacagatgacccttcatccacaggtgggattggtagatcacaagatgcaactttttttcttcatgcttctgaaaaagaaatacaatgcttgacttcttcattcctcaatctcctgacaaccatcacaccatgcaaaaatgtcatatgaggttcattgtggcgcacaattttgtggtaatctatacaaattactatatctccaattggggaatcatggatataaagaacttattgacggaggtagtactacctgctgactattggaagggggagagcagagggactgagggagaggagagccggacagccggagaagcagtggcgcaatgctcaccggagggggagggccgccagatgcgggatgccggccgggcggcggccgccggccgccggggcgggacgcgcgcgccgacgcgcgtcggggaggccggaggcggtgcaaccgcaacggcgtgagtcgggactcgggaaggcgggcaggccggccgctggtgtgaggggaagagagccgtggcggcgctgtcgggactcgggaagggggcaggcctgccaccggcacgaggggcagagcgccgtcgcgccgtcgcggcctcacgggatgcgggagcggtggcggctgcatcgggcgtcggagcgacggcgcgtgcacgtgcgactaggagtagggatggcaatttctccgacgggggcgggtacccgccggggacccgtccctatggggccggggtcggggctatatttggccccgcgcgtgcagcagggcggggccccgaaaatatgcggggacgggggcgggtctagatttccacccgcgggtgacccatggggagctgaaaatattgtacatacgtagatggcccattaaaaatgtggcacaagcaagcccatgttgtgaaataacttttcctatccaatcttatctaccccagccatacagtcacggagccacccatccagatcgagtcaatgacctttcaaaaaaaaaaaaaaagaaacatagagtcaatgggtagcgactgcatcggcgctaccgcagttgttgcaagcgatagtgactccgcatggctgctgcgcctcgtcagctccttgcgaggctgcgcctctgaccaggacggctgctgcgcttccgtctaggccgcgggtcgccggccgctgcactttcgctgcgtctccggctgctgcaactttgccgcgtgtcgccggctgttgtgccttcgtcgcacgtcgccggctgcttcgcctttgttttcatcgcgcgtcgccggcttctgcacctccgccaaatctccgcgacgctggcctcctcgatgagccaccgcgtcttggctgctacagtcctggtttgccctctttctctacagctttgcagggccccggtctgggtcggggaccagtaggggccggggccgggggataaagtcaggggtcgaggacggggccgttcctgtccaacccggccccgccgcgccccgttgccatccctaactgggaggccgggaggaggctagtaggaaagttagagtttttttttgttgggccaggatttgtttatgggccatgaaaaaaaaatacatgctcctttctgggccaaatcctagggcaattctgggcctacctggactaccctctgggtacgtccctgtggtgtactgctagaaaaataatttgtcatcacgaaaaaaatcatggcatcaatactaaaattgtgacgatagatacatattgccacaattttaaaatcattgctagccgtgataataaatagcgtggtaataggttatttcaacattttttattcggtggtaataaattttgatgttgccatagaatggatgtggcaaaaaatcatattgcaacacttcacatcattgcaataaataattattgccaccactccatatgtgacattagttttacataccaaattaaaagtttaaatattaataactaattttgttctacatcctaactatttattatttgataccttgtcttcgctagattcgaacacaagacctatcctttaggtgtgctctcatttaccaactcacctactcatcaattctgttagaaaagtgtatcgtttcatttgagcatatctaactgagatttaaatcacggatttaaatatctaaaagatttcaaatgaaaaagttatcacctataaaattgttgatcttatcgagagctataactttcatataaattttgtcccaatccatgtccatatgaaaaaattaagttaaattataagatgacatttttttcattgcaacgaatttgttgatcgtggtaacagaaaatagtgaaaagtaacataccacagccatgtactatgcaaaatgccaaaaaaaaattaaaattgtgatgatagaacatgtttttttgcaagcgtaatggtttttggcaatatcttattttctattgcaacaaaaatactaaataaaacaacgattgaattggatgaataattaagtagcttcttgatcaaacggttgttatctttgtactaatatgatctaatggcttaaaattattgctgatgtggcttcttgcatgtcttactttataggagtaaataccatactcgtctagtgcacgcacctcccaacgcggcgggcattgttttggtggattgaccagatcaaggtaacatgtgattcaatagggaagttaagatagatcagagcccagttgccattgatacagccaaacatgccattgatgccatccaacagggaagttaagatagatccagcagaatattacaatgttgtgtacctggtgccattgatgtgttgctatatactacagcggcagtacaagcaggatagacccatcacccatgtgctattcttgcccaaaagtgtgaacagaaacaatcaaataatagttccagggtaaaaagagagagaataaacaacatactacccgaggagcaaactttacctcttttatttttcaccagcagatcgacaaccccgagatagagcaactatctatctcatatttttcattagattaaaatttcatgaacgacacatttggatgtttagcccaaccctgtgaaaggcagataagaagtatcataaaaattgtagctagttgaaaaggaaattcattttgacaaattgacttgagacgtcagatcagctcaatttttgtatccagtgactaaggccgtgtttagttcgtgtgtcaattttttttaagtatacgggcacacatttaaagtattaaacgtagactaataaagcaaattacagattctgcctgtaaactgtgaggcaaatttattaaccctaattaatccatcgtcatcacattgttaaatcatggcgtaattaggctcaaaagaatcatctcgcaatttacatgcaaactgtgcaattggttttttgtctatatttaatgctccatgtatgtgtccaaacatttgatgtgacaggattttttgaagtttgaagggaactaaacactgcctaaattattagtgcctaccacatattgttggaacatagaaatttgacttgcagaaatgctaaggtcctctttgtttaggcttataagccaacttataatctgaaaagtctaagtctaaacaaacgaacaacttattcgtttggcttttttgaagccataagccactctaatactattaatccaaaagctaggttggagaaacttttatgtatgactccagcactaaccttaggacattaaatccaccagcttataagtcaataagtcaataagctgacttaaaagtctaaaccaataaacctaaacctaaactataatacttgattagctgtatactcctgttcttgaacttgtaaagagcattcatagggtacataaggccaaaaaagctaacacttctcatcttcagattattcttgctcttcaaatttatctctacctccaaagaaaaactgaagcaacaaagcaggtattgatttatggggcctagaagcttaagtatccatttcctataagctagctcatatccaacttgttggcataatttcaataacacattaacacaatagcttataatatgatacctcaataggccaaacatgccatttagtcctgttggatccttaggtgtttattccctgattgactagccgaccccatgcttctgtggtagtttctgtctccgccaactatttaggtaactataatgtttccatgtaattctgattctactatcttttgttcatgaaggtcataaaatcgttataaactttaagtgtctgtttaatacagttatagctctagccaaacagtttcagctacacttaaaatagaagcgaagttatagactttaagtgcttgtttgacacagctccagccaaacagtttcagctccacctaaaacaggagtgaaactgggtggagtgttcttacaaaataaatcacagaggcagagctgggtttatgtttaattatctacaactccactccagacaaaacttctaaagctaaatttaggagttggagttctacccgcagaccctaagatcatatagggtacttctataacataattgatgacgtgtaagatatcatgttctttagatggttctttcatatctctatttggagatctgaccaacaatgctagcgaggtcccacacttttgagttttgtgaatggtgcggtctggattagcgtaataagcatgtctaagtgaaccggtacttataaggttgtacggatgtggagttttgtggtactgtatattcctgacataactggataaccagtgatattcctgacaatgaccaacacactagtttctttcaattaacatgcacatctaacatgaagatgatgactctggaataggaatagcgcagcaaaaatcgtaatgagaatcattccaatctaccgaagtccaagattccgaagcaaacatataattctgaagcgcacacatatactccctccgtttcgaaatgtttgacgccgttgacttttttaaatatgtttgatcgttcgtcttattcaaaaaatttaagtaattattaattcttttcctatcatttgattcattgttaaatatatttttatgtaggtatataattttatatattttacaaaagtttttgaataaaacgaacggtaaaacatgtgctaaaaagtcaatggtgtcaaacatttcgaaacggagggagataagttcagaaatgcaatgtttgacatattacagtactagcaaacatctcacaatcgcacaccgacatcaccttacagatctagctcttacaggtggccatgcctacgcgaggactcaaattttcaccttattttcagcacgatttccctccgggttaccctcgaaacgtccaatcctgaaatacccaagctccactccggcctccgccgccgtcttggcctcgccgtccatggccatctcggcgaggatcctcccgactgcaggtcccatcttgaagccatggccggagaacccggcgccgacaaccacatcctttccaaactccccaccaacgaagtcgatgatgaaatcctcatcaggggtcatggagtacatgcacgactgccggatgaccggcccaccggcggtgtcgacgtggccgggcatgagctcgtcgatccaccgcgccaccgggtccgccagggcgtcgccgccagcgcaccagtcccgcctatccgggtcgcacggcgcaccgccgtgcgcgcacaccttgatcaggcctgggaactccatggacggcgtggagtagatgcaggtgtcaccgtagctggcgaacgtcgggaagccggactccggcgtgagctcatgctcgcggccggggcgggccttccagtagcagatgagcgtgtgcagcggctgcactggcaggtcgacgccggcgaccgacttgacaagcttgctcgcccacgcgcccactgtgatgatgcacttggcgccgtggaactcctccccgctcgacgtcttcaccaagatcgatccatctcctaaagataaaacgttagatttttattaaataattactcgctcggcctcaaaatatgttcattttgacccatctaacctatacaaatgcaaagctataaagactataatatgctcgttttatctgaactcaattcaattatttctcattttatctactctatttacaattactttctaatttcacaaactacaatatagtcataacacaaaagtaaacttattttgggataaacggaaggagaaaacaaatgaatttattctaaaatgaagggagcagtagttaattaatttcatggattttactatgcaggcaaatacgattccagattatagtgaacaggtaaagatgtaaatatgatttcgttgattgatctgttaccttgcttggcgatgtcgatcacctccgtcctgtccctgagcacggcgccgttcttggcggcgagcgactggaacatggcaaccgccttggtggccttgatgacgccgccgagctcgctgctcgccgccgtccacccctcgggcaggcggaacaccgcggaccacagccacgacgccgccgaatcgtccgaggcgccgacgacctcggcggcgccgccgttctggatggcggcgcggagggccgggtcggcgcgcgggcccatgtcgaggtgcggcgtcggggtgagcacgcggtagcccgcctcggcctcggcgttgccccagagccgcgcggcgaggcgcaccatgggcgggtaccgcgcctgcgggtacgtggcgcggatgccgcgggactcgccgtgcgacgagccgcggtggtggagcaggtcgaacctctccaggagcagcacgcgcgcgccgccgcagcgggacgccgacgacgacgccgcggcgtacgccgcgcagctgcccatgatgccgccgcccaccacgatcacgtcgaagccgccgttggtcgccgccgccgccgccgccatgatcgcgcttctgggattttggtgtgggagatgaaggggggagtttgatcgaaagggtagccgatcggaggggataattaaaggcggctggatacggacacgtggcggatgcctattcgttctacatttactggttggaggcccacaaattactggccccaaaaacggcaaccaaggttaatcagactaattagcaccatcccggatacgattttgctatatatttgtcgacaaattttcttccaaaaatttgacagatgtaattacagtataatcgtagtgtaattacactgtaacttgcatgtaattacactgtaactatagtgtaacttgtatgtaactttcaaaaatctctatgtaatatgttatttcggtaaaatggaggttgtgggacaaatccttacacatgtgtgtgctgtgatttttttcttcctcaccaaaacaaatcttgtaatagatttaacgattcaaaattacgtgaaacttatatacaacttacactgtagttatatgcaagttacagtgtaatgacactacggttgtactataattatatctgtcaaatttttaggagaaaatttgtcgataaatgtataggtgatcccgtagcccctccgtattttcttcttcgggcgtgtttagttcacaccaaaattggaagtttaattgaaattggaacgatgtgatgaaaaagttggaagtttgtgtgtagaaaaattttaatgtaatggaaaagttagaagtttgaagaaaaagttgggaactaaactagccttcgtatcaatgcagaggatcacaatacgtgtgcgtgggtgtcagtaaaattatgttctagaaacccatcagcatctgtgtcaatgagatattttccgtagaatgtttttcgggtgtactacgcttcctcgcatagcaaaactaaaaagtcaaacaaagaaacaatttcagcatcttcagtacgccttcatgtgtaaacatcagtagcagtagtccatcaaaagatcacgaaattgttcttctttttgaaacatcgtcacatcccaatgatcctttcgttcctgatgtcttccattcatatcatcatatgggagagaaatcaaaacgagtcgcatatgatggattattgatggttgccattgttaacctatggaagcatcaccatcatcgatcctctccctcacctccaccacagaacattttggcctctatttatcgataagtgatgatatgtgtgcctttacatcattgttcaaaaaatacacagctaccataataagtactatctcctaaatataagatattttggttggatgtgacatattctgatactacgaattgagagtatgtccacatttatagtactagaatacatcccatccacccataatcccttaaggagtatgtcttaccattgccagagagcaccaacatcagacttaattattatctgtagaaaattgaactttcatagtcatatatattccatttgttgttccaatctaaaatattttttttctaaaaaatgcaataaacaaaatcatttttatgagttcttgacaaatattaatgattaacctatattttacccagattaattttaccatgatttctccagtaatatactatagtatctaatctatgctttctataaagttatagccactaagtcgtaagctcaacatttaaccgtgccacatcgtcagtagtaataattacgtatttaatctcatgcaaacatacaacattatatacaatttatttaattctacaaatcaacatgcaagcatatccaatcatcacccctcaaatcatttgcacaatattttaattaatctatctatcatttttatattttttaacatatacttatcaatatgttttacaataaagcgagtgtatcatttgtttgttatatgataagtattgattaacccgatgttttatttttattttttgctcctagcttggttgtcaaaagaaatatattgagaatcgctttgtaattcctataacaaaacgcggggaatcacgtacttaacatttacagttgaagcctcagtgcacagtgtagtgcatggtcatgctgaacctgattgtactcaaatgagagtttggcaatggtgacaatattcttcaagtaaaaaggcatgaagacaattaattggacttgcgatatattttggcaaagattgaaacagttgacggtgtaattttataacagcagaattttttaaggcagcccctaactgatgtactaatgaaaccttagagcttggaataagcgcttctaaaccacagatagctagcttggatccatctgcagctgtactaatgttcacaataaaatgtactgctagctcactctgccggcgacgatatatgccgttgccgtctttcagcttttcatagacatagttgtaccataataccactagattgttttttcttttcagaatgacaactaaacactgttgtgctttcgttcctgatgacttccattcatatcgtatcatagagagcttaagaaaacggcatcagttgaatggttcccgtgcttgatagatggaagctagaaagcctcaatatcaaccttcccttcattaattatatttctcagctcaagtaatgacgatgatatgatggattgattgtaggatcgaatcacacgaactaagccaacagggagggtgaatggttggtatacccaaaaaccgaaaacttttagcggaaataaaagttaccctcgaaatcgacggagatcggtctgaccgaagttgccttgccggtctgaccgctcggatgccgtcggtctgaccggtatagatcaaccggtctgaccgccgtgctcccgccggtctgactgccggtagatcgttggttagaccgccgaaacccagtaaacacaaatcgaagaactcttaaagtggatgacgactttattgattctctctgtgtttacaaagtgcaccaacagcactccatacaaaaatttcgactaaactctaaaccctaactcaaaactcaactcaattgctctctaaagcgataccgggaagcctcacgctccccctctatttatacatgagataggcagcctaaagccataaaccaaactcatactaggagtcctaaacaccttaggaaacccactagtacaagaaagaaactttacataaccaatcgtaccaaatttggactccttccaaattcgactccgcatcccatacgcacataataactccatcgtatgccatatagactctccatcaaccacgtgcatcaactctagtcttagtatcccgcatgatctctgaccacaacggacgtcgtcttatccccaagccgactcccggtccatcaccgcaaatactctcccgagacatcgagtcacctacacatggaacaaataaagaaaccatattctgagatcaagctatctccaacttgactcattagcagcaaacaatagtattacatacgtatagtatccatttagaagtcataatcatgaaataaactcggatatccaaataaacaacccgaaaccaaaactgacacagtgtcggccgattagaccgcgggctgcgccggtctgaccgcgcaatacacgccggtctgaccggctaccagagcccggtctgtccagtcacatagaatgacaatcctgcgattcacctgtaaatgcaatcatctccaaaaaccacttcgtgaataaattccaaataacaaaaccaataatctccaatgcccaattgttcatcacagaataataatcgaaaacacctttgattttacaatctcccccttgatgaacacattggcaaatccataaaaatgttttggtgtttggaaaaataaaaacaaaagtggtaaagagcacacttcgtacaaatgtacacatcgtgctcaaaaatcgaaaagaaaacttctccccctttttaaaagaaagaaattcccaattgaacaaaaaacatgctcttctcaacaactctccataaattcaccttgcttctccaaaaatctaaaaattttcacattacttctcccccttttgacaatgatttcatcaagcatag

SEQ ID NO: 46090 - DNA, 3490 bp, Oryza sativa
atatacctattgcatttatcactctttctcaaataaactttagcacaaaattaccaagagaattcttttttaattttttcttttcttgagcctttttgctcatattttctcttttattccgggtacgtccctgtcgtcaagactgtttccatgaattcggtacccattattttgctcacatcgaatacgtccttgtcgtcaagactgtttccaaggattcggtattcatttttttatattttttttctcttgtcacaatgagcaattaaagctactagaggaataacaagtcaataaagcatatatatagagcatttatagatcaaaccatatgctagcatcaacattgcttatttgcttaattcaagtagaatttaagtgtcatgcatcatctcccttaaaagcaaaatctaaatctcatgaaaagactagaatacatacaagctatgctagagataaataaaccttcaaagtattgctagcatgcacaagaaaataccataagcataaacaaagctctcttttctcaatttttctcattgtcatattattgcttgataaaaccatgagttacaaactccccctcaaaccatgccaaaaggatgaattattcccaattcaccacgaagaaaagcaaagcgattagaatccaaaggctcagtgaaaatatcagcaatttgcaacttggtgtccaaaaactgcaattcaacatctcctttctcaacatgatccctcaaaaagtgaaaacgaatatcaatgtgctttgtgcgtgagtattgaacaggattcttagcaatattaatagcactagtattatcacaaaagagaggtactttctcaaaagtaagaccataatctttcaaagtagataaaagccaaagaatttgtgaacaacaactagcagcagcaacatattcagattcagcagttgattgaccaacactagattgtttcctagaagaccatccaatcaatgatgtacaagaaaatgacatgttccactagtacttttcctatcaattctacaacctccaaaatcagcatcggaatatccacttaagcatatagaagatgaagtagaataccaaattctaaactcaagtgtatgattcaaatacctcattattcgcttgaccgcttgacgatgtgaagtacgaggagaagcttgaaagcgtgcacacaaacacacagcaaattgtatgtctggcctagaagcagttagatacaacaaagatccaatcatacttccatactctttttgatcaacaacttcaccatcttcatcaggatccaacacagctgtagaaccaattggtgttgaaattggcttgcaattctccatcttcaaccgtctcaaaagatccttcgtatacttcgtttgatgcacaaaagtaccttcaggtgtttgcttaatttgcaatctcaaaaagtacgataactcacccatcatgctcatctcaaattccctgcgcatagtctcagcaaaatctacaaccaaagcatgagtcgaacaaccaaagatgatatcatccacataaatctgaacgaaaagttgattatcaccatgcttaagaacaaaaagcgttttgtcaacctttcccattgtaaaaccttttgcaagcaaaaagttcttaagcctatcataccatgccctaggagcttgtttcaaaccatacaaagctttagacaatttaaaaacatggttgggaaaatcaggattttcaaacctggtggttgtttgacataaacttcctcctgtataaaaccatttagaaaagcacttttaacatccatttgatacaatttaaaaccttttgaagcagcaaaagccaacaaaagtctaattgcctcaattctagcaacaggagcaaaagtttcatcaaaatccaaactctcaacttgagtaaaaccttgagcaacaagtctagttttatttctcacaatcaaaccatcctcatttagtctatttttgaaaacccacttggttccaataatattatgtctagaaggtggttcaactaaagtccaaactttgtttctctcaaaattttcaagttcttcatgcatggcgttaatccacgattcatcagttaatgcatgtaacatatctttgggttcaaaagaagcaacaaatgcggaatttgcacagacaacatgagtcgttaccttagaccttatagtccgctcacctatattaccaataatttgttccagcggatgtcgtcgttgaatgtgctaaggagcagtgacttctgaagttgatccacgttctgtatcagtactggtcgaagtcgtagtctccggaggaccatctcaatcaggatcaacagtacccgaacccgacgaacctggccggtctgaccgctcctcattggccggtctgaccggaggtgtgccggcggtctaaccggcctggcgcccggtctgaccggccgagccaacctcggcgtcgtcattgtagtcgctctcgtcttcaaaaaatacgaccatcctctccctgaacctgtgacagtgtacctgcaatttcgggtctagtaccaggactagcctcatcaaaagaaacttcgcaagtctccacgattttgatagtccccaaaataagtacacgatagtcacgagtgtgtgcagggtaaccaagaaacaatccatcggtagaacgtgcctcaaacttatctaaatttccagatttcaagacaaagcacttgcaaccaaaaacacacaaatgtgaaactttgggttgatgtccaaatcgaagttcatatgaagtttttccaagtttagatctcatgaaaactcgatttgaaatataacaagcagtattaattgcctcagccccaaattttctaggagttttatattcgtccaacatcgttctagccatctcaaccaaaacacgatttttcctttcaacaacaccgttttgttgaggaacatgaggagaagaaaattcatgttcaagacctcttccgttgcaaaattgttcaaataaagcatttttaaactctccaccattatcacttcgaattcttttcaaagaaccaggaaattcaagatccaatcgaagaaacgaaccacgaaagtgttgaaaagcttcgtccttagttgccataaagaaaacccaagaatatcgagaaaaatcgtcaacaataaccagcacataccactttcctccaacagattgcactctagctggaccaaccgtgtccatatgtaatagctgtcccggtgcatccgtcatcacaaaaacaataggagcatgtgaagtagaatccatcttagcatgacgacacggtgtacaaaccaaatcaagatctttcttaagtttacgcaaaccacgaacaagatccaaaccacttagcctagtgagatgatcaaaaccaacatgtccaagtctacgatgccaaaacatcatatctttatcaaacttagcaaccaaacatgttatcacaggtgaaacaggattttcaaaatcagcttgggctgcaggaat

SEQ ID NO: 46091 - DNA, 4487 bp, Oryza sativa
  unsure (1)..(4487): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatatttggaacatgtgcttctatcagtgtgaaacattagctaaaatgttgaatcattcaacttatatattacaggtggtaaagtttacttactttgatgagcatcggtcatcatcccttttagctcggtcgaacagcaatatggtcagaaagatcacatagaagtacggcaggaactacacgaaagcagggaccacagttattaccatcctggctaaagtcgagataaattgtaatcagggtgtgcttacatgatcaaaaagagctggaactgtccagaaaaaagcagatagaatctctggaacatagtgaaaatgacgagacaagccccacctgtccaaatggaaaatgagggtgcatgctcaaaagccattcattgcctctattgaaacaaacatggtacaaatcacttttgatgaactatgtaaagaagaaatgacgaatatattaaccatccagaagtcaagagaagactgctttttgtttctccatttgtagtctgataggaagcaacaatctaaagttccaccaaaataaagacgtcagcaatgttataaacatgctatttgttaatttggaagcagctaaatatttaatgcttcaaccttagatggagctttgccccatattgagcatttcccatttgtccgacggaattcttggcgctgacgaacacagtcatagtttatatatatgcaccatattccaaccaggaaaaatgaaaatggtaacttgcacaaaattaacaaaaattcaatttaaccggtaaaacaccaataccaaataataattgggtaaacctaacacagttatccaattccatttaacacatgaaagaaaaacattctgaaagatgaacctggggacccaaattcacagggtggttgacaaggtacattccaggagaggtgtatattgatggaacccataccaagcatccccagcaaatgtagaaaccagctggtaggaaatatatgtcagcaaaatagtgcatgcttgcaaattaaaagttgagtgctgtatcaattaatcacacgacaataccaatccaatcctggcttctcatttcaaacttacatcttcatggattattagaataaaataccttggcatcatcaaatttgtcatggtggttcaaatagttcactttatttacatcttccagggattattagaataaaatacaccttggcttcatcaaatttgtcatggtggttctaataggtcactgtaaactaagaaactaagtatctagtaatcgaacttgtacaattgattcaagtgaggtcactaagtgcgtttttttttataattgggggtggtatcaggcctaggacagctagggcctcaggccctagggcttgagatttttgtcatggcatccatatgttagctactaggtgcagtgagatacccatccaatctgatctgtagaacataaatccaaggtacatcttttgcccctccaaaaaaaaaatccatgccgataccttgatgctaatgtgtccttacgcaatgccctctcttacccaccccttgctttgatgggtccttatctagcaaatagagttggtgctgccgccggcggcttctctttttgcaaaacatgtaacttacaccgttgtgttcgatccacacaactaattaaatgcatctacgaggatcagtaactgatgaacttgttaagatacactgatgaaagcatttctgcaatgattgactgaggtttacagggtcatgtatcttcaagtttacatgcaaaacctctttgaaatagtaataactggtaatggcccagaagttttatgatgatgatgtggtaacctagaaaaatcaatattaacagtcttcacattttgtcgtatataaatttattaagttcacttgtgtattactttatttaactttattattatttggggggttggggggagggggttgtggttatcttcgcaggtcaacttagcttgtctcactatgagacagttgagttaattacaccatttaagcacttgcatacatcacggtgacatcctttgaatgtaaggagctactattcttaactttaaagaacatgaataaatttgtagaattaacctacatacagcatttcattttggagaaaatttcttttcaaacatcatattttgaaacgttaagatgcatgtaattaaaaacataggagctaccaacctctatcatgagcaatgtccatagtgcaccagtatccagattcccaccagaagaacttggtgacatagatcaacatcaatgcagtattcacaagcattgaatctgcaactcggccattcatttcatactgcattgcaaagttcaaagaaatcaactaagtttagtggataacttaatcatataatgttaacaaaagctttctatcttttacattcccattgtactattttagagcacataagtgagttctatgtacaaaagtactagatattggatagcaaccaaagcatagatgtgcctctaagttgcaagctagcatatcaccagagtattatagtattctgacctgctttatgcagtaggttacagcaagaacagcccaggacatcatcccaaaacggcagtttgtgaacactttgatatcaaagtgcttaccaatgcgaggatatagttccattccctggaatgttacatgttatatacacaagtaaagaaaaattcatgtaaaatcaaaataatgaaaatacctccccacaaaaaaagagaaaataaataataaacactatcactgtgtatcaattatcaaatataaacacaggtgaagaatgtcatcgctaatacaatactaatgatagaacaagtccatataattgatcgatctaattaacccatcacatgcaagaaatgtaactcacccagtagaaatcaattatcacattccctgaggatccagaatcagatgaagatggagcaagatgaccctaaatggagaaaaaagaagggtagcccatcaataaacgaagcatggtacatatctacataaagaataacaagcctaataaataagctcacctttatgtacagaaaaatacagaacacaaagcttccaaatacaagagcagagtatatttcccccaagtgatcgtatactattgcagggttaaaaattccaaacctgacagatgataaaatggtttaggcgaatagtggctatacaaatgataattgtacaataaaaggctttgaatcaccatggtgtagcttacaaaaagggttgtcacaaacacaatataaaaataaaataaatataatttgaaaatatgcagaacaagttattaatggtttcctgattcctccattgtgtaatgtaccaaaatcatgggtgaaatattaatatgttatagtgctcatcatatgctaaggtgcatcgaagctccttcatcaatttgagcctcgtgcaaggcgtgcattaatccaggataacaactactctactcaaatttgaaagggagaaaataatgcaacaaacaagcccatgtttaagtgctctaagttgcctgtgtgtgcttttgctagagttcactcccaagtcccaacttccatggtggtgcttttaatgagaacggatagtacccaaaagcatccgcagtggatagcatgggcaagatggtaagaaggtggggaccacacggcttaacctagcaacttcaggtaaaaaaattggtgccaagctccaagagttgatttgtgtttgggtggcattagtaactattttaacttcaaaataaactaaggtatgttggaatgtttgtgggacagtatggcaccttgagtcctcgagaattaaacaaccacaacaggcaaccaaagaagtgtgtatgaaattgtcctgtcagccatcatgataatggggaagctatagttgctacagttgagaaaatgctgtttattaagcatggtattttaaattagatcgaagtcaggagaacataatggctatacattcaaagctacttttcacaatcactagctaacaaattccggctgaccactatcatataaatagtatagataggcatagttatcgagggaacaagcaagcatggacagacagacaatttgctagatggctgaacagagaaggcaggtgaatgttgagtgtcgtaatcccaagttttgaactgtatcctcaatcagcaggtccacataaggaaagaagactatcttaccaccacaggctcaggtatgttatcaaggtcactgcatatgcttgtaagccatttgcctgaaagaaagagagcaaaaaaaaaacagagaaaacgataattattaactaaaaggacatgagcaaaaaatactatcacaatagtctttttcttttttcgggggggggggggggggggggg

SEQ ID NO: 46092 - DNA, 12111 bp, Oryza sativa
acgcacgcgcacgcacgcacgcacgcaaaacccaaaaaaatctcgggggtcaggtcacagatcgggtgcggaggaaaaggtgaaatcctgccccttctccttacagggaggattgacaataggctgtccaaagggatagaggggagatcatggaagcgtaagtgacgagcgccaagtgcaccttcttgagcggcgtgtaggctggcgccttcgccgcggcggcggaggccctaggcttggccatggcccgcgtcgatctgagcgacagtgggtgaaggagatcgagtgaggcgccgagacgagaggagaggaagcggcttgacttggctctggctcctcgtctcccctgccttcctagtatgcgtgggtggggcagagacagacggggcccaacagggtggaatgcccgtgccggcgagtgtttttgtgtgtggattgtgggtgtggatcggtggttctcgcgcggatcggagggcggcgcgtgcgtcgggatttccgccccaacgcaacgcgcccaaggggaggggatggatggatggatgggaatctttgcgacgtgcatggcctgcaagtacgcgacgaagcgacggcactgttttctgtttatttgtgtccactgctatgcctggccgtatgacacggggggatatttcgtgttttccttggtactgtagggggggtgatacggtgatgggtgatgagcgctttgtcagagtatttcaatatttgccaattgtatcgggagtttttttaagctaggaaaaccgtggtctgggtctgttggaagtatatttatttcatatactgccaattgacagtcacacacatggtctcatgtaactgtcaattgtgactgtcaattgtgagcaggtcggaggataagtgattagggatttcttatttaaaggacaaatacccatcgttgtattctataattagaagaaaatttaaatgacaaattcctctttgaattcaatttgatctggaaaaaacttccatctaccaatcggcttcttttcttaaccgaatcaactaattttggtgttaatacgatccgattcatttttatccccactgagaccaatgggacccactctaatttctcccacacacattataaccattgtactctttccgtcccaaaatgtagcaacctaggatgggatgagacccattataggaatttgaatctggacatggggccataactgctattttgctatattttgggacggaggtagtaggaagatccatatttgctactactacttacggtggaccacacccttattgtcaactgttacacatcattggccttgcccttaatgtgtgagagataagagcagttagccaggtacaatagcagactattaagctaactataaacatattttaaagagataaaagaggagagagaagagcagtgagctacagatttataatcagctgcaggacgaactccaagacgcagtgtgtgtatggcaggtgggaccatgtatcaatagtgtaatatatgtttataggtaaatattgtatgaattggctattaaatcgactatagatgatttggagttagtagttggctatacttttaaacttgctctaagacaacgaaacctagcctcgttgcaaccaggaggccctgtttaggtggtgtttggatccagggactaaacttgtccctgtcacatcgaatgtttggacattaatttggagtattaaatatagactacttacaaaactaattacataaatgagatgtaattaatccataattaacacatgtttactatagcatcacataggttaatcatgggttagttaggctcaatagattcgtctagcgaaatagtccagggttatggaatagtttttatttaatagtctacgtttaatacttataattagtgtataaagatgggatgtggcagggactaaaaatttttagtgctatgtaaacagcccgttagttaccaaaataaaattttcacgccgtcatagaacatgcataaagtataaatgtaaggaaaaaacaattacacagattgcgtgtaaattgcgagatgaatcttttaagcctaattgcgccatgatctgacaatgtggtgctacagtaaacatttgctaatgacggattaattaggcttaataaatttgtcttgcagttccctagtgaaatttgttttgttattagactacatttaatacttcaaatgtgtatctgtatatccgatgtgataaccaaacccaaaaattttccccaactaaacaaggcctatgaacaatagaacagaaggctgctgccttgtctcctcttcctcctgattcttcccttcctcaaacactctatttctctagccccaaactcccaatcccctgctactttccagtccaattgcaggtgttctccgcggcaacaatttggagatcctgctcacctcccaatccggtgcacgccaaatggaagtacgacgaggtctaacagcacaacaaactcaacgcagtacagaagagagaagctccataccctggtacaaacctccagtaataacccaggaaagaagagggagaataacatgcacaatggactggacgtctccaggcctgcctcttgcttataatggttaatggtgtggttttataaaactttatataatactataatacccgaagttatgtgtcacgtgctaaaatctccgaggttttgtgcaacttaaaccataatagatgaagctttctaaaaattactctattaatttcgaatttcaaaattaagttaatacatactaaattgagatgtgtacatattcatatttatcaattcttgatataaattatttaatcttcttggataatgaagagaaacttagacaagggcaaaagtatcaatgcaaatgatagtcctacttagaaatcatattataattgccaaagttcaaaaaaaaaacctatttagagtgggattagaacaacaattataatattttaagtgatatttgttataatgtcatctcccagagtgggtatccaatgttctggaataaagataaagtatgtccccttttatcccaaaatataacgatttgtagtatttaaaatttattccacaatatggcaacctctccatatactcacttatctcaactatcacaaccatctcatatttaatttctccatctacttccatatcttaaccaagcacaactatctcctatttaatttcacctaatagaatatacatgaatgcaaacagatgtgcaagaaattacagttatataaagggatatcacctgacaaaatgggacaatacacggatataactgctatctctgaccgtgatgggctcccgtgctcatagatccaataccattcacaggtgaataacataggcatacttacatccaggcactgatcaatggacatgaaaacaaaacacgtatttaaatacgaggtcaaagtgacacttggaaatattgatatgaaaaatccattttcaatcatggctagcatgtgaatcgatttgctgtccatcatgaagatgcccaccatgctccatccatgtagctactgcttagatttttgaggtttgaaaatgttgtcctcgtagtatttcagttcagcgatgctttctttgatatcattcattgccctatgttttttccctttttgaggagttcgcttcctttctgcgaagaacgtggcaaaggatgtcaagtttcatcgatatatttgcacgatttatttcacatcacaggagatcttgaatttagaatttaatgatgcgtggaagatgctggcacagccagcaacatgacctttgatagaacaatgtcactacattgaacctcagtagaactaaagctctaatttgagttggcgcaaaatctaaacatctcctccctctgttgattaacataggcgcacgttgacttcacacaaggatatagatgataaaaacttgaaatgcaccacaaatgtaattattttgggattatgaagatgtgggtggtaatacataaatgcatatgagagagagagagagagagagagagagagagagagagagtaaaaaagatgcacagtaatgaaacctcattaaaaagcttcatacaagacaatttttaacaagaccattcaatttcaaactttaggacttacatttgtcaatggagggagcataaaacaacaactatcatgatgttaaaatttaacagggatatgtaccaggctaacaaatgctgtcatttggctagtttttctactgaaactggagatttttctttttgtttggaaacaaactggagtatttattcatggcaattgtttagttacaccctggctctgtttcataatagttgtgtactttcacgacttcagttaagaaatctaaagtttagcaattgcaatgatcctactcttagcttgatttttagtgttgagagagtgatttactagttgtaacgtgtcatcaaataagggtatgtaaggatcaagatcatagtaggcttggaagaatattggcattgaattgttttatttgtcttctcaaacatcataaataaataaaaaaagtcttctccatagtatcataatacgagttgcaattcttcatggcattgcaacacttgaagcaaaaatactgttaagaaataggaaaactgtatccctattggcagacaaataagtgcagttaccaaataaattaatggaatatcccagacttgataggaattaggaaaacagtcaaacactaatactcatcaggcagaacttaaaaaatttagttcacctttggggtaccatctgatgcacaaagccattatactgctcacatcaacaataacgtgagagaagatggctgcaagctgcggcatataattctgtaaagaaaagtataaaatagaaatatcatcctccaagggattataagtcatatttaaaatggaaaaaccttgcaaaaatgatcaatatgttatgcctagtatcgcaagaaatattgagcatatatttgtgcaataacatgcgttcagagtgaagaattcataatgggcagatgtgttggtccatgaccagaaaatgtccccagaaaaaaatgctcatctcactgtgtatcatttctcactgtgttgcacaaagtaaaagaaataaagcatcaatatcccagctagtatatgacacctctaaagggcaattcttactaaccttcaaaaatagtaaatccacataaacagaattcccagctattaatggaggagatgaaccaacatgcttcttaacaaaatctaacacctgcaaatggaccaacagaagcttctattacaaaaacattagtgtaactatgtaatctttcaagatacacattaatttatatcttgtcatgggcaagccacagccatggaggatgcaaggggctcagacaggggacgctaccagcagcacctaattaggatttaagatttgtgcagttatctctagctcgttacatagtcatcattccatcagggagtcaagtagactaacccctgtagttctgggcgtaaactagacctataggaatacaatatattactagagccacttattctgacaaatatcatattattcagaatgaggataagtaaatgaaactatactgcaaatttaaatcatgatgactatttgatataaatacatttaccaaaatgttatacgaaatgtgagtttcaagtagcaaataggcaactaaagaagtcctaaactacaccaaaggtttaaacattgagacatattggttgagtgatgtaacttcataagcatgtctaccaatatgttgaaaaatacgagggtaaacatatgcatacttgtgtctctgcgtcatgctctgaaatcgtactctgtagtactctctgtgtcaatcctacataagtttcacatgtcataagattaatatttagaaaattaacacacaacaagaaaatggtactttgaatataacaaacaacctctctcttaatgaaatgatacgcagatctcctgtgtattcaggaaaaaaaatacaaacaatttaccactagctgcatgatgagttttgcaccattcatccatgttatctaacagatctttcttctgatttataaccaaatcagggccctgcataaccaaaaacagtcatgtcataatattcaattggcacctgaacaaagaactaaggaacagactagattaacaaatagctgtgggtttcataacatatgatatttgtagcattcaacggtcactcatctagtattaatcaaaatagcggatgtgatgaaaagaacaccattgtgttgtacgaattacagtatccagaatatatgtagaacaaactacgaaggtatttaaattcaactgccacctctatttgttttgtaagtttaccgtccgttatgatgcaagctatctccaatatccgatcctttgcaacatccaaacctacattatccaataagtgagttcccattagtcctacctaattattttaggtatgatgtaaaaaagacaaaacatgatctgaaatatatttcttttaactatacataaaacaattaattgagagaaagagatgcaaagagtgattaaattcccaactgcagcaaccatcatcagatcagaaatcaacaacatttagctatcactaccaaagttccagtattatccttgttattggatgttgaagaccaccaactaaccaattatataggatataggagatctggagataaccatatttggttcgaaatttgttctgttgttcattagaatccaagattatagcccgactaatgaaacccacacatcagaaatttgatgtatgtctcccttttcacaatgaacaagtgaacaatggcttgacaccatgttaatagaccactgatattctgtgaaaaatgctatatcatccagaccgaacaagtgaacaatggcttgataccatgttaatagaccactgatattctgttaaaaaattactgctatataatccagaccactgagcaatcttgaatgatttgtcatttacatatcaactgtgtgcatatatacttattaaaggtccattaataacgaaatgataccatatctctccttagagaaacattataataaaaataataaaacattctattctgaagtatgataaaaacacaaactgttaggacgaaaaaagtaatgaaaatgcaacataaaaatgaattcttcccataatgttgcaagataaacaagtgataactcaaaaaacacaccagtcatttccaagtctatccacaccaaaggcatctggtaatcaccagatgatgatacaagagatccttcatcgtaatttagtaccaacgtgtcactcagcgcattttcacctgcatggtggatgcaacatctaaccccattaatgaatatatattgattgagaataagaaattcaatggaaagaatcgtataagacatgaacataagtgtcagttgtagttacaggtaagaaaaagggtcttccttacatgtatcataatgctttcatttgcttaatgaaaattcctttatctaataagatacataccatgacgctggtagacatgcttatggaacaagtccattgtaaataaattttcaacataacagaaaaggaatttattcaagatcaaacatcaaatattctaaaacatatagggcatgtggttataatgtcaaaagagcaaaacattttgcaaggctaactgaattcagtacaaaagtaggcaccgtggtttgctggatttttttttaattcaagttaaattgtagtccagtgaacccccaggcatactatacaaaatgtaactgcttaaactaagaatactggagtaaacatgagttacagtagcaattctctatgcaggaataaagcagcggaaatctatatcagcgtaatgccataatccattacttagtttactttagaagaacaggggtaacaatcaggttttaccggcatcagcctctttgatgctggaagatgtttggatcagtgcttcttctgtatcatctgctccaccaccttcaccatctagatgaagaaccaagaacttgttcgcaagctcactcatctcccaaatttctctttcagctaatttaatccacgcaccaaacttctgaaaagaaaacgagcacagattgaataccatcaaacacatgtaggtcctcggaggttcaaacaaattagctgcctagtagtggatacatgcaagaaaagtaaagctagcatatcactacctctttcaacatcatgtttaggaagttgtcaccatatagtaatatattagttaatctttgtacacttcgcccccaaaagcaagaacgctttacctttcccacccctactctgaggtttacaagctgcacgaggagattaaggccccgcccttgttgaaattgctcgataacagactcctcctccctcggcgaaggtgcgcaccggcggtcggcggtcggcggccggcagcggcagacgcggaatcgcacgcacgggcacggagcaaccgaggctgaggttggtttagggaggaagcgctgccgggggacgccggagagctggtggccctttccccaccgtgaccaacctcggtggacttaagttgggccaacatcggtggcttcggcccaacagagcggagccgaactgcaatgaaaaaaaaggggaaaacatccaattttggatggtggtttcgttccacacgacaggttgacatggtcttcatctgttgtggcccctatgtggtgcttatatgtcattacagttataaacaaaatataaataattcatgagtcccatctaccagtgacatagctaatgccagtccaatcctcctaagcaatcgttggtggtggcgtctttgtttgctgaagctcctttgctactgtcgccgatgtgccaccggccttctctcacaacctgccatcatgcttcaagctccttgcgcatgcaacaagggtgatgagggagacaagggacagcttagagactgtgtggcgagtgtctcctagagctacattctaacaactggtgcaaattgttgtcatggtcattgtagcacgcagtcgtgaaaccgtgaccgccgatgacgcactcatgtacctagtggtcgcgggcctatggatctgccacgtaggcttagctgcctcgaacatcgcaatccatgtctgcgataaggtcccccgagtacatgccgtggtgtttgaggtctctgacgttgccattctcgttgtagcttcaatcatcccgttactttgttgctacacctcgtcctactcaccatctccgacatcaatgatgacatcgagccagagaagatactacaaaacaaaaataaatgcctttgggtccaatttcgtgtgtgtccctgcggattaccgtatccatatcaatcaattctaaattgcacaagtttgtactcagtaggatcgaatataaggaccaacctaccagagagggtgaatgatacgaacagtaaaaaccaaatccttttgtagaattaaaaaaccctcaaatctggtggagtggagatgcgaccggtcaaactgttggatcaatgtttgttagactattgatgtgccgcactaccttgccgctagtcaaaccgccttggagcctccggccagactactcgtctgttgtctactcgctaccgccaattcgaccacttgcttgctgctggttagattgcccgctggtctggctgtcgagatttagaaaaactaggtgatacctcgcgctttgctgtggaattgatggatggatatatgtgaaatattgtacaaatgatgaatgttgaaatgttgtgaaaatgatgtgggggacaagatgatgcgtcatgcttatataaaatttaacatgtaaattgctaatgggtgatgaggtgacatacttgcatattgagctttagcttttaataattgctagtgggtacaaaatatatagaaagtatagatatgcctcgatgaaactcttgaaagtggatcagctttattatatcaagatgtgtttataaagtgcatccaaatcactcccgtctcaactcacgaactagaattgaaagctcaaagcagactctaagttttttctcccaaaaaatcgatgtatttttagcctcaacccctcttctatttatactcaaaacatggttgttgcggctagccacaaatcctaatagaactagaaatcctaattacataggaaaccactcaaactagggaaacaacatccttttacaattccaaacttcaacatttctaaacttggactccaatccaaatttagctctgcttttcatacagacgcttgtatgtgatatggaaacctatgttactactgtttttttgttcgagtccaatcaaatatatattattatgattatctctgtctcaagatacatgccttagacatgaaacaggcaaatgttttttatttaattgtgatgagatgtcgatcacttgtactttaattatttagatgaaattgtggtctgggtagtgctaattagattaaagggggttttgcatcgcttatgatacatgacctagtggatgcatggatttgtgtggccaaattgggtatgatgttggtttcatagttggaaaataatatagtactataaaagatacccgtgcattgcaacgggataaactaattttatgataaacattgcatgattaaggttcagttttcatgatatgactattttccaaattatcaggtcaatgtaaagaaccaaaccctaaaacaaataaataatttaatagtccgaattacctattagatcttaaccaattccccccggagtgatctaggatttgggtggaaatcagatcagtgtaagctagtacaaaacacatgctactccgtattggtaaactgtaagggcatgttcaatggtagagacgagtatggtctcttaaacaatataagattatctagagaccgtgtctttataatagttaacacgacaaagactctaatcattaactcaaaaaatattccttttgttaatattcttttcattttttttaccctcatgcaaccatatttctatatatattatagtgattaaaagtcgttgttatacataacaacaatgttttgtctctcctctttctctttcttccactattgacaaccattatacataccctaacaatcatattcagagattaaattttctctctggaacaatcataataacaaaagaaatagtagaatgcataaaatccgtttccttaaaatacaaaatctgaaccgagaatatgcgggatcccctccgaaagagctaaaaggcgatcagccgcgtgcccccccccccccggcgcggcgaggcacatggcgtgcgcggagggggccgcgcggcagcgtgtggccgcgtgcgtaggttggggcccgctggttttttccgttggtttcttttcccttttttgcggttttccttttggttttttttctgtttttttccttttcggttttttaaagcatatacgtatacgtatatatacaaactttgtatacgatatatataaagtttgtatacacgtacgtacgtatataaagtttgtatacttatatacgaatatacgcgatgttttttttattttttaatacgtacgtatacaaagtttgtatacttgtatataaagtttgtacacgtcgtatacaaagtttgcatctgtgtatatttttttatacatcaaaaaaatatatatagtagtaatactagtagtaaaattggggagaaccatcattgccagaatgccggttgtgagaacgacctaaaattggggagaaattggataggttaattcaacgaggaaatactgaagtacagtagcgtggatgaggagggaaggttagagagtagtctcttctgcttctacttgcgtttatatttgagtttgacgaacctgactcatcacgtttataaaatcgtgcggttatcacgtgcgataactttcttattttttaaaaccacagtatatctcaccgtaactgtggggttactgtgataaccgctaaaccgtgaggtgatggtaacaccacaaaaacggtttggtgaacctgactgactcctcgcccaa

SEQ ID NO: 46093 - DNA, 5102 bp, Oryza sativa
cataacatcattagatggcgtactgtacatacatgcacggagcaataggagtagataacatcatttgtttggagccgacgatgatccgcaacacgcaaagacgacgacggcggaggacgacgtcgacatggctgcagcagctgccggcggacacggcaaccactcccactcccacctactaccgccactgctacgtttcccccacgtcttctcatggcgaccgttcttgctgtcactgtcactgtaactgccatggccgccaccaacctcagcgtccacgagctcgtacctcaccgcccccttgctcggctccgacgcgttgtacacgtacccgctcgccgcgccggccgcggccgcggcaatgctgcggcgccgccgagcctctccgacatctccggcggcatcgatgtgttgttcgcctcggcgtccagcagcagcgtgtcgccgtccacgccccagagcgagactttgccgccgccgcctccggccagcacgaggaggcgctcgctggcgcctccgccgccgctcgttgtcacgccgcaggccgcccatgactcgacggaggcggtgttgttgccctcgggcagctggagctggcgcgccggcccccactgcctcgccgccgggtcgaaccagctcgcccaccccgttcgcctctccaccacgtacacccgccgctccgaggcggcggatgacacccccctcgacgccaacggcgccggcatcggcgggcacgtcgcccaccctgcaccctcgtcaagaacctccaccacgcccgcggccgccgtcgccccgcacccgccgccgagcacgaccacgtggggacccaccgccgccacgaccgggtcgacacgccacacccgcggaggcggcagctcgcgccacgcggcgccgaccgcgtcctcggagacggccatggacgcgagggagagcgcgtagacgcggtcgccgccggcgcaggcgcaccgccggacggggagcgccccggcgacgcgccacccatcggaggcccacgccccggcgcgcgggtcgtacacgtgcgtggagcggccgacgccagcggcggcgccgtggacgtgcgccacgaggcaggggaggtgccgccggcgccggcggtggcgctggtgcgcctcgcgcgcggcgcggcgccactcccgcgacacgagcgcgggcgacgcggtgagctcgccgtgcggcacgcgcagcagcacgcactccagcaggtcgccgtgcagcacggagtcggcagcgtccgccgcctccatgggaatgggatcctagctgcactgctgctgcttgaggatcagtggatgaattaatcgatcaccttcttttgaaatgcaaatgcattatttaactactcctatattaacgttaatctgttggtcgaatcgttgatggcgccaagtacctaccaacccgactacgacctaacgaatgatgagtagtcttcccggggttggtgaaatatgtaagacgtgttgctgacgagtgtgtgatgccattccacaccagagttacttggacgaaattgaaacaggacatgcacgggagaaattgaagcatgactaacctttcctgacggcttcagcaattcatcacctaaaatatatcagatgacaacacaacaacacacaatatttgttaacgagattcagtcgaaacctaatccccaaagctctgattatgaacgctccgttcaaccaacataacacctagccgctatgaatccatagccacaccatcatcatcttcttgcgtatctacgctacattatagtcgttatagttacattgtggtgcccaccttacctataacagagtctgactctaactctatcatatacatattccaacttctagtgggactagtatatttgacacctattctaacaaacttcacattgacaaatatacgtcacctagaagtaatagaatcaccatattgattcacatgtcctccagacataggttggttctttttgtagtttcactgtgagccgattgacgagactgcactagactcgccgtcgttaagagactacgctatccttgtaacttcttacttttaactttatctgcaacagtgcttcaccttctctcttactatcataatcgttttgccaaacgaaattggactgctccttagctgccacatcatagattcctcgaagattatattcacctccatctttcgtcttaaatttgattttatctattctattctacggccagataacccatgtcatgactaaagaggcaaatcaaagtcaccaaactattgaagagaatccttttcttccatgttgttttatgaactgagctaaacaaatccaacatctatccttttcgcatccttatattggacccatgacactttgagaaaaatcaccgttgtttctcttcagttatggtctaactccatatatctcaacacgacgtcgagtctcagatatattatgttttcgctagataattccatatacaacctgactagtctatcgccgtcagtctactcgtcatatgtctcaatacgatcgactttgccccttagtctaaacagctgtacttgatcccatcgttcgatccatccttgtctgatcgaaaaccacgtacaactcacatgtcgcagcctgctatgtgaagctttctggaggtgtcaaatctccatgcactagttgctattctcaacttaggtctggtttagtttcccaaaattttttaccaaaaatatcacatcgatctttgacacatgcatggaacattaaatatagattaaaaaaactaattgcatagctaggggaaaatcgcgagacgaatcttttgagcctaattagtccatgattagtcgtcataagtgctacagtaaccaacatatgctaatgacagattaattaggctcaaaagattcatcgcgcggtttccaggcgagttatgaaattagttttttcattcgtgtctgaaaaccccttccaacattcggtgaaacatccgatgtgacactcaaaaattttcttttcgcaaactaaacaaacccttactctattagtttgcaaattggagactttggatttttggaatgtggactaagttatgtactatatgtacttctattttgatgtggtcatgactcgtcagattatgcgtatgtgtgtcatgtttggacatgtacgtgctgaatggagaatggacattgtggtcttgtcatcttgtgaaatgtcagaaattcaaatacgatggccgtgtttagtttcaaattattttcttcaaactatatacttttccgtcatatcgaactttcctacacacacaaacttttaacttttccatcacatcgttctaatttctttaaacctccaattttgacgtggaaataaacacagccgttacttgttggcttgctattgcattgcattatttaatgcctatatgatatgtaagagtatgattataatccattcttgttgtttacttattgaaaattgattgctctattgttgaagtgtttatttgctgctagctattgttaagaattattgctctatttctttatttgttgttttagctcattttgttaatcaagccgagcatattcttcgccaagctttcacgagccaatccctaaacatagccaacaaaaaaaaaatatttgttgcggcagggcgagagagggtgaggggaagtgtgagattgaatttttcattttcatgggtttcctaaattgattttaacactgaaggcatcgaaccaaagtttccattgtccaaacttaccgaactaacactagaacttgcccttatggttttgtggtccacaatgcatctttcatagcaaaaacgataaaaacaaatctattgaagtgatatatattggctaaatgggaagcacatacatacactttgagaacttgcgaagtgatgttgtctatataccgtcgctaaaataaaataaataaaaaaaaaagcaaatgcaccagccgggaatcgaacccgggtctgtaccgtggcagggtactattctaccactagaccactggtgcttattgcatgcgtagtctgtttgattttagatgacactgcaatcgacaaaattcttacattgttcatgctaccaccaccaggaatcagatcctctaaagtcgaccaaaatgacttgtgtctgcagtcacgtgcatctggccactcagtccctatcgaacggtggagccagaaatatctgctgtcccactcggcttgctgggccggcccaactcagcaggacgcacgtaagagctttggctgctgtaattttcctggcgcgaagcttcactactttggcgccggtttgacaacaagagcaagtttaaaaaaaagggaggaaacaaaaaagaaaaaagttcaaaggtgtatgacaagaaaaatggaaattgttcaaaggtatatgactgttggaattaatacacgggctaaggcccattcgaagattaattctttggaaaatcacaaaagcccacctcataagatggcatgcatgtggagtttagtaccaccttgcttattctaggaaagggggacctccttaaaagggaggatgccctcctagccatttgaagcatgtgtggtggagagaagaggggaaacacacgcgctcgctcacctcgccgcagtctccttttgcagttttgttttgctgcaggaaattcggatttgttttgttttggaaacattccgaaaatccggtgcgtgaaaacggcgtgtagtccggataagttatgcgcgacttatccggttcggttacgtggagtggagatcgtgcggacgccctgatcaagcgacctatctctatataaaccgagctgccgccttcacgcaacatacgcgaaatcaatctagggtttgcctcctactctgtgctgcgccgtcgctcgtagactactccatctcgctcaccgacgtgcaccggcgatcgggagagcaggtctccggaacctctgccttcgacgtcctgcaccgggagaaggcggcaataaggtttttgggaagcgcttcgcgcgactgctgcctgttcgtccgcgacggctcaccttcctctccgctcgcgtgctgcgcgccttcgtcgacgcct

SEQ ID NO: 46094 - DNA, 10270 bp, Oryza sativa
tctttccgccacctcggtacgtgttcgacatgctgcatatatttgatctgttcatgctttactgcttagtttatatgtgtagatctaatgatgcgttcatgctagtttacatctgcaatgtcatgattcatttatggaataaattaaatcattatgtgcttataatttcaacaatccaaaaaccttattataggcgctgtgacctttactatggctggttttaccgatgcactgaggctggataaatttaccggtgtgcactttaagagatggcagatcagggtcactctgtggctaacagctatgaaatgcttctgggtgagtactggcaagcctataggcgttcttaatgctgatcagcagaaagaaatcgatgaggccactactctctttgtgggatgcattcttagtgtgcttagcgatcgtctggtcgaggtgtatatgtgtagacccccgattttggaaatcggaaatcttttgtgtttatccataccaatccctggatcagtagttggtacacacatacatagttggatcacaacatatcaagaatgaattcaggctaaaagagttaaatacttacattagggccaggtaggccaacaactatcagagaacaacagcggaagacaaaataatataagggcccggttaacatgtcacaggcagttgactggggaacgagacctagaacaagaccgcactccgatcatcttgtcaggtacacaagcgtactaacaagggcttctcttcaacaccctcctaaaagatatataaatagcaagagtgagtaccaaccgtactcagcaagccaccatagcaacaatgcatatgatagagggtatttcaaggaagggctccaggttcttttgcgtaaagcaaactttgcaaatcttttcacaagcctaagacctagcatagactaatcaagttttactaccaatgtttacattatacaacgacggttctgtccaccatccattgtgatcccaaggatagcttcccgccattgagtcgtcatgattttctgaggacgtccgccttcctttatctcaggaagtggctccatcagcataaagctcatcatgcaataacccatcccacacaagttaagaatttagagtctagccaagtgtaatacacgtctcggtgctcaataaccacgagcacggctattcgaatagatttggtttactcacactgcagtggatgtacactttatccgcactccgcgactgcccaacacataagcctcgtcccaacacatgagacgcgtcacggcaaagctttttgataacctcgcattggcagtacccgctccatgaactttacatcctcatacactctaggcgtacacggtttctagcagtgagaggagttctggcgcacccgggaagggaagactcatacatgcattaagttataattatgtttagattctcacatggcagtcctacgatggcgacaccactgtagatacccgccccgcggtcctaccaatggctgccccaccgtagagcccctgcctcacacatcaagaaaccactatgcatggatactgcctccgctcagctatctactccgctaggtctatatccatacgagaagtgcggttgtacgggggtcgtttcatgcttaacttcatggctcggtccttaattgaccggggacggcactagccttttccggacaccacccaaatcctccgtccgccccagtcgaaaacagttgtttaattttatttctcctttcacaaatcatgtcatcaacatcatggcaatgtggcgctcatgtctccacatgccgcatctcaattaccttcccaaagataattgcctaagcatatagcatttgataaatatgagtatgcatgattctagaatagcatttctaagcaattgtcataattgactagggactcatacgtaaacatggttacgaaggcataaggggtaaacaataatcaaggcatggcataatcacaagtaggatgttcatcattgcatgcaattttatttgtaaacaaaataatttcgcaattgggatcaacatgttcaaagaatagtgatgacttgcctgctcagaatagtccttattcttgatataatcttgatcaaccttcacctcctagaagttgcagacgttgcctcacgactaatcggtacacagattctataatacgtgagaaaaaccaatattcagacaacaaccaaatatgcacaaatagaatgtaattgttggggtcgaacctagggttgctcatattactcgcgcttgctaatggattccaatcatgctagaggctaaggcttcttaatctttctatcgtcatcatggtctatttaggagttaaccaatagtgtataaatgagatatacatctagctaatgtgtggtttagtctagctaatgactatggaaggattatggctacacatgcatttatctaaataaagtggtcatatctagaggttctcttatcggatggatttagtatcaatcaaattattacagtgaatcatttgtatcattattttattgatggaggttttactttaattatgaacataattttcttgtcacaacaaattatgaaaggataataattatccatgctttgaatgttagagttgtttaggttaatcatattatggttatagattatcccttaatgaacaatcctaatttacagttgaactataattataattatatgaggtcaagatttataactagtatttatctaatatacatgtttgtcatatactccctctaatttaatatatgcaacacgcaaattataatactataccgtacaactataatgggatgtatagtatatgtgtaagcaacaatattttattattggatcatatatttgagtagttgctttttactgtaagctatacaatacatgttgattttaagatggctctgtttggttaactaatggatgtcaaccgaactatatatatatatatatatatatatatatatatatatatatatatatatatatatatatatatatatatatatatatatatatatatatatatatatacttttaagtggtccaaatacaactagctctgttattattctcctaaccaagttaaagattcatctatgtgtgtttatattttagttacaaaatatgaggctaaactttatgtaaataatttataagtcatggatataattatatatgggcatctattagttaatggcactaatatttcctatgctcgtattgatttgaaacattaattataattaatttatgtggttgctacagtgacaaaacatattaaagaccaatattattacatctactctattgtacaatatcaatcctattcattagctcatttttaagttgactattatgcatcatcttgatactaattattaaaaattataaatatattttattaaatagtgaattatataatattggaaagcttatgaatttatatgaatttaggttcaagtttcacttaaatccgagttaaaatgaataaattacgctagtgtaaaaattcaaatttgaattaatccgagaaaatgcgaaaagctgctgttcataaacgatttatttttaacccaagacatatccacagccttgtaccaactgacaagtgggaccccgggtttattcctttttcctaccgaattatttttcaatgcaaaattccacaggtggaccccgctgctctctctttctcgttctttcttttcccgtcgtcttcttcctcgcgccggccatcgagcggagcagaggcgcggcgcgtgcgccccagcccgggcgagggcatcccagcggcgaccagaggaggctcggaggaactccagtgaccacccgaaggcggccacggcgcatggcgccgtgtggactggcggctaaactcggccacgccatggctgagctcgggcaacatggggctagggcgatagcgataatttctgaccgaattgatgggtgtgggagcatctacggggtgtgagggttccattttgctagctagatggagagaaggggctccgggatggcttgtccacagcgagctcaccggcggcaaaacggtggccggaccggcatggctacggttgctaattggcaaaattaaagggggctctagtttcacggaactaggagaggacataggagcgaggacttaccgagggatggaggaacgacgaagctcggcggcgttggtggacaggcatgcacacaaggtgtttgagaaaatgcatacaagagagaagaagaggcagagaggggtggacgagctcgtgggggctcttggggccttgtgatgggagccaacatggtgtgtggggaggaagggagatgggagggggtatttatagggtgcaggaagggtggccgacttaatggtcgacgcaacgggcggcgcacggggctcgagggtgagggcgacgtgcagcgacggcggcgtgtggcagcgacgggacgcggcgacatgcagcagcgcggggctcgaggcgcggtagcggcacatggcttggcggcgcgtggtgcgaggcgcgacaagacggcgcgcggcgcggcagtgaagccgacgcgacggcgatggcgacggcgcgcggcgcggcgatgatgacgacgcgacgcgacggcacgcgcggcagcggcacggggcgcgacacgatgcgacgcgcgcggcgtgcgcagggctaggcacggcgcggcagggggagggcggcgatgggacgctcacgcggcgcatgcgcgagatcggcgcggcacatgggagcgatgcgacgcgggtcgctgggtgttcggcttgggctctggtcgagcacctggcggcccatgaacagtagccagctgggaaaatcacagaaaagaacaaaagggaaaaagggaaagatggaggggccaaactgaaaaatagctgggattggaattttatttgagatgcaatctatacattttgttttgagaactcaaatattttatttgaatgtttatttgtttgtttgtttctccccaaatgaatttgctttttaattagattatcctaaaatttatcctaatgagcccattataaatatagtgatgtatttgctcaatttatttgtgtgaccaattattttgtattagttgattttatgacacaagggacttaatgaaatgtcctaaatattagcttatatattcccatgaaatactcatttgtaaataggatcatgatagtggtgatcatcatttcatgtgtgtttatatttcatggcacgcatcacatggttcaagtatttaataattgttccataaattaaattagtaattaaccttccctttgtctggctttgttttcttgtgcgtaaatatttgtagggttatccataaataatatattctcataaatttatctattacttaaatttagatctttactttactttctttgtgatcatttacggttctgcaagcaatagcaatcataacaaccagcatgatgcaaaagttttaaaaagtttgaaattttagtgatttttattgtcggaaattttcagggtgttacaatatgcatatgaccgacgctaaggagttgtgggatgcactgaatactaaattcggtgctactgatgctagcaatgatctgtatatcatggagcagtttcatgactacaagatggctgacaaccgttctgtagtcgaataggctcatgagatacaaaccatggctaaggaactcgaactccttaagtgtgtcttatctaacaaatttgtggccgggtgcattatcgcgatactacctccatcttggagaggtttcggtactgcactcaaacacaagagacaggaatactccgttgaggggttgatagcgtctcttgatgttgaggagaaagctcgggaaaaagataccgcgtctaagggcgatggtgggcagtctactaccaatgttgtgcacaaggcccagaacaaaagcaagggaaaacacaaaactcagcagaccaccaacttcaagaagaagaagaacaacaacaatcctaatcaggatgagaagacttgctttgtgtgtggtcaacctagccatctagccaggaagtgtccacaacgcaaggggatgaaggcacctgcagggcagacctctaagtctgctaatgtgaccattggcaacactagagatggaagcgggtagtaatttacctactgttttttcagttaatcagtctactaattggtgggttgatacaggggccaatgtacatgtttgtgctgacatctcattgttttcttcttatcaggccgcacggggttccaccgtcctaatggggaatgggtcacatgcttctgttcatggtgttggcacggtagatctgaagtttactttgggaaagatcgtgcagctgaagaacgtgcagcatgtcccttctatcgataggaatctcgttagtggctcccgtctgactagagacggatttaagttggtcttttgagtctaataaagtagttgtgtctaaacatggatattttattggtaaaggttatgagtgcggaggcctgttccgcttttccctttctgatttctgcaataagtctgtgaactatatttgtggcagtgtggatgatgaggctaatgtttggcactcacgtttatgtcatattaattttggtttgatgtctcggctttccagcatgtgtttaattcctaagttttccattgtcaaaggttctaaatgccatagttgtatgcaaacgaagcaatctcgcaagcctcacaaggctgccgaggagagaaacttggcaccactagaacttctacattcagatctttgtgaaatgaatggggtgttgacgaagggtggaaaacgatatttcatgacgttgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcaaacgagtttgacttattttgtgaggaacatggcatcatacatgagaggatgcctccttattctcctgagtctaatgggattgctgaaaggaagaaccgcactctgactgacttggtgaacgcattgttgaactcgaatcatgtgttaaacagagttcctaacagaaataaggacaaaacaccatatgagatatggattgggagaaaaccatcactttcttatttgcgcacatgggggtgtttggcgaaagtcaatgtaccaataacgaaaaagcgcaaacttggacctaagactgtggactgtatctttctgggatatgctcatcacagcattgcctatagatttttaatatttaaatctgaggtacctgacatgcatgttggtacaattatggagtctcgtgatgctaccttctttgagagctttttcccaatgaaggatacacatagtagttcgagccaaccctctgaaataattcccagttcaatcacaccaccagaacaaactgaacatacacatgaacatgtcattgaggaggatgtcagtgaagctcctcgaaggagtaagagacaaaggacggctaagtcctttggtgatgatttcactgtgtacctcgtggatgacactcttaagtcaatttcagaagcatatgcatctcctgatgcagactactggaaggaggctttccgtagtgaaatggattctattatcgctaacgggacttgggaggtgatagagtgaccctatgggtgtaaacctgtggggtgcaagtgggtgttcaagaagaagcttaggcctgacggtactattgaaaagtacaaggcttggcttgttgctaagggctacactcagaaagaaggcgaatatttctttgacacttactcacctgttgctagactgaccacaatttgtgtgctactttccctagcagcctcacatggtcttttcgttcaccaaatgaacgttaagacagcttttcttaatggagagctggatgaggagatctatatggatcagcctgataggtttgtagttgaaggtcaagaaggcaaagtgtgcaaattgttaaagtctttgtatggcctgaaacaagctcctaagcaatggcatgagaaatttgacaaaacattgacatctccaggctttgctgtcaatgaggcagataaatgtgtgtattatcgccatggtgggggtgagggagttattctgtgcttgtttgttgatgacatactgatatttgggacaaaccttgaggtgataaatgaggttaaatcattcttgtctcaaaattttgatataaaggatttgggagtagctgatgttatcttaaacattaagctaattagaggtgagaatgggattacactcttgcagtcccattatgtggagaagatcttgaatcgctctggctacattgatagtaagccttctccaacacctggctagaacaagagaattgctaggaatcaactggaatactccgaaatcattggctcactgatgtacctggctagtgcaactaggcctgatatctcctttgctgtgagcaagttgagccgatttacctctaatccaggagatgatcactggcgtgtacttgagcgagtaatgcgctatctgaaaggtactatggaattggggcttcactattctgggtatcctgcggtactggagggatatagtgattataactggatctctgatgtggatgagatcaaagccactagtggatatgttttcacactaggtggtggtgctgtttcgtggagatcttgcaaacagaccattttgatgaggtcaaccatggaagcagagttgacggcactggatactgctactgttgaggcagaatggctgcgtgatctattaatggatctgcctattgttgaaaaaccggtgccggctatccttatgaactgtgacaatcaaacggtaatcgtcaaagtgaatagttctaagaataatatgaaatcatctagacatgtgaaaagacgattgaagtctgtcaggaaattgagaaactccggagttataacgttggattacatccaaacagctagaaacctagcagatcccttcacgaagggactatcacgaaatgtgatagacaatgcatcgaaggagatgggcttgagacccatgtgagttatattatggtggtaacccagtctatgtgatcggagatcccgtgaattagaacctgggaagaacaaaccattagtaaactagaggagagtaccaatcaataccctctttaagtgaagatgcatgtactctcgtgagctgcaaggcaggttggctatgccttaatgagttctgttggctttaattagcgaagatgctttcccgtaaagcattcttgaaagaactcacctttgtgagcttgactattggtcgcagtctatagagattttgggtgaatcttctaggaagcttactaaagacctaggagtatgacttatacgttccacccgaggggtagtctacagacggtctagtaccagataagactctgagtgaaacttgcttgtacaagagttgcaattcaaggcgtagtctattgttcaagttgtgagtaagtgtagcttggagttctaggtggatgttcaaccttaatcggtctccatcgaaccgctggtatataaatagtacattgaaaaaggcaaatctcaatgggattttgagatttggtgggggattgttggaattaatagatgggctaaggcccattcaaagattagttctttggaaaatcacaaaagcgcacctcatgggatggcatgcatgtggagtttagtaccaccttgcttattctaggagagggggacctccttaaaagggaggatgccctcctagctacttgaacatgtgtggtggagagaagagaggaaacacacgtgtgcgctcgctggcctggcctggcctggcagggcaggcggcgcgcgtgcatgacgtacgcgtcgaatggtccgcaaaattggctcctcacccttacgcagatgcagcctccttttgcaattttgttttgctgcaagaaattcagatttgttttgttttggaaacattccgaaaaatccggtgcgtgaaaacggcatggagtccggataagttacgcacgacttatccggttcggttacgcggaatggagatcgtgcgggcgccctgatcaagctacctatctctatataaaccgagccgccgccttcacgcaacatacgcggaatcaatctagggtttgcctcctactctgtgc

SEQ ID NO: 46095 - DNA, 4264 bp, Oryza sativa
tgaatcatacatcattgcctgaagaagggatctctgaatcctacagggtcagcaatagcttatctgaactattgatggtaatatttcaaagtaatacactttttctctgaatcatacatggccattatgttgaattttgtttttctaattatcagggagcaatgacagatgctgttattgttattggtgaattctagtagtacagattataccccatatgcactcaggagtatggctcaacaacctccttgtccatcatgttcagacagttttagttcctagttctgtgtaatgagccataatgccatatgaaagttgcaagttacggacttgcaattattttgtgcagccatatgagcttgcagtaatcagcaaacatcttttggatttcattcacaatatcccacggggcgcagatcgctggggcgctggctcgccggggcggacctccggggtgaggtagggagcgccgagcgtcgcggtggcggccggtcgtggaggggaacgctgacctggccatcgcggcggcggagtagaacgagtcgaccagagtccgggacgctagtcattgggcagatatgggccggttacaggcctggtttgttttagtgttttgctggtctcacggttagatccaaatcggatggtccagatgagtgactggagagggaagtcgatttgtccgactttagaggatctgattcccactacaacaggcttcttcacctaccacgaaaacgcattcgcgatggttcggttctcccgttctcctaaattgtcaatcgtgggaaatgccaactgatatgctattatacagaacttcgctttacatctatctgttcaacaaaattcatgtgcacagatgatgtgtagacaacggggaaatcatggataggtgaaaatttcattttctcgagctctcctacaactctccaaatatcaacaatcgaggagaaccaagttgcaacagctcaagagtgaaaagctcatggaatccctttattatttagtgtgtcaaaggaaacagcagcacaccagtctcggctctagtattagcaaaatgaaagttacagcattgccgcagcggttgcgaaagaaaatcagcacattctggttccccagtgtgccagggagctcgaagcagactgttaaactcgttcaatccagcgtcaagagtgagtaggtcagaggagatctcatctcttccaccgccgagcttgctatcttgagtccacaacagtgccctcaggaagcgcagacaggtgtacgagagcgtgagatttttgtgggctatcggagccagtgatcttctccttcggccggctcaacaccttcctgacctcgttagctagctcgatgattgaatcatcttcatggcctgaacaaagcaacgtagcatcatttgtaattatactatgaaaatctctgtgagtgcggtcctgttgtccaaatatataagcagcaggccatcaactagcacatacatgtactgaaaactgatgcagtcattttttttatataaaaaaatgaataggaatattaaaatgagtatgtcatgagctttgatcaaataaagatatcgtaaaaagatctttttcttacatatgttggacaatgccttctccattgagaacaggtaatccctgttattcccattggggccattggctgtagcaatttgcctggtattaaaaaaaatgatcaagtagtcagaaaatgatgctaatcaagcagtaagccagtaaaagtgcaccatgagatgaatagcccaccttgccatgtcctccaaaggagcaggcccaagatagtatttgttgcctactggatcaggagtggatacaaagctgcacaagcaccaaagtaagtgagttaaacagaaaattaacaagttatatcatggaaatttcaatcgtgcagtttgaacccttacactagtacacctgtcacagctggcttcaaagaatctccttcctaaacaataaaattcaacaataggatattagagtaatgcaaataattgacttttattttctaaaataatgcctgatgcaaaacgagtaccttgtagaaatccacagagatcttctggtcatactcacactctcttctttccaagtactgaattgcaaaataaatttgtcaagataattctagcctcataaatctactcattcttttaatctacaaggaaaagaagcaccaaccttcattgcttcttgctcctttttaagcccccctttgacacagtatgcaatcccccactgcaaatattcatatcggactgtaaatacagctgatataatattcagaaatgaatctttggaaattagtaaaactaacatctctgtggtaatgataaagcctgagcaaagtcacatatgtcaggataatgattttcagtgcacagaacttgctaaaacagtaaatctggtttgagttcatgtcctgcctgtatgttatgaattaaggcaaatgacgtgtctttggaccaaaacaagagacaaatagcacaagagtgtaaagcatggtttgtgaggagaatccaccggcagattcctgctcagtcatctgccatctgattccagatttccagtagtcatctgctttacatgagcttttgagtccctaataggattgtgctttggtgccactgctcagcatgatatgtcaaactgtaaatatcaggtgcatgagttggtcagtcatgctttgcattaagctaatctgcagactgccgatccaccataccaatgtgagtaagttactagaggttattgcagagtcgtttttttagtcaaaaaaactataggttattggaaattcgaacagtgaaggtcagtatgcccctatgatgagggaggctacagggttattgtgttctttttctaatgatgttatagagttagttactgttgtattcctctcccaaataacaaatcaagcaaggcacagaagcaacttttctctccagtcctgcacaagagactatttaaaactgaagtattcaattaaaaaaaatccctcatgtagcagttatttctccaaaatcattgacacctttaagaaggttattttaattgtcatcaaaacttaccattttgtatggctatttcctaaaacaaaagcatctacaaggttcaacagagtatcggtaatgtcaccgatgcaaatcctacggaagaatcgtcaagatagttgtatttatatatagcacaataagtgaagtatgcttcaattcagtgcaaaaatttcaatgcggtgcatcggtgaaatgggaaaacgaagatgacagctcgcttacgcatatggcttcctcgtcggactcaagtgtgcaggtcctcgcaggatgctccggcgtgccccgatggtcaatgcaagctgcagggaggaagaaaaatatgaagatgcacacataaaagttgaggccaatatagaacagcggcaagtttaagctactgattctgcatttccaagcccattttccaagacaaccaggagtaaatctatcgtaccaagattgaaggtgcgtttgtagcccttgacgaagcccaggatcttctcatcgaagtcgaatccggggttccagatcagggagccatagccgaagacccagagcaccatctttctatgcctgcacattttgagcgcaaaaacagcagataaatcagaaagaaaatcttgtatactatcgagaagattgtaaagcttctcctaatccccaaatcgagatcccccgaagcagacaagaatcactctattcggggcacaccgacgaggattgcgacctcaaatccaaccccagcgggccattcgacgcaacaatggcatcaccacccacccaactaaccccacaaaccatgtaatctcggggaaaaatggctgcaagaaatcacctggcgagcgggaacggacgggacggggccaagtgcgcgcagcgcaggcgagcgagcgagcgagcagggcaggaggaggatcggatttttgcctccctcgggcgacggcgtcgcctcctcctggccttctctcccccctcacacgcgcgcgcccgcaccaaacccccgcttccgcaagctctctggttgggttactgttgttggtgagagggagagggatgggcgtggcgtgctgtatttatgccgcgcgagcgggtggggggggtggcgagcggcgggcacgtcgtctcgtcgacgagagaaatggttggtcgccgcgtgatcgcgccgcggtcgcttgggattaggatcaggatgaggacggcgatggg

SEQ ID NO: 46096 - DNA, 2408 bp, Oryza sativa
gttggggggcacggagatacggggggacaccggacaccgacacgctccgtacggggttacgagttacgaccggtgtttgggagctatagtagctggcacgatggatctggacgggtttgggggataggggattggggagagccgtgaggatgtcccggttcagtggacggtcgggtgtggttgaggtcggccacgcctgtcgcgagtttgactttatttactgttgatgtgacttattctcaactcctcctccccttcgtatgcaacatggaaaacgatagattaatacataactaattaagtattaattaaaataacttaaaattttggttaatataattttctaaagtaactttcttactaatacttttgtaaaatacatatcatttagtagttgagaaaacatgcgtgtgaaaaagagaaagataaagttgagaactaacaaaaaaaaaaaactacatagtcgtcgttgtgatacggtcacatctaaaattcgcaagcgcaccattatcgatgtaacactcacctccattgacgcgaaaaacaacacaattgtttgggagatctgcttaactctagtgcaggtctccgaaaaaaaacgctagtgcaggttctaaattattgatgagatacgggcgtgctagtcagtttgatcctgcgactaacaagacatataaatatgtaaatgatcgaaaagccgatcggctaacaagcaaatgtagcgatattagctgatatcgatactagccaatgtccatagaattttgaacaatcgactatatgtccgatatagattctaacacttgtataaacaatgatagaactttaacaaacaatccaatcagccgattataatataatgaagtagatgcccgatgaaccaatcgacgatatttatgctgaatattaaatgttggctcagtggttaaaacttacgttggctggaagtctggtgcacaaataatttattggctagcactccgataaaacataggtaagaaacctatcgacttaacaatacttagattatcaacaataatgtagtaggtcaaacctaaccgatgattgtatataataatctaatactcaataagccgataagcctatgaaaacatgatggacataccacatatatttaaaacaacattgtaattgtagagatatatcgtctaagacagaagaccagacctaaccgatacagtctcaactaaactaatgtgtctctaaacacaatgtgattaaagatagaatcgaaatatcagttaggcaaaatatcaaccgaaccagagtgatccaagaggtcaaagcgatacagccatgaataacaccaatgcagccgacataattcaagggccgacggaacatagggcttactcctttgaaggagatcgaagccgatgcagccccgtgttaagtgccaagttccgccggtgataaataaaaaccttggaaaataaggtggtgatgcgtcaagactagttgtattgatcgagagatagattacagggaccccgggtgtacgtatttatacccataggccgataagagtcctagtcgggcacgacacaaactttccaaaagataaaaggaaaaacataagttctgattggacatgacacaaactttcctaaatacaaaacttgcctaattaatatataaactcaagctgctatgtcgtggtcttcgtgactccttctcgaacccgttctcttctggataagcttttaatcgactgattgtaatctttccttaaccgaatccactaaagaatcttatcaaattttggcgttaacattctcatagcattccaagagtatcgaatcatagggaatgtgtgtgtatatctaagaacataattcaatccaagaacaacaactaagggtaggcttagactaaaaaggattcctatgggttaatttactagtgttgagttaaaggtaaaactctgtcgattgcttcgggcacaccggctctccactggtctctcaagctgagtctggcctacggctctatgatgtacccgaatatggagggatacaaagggcagacatgactgtcacgacctgccgcctacctcacttttcgtggagcacacggtaaccgctaacctataaatcacgcctaagttattgattactactctagtctcgcgcatgaacttttttttttatccagagtcctagtactagagcagttaataattcaattaagcgacgaacccgcaacaatgggaatataactcactcaagcaaataaattaaataccataaggagatatcgaatacttactttattgaaagaagcatccgccaaggtacaagcgagagcagaagaacaacaactccagtgcttcttcggaactccagtggaagaatgttgacaaaaccaacttcccggagagaactccg

SEQ ID NO: 46097 - DNA, 2877 bp, Oryza sativa
aaagtgagaggttctccttctttatagggtgtttatgatggttgtggaggttggttcacccacaaccgtcattggggagtgatccaggccctccacgtggaagcagatggagggtggcgtctatggtggttaggccaaactgtgggccccacctctcagctgctctttcggctgggaggctgacaggtgggcccctatggcactgcaccttggttggatccattttaagtcgattttgattggccggaagtgggccctccaatcctcatgctcacatatgattggccggaagtggcgtcgcatggcgggtgtaaatctctccaaattcaccaacataaatatatttaccaatactagtggaaatggttagtaatacccctaccactaagtttgatattatattttgaattcttttatgcaagagttgatagttaaagtttgcacttaacaactgtcaacaatagcctaaaatattttcaagagcacttaaattcctcgactttggatctatgcaaagatttgtactcagacttttttttaaaagtgctccttttaactccagtgatcgtgcagaaatggcatgcatgattaggttacgaatggaattagggatctaagaggtcttattggagtgtgaagagatggatatagggtttagaggaagggtccgagtgacggtggtgccatcggagtcatgagagcgaagtcaattgttgcaacacaaaatcgaaaaggttacaaggtgtaacagcactccctccacaaccgtgcagcccagcctaaacgacaagcgggccactaacacataccactccacttacaattttgccctcgctttgtgcaaaagggttaaaccggaaatgataaggttggagggaagatgccttataagttggttccaaccttgctaaactagcaaggtggtactaaacatgcccacacagctctcatgggccacacagacctcatcctaattggcccaggatgtcacacaaggcgacagggtggtgaccggatccggcaatgctagccatcggagatggagaaggctcagtagcatggggaaaggtcattatcaaaattgtagaagaagacatttactcgagtatggaatcgatcaagaaaagagctgggagggtagaagggaataggtgactgacggggctagcccagttccatggaggtgttgtcgaggatgagttggtagcaacgacatcgtgtcacaagagtatgaggaaaaaatagagcggacgaaagagatgaagatataagattccatgctcgaaccttcaaacatgcttagccatgtaaacaccactacaaaaatgattttttccgtgaggtcgaaaggggttttcgcgtgcggatctcccatccgtttgcaccgaggggtctgcaaaaattcgattttttcgtgagggtgacacactcgcacacgaaaatccaattttcgcgtgcgggcacttaagccgtccgcacaagaaaacaaaaattcacaacaaagaaaaaaacgaaataaaaaccctagccctggaaccctaatctagccacctccgccgtcgccgccaccgtcctgcccgaggcccgccgtcgtcatccctgcggtcgccggtgacggattcagccgcccgaggcccagcggcggaggatccaacgctaccgttgttgggagactgccgccaccatcgccgtcatcgttgccgccctatccgaggcccgccgtcgtcattgccgcgatcgccaatgatgcatccgccctccccacggaagcaggcaacagccgccaccctcctctccggccgcaacgcagctgacgcccctcccctctgccggatctaggaggggagggaaggaaggggaggggagctggagggagagggagtagaggaccagcgcacaccgtcgtcgggagggaggtcgccacgcgccggattccgctcagggggagggcgaccggccgccggatccatgcgaggatggccgccgtcgccggatccatgtcgggtttggctgccacccactggatcccgcgcctccaccatcggagggggccgccgtgccctcgcctgccgtcaccatcgcctacacccgccgccgtcgccggattcgtgcggggcttggccgccgtcaccggagggggccgccattccctcgcacacttatggcccgtctgcaacctattagggtgcttgtccaggaaaatcatttctgtactagtgaaatttgaatatttttcccaccaaacaatcaaatggattgtttttttattttattggttaatatggattggttttgttataatagtcgttggtggttacaagagcctcagtagcaccttaggtcctgggttcgactctctatgagagcggattttccaggatttaacggcattgtgctttcagtggtaggcaacatacccgtcgacaacaagacgtctgcgataatttcgtcaatctcaagtatttgccggcccagttttcaaagatgctcataggagtagggtttgggtgcgtgcgtttatagggtcagtgtgcgtgcgttgtgagtatctgcgttatactgtgtaattcgtaaaaaaaatcatggtgaattagtaagtatggagaaatcatttaaaaaaaagatatttagttacatttatgccaccgtaaaagccaagttaagtgatgaaacacgagcttcttgacaaatctcgttgctggttcaaaggtaagctgaatatacaaacatacatataaagagtaaattatttattggcccatttaagttgaccgtatccattatttgctttgaaattgcctttccataaaatggttctcaacttgttttcctgatcggtgtacttcagaaacagccacaagtttttttcgagtgaaa

SEQ ID NO: 46098 - DNA, 5202 bp, Oryza sativa
cttatgaatttcctttgaatcaaagggggcctaaactacggttaaagaatgttatatattactccctccgtttcacaatgtatgtcattctagcatttcccacattcatattgatgttaatgaatctatatagatatatatgtctagattcattcgtcatcaatataaatatatataaatatgagaaatgctagaatgacttatattgtgaaacgaaggaagtagtaattgcctttcttcttttagatgcatagccaagtggttgtgcctatgcccgtggttgatgaagcccaagcatgcgtgcagtgcaagtattagccgcccatgcagttcaagcttctcaaattcaacgacggtgaacttcatggatattctttgctgagtttggtgaagctcacaccaaaatctagagtcaacaaacctttaaattgtgctattttcgtagagacagccaaacgggatttaccggtttatcaagcggagttcatatcaaaagaggctcaagaagggtatagttgtcgtagccacaccacaaatccctctcgattggttcctctgctgctatttggtttcactagcaagtttgctttcttagtttagctaaccatcttttagatgaagatggttcaatgctttaaatttatctgtttggcgatgtattggggattgtttctgagattttttttttaataaaatgatgaggagaaaggtcgagaggaaatctctcaagtaagagagatctgtcattttgtgttccatttaacagtaatccaacagtaaattagtaaaacgggtaaataaggcataacacagagagagagagaggccttttcaaagggtcaaaccattaatatggtcaacttacataggcaaatcaataatctattcaaatatatgatagacacaatgcgcatggtttagaggttggttatcattgttggcaagagggcactttgtaaatttgttccaagtcagcttggaagacatggtcgctttttaatacgcctatatatacttcgggaaaaattgcacccagttgctaagtcaaatgtatcaaattgcacaaaatttaagttctttaccaaatcgtggcgtattttttaaaactgaaatcatgacgtacttgcccacttgtaatgtgggagcaaatttctttttatattttctttgcggatctttatgtttatttaatatagtttcttaagggatttatttaaaactctagttgtgatgcatatatatatatatatatatatatatatatatatatatatatatcttacctactagtacatgttaaatttatcttaattatttatgcggtactcgtgataataacattgatgtttaggctgatgagggggattaattcttcactacatcaatattaaccttatgtaatccgttattaaattgtggtgctttttttgaactgcggtgatatttattgatgggaacacctaataatgaccataaggtcacgtcaaattttgctgtcgtcctatatattctgaattggcatgacatatagagaagaaatatgatacgcatatagttgctacatgtattattttatttatgttactttattcagtcttgcaaactcaatattttctagtctacgatccagcgacacattctgatatttcttaaggagatatagagcagttcaatatgctattcgtgcaaacatgcatgatattcgaatatattcctgcggcctatcctataccacgaataaattttattcggtgctttttgtgaactgcggtgatatttatcgatggcaacacctcataataaccataaggtcacgtcaaattttgctgtcgtcctgtatattctgaataaaagcgtatccagattcgttgtactcaaagtcacatcatattttaagttaattattttgggatgaagagaatttgccaattgatgaagtttacaactaggtattagaaaaacatgatatttgctagtagaagaattcacaaagtagtggcttcattaggaaacagtctaaacgtacttgattgtttatatactagtcattattttatattaaaatgtaatatatactaagcatatggacaatgaggcgaaagaaaatgataaaaatacaatcagttctattcttatttctttcatttattcttttgggtgtcccattcttttttaagaaattgagtacatacaccttagaatttgattaagggtacacactgctttaagctgagttcttttcttggagtttcaaactcactcccctcattttacacgtgcacgcttttcaagctgctaaataatgatgcaaaaattactatatgaaagttgctttaaaaatcatattgatttaaaagaaattagttaatacttaattaatcacgcgcactccgttttctgcgcacagggaggtgaagttcccaactccaactccacctcccaaacacttgtccttgataaaaaccccctcttctatgtctcttcttatcatttatttcaagtaaactttttaaaaaatacttttagcgattataaaactaaaaatttagcatcaaacctttcatacaatcacatattgaaagtatcatatcataaaactataaatttagtgataactacatatttttagagtttagatccatagcactataagttatttatacgtacatatagttttgtgataattgatattaaatccgtggtttttatgatatgatatcgtcaatatgtagttttatatatataattgacactaaatatagttttatggtacatatttttaaatcaatataagtagttttctaataattggacgaagtatacatagttttgtaaaaaatattctttattatctcatcttgtgtgtgttttggtactacacagcacagatgacacttttccccgatgaacagttctcttggacttttgggcggcccaatatgtgcgaacgttgtgggctggccacttcagatcgagttcagaacttccatcgtaatgtccgattgtgattcagagttcagaacctccatcgtaatgtccgattgtgatatgagaaaactgaatgcagcctaaccattttggacttgattatttcatgcttcatattccaataattaagcttgtcccaggcaagaattgctccctagctaaactatgtatggcccaggatttttgagtcagctaacgaatggcctaacggttttgctagaaaactatcgttatattaatttctcgattgatttcagccaaattttggggcatcctcacatggtgtgcacggattgggatcctctgacgtgaagtcagaggaacatagtgactgacatgtgggcctcaccgctcgcggggccacctgtcagtgaccacgtcagggacagttcacatcagaggatccggttccatcgcgcacacatgttccttgctcttggttattcatacgtttttcttgtttttcccttgttgtaataacttattttatcctaatatggtttgtacttaaaaaaattaatgtaagttttaaaatttatagtgtgagttgtataatatatatgtactagtgtattaagtcgtgcattcgcgcgactacagccatcacgttatgaatggtgtgtaagaaaacatattaacgttaatcaaaaattataatttgttgttcaaaagtataaaacatatagttattttatgataattttattatggtgtttacgtgactataacctccctctttattaaatatattttacacattatttacagtgattagcttaattttttataattaacaatacattttttttcaaacatactttataagaatattatcataacaacaaataatttaacatacattattgtgtccattgcctccctcttgttgaacttttaaatgtttcatttctagtaatagtgtaaatagacttgtaatttgaattgtgtgtcccatctttagtctgaacaaaatagtgagtccaaccataaacaccattttcgttgatgcttttagcaaatttaaattcttttgcatacatgaatatatgttaagataacgtatttagcagtaagtctatgtataacacgaattgttttatcttgatctgtaataaataaatattaccatgacaataaataatttacaataattatgctaaacttgataattttatgaatggtgtacatgtaagaaaaatatattaatgataatatgaaattacatagtttgttgtccaaaacatataaaacatataattattctatgaaataattttacgatggtgtttacgtaactatactttcctctcaattaaataagcttaatttgaaatgtacgaaccattttttgtttaatgctttttacataaacaccattttcattgttgcttttagcaaatttactttttttttcttttgcatacttgaatgaagtctaggtactatggttatgcaatatctttctaccatctcaagtaagaggttcttgtgtagcatgctagaaggatctagaactctatatattttttaggcaaattttgctacaggacactatgatttcgtggttttagccatgggacactgcccaaactcacttttagagaaaacactccataaacatggtaatttgccaatggataccgcgccaattaaaataatgatttttggttaaggaggagagagaaatcgcgtgaaatatcaaaaatgtccttgggccacatgtcaactctccctctctcttcctttctttctccctcctttctctcttctccccgtcacggcttgctcggcagcggcggcgacgcctggagcatgacggctgggcatgccggggcgaagcaagggcggctcggcggtggtcaagggagatgcggcgggactccggcgaccattcgcactgcaccgatcacgaagcacccaagcacgaatcgacgtccaagcatgggcgattgggccaatcctcgcggcgccggctccgttaaaatcgcaggatgacgacaccagcatcatccagtggctagacgcacatccgcggcgctcggtgctgtacatctcatttgggtcgcagaacagcatcagcatccatcagatggcggagctggcgctggggctggagacgagcggacggccgttcctctgggccgtccagccgctggtggggttaaaccacaaggacggattcgatcccggctggctccccgtcggatttgagga

SEQ ID NO: 46099 - DNA, 10204 bp, Oryza sativa
cggcgagattggaacagtttctcagatgcgttgaggcgtcggcgctccgagcgtcgccgccgccaccgagcaagccgtgacggggagaagagagaaaaggagggagaaagagaggaagagagatggagagctgacacgtgggtccaagggtatttttgatatttcacgtgatttctctctcctccccaaccagaaatcattattttaatcgaagcggtgtctattggcaaattaccacgtttatgaagtgttttcccccaaaagtgagtttgggcagtgtcccacgactaaaaccacaaaatcatagtgtcctgtagcaaaatttgccatgttttttattgctacttaagtttgatcctattgttaaaatcgattccaactcttttgtcattttgtgaatctgatggccaatgttcatcggataatgtggcacatttatatcttaggtttcacttttcattcgttgagatttgcaacataaaagttggttgatttctctactactttaaaagcggagtcgtttttcaaatgttccctactacacgtcgcccgctcctttgcgggtaagcatccattaaaaggcacacccacctacacaactagaaaactgattctttcaaacgggaaaaaaaattacaggcggtcattaaccccgtccgcactttaaggcctccaaaaatatacaatttttacatgcgaccattatcccagcctgcacttcgttatatcggtttattaatgaagatgaccaaattaatcggaataaattcagtcgttgaaactgttgtctgaactagtgaccgaatcatttgatttcgttttattttgcccgtccctaagctcacccgctcggtcggtgtgaaacgaaagaacacgaggaggaaactcagagagggcctttgccgcgggcggatccggtgctatcttgctttcggtaaaataaaatgttcatggcgcatgcatatacatgtacaaattaaacgatatgcccatacgtatgcaaaaagtaaagagcacccaaagctaccaactaaagcacatcctcattcccaataggaaagttacaaggttacatatgctttgacaaaaaaaaatttcccaagcatatatgattgagcactttgtacgcacaaaataataaacagaaaagcaatgtcatatgtgcagtagctagcagcatatattctggtcttatgaaattgctgcaacttttttgttcgtgcgccgagcataaacgggtttaattaacttaattcaccccgttatgcatgtgcgattgtaacggttcgtcggtagcttccttgtaggaactcaccaaaagcaggcaaataaacagaaggaagggacgacattccattcccagagccccatgcacttcatagctccaacatgtgaggcgttctatcgtgcttggatgttatatatctggtccgtctatcaataaaaatctaacggttcaaacaataaaacaaagatgtcttacaaaaggtagtaaaaaaatgggccaggcagttaatttgtagattaggtgaaaggttaaatatgtaattgtcactacttgagaaatcatctttggtcggttaccaaaaacaacaatactcccggttgcttaaaaaaccgggggtttaaaagtgcaataatctttagtcccagttagtgttaccaaccgggactaaagatcatcttttgtcccagtttatttattggcacgacgtgacaggtctcctaatatttttaatcccggttggtatgaataactgggactaaagatcagatttttagtcccggttgtttataccaaccgggactacaaatcagtttcccacgtctcgctctctctcttccatcattctctccgcgcgcatcgatctgagtcctcatcacccttatctcttcctcccctccactctttatctctccgttcttttcctcaccttcctttttcactctcatctcttcctctcccccttcttcttccacatctgagttttcctctcatctcaccttctgttaagttttcctctcttctcttcctcagatctgcgggacaagcggccggcagcggtcgggcccgtgccagggagtggcggcggcggtcaggcccgtgtagggcgggggcggcggcggccgggcccgtgctgggcggggatggcagcagccgcggccgggccgtgccgggcgaggaaggcggcggttgggccgtgccgggctagggaggcggtggcggagtgacagcgaccaggcggtggcggagcgacggcggcccgccgcggaaggtggcggcggcggcaggctccatggatttttttcttttttttctctttttccttctcgttgtgtgaataattgtttgttgatttgatctgtgatttgagaatgatgtgtgaatgatttgtgatttattgttgtggatgagttgggatattgagatattgggttgttgctgtggatgatttgggatgttgagatgtgtgaacgatctgtgatgtgtgaacacaatctgtgatttattattttttaatgatttggagatatttggcgccagaaaagatttaatcccggaaggtgttacgaacttagtcttggttatttcaatcgggactaaaaatagatatttttaagtcccggatacatagtcccggttgtaaaactgggactataggggttctcaaccgtgattaaaaagcgattctccagtagtgtgagtcccttttatcagattagatatggtaaatagaaaatctatttttagtcttggttatttcaaccgggactaaaaatatcttagtcccggatacatagtctcggttggaaaaccaggactataggggttctcaaccaggattaaaaagcgattctccgtagtgtgtgtcccttttatcagattagatatggtaaagagagggcgatcacaacttatgctatgcaaataaaccatatatagctgaacatatagattatataacaggcgataaatacctgttgataatgtacaatatttaaataatattaattaactttttatgggaaggacaagttgattgatgtgtagtttattattgtaacgcacaaaacaacgtagcaataccctatggacacacgcacgcaaaccctacccctatgagcatcttcgaagactgggccggcaaattctggagagattgacaaagtcaccacaggcgcctcgctgtcgacgggtacgtcgcctaccactgaaagcacaacgccgttaaatcctggaaaattcgctcccatggagagtcgaacctaggacctcaggtgctactgaggctcttgtaactactaggctacaggccctttcgcaacaacgtagcaatatttaatacactgaatgtataattaatgataaaactaagtaagtaatcaataactatatattttcctttagttaatctatatgctcagattcatatagtgttcccagagaaaagaaaaaagaaagagatttttaaaatatttttatgcccagttatccttaataaatcaacggtgtgtgttttattggaggtggaggtacttgaggtacctctcaagcacattaaaagatctcacaacatgtacttaccccaatacattcatccgtgtgtgaatcgtggttgctgaggatcgagaaaacattaaaacacccctacacataagcacggcgaaccactgatacatctgccgcacggccgctcctacatcatatgtaaacctacatataagtccaagtccaaactaagcaggggcggatccaataatagattggagaggttgatctccttcttcctcctctccctattttccctctcctctcttcttttctcaatgatcatctagtggggtaagggagctcaacccccctaaccatctgcccatgaaactaagggagacaacgtacattgattgatatgttgttggagagcctcgcgctgcttctgtcggagatatagatttttttttaagtaataggagtttataaaacccggcttctacaccaacgtggtgcatacaactacagaaattccaagtgtaatagcttagtcattacacataagtttacaaccaaaatgagcacaaatgctcaaataccctacataaaactaaaagagcacaaatactccaacacctatcaaagtgaaaagagcacattttcttctctcaaaatgagcacaattgctcaaataccttattttcttctctcattaagtcatatcaccttaattctttttagtccttagatgattaatctatggtccaaattacctccctcctttttttctctcataaagctacatcgctttactcttacatttggatcatcattctacatactatttaaattatcataaaccatatcaacttatgtgagctcatgttgtctagctattttacacattatttttacttattgatatcgtattgaactcctgcagcaacgcgcggagtttcacccagtatttctaaacttcctaccgcaccgtgcgaggtatccactagttaaatatgtcgacaaaaagtaaaggaagcccgcggtgcaaacatattccatgacgtctttttttttcaatttcttttactattatgtagaagacattcgacacggaaaactaaccgtacaacctaacattctcaagattcttacttagggtgaattagcactataaattataattatgtcgatatattgtcgtagtattgtttttctgatatttttccatgtgctaaattaatggtcaaccatcaagaaaaataacttctgatgtgaagtcgtattttcttgtgggttcacccagacaggacataggatatatcatgtatcctaattctagtagtgatgccactacatgcacacacacctattagttagcaatattgctaactagagtaaggatcattagtggacctattcggctgcccttatttgcactgtgttgcagcttatacggacagtactttatatgtgcagctgtagcgcagccgaacaggcccagtaagtccttggctaaaaaggtcccggcgatccactattgaaatttgaattaatttggttagccaaataataatttctttggccaaacaatttacctgaattttagaaatttcgatccaaggtattacgacccaaccatggttacaagtacctgtgatggttgtaacgggacattccctcgcacgtacgtacaaggataattagctggattttccattttccatgtgaccaagaaggtcaattttaaaaaataaaaagaaaatattttttatcgatatgacatagatatactcttttcaaaataattagtaacattatactgtcatcgtatctgggggacgcaaaaacgctggatatgacggtgggatgcgcgagttcataccaaccatttgcaaactaaagataaaaatgaggataacctgttatcggataattggaaaaaaaatatgagcatgttgaaaaccgaacacacatgactcaccgctgcactatccagtgtatctccacccatgcgtaaacttgcatgagtttgtgttgatgacgtcctgagttcgcgctatcaactcgcacgagtgacgtcattagtttgtgcggtgaaatggcaaactcgcacaagttcacatggtgaactcgcgaacttgcacgactccatgccgatgacttaacgagttcacgcgttggcagtgtgaactcgcacacatcatcactgtgtcaccagttctatatctcgcggatgtgacaacggtataatgttgctaatagtttaaaatgagtatatttatgtcataccttctaaaaaatatattttaaaagaaaaatcgaattttgtgccgaaatcccgatagtttttctcctcccacaaccgaccaaggtacaattgattccgtgtcgcatatctgtcttaatttcgtggaaggccatagcggagagatcaaaatcccggccggcctgattgggttatcttatcctcagtcctgaacacaccacttgatctccacaaagtcgacacgcaaggtgcatgtaaggttaccaactgccaaaacacaccaattgtctgatagtagtaggaaagtagagcccggacgggagaggagatcgatgagacctagcttgacacacacacacgagagagaaaacgaagaaaagaaagccaacgaaaaggcaaacgacgaccaaaatattgacccttttcctccctgcaaccaccaccaccacgtcccaaactcgcacgtttctccctttctcctcctgtatacgtacgtacgtgccgctttcgccacgcgccatgcatgcaccactgccaccactatcaaccacacaccgttctcctcctcgcgccgcctatataaggcctcgcacgcatccatccaccaggtgcacatcacagccgttacagctggtcactaccaacaagtacaacacacaagtcatcacatatatatacctcgcatcgcatcgattccatcgattcgcgcggccatggcgcccgagctgtcctccccgtcgtcgtcacctcgctacaccgttggctacgcgctgctgccggagaaggtgagcagcgtcgtgcggccgtcgctggtggcgctggccgcagaccgcggggtgcgcctcgtcgccgtcgacgtgtcgcggccgctcgccgagcagggcccgttcgacctcctcgtgcacaagatgtacgaccgcgggtggcgcgcccagctggaggagctcgccgcgcgccaccccggggtgaccgtcgtcgtcgactcccccggcgccatcgaccgcctcctcgaccgcgccaccatgctcgacgtcgtctccggcctccgcacccccgtctccgtcccgccccaggtcgtcgtcagcgacgccgccgccgacgcggacgagctcctcgcccgcgccgcgctccgcttcccgctcatcgccaagccgctcgccgtcgacggcagcgccgagtcgcacgacatgcgcctcgtctaccgccgcgacggcgtcctccccctcctccgcgcgccgctcgtcctccaggagttcgtcaaccacggcggggtgctcttcaaggtctacgtcgtcggcgaccgcgccacctgcgtgcgccggagcagcctccccgacgtgccggcccgccgcctcctcgacctggacgccgagccctccgtccccttcgccaacatctccaaccagccgctccccccacctgatgacgacggcggcgccgccgacgacgacacgccggccgccggcttcgtggacgaggtggcgcgcgggctccggcgagggctgggcctgcacctgttcaacttcgacatgatccgggagaggagcgaggagcacggcgacaggtacttcatcatcgacatcaactacttcccgggctacgccaagatgccgggctacgaggcggccctcacggatttcttccttgagatgctccgtggcacaagacctgttcctgagcagctgggcccgggctcgggcctggacatggaggcccgcaagctcgagcctgggctgggtatcggtctaagagaattggagtctggccgagctcaggcctagctagcactccgaggctcggtgttggcccgtcagctcggcccggcccgacccagcgtttgaacatgtgtgcattttatactttgtaaacaataatcaatgaagccaagcaaatgctacaagtgcaagctaaacctcaaaggacggtgtgtgtttagaagattattagtacatgttcagtctaatctagtgatccaagtaatcaaggttagtggcaacatccagccctttaccttaaatggtgagaaatttaacagattgtattcgttaaatgttcatgtgaagatccgagtcatcaacgcgtgcatcaaacttttaacttaaatattctctgtaaaaaagaactttgaagggatacaactgagaagtaacctatcatcctcttttgctttttttttaattgaacttatcattctttttgcatgcttttatgcactagcacagctcgattctctagtgcaaagtgcgtctatatcaatgtgccagtcgatatacatgtgcgaaatttcatatccagctagtagttttttaacatcaacttgttgttactcgactttgctatgtgctgtcaggtgagctttaactaacaccactcaaagtatcattaatctgtgatactcatttgctcgtgagtattgtaattgtttccccgttgcaaacctgtgagtttatataattttgtgatgaatgcaaaccttttttttttatgcaacggttttcatatttctgtcccttgggtagtggagtggctactgtaaacatccagcatacttggctttcatggttcttcaaatcttgctgcaataatggaatcacattgaacacgcaacagaacagagcagcgctatttcagacattggataaactgaagtccagaattcattcatatctggagagaacagtattatctcagagaaaagaaaaacaccatctcttaagctaagaaatcatttcggaacagaattttgcaaatattactagtaacatagagtacttaattttgtctgaccaaacgaaattaagggtgtagagtagccctcatctgctgctgaaacgatcataacttctggctctggattcggttcatatcgagattatgtgagctttataccagtcaattacttaattagcaataatttaagtacaattagtttgagatatccagaacacgagtgaaatcaaatctagtgcccatattaagatgttccccgttgctaagagtgttggaagcaaacttttttttttaacgcgtagaaggattgcacgtcaatatattagaagaaaagagttatagttacataacgcaatcagctagaccggcttatgccaagcgaagggagaaaaggcaaaataaaaagctgaagcttagaaaactacggtggctaaacacaaactccaagcagcgagaaggggccgagccatgctacactcccaacagatcccaaaagcggcaacaacgccagctaaagaccacagatggcattccgagtggatggactccagaaccactgagactgtagagaaagcagagtcgaaaaccctataattccattccttccacagctgccaagaaaccaggagcaccagagagtcaaagccggcgcggagatgctcacgtaagcaggccctggaggacagccaccggtcctagaaccagctgcacacggagctagacctgccgagcaaacacgcagtcgaggaggatgtggtttgtcgtctcaagatcctgagcacaaaaggggtaggccgagtgactacgatgccatgcttctggaggagatcagccgtccagcggcattgctggaatgtaaaccaaaggaagaacctacatttagcaagaccctttgcgtaccaaaaatgattagcacaggcaaagtaatgctggccatagaagaaagcctagtacacccaacgcgcttaccgctggtcagacatccaacgccaaacgagacaatcctcgacacccggcgagtgctgtacgtgaagcaccgcatcccaaataaggagaaactaggagatgaccaggacagtgaggtcaccgtggatgtcagagacccacaagttgttcaccaggccagaagcaaccgtgctcaaacctcggagatgctagggaacggcgaagaagagatctggaaccaaggatgccatcgagcggtcgtcgatccattggttagatcagaagagcataaactcaccatttcccagcatgatgaaagtagatgccgcgaacatgtcagagacggattgctcaactggggccttcaggccatcctagtaggaagtggcgaagctatattatgttggggggtggagagggaccccccctccccccgaattcgtaatttctcactaaaaaacactagaatgtacagtgttgtagtgaaattttctagatcctcaatggtagggcaccccccttgttttgatgctagcttcgtccctgccagtaggggtgccctgagcactgaagccagagccagcgaacacgcatggcaaatcctgccaacctgaggtcaggaatccccaacccatcgtaggtttcgggacgacagacgtgcgtccaggacacccgacactgccccccctccccccaatgagccgagtccatacccatccacaagaagacgtcatgttttttgtcaacggccttaataacccagactggaa

SEQ ID NO: 46100 - DNA, 8085 bp, Oryza sativa
aaattgaatcggagtagcatgtggcacgatgatggaatcgtggatgtatgaacaaaatattacaaataagggtacgattgtaatatgagatgttagggagattataaagttgtcgctggtctcgaactgtgattgggccatgtcatccgaaaacatacgaccgtccgatacaaccatggggtaaacaaggagcgttagatcagatcaggaaatctttcaaaaaaaatgctcttccagatacttctctcaacttccggtcctcccgcctatgcacatttttatttttcccctccctcccgtgcgttgtggtgccgcatttaccgcctcccctcctctcctcctcgccgcaaccgtcgcggcgacgcctcctcccattcccgtcgctccttctcaccatcccttctccgcttccacctctgcctccccctagccaccgaattttttttatctaaacacatgcaaaccactaattacaaatgtgagcacacaacaattacatttaattatttaggcaagatgctcatatacagcgatatgtttccctctaatcagtagcccaacaaactggccgttgaactaatcatgttagcctaacaacccacctctaaaattggttagttgcatcattacggggagttttctccattgttcaaatctaattcatccggtagtatgaaaatcatagggtttaattagggtattatactactaaattttcaatactagcgattcatattagtggatcaattgtttgctccatgctagcaagtttgattagtcgatcacaatgtgctcagaatagaagaattttagttgcactatggccacgctaacactgtcactgtcaaaggttatattagatggtttatacatacacacaccatcatcgtgtcgaggctaccgtcatggcactgagccaaagctaacaggataagaaatgaggagcccatatcatggacagtacagcactaggtcaactggatttacggtggtgacgtgggcaggttgtttagacctagaattccaacttttacgtgctcacatttgtaattagtgtaagatcaacgtgtgttttgattcttattatgtgatgaacaattggcatatgtgattattggttttgatatttggagattatcgtcgaagtggttttggacaggtgatgaacaaggtttgttgttttgtcgggaccggtcagactgggcggaggttgccggtcagaccggcgctatgtgtgcggtcagaccggcccggcccgcggtctgaccggccgacgctgtgtcggtttcggtttcgggttgtttctttggatatccgtgcttgtttcatggttatggcttctagatggatactatacgtatgtaataccgttgtttgctaacaatgagtcaagttggggatagcttggtctcggaatatggtttctttatttgcttcatgtgtaggtgactcaatgcctcgggagagtatttgcggtgatggactgggagtcggtttggtggtaagacgatgtccgtggtggtcagatatcatgcgggatactaaggctagagttgatgcacgtggttgatggagattccatatggcatacgatggaggtattgtgtgtatatgggatgcggagtcaaatttggaaggagtccaaatttggtacgattggttatgttaagtttgtgtcttgtactagagggttttctaaggtgtttagaactcttagtatgagtttggttcgtggctttaggctgcctacctcatgtataaatagagggggagcgtgaggcttaccggtatcgcttttgtatcgctttggagagcgattgagttgctagtttagctagggttttgagtttagtcgagatttttgtaaggagtgctattgttgcactttgtaaacacaaagagaagcaataaagttgtcatcaactttgagagttcttcgatttgtgtttcaccaggtttcaacggtctaaccgatgactcaccggcggtcagaccggcggcaaggcggcggtcagaccggcggcgtaagggcggtccgaccgacggcggcgacaggcgcgacgagcgacttcggcggttcgaccgatcgatctacatcggtcagaccgacgttcttcaggcggtcagaccggtgcatctacttcggtcagaccgcgatccatcgatttgagggtaacttttatttccgctaaaagttttggttttgaggtatatcaaccattcaccccctctctggttggcttagttcttatgattcgatcctacaattagtggtttgcatgtgttcagataaaaaaaattcggccctagccacgccccctcttctttcccctcatccccaacagcaccgcctcttcccattgatctgggctcgctccatcaatagcagggatctaattcggtagcatggctcgatccagttcttcttgtccccctgtggtgaagattgccaggggaaagattaaaggtcccaaaaactgcacgattggggaagtcaacattgactacaatggtgagtataacttctcgctcctgacagtgttcattgtatgatgtgcagataccaggtcttcagctaactctgagaagttgagcacatgcatgtcctagctgctaaagtggaatcagtacacgcctatttattatttttttaatgatgtaattatgtctaaaaaacttgaagatctaaatctgaaatagtaagtttggactaaaaaagatcaacaagttctaaaacggggtgtttaaagccacttatgtatttgcaatttttttagtatgcagatttcatttaaggtcactgtaaaaagaacatgtcctacaaacatagaaagattttaagcaataaatattatagttgtacaacagaaaaatgtgttgatggctcaaattcattaatgataaacaattacccctccgtcaatacgaatgtgaaaaatgttagaatgacttacattgtaaaattgtgaaacggaggaagtacatgcacaattgaatttcatatatcatgttatactcatttcaaaatgcatatgacaacaaatgggtttcaaactagcagcaaaatggtttataagtggattgagatagtatttcattacttttgcacacaaacatataaaattcaaaaattaagtttccaaataaattccatgagtatttgattaattcgatagttgccaaaaaaaattagttgtgacaagttagctgctaaaaagttatagctgtgacaagttgtgataagaaaaatctagaattatatgcaagttggctgcttcagaagtcattgtattacatgatgtagataagtcagaaatttacacattcttttttcttggtattggtgttgaaccataccaatattgtcgaatttggctccttgagtacattcatctgcactggaattccttatcaaccattagtcactaagtgttcttccttgtcatactattgcctcaagtaaacaatctacggaaatttgtgtttaactagtcgggtgcccgtgcgttgctacggatcttgaataagtaatatgatatggtgtaacttgaaaatatataaacgtgtctgcattactgtaagtaagctagaaggcaatattatatttgaatagaaaaaagttactccgacgtctcccaggatgtcgatcaacaattacaagatataaattccaaaagaacaaatatgccatggatgtagactcataggtcctctttgggaccaattatagcaacggacagcttatgattactctaatatctgattatccccaaacaacaaaattattcataaatatctggccaaccaaacaagtcatcactttttttttttttgggggggggggggtctagtcattatgcactcatgccgtatattcaaatatagcaggtacatatttggacaactgcatataatccataatcaagataatcaaaagctttcataaaggtggccatatgcatagcattatcaatagttatgacatgccggatttgtgcagccatgccatcacctccacttgatcctcaccacgttgccagacctgcacgcgccaacaacagaagtaagaatgtcttcatcgagaatgtcatcacctgctgcttcagttgcttgaatgttgcttctgaatctgaaaattagcagcaaattcaaaagctttcagttttagaaagtggcaccatggcactcaagttcttggttcctttatcacaaaattggcaaattatctaccaccatctgtaccttcatatgcatccaccaagatgttatatgaagctctgtcacaatcacccctcaccaaatgctgcatcaaggagagatccctcaagcgccttgcagcaatcctgtatggctgtggtgcattgatatatacaatgtatattactccaaacttaaagaaaagtaaaaaattccatccagatgtcggtaggaacgtaggctcgtgtagccatggatttatgatgaccaccatttatcttccatgaggacatcataagcatacacttcggtctcgtggctagcctgttgcattcttcaaacacttcttcagtcttctcatactgactttcccttgcaaaatgcattcaccagggcagtctaagtgcagctggtaggattgcaccctactccatctcatttaagattactatcaacaacatcggttgctctgcatgtgaaataattaatcataattaagaaaaacatgtctaaatgtcttgaactattgaggccattaaagttatttttgaggcacccatctctatttcatcctttatcagatcaaataaaccaaatatggtacagcttaagatataaacctatattatattatattatatgaataactaacctgatcttgtcagcgatgttggtctagaggccccaaaattgctatccattggaaccctgtaatgcacaagttcaaaattttcagtgcagtccagtacaaaccataaggcgaaatcgaggaccacacttctagtgcattccaatttcatacagatgacagactctagtcatcaaaatatattgttttttcaatatatgttggagtacagaagtcaagagaaacacatggcgaaaagcatatgctgaaagggttacaaatcatgcattcctatctaccgaaagatgcaattgaaagcaagaacagacaagaacctctcaactcattcagttctagcttataaccaaaactttagagaaggatcattgtttgctgaaaaataattggttgcaccaaaagagcttatcttcctgcaatttgcagcacaatagcataataaaatatttttttactttattctacttggtgaaataatagcagtgccctgaatatttcgttagggctataacacctcaagattacagctttatatattgcagtgagttctgccgaacaaatgccctgcaagaggcttaatccatactacttgaaatacttttccctgttttcagtggcaaaagaacttttcctctatttgggtattggtaaatctgaagatatatcttggtgactgacagactggcagtcattccagaaacttggcttggctttaataagagctcaggttaggtaaattcagaatatccaacaggagaaatacaggattgataagatctaaaatgtaagcacagtacagtaatacagggtaaattcaaacaaacttaagagcaccgaaataccccgatcagatcgaacaatttctactaagcttacataaaacaaaacaaaagaaaaaaaatcccaacctttggaatcattgtcaggaattcgaagaataattcacaactttttctgtctaatttaagtaaacaagaaacctttggaatttcagcacatatataatgattgaaacttgttcttgatgatgcaaattcagttatggagaaactgaaaaatgttaagaacataaagaataaccatatttaaccaacaagtgacaggaatttgtttgaccattgagaagacacaccttgcaaacaagatatatatcgctgcacaattaagcctccaaatgaacgtgcaattaattgaggtggcaaggagatctccttccaggtgaaatcagcaatatgacagcctatctgtatgaatcaccaaatgcaggcatctgttttttttttgttgtcaagttcttcgtcagaattaaaccgggttaaacttgacttcccattaaatttcgagtactgaagaactcatctgaacttttcagtaacctgctattcattgtggctgaaaagaaacgcaactacattttcaagcatgaggctctcccaatagcatgaggagttgtttttctgttagctgtgatgtaggggtgatatcaggtcagcacggtctgcacaaacttatcggtagcatgctgtgctcgattcaggtttgatttgggctctcttgtcgttttcacataggtattcttaattagttgtagatgtcatcaagctaaaaaaaattcgtgtgcatggcctatggaaagaagctcaaaatctttaatgaaaaatgattaagtagcagttttccgaaatctgaacctcaaaatgatttttttttgttggattgctgactcatgtttcagggtcggattgcttcttggttgaaaacttgaaatagcatgtacaagaaaccaacataacagtgggaaagcttatcaagatggagttaacgaggcagtaaagcgacatggcaagagattggaatggattggaagaagaagaagaggaggaggaggagatgggagaatttaccatgaaacaggtcttgccgatctagcaatcgccgagcaggctgaccttgaggctgcgtccttgacatccggcgccttgcggtcggcggcggcgccaccgtcgtccctggggagcagggacagaacggccccgttggctatgcgctgcggtggcgtcgaggaaactggggtgggggtatggggagtgggagcggcgacggcggcgaggaggcggggaatcgccgtgatgggatggaccacgaaggagagggagaaggcggcggcgtcgcgtggcagttggagtgttggacggaggcggtggcgtcgaggaaagtggcgccgtgggttggggggtgtggggcgacggacggaggaggcatggattccgctgcaggcggggcagggcggtcgccggtggcagggcgcgatggcgacggtcgtcggcggcagggcgatgcgcgacggagtgtgggcggagtgggcggcagacgcggagaaaaaggagtgggggaggcgccgctcgataagggcaaccacaatgtgcttaaaaagcaggtaataaacaataaatgcactcgtccaaccaggtaatagccattgtgggggcagataacagcaagaatcaggcagtagtgttactgccggcaagagacaaataaaatatagcatgtgtacagtgattttagagagttgcactaaaataatagagtagcagttagccgttacatttgtagcaattgtaacttgttgcaacaacgctacaacctcatccctctacaaatacaaacacaactcagtcattttctgtatttcatcaaataagatggatcctcccaacagaggttttatgcacatgcttagctagggctcccaaagccaaacttctggaaatggtagccaaaactccacttctccacagttcccctcaatattctcccaatcccagttttctcaatcctcaacacccacttttcagaacttccatccttttggggctccaaacaactatcaaccatatggcaattctactccaagcttccacggttttcagcagcaagcacattggttacactctacaccagtgagttttcaaggttttcgtcctccggaaaattgggtgtactcacctaatcaaattactgggtctgcttcttcccacggatcagaatcagcctctcagtgccctgcaagatatgaagagaacaatgtggttgatatcgaagagtcaagtgacaacagtcaagaggcagggaggagaggaacacgagtcaactggactgaagaggaaaacataagactccttagctcttggctgaataattcagtggatcctataaatggtaatgataagaaggcagaa

SEQ ID NO: 46101 - DNA, 2399 bp, Oryza sativa
catgtcaagactttgttctttccaatgaagctataaaagtgaaagcagaagcgatgctgaaatctgcagaagcaacatcgaaatcagctgaagcaaagaaggaatacacaagaatggagaagtatcagacatacttaaaattgttggacaaagacacttcaaattttagtgatgcaaaactgaagaggcatgaagctgtcctcgaaaagctagctacagaacttgctgaagaataaatgatcaccaagtgatgttgtatccctgttacttagtgtgccactatgtggtctatgatcaatttgctgctaggatttagacttagcaattattagacttgtgaactcagtgttaagtttgtaggctaagtaaatgttggattgtaaacttagtgaatgatggttgtatctttgtacctgtagaagatgttatgtactgataatatgtagcccacagtcttaattgaacttatttgaagttgttggcccataatttcttagcacttgatttaacagcagcctacaaaatacatatgtagcagcaataattagcacaattatttataatcttgctgttgtgatagtttaaaatagttgtaaagcaagacattgatgtttataaaactgttgtttcaatatataaaaagcaagacatggatgtttataaaactattgtttaaatatataaaaagcaagacatggctactaagaatctagctgttggaatacatccaaacagcaaggcatgcctgctgtgaatctagctgttggaatacatccaaacaacaagtcatgacatagttgtatggaatatagctgttggaaactagctgttggaacaaaagcaacactgagatgttagcacatatccattcagttgtatcttctatgaaacagggtatgcagttcagcaagatatataccattgcctttaattcagttcattctcaacaaagccacctagttcccacaaagatgtctagtgattcacaagtccattctagtcattctgatgagtccatcactagtgagaatttggaagatatgatgtgggaagaaattaatgatcctactgaagctcagctagaagcccggcttgaagctcaacttgagatgaaattgatggcacgcctagctgggaactctaatcagcgtggaggctacacacgcaggtacatcagtagagatcatgaagacgatcacaacaggttatttgctaaatatttttcagacaatcctttgtacaccgatgatcaattccgtaggagatttcgcatgaggaggcatctttttttgcacattgtacaagctcttggcgagtggtctccatatttttgtcttaggacagatgcatttggaaaggtgggtctttcaccatttcaaaaatgcactgctgccatgcgaatgttggcatatggtactccagctgatcttatggatgagacttttggggtagctgaaagcacagcaatggagtgtatgatcaattttgttcaaggtgtgaggcacatatttggtaaacaatatttacgtaggcctaccgaagaggatattcaacgcttacttcagtttggagaggcacatggatttcctggcatgttgggtagtgttgattgcatgcattgggaatggcaaaattgtccggttgcatggaagggacaattcacacgtggtgattatggggtacccactatcatgcttgaagcggttgcctcaaaagacttatggatttggcatgctttttttggtgccgctggttcaaataatgatattaatgtgttagaccaatccccattatttactgatgtcctacaaggaagagcacctcctgttcaatatactctcaatgagtcagattacaacatgggatactatctagctgatggtatctatccagagtgggcaacatttgccaaatcaatcatcagaccacagagcgctaagcataaattgtatgcacaacatcaggaatcagctagaaaagatgtggaaagagcctttggggttctacagaaacgttgggccataatacgtcacccggcaagagtttgggaaagagaagagctagcagatataatgtatagttgtattattttgcccaacatgatagttgaggatgagaaaggttcctatgacataccggatgacaaaacatatgaacaaggtcaattctctgctcagataacaggacttgaccacggaccaatatatggatttgcataggtactagagaaaaacagggctattcgtgatcgatctacacatcggcgtctcaaggaacatttgatagagcacatgtggcagaaatttggaggtcaacctcaacaacattagagtgtattaacttacctatcaaccttgtactttactattttcatatcaaccttgtactgtaatattttc

SEQ ID NO: 46102 - DNA, 23396 bp, Oryza sativa
  unsure (1)..(23396): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaatagaaagcatgcatctctgttagaaaagaacacggcctaaatccagtccaatttttcatcccactatcataggatagtggcccaataggtccactttggcagtaaaaacgtcccaggctcccagcccatcacggcctagtatcatgcccgaagggagaaggaaaaaagttcacctcaggttcctcagtttactgccgagttacaaaatcatccctaaaagaaaaaaaaaagaaagatataacgccttccttgccttacaaaatcagatcattttgagttctaagacagtattgcttccatttttaggtgacatggtggctgaatcagtatggtacccatatgtcatactcacaaaaaaaaatcctcttcatgagtccccaatctctcccgctccacccaccatccacagcatgagtccgcacaagcgggcatgctcggcactggccctgtcggtgttgcgggagacgaggcgccatggagaagataacgccaacagcgggtggaggcggcgaagcccgtcttctgagaagctatgtcgagctccattagtatatgttgtgtctagctcatggtgtcgttctattgcgcactcagcctggtgccgcccgacagcgatgccggcaccaggtgacagctcgccgatgcgtcaacctcacagccagcgatcttgaggtctctatagcacgagacgaacatatggtagcagtagtcggacttgaagcgctcgccgtcagtggcccaatcagaggcatctcacatctagcggtcggggaagatctggccaccttgggtgacgagtgggtagtgatggacggcaatacaaattgacttatgaaatgaatacgaagacgacgagtacttacgtagaaggtggtgttgacgccggtggtgtagctggaggggaccttgattggagaagctcccttcttgttcgccttgccgatgccgttgttgggttcgtgggggcaaggaggggccctcgctgctcctcctcaagatgggtgccactctgcactggagctcgacagagcttctccgaagacgggcttcgccgcctccgtggctccgcctgcccctggccttctcctctcgatggcgccttgtatctcatgacaccaatggggctggcgccaagcacacccgtcctctcgcttcaccttgccaccctgagcctcgcctaccatcttgtctgccttgttgacgttgtcgttagggtccgtgggggtagggagggcactcgtcgacggttgtggcccgctcgtccaagtctagtgccccaacaacaagcacgattgcgactgctatgtcacctactgtgacatcactacccaacagagcgccctatttgtgcctggagcctggtacagcttcctcaccgcgccgccagcgctcctcggccacctcattggcaaccactcccggccctctcaggagattacctactgcgccatccactcgctcatcatgtttgcgtcggagccgacgtggcgacacctgttgctggttgtgcgtggggacggcgatggctacgacaagcgccatgtgttcctcctcgccatggcacctaatctcccgcaacatcgactgggccggcgccaaggacacccgttgagtgagggagagagtgaggagaaaaggcaatgattttttgtgagtatgataggtgggtttcacattgactcagccaccacgtcacctaaaatcgggaacagtactaatttaggacccaaagtgatccggttttataagataagggatatgttatagagtattttttgggttcaaggatgattttgtagctcgtccacagaatgaggggccttaagtgcaccttttccaagggaaaaccccttccagcgcgaagaaaccaaccaattcaatccaggcccatcaaagcccaaatccatcaaccctaactccttcaagcacaacctccaccgtcacagaccgccggcgccgttcgactcttcgacctccacgccgacgtcgcgctgcgcctgccacctttatcttgaaccgcgacgtcgttgtccgcccctcccgcgccggcgaggcgaccgagccccctcccctccttccctgcctcgtgccactagcgccgcccttcgccgccgccgccgccgccgcccgcgagggagacgcgagaaggatgagggtgaagaggcggtccaagaaccgcaaggtggtcaggttctacgccacctgcttcggcttccgcgagccctacagggtgctcgtcgacggcaccttcgtccaccacctcctcagtcacagcctcctccccgccgacgacgccctccagtccctcctctccgcctccaggccccctcccctcttcacctccaagtgcgtcctcgccgagctcaggcgcctcggcaagtcccacgccgacgccttcgacgccgccgccctgctcgccacggccaagtaagtagtagcacacttctacttctaacgatggtttttttttttctcttatgaggcaatgagggttttgttccattggaaatttttgtttgtgggttcaggtgtgagcatgacaaagtagtcagtgcagtggattgtgttctgtcactgataggtgaaaagaatcccgaacacttctttgttgccacccaggattctgatctccgtgcaaagctacgggaggtatggaaattcactaccctttcgtgctcgtgccaacacgctgtttcagagtaatttaagaattatcaccttaattatgttatgcaaaagcatctggacagggagtcagtggcgggcccaggatttagaacttgtgtattcgaaataggagtagggtaaaaaaatttcctacacccaagagcctaataaatgatgtatataatataacacaccagtaattatataatatatagcatatataacacaaaatacacataagttcgtatattgatataattttataatatatagcacatatgtaagtactaattggatgaagtacacacaaaagaatagaaaatggtaaaatgataagaaatctttcaatttagagatgaacttttcaattcttgatattttgaaaatggtaaaatgatatgtaatcttacaaatcctacttactattcccctacatgcgcctaactagttacttaaatcaagtctgcaagttagcaattatgatgaatcaacttccaagtactcagtgaacaattagtagaatactagaaaagtagaagtgcagaacaaaaaatgaaatcagtgaagtactaacatcccaggctcccaaatcccagcgtccctgcctcttggtccatgcgagctgcgatgctgcctgcctggtgcctacgtcgtcagctcgccaatgcggcaccgacaccacgagcctgttcggttgccccgcgctgccgtcgccgtcttgccgccacgccatgcctacgcttgcgcccgagcatcgccgctgcgtgtttggccacttgcgcgcccgcgccaccgccgtccagccaccggccacccaacgtccgcgaggctgtgcgcctgcgccgaccgcccgtcggctagggttaggggagactgagggaatgggatgtgtgagattgatgggtgaggctggaagtgggtaggggagaggagagctggagagagggagggaagtggggaatttgggcccaatacatttgggctaatgggtgaatgaggagggaggatgaagcaagcccaagaaaactagtttgcttgcttattgggtatttgaggctcttttttatttgtttgaattcatatacgaaatatatagtatatatacctattttttgtgtaaaattcttgggcatacatctgaatacccttgaatcatagctgcgcccgcccctgacagggacagtcagtggcccggtttagttggcaaaaatttttgttttggggtgtcacatcggatatacggacacacatttgaagtattaaacattgtctaatgacaaaacaaattacagattctgccaggaaactgcgagacgaatttattaagcctaattaatctgtcattagcaaatgtttactgtagcaccacattgtcaaatcatggcgcaattaggcttaaaagattcgtctcgcaatttacacgcaaactgtgtaattggttttttttcccacatttaatactccatgcatgtgtccaaacattcgatgtgataggtgaaaattttttgttttgggaactaaacagggccaaacttcatcacgtttgaccaagtttttaaaaaatacatagcaatgtcttcaataccaaattagtttcattaaatccacatttgaatatatattttttgtagtatatctgttttatgttggaagtactgcaacttttttctataaagttgatcaaacataaagaagtttgacttaggacaaacccaaaacgccttacactatggaacggagggtgcacaataatgtacatgttgccattacatattctcttgaatcagtttatgtgttcatgtgtgttttgactggatgcaggttcctggtgttcctgtgatatatggtctgaagagctccttgttcattgaacaaccctctgtgcagcaacgtaaatttgctcagttggacgaggagaagcgtctgcatatgggtaaatcagaatatcagaagctactgaaggttccatcggatggaaaggcggctgccagtgaaaacgcaagtgatgatgaaaagaacagaaggcctatcagttctcttgtagaaaatgcacttggggtggccgacaaaagcaaatttaagaagaaaagaccaaaggttaatattttctgttattttcttctggcttctgatgtattagatgtatacgcaagcgcaacaatacgtatgatctagttggcatcatcagccttactccatagtcaatcctattttcgataggaccgcttgacaattgaatccaatttttcccattatttaactatccataatagtgtggaaagaaagtttgctacaacagttccgcttccgtaagtaatttttattgcttgtcatttctgcagggaccaaacccactctcctgtaagaaaaagaaaccaaagccccaattgtcagctgctcaaaatcaggtaattttcattttatatcactgttgtttttctctcagtagttgtacgtaataatacctaaaactgttactttcagattaacatgcccattattagtatctattatgttgttggaaaagcatgtctagaagagctgtttgctgtcgatgcaacacgaggactgatgagaacatgtgtcctacaggggcccaaagctgatggggaggcaaagcgaaagagagttaggaagcggaagagaagccacaaagatagcaagcaaacggaaacaatgagctaagaaagatgagctgcaaagttaagaaactctcgctgcatatccagaggcagagctaggtggcacaatgttttgaagatagaaatcatactgatctcatggtgtgccactcattgagtcggctgcgttctttgaattgtaatgcttgattgttcacagatatttatgatagatccgtataggatgtatctggatgtcttcttgtagcagttgatgcaacactgtctatcaaatggaattcatggtgctactgctaatctgatagaatttcctattgggttcaaatcctgtgaacttcctccatttttcctttaaaaaattttccaaatgttttcccctgtcacaattctcggctatgcatattacaggccacaggatgagctggcgggctgctctgctcccaggaatagtctaccaaggatgctgctccagcgagtgccatcagttcatcaactcgtcaaattgatgctgatgtctgaacagttgcgaactcctcaagatctgattcgtcagagcgcccttgtccatcggccatcgctcacttcattaagttaattgtcctttctgtggtacagttttgcttgtgaatcgtttaccttgattctttcctctcattttctgtaccgcttgaagagttctttgagctagtagaaaagttgctttggtttgacatccgataatctagatgttccaaaagattagatttctgaatctgatggatgttttgctttcttttctttttttacatctccactgctattttatcaccagaagtcaatctgactctgctgcatcctagccacttcatggaagaactacccacggtccacaagctcaagattcatccaatccaaatgtacatttgagcatagagctgggaagaaaaggtcgtactccctccgtcctaaatataaggaattttgggtggatatgacacatcgaaaatcccttgtattttaggacggagggagtatagcataagctcattagaacgtcttgccagcgatgtattaaccatatcatgatatgaacattggaaaaaaaaaatctttctgtttcaagtcttttctccgcctctgcaatacagttggatggaacttgtttgatcctcaagaagttgaggccaacacaggattcgttgaacttcaaaatgatggcatgtcacatgtgtacttcacctcacattcgtctctgttaaggttaacattgaactccaaacatctgtcttgtgtgatcttggatctataatgcagacattcttctacagaagttaacaactcctcttcgagctatctttttattattatggaattattataccagtagattgggtagaacattagcggtaaattttactccctccgtcccctaatataagggattttgacattctgtttgcactatttaactactcgtcttattttaaaaaattgtgtaaatataaaaaaagaaaagttgtgctgaaagtactttgaataataaagtaagtcacaattaaaataaataataattctaaatttttttaataagacgaatggttaaacaatgcaaaataaaatatcaaaatcctttatattaggggacggagggagtatctttagttagttgccctctaaaattctatggacttctcattggtatgtgttgcttgaaactctattctaaaatataacaacttctgactaatttattcagatagatagctagaaattactatattttgaaaccgatgtatatactactaatgcatacttgcatatagtatccgcgtcccattttacaattagttgcattgaatttgaagaaaaaaatgtacacgatgggacatattagaattagttttcccctgtccagcttccgccaaggccgaggccttttgcaaaccctgcaatctccgcgaggtacaggtcgtccatcccgccgccgtagatcgccgggaagaacagccagaacgccgtgccggcgacgaaacccagtacgagcggcgcggccaccgcgcgaggcagctgcggcctcgcctcgcgcttgtgctggcgcgcgcaccaccaccgctcggcgcagacgcacacgccgtggagcgcgaagaacgccgtgacgcgccccgtgggagcccgggaggtcaggtagagtatcaccacctcgtgcatcagccccgacacgaggaacgcggcgagcacgccggccgccgggtcgccggagcgcgccctgacggggtcgtagacggcggcgcggagcaccgccgacgccacgaggttccaccgccggccccagaagtcccgcagcgaggccgacaggtacggccggtcgaactgcggctccatctccatgcccagcgccacgcccgccgcgccgagggccggcaggacgacgtcgaggaagcagtacatgaagacggcgttgagggagaacgccgcgtagcggtgcatctcctccttggcgtggaggacgcggacgatggccgccatggcgccgaccttgatggcggacgagacgacgaacttgaacgtagctgcaggtgcagctggcggtggcctcgacgccgacgcgcctgctgctgccgcggcggcgtcgacgagcttgacggggagcgcggcagtgaagacgaacgggagagggcggagcgccgggtggagcgggccgtggccgaaggcgaggaggaggagcttgaactcgccgagccagacgaagacgaaggcggagaagccgcggtagctgtagtacgggagggcgagagggaggacggggaggagtgccatcgccgggaggagcgcggcgaggcggcgggggccagggccggtcagggaggcggcgaggcgggcgtacagcatggcgacggtggtcgccagcggcacggcggcggcggcggcgtggcgcatgacggcgtgtcgtgtactcgtgtcgggggcctctgtgcttggatagtcgggtgcgaggttttctgcaggacaaactcgaaataagaacagagcatgcacgcacatgtgtactgttcctagtgcactggagtagtgccattaatttgtcagtacgagggtagagttttcacaattgaagtcttctccaaaatactccatccgcaccgataatacttgtcgttttaaacaaggtgagatcaaactttagaatttttattataaatcatttttaaaatatttatctttcaaatatgataactacatgtatagattagtcttaaaaaatattttaataaaattatatagctgttaacacttttatatatattataataaaaaataatggtcaatgttagttttcaagaccgtctctagtccaaaacgataagtattatcaacccggaagaagtagttttgaagaaattactggcactaattcttccgaacagtgctagtgctacaacatctgtcgttatgtgcatattcattagttcgatccatgccattgcaaatgtggttattaaaaaaaaagtcattacaattcttcaatttctaagcgtgcaacttaaattttacgaaattggaaccatgccatcaccgtcatattttctatcttcttcccgtttacatgtggggtgctgatatttcttaacgacattactataaatatgaatttccagcaatagcgctagaaatggtcctgctatatatacagttacagaaggaatccgcaagcgcacagatatatcattgtagtattttatccgggagtattccaaggtatcgtatttattaggcaaaatttgctacgtgatatccaaattttgtataattggctgagggacaccgtaagatcgtgccattgccaaaagacaccataaaaatgatgtaattgtctgtagaacactagatacattattttataatttttaagaaaaagcggagagagaaatttaaaaaagacaagtttgctcctggcttggcctgagcttaagttgggactttctgcttctgctcaaagaaacaaagctttggtttagtgactcgcatgtattcgatcaacaaaagatgaacaaatacaaatcaatagagtctaacaagaacgtgtcgacatatgtgatgtaccaggaagaccgtgctttgcggatgaacaaatacaaatcaataccggagcttcttgcggatgttgccctacgtagttgttgttgtcttgctcgtccgaccacccgccgacgacaacaactccagcaacatccgctcaccgtagatctcctccacacactccctctttagcaccacgcccacggacaacaatgtgtacacgctatgcgtagggccacggtcgccgtcgcagctgcgtccctcgttttgtcgagcgtgcaacgatggctgcagcgacagcaatacggccaccggtagccaccatggtgtgccgtcgcgttggtcgttcctcctccttggccgctgccaagggacaggcccagcgccaggctagcattgctcaggtggccgacgtccccaaagcgggccgcccatagcagcgggccgctgcctgcttgcacagctactcgccgccgccacctcctcttagctaggggagaaagagcttgtcattttaaaattctctctccactttgtcatggaaattattaaataatgtgtttggtgtcctacagacaattacactattttttatgtcctttagcagtgacacaattttgtggtgtcccacagccaattacacaaattttcaatgtcctgaaacaatttagccttatttatttaatcccaagggaagattgtaaaaaagaactatgctaataatgtatatatgccacttgtatgatcagagtctaaacaggggttaatataatcataagggtagagtggcacaaagcaaagaactcatatctctcattaatcaatcctacgctatgtggaagaagaaataaaaaagcaattaattcctatgcttctagtatacgttccatcaattagtttatatccgctagtatacagttgtatggccaataccctctaacaatgccctcctggtgttttgagagaccatcctgggttgccgagttccttacgacaacttatcatggctgtccaaccgggactaaatacggaggagtaccctccccaggaatttatcttaggaatatatactaacatggaggaatacccgtactaaactttcaccatcagcggcccacctctactgtcccgcagcatatatgcctagataatgatacttaataatctaaacaccacgtctacattattaaatactactctatatcccctaggatgacatagagcaaccgaataatggaacattaaacccacaccattgcacctctctggtaggctagctacacaactataccgatacagatataaagtaaagtcgatacttacataaactaaagcaccaagaatatataaatatatatagaataatattccattaattccaaaagtcttacaaaagaataaagaaaagctactaccgccatactcgaattcccccctaaagactccgaggacttcaagagctattccactctactccacttagcactagaatactaaactaaagtatagatagaaatgttgagctttcttaagtgtgttttgaagtgtgaatgagctcctccttaaataggcaggtatgatggttgtagcctatgcgaaatgtccaatatgccctgaaaccgtcaatccgtcattggggagcgatcaggagcgtccatgtgtaaggccagtcgaagctagcgtcaccagggttcggccatacttgggccggcccaacaggcctccaaactactctagggcactgacaagtgggtccctatgatggttgtggcagttatgacggtttcgaggacagttacacctgacatgtggccccatcttatccttaagcttgcttaaggatgagttctcctccattttatttgcttaatcactgcaaacaaataattattctaaaataaatatgcattgcaagtatagctagctcccctttattttagttatattgatggtcaaaatttatctataacgaccatcaacatgaggcccaccagtcatattcatcttcttcctccattcttccctcctcttttttcccatctctctccagtacttcttcacctcctccccaccaatccatcctctccccgccaccaccggtgccggcaccgcgccagagcgcgcggcccacgttggccgcgcagctgctgcagcagcacagcagtgcagtagcggcagtagcaactacagcagcatagaggagtagcggcagcggagcagcagtgccagcaacagcggagtagcagcagcagccgcgcgcgcggagcgggagcggcgacagcagcggaaccctgcggcagcatccgacgggggcgacggcacgagaacacatttggccaccgacctcgccacctcctagccaccggagcactggcgccccgctcctctcttccctctgctctacctagcaagaaagaaggaaaaaagagaataggggaggatggaggaaaatgaatctgaccggtgggcccacgtatagatggggaggaagatgaaaaatgtgacggcgatggtatggttctaattttgtaaaatttaagtgacacgtttacgaatagacgaattataatggcttttttttaatagccacatttacaatggtatgaatcgaattaactctagatttaaatgggatgtttcacggtgttgctagtccgtacggagtattgtttctcttaaaggatggggatgtttcacggtgttgctagtctgtacggagtattgtttctcttaaaggatgaatggataaatgtttacgttattttatatttctactattataaaaattaaagatttttttgccggtatttcggtacatcatccgtgttttagtcagtttttaagttcgttcgcttttgaaaatgcatatccatgtttgagttggatttaaaactcgtttgcctttgaaaatacaaaagaagtcgtataagaaatctctttaaaaaaatcattctagcttgagatgaaatacggactcctaattgcagtttatgattttctaaaagaaatattcaagcacagtgaattttaccctagctaaaccgtataaaaataataaaattaaaataacatttatcgttgcaacgcacgggcattttcttatatataaatttaatagactattcttttattttttttgaactttataataattaattaattcatttatacccttgattacttgtatcacctcattcaattaaatatttagtcattcagaaaaaaaacacatgcactgggcgaggtagaaagaaatagagggtgccacttacttaatttattctacactttagatcaagtttaaactatgcgggtatctaagtttgtattagagagtgcacacatggtgaaaatgtatgagatatagctcaattttattttgatcgggttcctgggcactcccctcccatactctacctccgctagtgcatatgaatgcattaaaaccaccctggagttgccgcgctgaaagtgttttggaccgacgtgttcgcacgcggtgctatccacgtcactccagcgcgctgggaggcgggcggatttcgcgtccgcacgcgccgtccgattagcttgagtggacgggcaggatgatgagggtggaagttttgcaaaaaaaaaaaaaaaaaaaacccttcacttctttgtaacttttgttaggttaaatacatacggtcttacgttttaatttttaacgtttagaccctctataaccaggaaaactttatgcaaagaaaagaaaaacatgaaaataggtccgcactctgaaaaacaaaaggaggctcttttgaaaaatataacatccccgatcggccaatcccctccccaccgaaaccctagccagccactgctcccaccaggggcggattcaccattggggcttgttggggcgcaagcccgagcttcagcttccagcctcaagtgttctcccaacaagctcaaagctagtataaatcactgggacagtcagagtatatatattggagcctgcagcgactagagaagaagaaaactcgcctgtagctatgtggtgtgattagtgctttgtctgtcatctagtgtttaataattgctaaatgctataccaagcccaatacaattaccgaaccggtgaggaaaagacaagacagatattaccatctaccaggagctcttggtttgcattgttcagggcacatggatggtctaattcaactgggcatacatgttttttccaaattaatgaaacatggatttctaagttcataattttgaaatatgatttccattactgagctatatatttttagccctatgcattagcaccatcttctatttcaatcttggggcactgctcccacgctgtccccccctctccctgccgccacctcctccacctccttcccccgctgtgatggctcgcggctcgcgcctcgccccgccgcaactccccgccaagcgacgcctctcactgatccgtcccctgccaccttcctcctcgatcccctccctaccacatgcttggtagcttcctcatcagccgccgccatccatctgttgccgctggtggactggcgctcaattcggcgggatttggtggtggctgcctgcattgagtggatttggggaacgacggctcctgtggcggcataagcggcggaaagcaggtgcggtggcatgagctagggctggagtcgatgggccactaatctggtggcagcttaacaccaccccattcacgagatcaaagcggtggttggtctgagggaaatgggcggtccgggcagatgtgcagacatgctctgtgtcgaaacatgaattcggcaataataaaagggggtagcgcacgagacctaaaagtggatggatgtagagacaaggatttagacaggttcaggccctctcaatgagaggtaataccctactcctgtttggggatttgaatccgccgggtgtagtatagatctgacgatctagttgtgtctcatgcccctagagggcctcctgcccaccttatatagggtggggggcaggattacaagatagaaaccttaaccaatacggtatcggtttcctaaatctactttacaatattatcaaaccaggactttaggccgttccataatatacaaggaaacgtaatacctaagtcatgattcgttacatattccatagatataaattatcccttataacccgtcggacaaccatgccgtgtgggtatggggtacccataatctccacagtagcccctgagaccttcacagtcgaaaagataatcttctctcgaaccagattactccaaagccaagtgcttcaatcatctttgccatggtcacccgagtactttaacaaatatgaagactgtggagggctgaaaaataaagtcagatgcattgactagatgcacctaatagatgtagcccccgactacgtggttagctgaacaaactaagcatatagtcaaggaataaataatccaaccaaccgagtggttttgataattgtaatcaaccaagtgacttgatatcaatatatagcatatgcggtgtgaatcccccaaataacatgatccaagtgatataccgactgctttgtaaaaattgatgcgagcaacctaaagttgactacatcattgaaaattcacatagcaaaacagctataaacaagcttgaatgatgtgaataaagaaattttcaaagtattaggcatacgccatgcacacactgctttaataaatgtgcttaagtccctaaaagacacatggtttcaccacacccggaaatatacggcatatgtggtgtaaaatccgagtaaataaactcataaaggatttaccaaccgcctgaaaaatgactaagatatataatcagcctaagccataatattggtcaataaaaatgcacacttacgtggcaaaaagcagtggtattgtatccaatcaattgctttataaacccaaatagcacattgactatataaaaaagtcagtaggacagctatgaaaaacttcactgctgggcaccttttaaaatgcattgtaccaactcctaaaaagttgagtaactgcggtataaaaggattttaaggtattgggcacttgatcacacgcactttggcctaagcaaaaaatgcctaagtccttaaaagaacgtgataggctacacctgaaaatatgggctgcagacatattaggcctaggccaaaaaatatgccttcgacaccctttaaaggatgacgcatgtaacatgctcccgagtaataaatcttccgggtgatatagaccaagtgtagctcatacgaatagcttctgatctgagtgattatcccttatgggatactcccaaatagatataataattgaatcccgactggcgcaagtattcggttgataacccttacggggaataataaatagtccagtctttgagcatagaaaatagacccatgatcatgaattcatgttgcatgtattcggaacaagtccaaattgaaggtatgatacttgtgtttgagctagtaagtccctaagcatatagcttgtccttctgtcgtagtcacaattgtccattgatggtagctgacgtagtgggcatagagacaagatgaccaatatagagataatattgcccaccagaggtggcaaaaatattggtagtagtgaagatagtgataccaatcaaaagtgatgaagttgcacagccgtagaggcgaagaaaccagtcggcagcagtcaggtcagccagcattgaagatgaaagcgcccaacgacagagttgtgcagccatggcagtgaaataatcagtcgataacaaacgaggtgcccggtgaagaagacaaagacgcccattagtagaggcataataagccatccgtgaaagcgaagacatcatgggcggaggcaagccggtggtgaagacgtagacgctcatcaatggcaatggcgaaatccatcaatcatgaagatgaagaaaatagtcagcgacagaaaacgcaaccgatgataatgatgattagcagcaacagagatgatcgaatatgatgacgaagttgcccatcaatagcagtagaataagctatgttgaagaggcttgacatgatgttgatgaagatgacgatgtcggtgatccagtcaatagctgtgtagcagccgatgataatgacgaaagacactcatcaacgtttacgtagtaggtcagccgtgaaggtgaaataataagtcggcaaagacataatcatccattagcaacaatggagatgacagagccgatgaagcagaggtgctggtgatgatgtcagtgacaataatccatcaaactgttgagaagatatcaaaactcgagtagtttccttgatgcgagcgtgtgcataacaaagatgatgcaatgccccttgatttacgaagatgactacagaacttagtgttatatctgttgcagatgcttcacttggaagagagtagatgttgttgtccaacttgttgaatatgagttaattggttgataactccaacctcccgaatatgtagattaaatctcaaacttgatacttgagaaatttgaagtagattgtggcagtatggagcatccaaaattgtcagtgaaataattgaagtagaacgtctgctccgaagcaaaaacgaagataatgactcctggagttgtaaatcctttatgagtttatttactcggattttacaccacatatgccatataatgacccggcaattttgagagtcttgtgtagcccccaactctttgattagttgggaaacaactgaacatagagtcgagaactatagcttcttgtcatcgagtagtcattgcttgagtgaagatatgtgttgaggatgtccgagtagaaatcttgaatattgaaacaccagttgttgtagtaaaataacacggcatcaaatctagtggtgcatgccgagatgtcgaggctcttgtagtcgtcgtggtttgtgaagtagcaaagcttgcgaagtagaggcaatagagtttgctggtgccgaagataataaaaatgaagtcgctccaccatgacgacaaagttgcatagccgtgatgaagtgaacacgagtcggcggcaacagaagcaaaccggtagcgaagatgcgtaattgtgaagataaaaacattagtcggcggcggcataaccagtcggcgatggaagaagtagaatgatgacgaaaacgaagacgtccttgaatggcagcaaaataggccaaccatgaaagtgaagacaccatgggcggtggcaaaggcaaaccggcgatgacgatgacaccagtcaatgttgatgaagacacgcagccgtggaggcgaacaagccagtcagcgtcagacaaggtggccagcaatgaagacgatgacgtccatcagtagtggtagcagcataaaccagtcgtagaggcgaggacaccagtcaacagcagacgacatgaccggcggtgaagatgataaggccaatcaacagtatcagaatcatgcagccatggaagtgaagaatccagtcggtagcagatgtagacagcttgtgttgaagatgatgacgcctattagcggtggcggcgacgcggccagccgtgaaggcgatagcaccagttggcgtcatacaaggcggccggtcagtgatgatgtggacgtccaacaacggcggcataatagaccagccttgcaggcggagacaccagtcggcggcggtgaaggcgagccggtcagtgaagacgtagacgcccaacaacggtggcataataggccagccgtgcaggcgaagacagcagtcggcagcggtaaaggcaagccggtcggtgaaggcatagatgcccaacaacggcggcataataggccagccgtgcaggcggtgacaccagtcggcggcggcgaagacaagccggtcggtgaagacgtagatgcccaacaacggcggcataataggccaaccgtgcaggcgaagacaccagtcggcggcggtgaaggcaagccggtcggtgaagacgtagatgcccaataacggcggcataataggctagtcgtgtaggcgaagacactagtcggtggcggcgaaggcaagccggcggtgaagatgtaatgcccaacaacggcggcataataggccagccgtgtaggcggtgacaacagtcgacggcggtgaagacaagccggcggtgaagatgtagacgcctaacaacggtggtgtgaccaaccaaccatataggcgaagacaccagtcggcggcgacgacggcaagccggtggtgatgttctgactgatccattcctagagcgtaagagataagcttaaagccatgaatcccttttatgcatatttggatctggatcctgcagaacaaacatataggatgagtagtatctgatataaatataatactcgaggaaaattcaatattttaaaatgtttataaatatgtatttctcctcttgttaattttgatttccccgagcgaatgactccttacgtttaaacactctgcccgactagtcatagcccccaagcaccgggagtcggcctaagcacttccaaaacatgcatatgagtgacatgagttcgtcattaatggaacaaagtttcacgaatcagaatttactactcgggtacttttgcaattgttaagagcagaaaataaatttatcttatctctatgcttttgatttattccgaataatacttagcaccttgcgttactcggtccatccaacgagcccccgggtgataggaatcggcccaaaggcaactatccatcggcaaaccaaatggaaagcataggaagatagaactccataactcgataggcacttttgtactcagattatattgcaagcaatcaagataaatattataaaaattgtttaaaaaatatggtataacatatgtagccccgactcactagtcaacggcgaaccagttgacatagtgaggcagaggaaaaggaaaatatcatgtaaagaatgaaataaatgatgacttatctttgtaatattcccgttggtgatggcagaggtgaccaatgtgggaacaaagtcgtccatcaataacaatgaagacaccagtcggcggcgacgaaggcaagccggtgtagatgacgaggcccatcaacggcggcggagtccaccaaccgtataggcgaaaacactagtcagcgacggaagcaagccggcggtgaagacatagacgcccatcaatagcggcataacaggccaactatgaaggcgaaagcaccagttagcggcagacgtggcggtcgatcggtgaagatgacgatgacgcccatcaacggaggcggagtccaccatccgtatacgtgagaacaccagtcggtggtggcgaaagtgggccaatggtgaagttgtagacgcccaacgacggtggtgtgaccaaccaaccgtgtaggcgagaacaccagtcggcggcgaacgaggcggccggtcggtgaagacatagacgccaatcaacggcggcataataggccagccttgcaggcggaaacaccagtcggtggcggcgaaggcagccgcggccatcggtgaagactgatcccggcgaggtgccctagctgacagccaacatgaataggcagccatgccgaatatatagatgaacatactgtacatggcttgatgtattgcattgttcctaaaaaaattgcatggcatcgggtttggcccaattgatctgaacaaagatgaaaccaccaaagagagcaaaaactccgcctgtgtgtgcgcgtcgtcgaggccatggtaggtgcagatcattatggcaaacaaaaacggcaaaagtccggcggccgtgaccgacgctcggagagttatgcatgtgtgattgttgatgcatgcacgtgagatggaggcgactggcggcgatctgatgcggtggaggtcccctggtcgactcaatgcatgtatgcatcttagatagataaatcatttgactaatcaaattcctttcctggttgctgatgacgtggcagctcctgattgattgaccaaattgccatgcacgtttgcttgcacatgtatcagatggaaacatacacttgcatgattaatgtcttcgagtattgctgatcaaggaaataactcggcgacgaccgctctgatcgattggctccaagttcaggctgactccgatttggattagtaattgagtatcgctaggaaatttcacatcttcttaaaaaaaagctggcggatgagaattgatctgttgcattgatatcgccgaacagattgaaccagatgatgaacacaacatgccaactttcttcaataaaaccggtaaacatggcggcgatccaacgagatgaaagaagtcttaagccttcccgactgattttgcatctgaattacagaagcataaaattccaaactcgtggacgaggaaattgaaactcccgaagtgagaggcttggggtgaataccagggggtcaatctgtaattgaaagttaatctaacaataacattggttagattgaaacggcaaacccgatatcgatttgatcagaagattgcatcaatgacggcataatccatgaaactcgagggaggatgatgccagcgactcaggttgattccatcacacttcttgacagataactcggcgtagccctacctggcgcgccaactgtcgaaacatgaattcggcaataataaaagggggtagcgcacgagacctaaaagtggatggatgcagagacaaggatttagacaggttcaggccctctcaatgagaggtaataacctactcctgtttagggatttgaatccgccgggtgtagtatagatctgacgatctagttgtgtctcatgccccctagagggcctcctgcccaccttatatatggtggggggcaggattacaagatagaaaccttaaccaatacggtatcggtttcctaatctactttacaatattatcaaaccaggactttaggccgttccataatatacaaggaaacgtaatacccaagtcatgattcgttacatattccatagatataagttatcccctataacctgtcggataaccatgccgtgtgggtatggggtacccataatctccacactctgcaatgcttcacccgtgttctagctgttgctgttgcttttcatgttgacatcgttcttgccatcgaagacaacggatctggccaccggttgctgtcccggggagcttgtaatggaattaatgtcaatcagggcaatctaccgttctggcttggccttgtgctgctgtagaagacatggccatatgactggagcaactagagattggctgcctaccactgctgtgctgtttgctgtaacatttaaacaccaaacaagtaataatctactgattttgatttatctctgcatacgatattatttagtagttattgtttcttggatatcaaataggtacattattagcagcgaatagattgttgtgaggtcaaacatattagcaggtgcttggcttactatgcagtgtggcagggggtaatattgcagaggtaatgcacagaagagtaaacaatgatttctatttcttttcatgaaagccacctttggatgagcatagtatagagtatagttgtgtgttggttaccttgcctttaaggtgtttgttattcttcctatgagcacagagtatgaaactatcttgaagttatcaactagatatgcatggcctactgatatgcattggttgggtatgagatatgtggtccctggctttgaactattttactttaataattgtgttctttggctccccatcctgatctattttgctctatgcttctgttgtgcaatgtagctaaaaaaacatccagagaagagctttgcttaagagattctagatttagatactttagttatttaagatgtaagagttacttttattgtgttcttggctcaatgtgcagctatccagctgatcaatttattgtgatttcaagttatatgcaaaaaaaaaaaagaggagacatctgctttacagattctattgtagaaggcacatatatctgtatgggtatttggtgttaaattttattgtagggtactccctccgtttcacaatgtaagactttctagcattgctcacatacatataaatgttaatgaatctaaacacatacatttgtctagattcattaacatcttaatgaatgtggacaatgctagaaagtcttacattgtgaaacggaggaaatagttctcacatagatctgccattgtagtggtattggtccgaccgcaagaaaacaaaactacagatgtgtcgtgtatatgtttgattaatcatccatattctgactaaatttgaatgtagttcagttcttggcaattttcatgattaaagtattaaactggctataaattgcatttctgtgcaaagcatcagctgagtaggctataagaatgctaaggtatgcccatagttgagatattaattaagtcccccccccccccgccttttcatatgtactaacttcccagtttatttcatgtttgtgtatctgatatgatctgtgccataaaaaaaatgtgcattacaatgtccttattcacaatgtatgaaaatacttaccaaatctttgtgtatttattgctgaagtggttttagcacaaaatgtccttattcatacaatgtgttaaagatgcttcattatctaacaaatgcttctttttttcagataatttggtggttaaaacttttggtggaaataggttattaagggcttgtttggtttgataccaacttattgccttaccaaattcttggtaacttgaatagtagcat

SEQ ID NO: 46103 - DNA, 4266 bp, Oryza sativa
aaataacgtatataccctattcaatggagtgatgttcggtgacgtgaatcgatgaattatgatgcatttctgatatgtatttagctccatgataccttcttaggtttcgctcagtaatgttagaccaatcttaagactcatcactgtttttttgagtccatctcctcatttcttatcatgtcagatgcacggcattggcattttaatttgttgcaataattaggttgtagcccgtgcgtttactgtcatcatgacttcttttttttgcccgtgcgtttactgtcatcatgacttttttttttctttttgttgtttgcctgatggtagggcgcgcgaagcacgccttattatctactcccccgttccaaaataagtgtagttttgtactattcatcttcaacgttcgaccgttcgtccatctcaaaataattactatttttattactattagatgataaaacatgaattatactttatgtatgactaatttttaaaaatattttataaattttttaaataaaacgaacggtcaaacgttggacacggattttcacggctgcacttattttgggacggaggtagtagtatgaatgcattcagacccaaaacacacacacacacgtatgaatagctttgtatcgtgcaaaatttcacatctccctgctttcggtctatttttcatataagcacagctagtgtgagtatttgataggttagattgcaaaagttcgtgctgtggtgcatccctagcagaatcaaggccttcctcaatgggtaacttcgactctatatggcatacctttgtacccttggcaaacacacccatcacaactcttcgaaaaaaatggtaattccaaaactttccactctcaaaactcaacaaaagctataaaggtcttaaaccgaacactacccaaacatcttctacggaaccaaagtttgctaagttttctctttttttaaaaaaaaaaccaaacaaacccataattcaaagcgattttgaatttttaaagtttgatttttaagaataatattagctagtctttgaattgttctcctagtgatcatgaaaaagagccagacaccaagacaaaaggagaaagacaatggaactaattctaaaacaaaagcttaaaaagaaaatcaaaactacctctaggagagtccctgttggcatcatactaaaatcaaagcctaaaataaaataaaaaatacctgaagattttagcctttcgatacagcttccatgtgtcaccagccgtctgattctaattgcttctaaactataccataaaggagaaagcaaaagagattgtcccggaataaacatcatactacttagtttcaaataaaaaaaaatcatactacttcgcacccaatggcttaacaatggagtttaagatgcatttcctccgttttcaaacaattcaaagagttctctcggattacacttggtgagttggaatcataccaaaatggttgggtataggcttgcatgtgacatgccactatgaaacttcacttttgtcagctacctcttccatatgtgacttcattttcttacaacagaaaaggcgggaataagaaaaaaaaaatcagtcatctgggaagccaaaaaacttgttaatcagcgatacaactggtttggcatcccctggcacataagggttgagagtctctatgtccatttcctggatcgtctctcctagtgtttgtgggcttgcacagaagaggtgtttccttgtagccagttcctctgctaactcactctgatgattgtccatcaaatcctcatttacaacaacaattagaggtttgccatgtcgcaacgtctcgaatatgcttcctgaacctgctagagctcaatctggttaattgcaatcagcattgacaactactccctcagtttcataatgtaagactttctagcattgcccacatttttatggatgttaatgaatctagaaacatatgaatgtgggcaatgctagaaagtcttacattatgaaatggaggaagtaacaaagatgcaaaattgatgatatacttgctaaaattcacagtatttatccagagcacatatcaaggcagcacagaatttatgtaacatttaatgaaatttgaccataacggcaggtagaaatattacaactctacctaacaatagcaagtatggtcagcttacttaaatattatgcttctttgtacgcgtcagataaatattgtgaagcgaagtaaaaatggcatgtttattagttcaaatgaactcaaatagcagtatgatctagaggtgaaaaaacataaattggttaacaaaaaagtgcttataatatcagaagatgttttgtaaataaaaatcgagcagccaatatggcgttaaaacagtacaagtgtagctattctcttcaggcgtcagccatttaaagacaccaattatgctcaatttgttggcacaaactaccaagtttagaaaggatttcatgtaatgcaccaaagcgttccacacgatataatactccactgcagcacttaagaaaaaaatgagatagcatatgccttaatcaagttcaaactattggcatgaagatctttaaacccagttttgtatataagcttatacggtaagggtgtacactcctcatgtccaacagaatagaattggccatgaagacagactttacacaaggtatgacctataaacaatgagagcatattcatggtgcagtggagtaatccttcaattgagaaaaccattatattgggtaaaaatgttatttgaatgaaatacatttcacctggtatgtcctataaacatgtacaattacctgcatgactgatgaccagggaagcatcccttatataatcagcaatgcttggcgaaaaagtgaaataatcaacttgaagagttccatctcctgagacctgtattcaaatatatcaaagtttctggctggtttcacttcactttcacaaccatcaacatggtgcttacaaatgtttcaggtagaacagaggaatcactagcagagtaaagcaattattatctgctaatataacataaattcatgccacatgttaggaacatcccctaatcattcaatgattggatatagtccctacccattcaacttagaaacattcactcgaaactggttatataaaactgaaaataagaaatgtgcaatccaaacagaactcttcacaagaaatcaaaccgcgcaacttctgttcatctgacaactcatcaagaattaaccccaagaacagaacacgcacacagacaaaaaaaaagcaccaaaagaagaattaacatgcagaacaagctggaattccgtgctggtaaagtggcaatttaaaaggaatgaaagagaaattcattgaccttagatggaacatatgtacctcggcccatttgaattattagatcagtataacctttttccagtagagcttctttgacttgcggggaatctactgccttgacaagagcatcaaaacacgtggtccctactgtgacaaacacagttcgtctttccctatctcccatttattctgaaacgagcactgtctgtacaataatgttttccttaatccgtaaagagaaaacagtattcaagagaaaggtgaaaaaatgcattatgctggcatgctgctatgccaggtgaaatttagagagagacagagagagagtaaatggtgtgccagaaataattaatcccattattccacagatactattatccttgatagttaggggcatctattaaaacaacaatagagagtttgacaaacgaaagggtttctgttccgatgcgaaaattagcacaaaaaatggggtaagaactggtaattctgtactaaaaacaagatgaacaattcagacactagcaggagcggatctagcgtgggaccgacaagggggttcaattgaagccccaaactacttgggggaacaaacaaactgttactagttattcagattaaggcaaatttctagaacagaatctatagggttcaacgcaaattcgagaagaagtgcgtgggaagagaccagagagagatgaggaagagggtgcgcgtagggtaacggatggatgctcaccaggatgcgggcggaagcaacaggacgaacgacggcgccagcgccgggcgcccctgctcgctcgcgggatggagatcggcgcaggctgcgcaagggcgagctcacgaggaggagacgacggaagtctatgccgagctgggggggatacatgggccgcacctttt

SEQ ID NO: 46104 - DNA, 3857 bp, Oryza sativa
tacatgggcctcacgaacactttggacacatagcagtcccaaaattggaataagttcactgaaggtcctctagttgtcaccgagtctaaaattcgtctctaaaccacaataccagatataacacgtccctcaactcacaaaaccagtgcaaacaaggtcccaaggaagtttggactatggtttcgactgacatggtgtctacgtggtgttcacatagcgcttaaagtaaaaaaaaaacataaacataggacccacatgtcagtgattgtccagttaaaaataaaaaagatacagtgggacccacgccatcacccctctctttaccctcttctctcccttgcggttcaagcacagcgccatttgctgaggagcgcagatgggtgggtcccctctcctcttcctaaatctccccgtctcctcctccgcagttgccactacatgaatcctgtcgctggcctaggaaggtgccgtgccgatgatcttgccgcacttcactcacctacctccccacctccccatagaaaactagcagtattcacccagataggcatagcagaatatacatcaaagattatataatataaatgtgtgcagttatatctagaaatttctaatattaaaactataatttttatagaaaaatattacagaagaaatatcaaatgcatgcgaagttgttgtcgctggtttgtatggagcctgacaccacacgaaacattccctaagagcatcaccaatagttctcataaacatatcctaacaattataggatttcagatgaaaatcatgctccaacaatccatctgatcaattgcctaaaatttgaaaatctcatatctgtttttttttggctatccacaagtcgagaacacgcaaccactcccaatcgatggatcgcgtggataggagggggagcgccgatcatgcacgggaaggggggccaatcatatgaagaagagttcgaggtgagctcactttttttttgttttcgggagttagttctgggcaatctgttggaggtatgttttttttaaaaaaaaatcctaaatccatattagagattcctaaaagaaaattttgaattagaatttgtgggaactgtgttggtgatactctaatgggttatctcccacacaacgttttttacgccaacacggttcccgcaaattctcctgaagatgaaaattaagtttttttttacgcaaaacgaggtagtattaacgtatgattgattgagttttaattattacaaacttgaaaaatagattaatatgatattttagagcaactttcatataaaaaatttttgcacgaaacacaccgtttagcagtttgaaaagcgtgccaaaaaatatttatcttcatccaactgttgttggagaaaagaacggaaccttagagcaagtacaataggaggctgtaagccgactaaatactgatgcggaggatagaagagaggagagagaggggagaagcgggctataaacttataaacttacagacggcttggacacaagagccaagaaactctgtaagatagacaagtgagccctgtattaattgtaaaaagctaactattatatgaatggactgagagaaggctaaaaaaaccttacagccaacaagttggttgtattattagccttgctcttaagactctataaccccatgcatttaaggcagcctcaagtaccacccaatacgttgatgagtaaacaatgagaacatataccgaaccagtcttagcagcttagagcaaggtcaatagtatagccaactactggctccaaaacatctatagccaatctaatagctcattcatacaatagttaactataaaaatatactacaccattaatacccggtcccacctctcatacacatataacatcttggagtccgtgttgcaaccagctacaaatttgtagcccgctttcttctctctcttttcttttcttctcgatatatggttatagccggcttatagcctgctattgtacctgctcttatacataagggtgattgatttttttttcctgaaaaaggtttatacataaggtgttatactctatcctatttatcatcacgcgaaaattgaacttagaataagagtgtatacacataaaatagaaaatattaataggaagtaaagttaaccaattagagaaaatctaataaaatttcaaaaaaaaattgtccgtacttttcactattactagtgcctctacagtactttgcttttacatatcaaagaggtgaaggctttatcaacgaaagtttctttcttttctaaacgaatattcatttagaaaaaacagagacaacgaatattcatttagaaaagaaaatcacctcacttttaatttgagcttccattcttaaacctattctcgaaacaaactaatacgcatacctacacgaatgcgcgggttaccttcctatttagaaagaaattaattaaaatctagaaagtaccaaattggatattggtaatatcaatcatttggcttaaaaccaaaaccatcatgcctaccactttaagcaatcaaaatattggtagggcaacaaagaaaaaaaaaacagtcctttcattttcttatgggcatagttacgctgagaatatgaaggggcatatgaaacattgctaccgttggtaatcactgcgacactgcctataaaaaaactcgaaagatcaataggtaatctctaacaaaaactgactcaggaccatcaccgtcagtcatctgtattctccgatcttagagaaaggataataatggaagagagagaggtaaagaaaagcagaaagtattggctctaatacaagagctagtataaatttatggtgagagaaagagaggatgacaaaaataaaactaacattatagccaatcatattatctctaacattgatttatattagtaagtagtgagcttatattataggccgtctcataatgacctttccatcgattggatggccattctggcgcccagtaatccatccaagcctccaaggtcgcaaaaggaatacatgccgaactaatcagcgtcggctgtgccagcgatatgccggtgatgaagattgaagaagatgacctttgctcttcttcgcacgggcatccgcaagaccgcaacacaggaaaatggataatgttctgaacatacagtcagactacaaaggaagagataacagaacagagcagagcagagcacatttctttttacgcaaagcagagcactttctcacactagttggatgacaattccatttcacttttcaaattacactctttaggaaacaaaactgaaaacatgctgtaagctgtcatttataacctattcttctgcaattttataaacaaacaaaaattttaattggatttatcgactgatggcacgaacttgattcaaagggattcgatgagttcaggcagagatggggtggaaggcgacgacggagtgcttggcgatgtggaggctgaactgcccgcctttctcgctcacgtccagcttctccacgcccggcggcggcaccatctcgaagctcctcaccagcttcccgacgatgagcgccaggatgggcagcgccaggatgatccccgggcagctgcggcggcccacgccgaagggcaggaacctgaagtccaccttcccggcgacggtggcgtccacgccgctctccttctccaagaaccgctcaggccggaactcctcggggttctcccacagcgccgggttgttggccagccaccacgcgttcaccaccaccttggatcccttggggatggtgtacccgccgagcttggccttctccaggttcatgtgcggcaccagcaacgggatcggggagtgca

SEQ ID NO: 46105 - DNA, 2257 bp, Oryza sativa
tggttcaaggcgttgcccacctgcagccagttgccgaacaccggcacggccgccggccccggcggcgccttcccgtcaccaccgctcccgcccttcgcgcccaccgcaatgccgacaaacacagccactggcagcagcaaggtgagagcaggatgctgcgcctgcacgaacgacttgacgaacaaatgcaccgccaacgacgccccggtggcgatggccaccctcatcgcggaggccgccatgctgctcgaactagacccgctcactggctgtgcgatacgtccctgtgttgtgttttggtggtttgattttagttggtggaattgcaaagcgagctgtggctgctgggtcgggtgccgttggccgtggcgtgcttatatagcgtcaatggattggttggtgtgggtggcagtagcaagtagtagtgagtcagtacgtgggaaacggctcagcacgaagagatgcggcgaatttcgccggtttcgcgcggaaacccgtgtgccacggaaggaaacagggttggcgggccgcgatccatcggctgctcggcctcggcggaatggaggagagacgtggatgcgccgcgcgctcgtgctctctgttgtgctggctggttggtgggcacggccgcatgggcaaattgacaagtcgtatcgtctcgttgggctagtccgccgctctgacctggtcacgggggcaaagcggtggtggggttggtgtggcgcgataggagcgtctggatggccgatggacggccaggatggaggcttagttccggggttgggtttggtggtggtgggaggccagcgacctgtgtgagcttcggtgttggattacaattccctcacattctcattgtgcgttcaaccgttggttgggtcttttttgttttctgagagagagcgtttgttgggattgttgaccactgtcttggagatgagatactgctttaccacgtgattagttcaaagtcatttgaataacctgacgcataagtacatcattgtaacatttaaattcgaacagtttctgtgaaagggttcctcgcggcgatgtctgtgctacagtgatcaaatgcatacaacggtgtgcgattttactgtagttaatatagtactttacttgatgcaaatggggcactttagattagtcctaatgcactgcatgcctaatcgggcactttggatccatttccaacccaggcggccggctagatttcaaggttcaagctattcctatatacgtacagctataatgtgatttgtacgcttattatacgtagaatgtgtaagcttgacttcttcccctctgaaatgatgttgaaatttgttgatctcaaaacaaactaagtagttttcttttaacatcgttctactaaatcatattattgaaatagcgtaaaaaggcatattcataattccatatttacggtttttaccgtccagcaccgtcgcgaggtaccgcgtggtaccaaggtggtaccaaatcgcagccgttggatgtaaacagatctaacggtcaggaatgcacggtaccgcgcggtaccaaattttcctttgcgcggtaccgcctgaaatcgtagggtggaagggtagcgttgtcttttcacaatatccggatcgatgagtggtgtatcgttgccctaacgaattggtctccatccgcatcgcagagacttgtccgccgctaacccttgtactgcgccgccgcctgctgcactgacctccccgccgtcgtcgcgagccccgcggcttccggctgccgtcgccgcgagccccgtggcttccggctgccgcctcccccagcagtaacctccccgagcgccgaggcttgcggtgctcgcggcgccgccgtcgccccgagcgacagccccccgcgcgcctggtctgctcgcggtcacttagtcgtggaggagcgcgatgcgagggcaaacaggccgtggatactcgcgtcgccgccgtcgacgccgtggccggccccgcgcgcggcaaggagcggtgcatcgctgctgccgggcctatcggcggttggtagagcgctggtggtgggctatcggtgctgccaaatcgccgccgtcgacgccgtcgccggccccgcgcggcaaggagcggtgcatcactgctagcggatctatcggccgttggtagtgcgctcgtggtgggctatcggttttgccaaatcgtgtgtcctcgccgtctcagaccgtggtgggatgtttggaagaaaaaagttgtatcacactggtatgttgtttgaa

SEQ ID NO: 46106 - DNA, 3807 bp, Oryza sativa
aaacgaggaaaaattagacatgatatacttcttcagcacgtagatcgcatagcagatcttagcagagaatacttgccattgcatcgtactcgggggataggtcttttccattccagtgttcaatgcacttgagcgtaaacaatccacatgaccatctgaaattttcaattatgtttatagtgttacatttagacatcatagtaatttttatttacagatagtagaaatggttacccgtccttctgttgaggcacttgcatcgggcatattggccatttcgtgatgttcgtagaattccatttataagtcttgtgttcatcttgtttggcataacgaagatacttctctattcctttgatctgttatattgcaaagaaatataattagttgtagtgctttcagaagggaagtgtatgaaatgtgttttcattataccgtagtggtaagggttttttctgcatcatagcttgtcctatccatatgcagtgagtccagtatttggattttttcattgacaccatccaggacagctacataccagtgggccgagtttctatttaagggtaggaaaatctacatgcggaatcatgagtaagaaatgcattttcacttatggatataatgtatacgatgtatgtattaccatttcatgctctaaatagctggcagcaactttagatctttgatcacgatatctcttgttgcatgtacctttgtctgtaccattaattttccacagctggcattgtgttgcagtttcaaggagtgcaattccctgtcctcgtggagtgtcggattgcttgtctatgatgatttgtatgtatgcatctatgacctgtccaatagcagtgcatattgtgagtgtttaattattctgttgttggttaaattagaagcaggagatagcagtgcttacagtgccgttcaaccactttgctttggatggagcctgttttggtaggataagtggtttcagatgctgtcgaaaaatcttgattcctgcaattgttgatagcaattttttgtcttcactcttagagatgtaactcaaggttacttcatccagcaggcttagatcatgtggtttcggttccctactagatttaactggctttggaaatgtttttttgtagtagatgaaatcagtttgtgacttgtgtgttggcttgataatccttccctccggtcgtctaagccttccgccaattgttgataactgctgcaatgtacaagcaattagcataatggtcagtgtagcatttgtaatgtagatgtaggtctattatttgaaaaaccagtgttggattttgctggctattgtcatcgctttcgattatgtgtggagaagtagctgttccatttggttgactatcgtagttctgttaagatgcaacaagattagttagtcatttgtaatgctcattggaatatactattttgcttgcaaccttacctttgaatcatcaactaggtcttgtcggcaatctgccctggaatcaattactgtctcttcttgtttggctgctggtttaaatttacggaaagttcgtgaccttgaagttgtacccaacctgtactttattgcctatgcatgttcgaaatcataaatagtacaagtacaatatcattaacttagtacctgaatttgttatgagtacaataactgttaaaattggttctgtacctgaatatctcttctattttgaatgcaagtattctctattgagattagttttgtggatatcttgttgtccagaaactgacaaccttgttgaatctgcatgagttgtgtcataattgcatcgaaattggctgattgatgtgcctacaacagagagatttaataaatgtttgaggtgagtagtttaaacttcatacagtgggtattacctcaagatctttgtaattttcaggacttgatgccttcaacagagagatttaataaaggtttgagttgaactgtttaaacttcatacattggctattacctctggatatttgaaattttcaggacttgatggaacattaacatcgtcttctatgtaaacatggtgtggactctcatcatcatcgcctcttccatgtgagttgaatccgtttgcagccgttctttctttagttgctttgaacatataatccggttcttcattggtgggagtgtcgtctttgatgaaatcaccattattgttttcggcagtggcgccttgacagtcttctgacacattgtcccctttgatctcttcaggctcaggtacgatgtgtatgacatccacagtgttatcttccatgaaaccatcaatttttttttcgtcaatttggccttcacattgtactgggacaatgtcccctttgatctcttcaggatcatctatgacaaccacaacctgtaatgtaatatgaatagtatataatagtaggtaattaacatgttaaaactaatatttaatgttgcaaagagttgtaacttacagtccctgtttcaagaatacatttcttgtcgtactttagccatgtcattacattcatttcattccaataggccattagcggcggtggccttccaacgtatgtcagtgtgcacattggatcgttaatgtgtacatgttcccatgcccaaaactgaaaaaaaaagagagcaagaatcactgaatgtggattgcaaatggagacgtgtaatggatactttcatacctgaagcaatggtacattcccttctagatttctccttcctcccttcaattcattcagacaattgattaagtaatctcttgtgattctagcccagttgatgttcttaatgttgtcaatgtctttcaaaagggctaggtactgagaactaactattggcttggtggtggggcataggatgtacccaatggtgaatagtacaaatcttctaagaaagtgctcatctgggtgttttgcactattgatttgtcttgccaactcatgtagggaaatgttcttccccttatgttgcttgtacattgaataatatttgtagtcttctccattcatgtgaggctttggcttgataatcataccatccgcaggcaaccccatgatacacttcacatcatgggttgttattggtattgctgttccttggatgttaattgtttcagttttactgtcatatctctcagcaatttgcccaatcagtttgcggtgaagggtgatatctggcagggcaagcatccggccaaatccaatcctctcaatttgtgatatcttactcttgtcaaaattagcaactacagcgagaaatctttgtattgaacatgcaatagtcatgtctttcataatgacaggctatgaagttcatgaaaaatagaacagcttcagaagtatggaaacataaggccaataaacaaaaaatgaccgaagctaaccttatgctcagtgaccagtgcttcagttgtgatttcatcaaagcgcggctggaccgaaggttcaaactgtgcttcatttctgacttcgtcgtcttccatttctctggcgatgttgatgcgataagagatcagactgtactttctttgtaaataatctgtaatttatatggggattaggagtgaaagtatgccatcagtcagctatttgttacgcagtaattttcatctcttcgtttactgtgctgacagcaataaatatgtgcattcatatgatgttctgaccaaggactaaatgctattcccaatgcacaacagtacagtgacgcataggtactactgcacgcatggttagatgatggtcatctggttggtgtgtgaatgcaatcgacacgacaaacgatgagccctccatcca

SEQ ID NO: 46107 - DNA, 8505 bp, Oryza sativa
tgtcgcatctgaacgtgtcgagtcacaattgtgtgttaggtccgatcgtacgtgacttgtcgtatctgaacgtgtcgagtcacacctgtgtgttaggtccgatcgtacgtgacttgtcgcatctgaacgtgtcgagtcacacctgtctgttaggtccgatcgtatgtgacttgtagcatctaaacgtgtcgagtcacacctgtctgttaggtccgatcgtacgtgacttgtcgcatctgaacgtgtcgagtcacacctgtgtgttaggtccgatcgtacgtgacttgtcgcatctgaacgtgtcgagtcacacctgtgtgttaggtccgatcgtatgtgacttgtagcatctgaacgtgtcgagtcacacctgtctgttaggtccgatcgtacgtgacttgtcgcatctgaacgtgtcgagtcacaattgtctgttaggtccgatcgtacgtgacttgtcgtatctgaacgtgtcgagtcacacctgtgtgttaggtccgatcgtacgcgacttgtcgcatttgaacgtgtcgagtcacaattgtgtgttaggtccgatcgtacgtgacttgtcgcatctgaacgtgtcgagtcacacctgtctgttaggtccgatcgtacgtgacttgtcgcatctgaacgtgtcgagtcacacctgtctgttaggtccgatcgtacgtgacttgtcgcatctgaacttgtcgctcattggaatattaatcatgttttatcatctaacaacaatgaaaatacgaattataaaaaaaattcacataagacgaacacacaggtatgacttggaaaatgtctggttagtctttttttttttacggagggagtagtcgtgtgcacttgtgtacatgtatatgactgatttatgacagccgtgcatgtgtatttgtgtacgcctaatttaatgtgcaactactactaaatgccaagcaatgaaagcaacagtcccaatgcgtccttatatactacttccattcttctctgatgcatcctgttctccaccattccatctcttctctttctgcctgagctgcatccccagttggcgaacatgaaagacaaggtatgtccgatcgtgtaaatcgttcgtagcgttagtattattagtttaagcgtcgccgttacttcgagttgactcgttctgttcatttgattttttgctagtttcaccgttctggactttgcttggaagttcccatgtatattgacgacggcgagtattttggggatgaaaccggtacccagctgaaatgtcgtcatggcctccgcccgaagagaagaactgcatgggaatggaaggacaccggaagaaggtttcttggttgcccactggaggaagaggaccagtgcgacgctttgttttgggttgacgaagaatggcaaccaagaatacaaaaggcatttgagatgctctggcttgcattggaccatgcaagtacacgcaaccctaccaaggcgcagtaccaatggtcaaattttgtagacagaacaatagtcgaagaagacaaaatgaagttagaatttcagatggcttcacagatctcggcaatcgaagcaaaacataagaagagagtttccaggataaaaaaggaaacagaagacctcaaggcttggcttatgggttccctagtcgttattgcatttcttttatttaaaattatcgaaaatatgtatcagggatgttgatgcttcaaatatgtatgacgtgtgttgatgcggctttaaatttgtgtcaatctatttcattgctaattatcacgtcacaaaagcccattgagtggcccgtttattgaagcccataaggtggcccattttatagacaataaaaggcacactctctagggtttcccccatccacaaccttcatcccatctgaccgaccatgtgaggagccagccgaccccgccgccgacacctccgatcccgccgtcgacgccgacccctccgaccccgccgtcgacccctccgaccccgccgtcgaccccgacgacgactcccccgccgacgaccacgccgacggtcctgaccccgccgtcgacccctcagaccccgccgtcgacgccgacccctccgaccccgccgaccccgccgacgacgccgacgactccgatccctcagatcccgccgtcgacgccgacccctccgaccccgccgacgacgccgatgactccgaccccgccgactgcgccgccgactccgacgtggcttcaacccctccgactgcccgacctcgcctacgcagccgactatggtgaacaacaggaaggttgttatccaagtcgacagtgacacgggtaatgttttgcatccatcgatttgtgttaacatttttttgatgaccgtgaattgagcaattgatttgtgttaacatagatgaagaggtaaaatccgacagtgacactgagacagaatccgagagtcatatggaagaggaagtagacccttcatcgttttttgctagtgtgcggcgcgaaactatcaagtgtggttagtatgcttgttttaccgagactatcaattgaggtgattgagtttttttttttttggtattatctattgtggttactatgtcggttcatttgtgcagggccaaacggcctgcagtacgctggaggctttcatagtagatgctggtatgaaaacgatgtgtacttgacaagggcataccaaatgaatgttttttttgttttttttgtatccttccattgctcactgcacaataaatgtacaattcgaactgcacagcaatggcagccgcaataaacagcaattcgtgattcgctgtaacttaagcaaaacagacttaaatcacataacagacacaagagcagcatttcaatcccaaaatacaagtcaaacacaagagcatatcattctacaacgcacagcaatgccaatacagactgaacatcaataataaaagcaagttgcatactgccagtacgtctcacattaagttcttaatacatatattcatcaatgccatacaccacaaatattcatcaagttccaccccatgttgcttcatctcagaacataaacaaactaacaaaaaatacatgttcctttcctgtcttattcaacgatgcaatttgacggccaactccatcgttctcacacatcaacacgtactttcctgaaaaaaattgtgaaccaattaaatacgcaggtattttttccaattgaactagcttgacttgtcacatataaattacctctcgtaaattggacacgaacgaatggtatggccaccgttacggcaatagccacaacgcctaacacgcttctccaaaaaacctctcaatctttttcgcggtgctcccttcggaactacctccatgggatcatgtaccaaaacatggccactaatgtctgtacgtaaactttgacctaccacgtgaccacacagtgtcctctctatttcgttaccatcacaatcttcagtttctaaatccaacttttctagcatctccatcaccttcaatgtacattcctcagatatggagcacttcattagtacttcgctaccgaagctacgcaacatgcgatacctttccatttggtccgaccatgaaaatgtctcaccatatctatccgacggaaagacacttttggctttcacagtccacctgcgaactatgcaactttcaggaatggcatccatcttcaaataaaacagaactgcaaacatgtgctgacatggaaggctttcacaatcaagtttcatgcaagggcaactcattgtcttcaaaaatgattcctcataagtacagttcaaaatcttcagcttctcattgttctctttcaagcacatgacatacttcactactgtatcctcatcaataaaatctattacttcccaatccatggatttaataatctcaaacttaaccttcttgaaaattgcaggtgtatatatgcgcgctacttctttctcaattaaacttgcatctgtacacgtgaaggggactgattgtgaagcttttgaatctagctcagcctccctatgtcttatacgcgacacgcaatgttcgtaatgctcaaccaatacaactaaactcattgtacgatccaaatgcttatgaagttttgaattcaaactttcactatgctggttgcttttcattcctagaaagtacttaccttttaaataagcagcagcccatttcttccttaagttgtacattctaaccaaccattgattatcttcacccactttatgtttgtccttgaactcaacccacttattctcaaactcttccggaccataagtagaatggataagtgccctgaaatcagccaacatttcaggccggagatgtcttgccatattctattctatatgccaagtgcacaacctatgctcagaatgtggcatcacagatgaaattgccctacgcatagaattgtctccatccgttatcaaacctctgggatgtttctgacccatgcaatccaaaaactgcttcagaatccactcataagatgcaaccttctcatcagccacaatagcacacgcaaaaatgacagtcgaaccatggtgattcacaccaacgaatgggatgaaaggcaagttatatttgtttacccgatatgtgctatcaaaaacaactacatcaccaaacgcatcataatctatacgagattgagggtctgcccagaataaccttttcaatcgaccagcctcatcggtctcatactcaaaaaagtactccatgtcatctttttgcctagcttgcatgtattttataacatgatctgcatctccacctaatatctgtttcttcttctgtcttacaaaaaaattataaaggtccctactcacaaaaccagtagactcaaaaccaccatgacgcctctccatgacatccatcacttggtgctgacgcaaaccaacttctctcaactccacaacatttgccttctgagcaatgctaatatttcggtgagaacgaaggaaaggaacttcatcagatttagccaaactatgactgtgctttgccacaaacttcatacaaaccaatcaccctgtttcttgtcaagtctaatctcaaatatagctttgcatccacaacgagttagtgctctaggttctctgcttttgttaccaatatccatataaacatctctcctatacccttctcttgagcaagtgtactgcctaaatataacatcagcagtcacaggatcacgcctagcaaaatttttccttatactaaatcctttccctttcgcatacctgttatagaacgtgaacccgtcgttctcgctcttaaacctcattgccatgaacgtagcatactcctcttcctcctctaagctactgaaattgtctgccatctcatcaaccatcatgattctgccaaaaaaataacaataatctcaatatataaaacaaattacacagtatcacttcaaacaatttacgacacatcgatttacctgtaacaggaaacacacggccgttgcagaatactgaaacggcggcagtaccttctggcgatgaacaagattgctccagcgactcagacaacggcgactgctacggcggagatgtgatttggcgcggcggctccttccggcggcgatgtgatttggcgcggcggctccttccggcggcgatgtgatttggggcggcgatgtgattaggggcggcaagtgcttccggcgatgtgaattgggccggatgttgcttccgccgtcgggcgccgatgtgagtgaggcgcgattcagagcgatgaaatttgggcgggcggtgggtcggggcgatactgaaggcggctagggtttgcgtctcgcgtctgatttggggagtagataccgattgcggtgcgccggcgccaattccaatcctacccgccacaaaatcaacggctggatgggttttggtaccacgcggtacaagtaccacgcggtacaaaacgcaggacgggagcattgctcttccatattagttttctttgcagcccggctaaatataggtctcaataaaccggaaagagcatatcaaatacaatttagaattaactaattaattaatacatcataagatcaattgcattttggattgaaaaatataataatttagaagttttttccataagaacttcaaattgaaaatcctttagtaacttctatttgaataaaaccgtggttgtgttcggcaatagtgatttgggagaaaatcccccttgttattcatgtgcacgttttctaaattgctaaatgatgtgctttttcaaaagaagttttatagaaaagttactttaaaaaatgtattaattcatttttaaaatttaaaaataattaatactcaattaatcatgcgttaatggttcaactcgttttgcatattttttcgatcttctcttttctcctcctcttaaacacaacccttagatcaaaaattgttgtctaaatgggacatcattcttgattttttttactattgtaggatgaaaaatagatgtttgagatttgtttacgtcatcctaactaaaagttttacttatggtttaatttgggagtaaaagttttacttgatatgacgtgtacaaaatttatacgtctatttttacatcctacaatattttttaggtttccattacatattagccacacaaagtcgtgcatttgcgcgaccaagagatgcatctttgttaaatatcttaagatttttctcttacaattatagtggctttgctttcttgcccctaaatattactactgcgaagtagcccataaattacataccactacaacaatatctttatgtttttttacacaacaccaattcatgtatgtttgttttacttatttcacttctcaaatttaatcagcacgagatcaaatagtgtaatcatttcccatgcaaatcaatatcccatagtgtattttccatgcggtggactcttgttgcttgcgatgtgtcaaaggggagacgctagaagacacaggagggaagtgcctagtgcatgtattttcttttactgcatggatgttctatgatcggatggccatcttttatccaaacattcatccgatggggcgatggccattgtttttcggattacgtggtccaatatgctgtcaagaatgattctttctttcattactttagatatctaggaagcatattctaggatataatcattagttgcacaccgaactggtattatgtgccatggcatatcaaataataattcaaatttgttaatttgttcgtgtgatacaataattttatgtcctgaaacatttatgaggagcaacggaaaattgtagtaaagtgtatttgtggagtttttctttcaaggatatttgtgcagttttttttttgaatggctaaatagttgttgataggaaatcagggccaaaatcttgcaaatttctaatcataaaatttgcttcgtgattcacactctggcgaccttatttctatctgccctatctccagcgatgccatttcctccagctctgctgaccgacgatggcccgatgagttagggtttagggtcccgggtaggataggggtagggcagagggaagaggaaggagatcgtcgggcttggagggatggccgtggaaggcgaacatggataggactccagtgttggagccaaggtgttggaggagatggcagcgggccgacgttggttgcgagggccaaacagagcttgtggttaggcggtggcgaccggtggtggtggaggggagtcacaggacacgaagaagatggtggggggcacttgctaccgtcgtcgccttagggaagagaggggggggggggaggtggcttgatggcgccgtggaccccgttcggctagacggcgatgtggggcagtagtggtgcaggaggcgacgggcgggaccgaggaaggaaaggagaaaacaatagggtttgaatacgttacatgaatcttaaagcgatccaatggtctagaattttgtaagatttaaaagttttttttcctaccaaaagccatgtaggcaaactttcttttttaagataatccaagaaatgccattgacaagcgtccaagtcccagaaatgctatcaacaagtgtgagttccaagaaatgtcatcatacaaacgattttatcctaaaaataccatcaccgttagggttccgtccattttgtgacattaaaaacactgttcatcctatagaacttaacggcgcaaaatggacagaaccctaacggcgatagcatttttgggacaaagtcgtttgtacgatcgtatttcttggaactcacacttgtcgatggcatttctaggatttggatgcttgtcaatagcatttcttggattttctcttctttctttcttttttcttttttggcaaggatacctgtggtgggttttatgggcatggaacgtaaggacaccacgttgtcctcatgacaaatgggctaacttgtttgatcttagatactactccctccttttctaaatgtttaacgccgttgatttttttaaacatgtttgaccg

SEQ ID NO: 46108 - DNA, 5259 bp, Oryza sativa
cccgtgtaagactatatctatccataaaagtatatttaacaataaatcaaacgataggaaaagaattaataattacttaaattttttgaataagacaaacggtcaaacatttttaaaaaaatcaacggcgtcaaacattttgggatggagggagtatatctctctcctttaatatttgacgttggttagtatcatatttagctagccaacgtcatatataatagtggaagggagtaaattttaaattcctacttgttcttaatacttattgttctattgttctagtagtccaccgtttttcttggattttcttcaaaaagtgaagaaatttacgtgattatgagtgaggtaaggaaaaaaatgaagaaatacgatttgtccatcagtccattggaaacgttttcggcaaattcaaatattccacgttgtaggtgagctctgcttttgggaaagtcagttgttgacgccgccaaaaattccagtcctctccatggtagtcaacgtcaatttctcacttgtactatatcctaacgagtttttggttcacacctgtttaatctctgttcgaaatcaagaaaagctggatggagtagaggatctatgtcgagtttagctccaaactttttctttaaacttttaacttttccatcacatcaaaactttcctacacacaaacttttaatttttctatcacatcgtttcaattttaaccaaacttttaattttagtgtgaacgaaacacaccctagcatgtatggcattgtgccaagcgtcgtgtcctgaactccagaactccagaattccatatccatatcgtacctacagcgaagggaaggttcagatttcagactcgctgtggtaggtcagctcggacagtttgaccacgccttggccacttccgctactccactccactcgcacggtcgcctacccagttttctggccttagcggcacatagatttccgcccaaaaccatccaccttttgccgcctccgctcgtgcgcagcagcgcagctgccttgccgtttcccaattcccacacgccatgacgccaaccaacccaagcacagcagtacaccacacgatgtcacgactcacggacacacgggctatatatatcgacgtgccacaccacaccgtacccaagcaaacagatttccaactaaacttgtaccaaaacacaaacgacatcggtcccagtcaagcggagcgcacgaacacaacgcagagcatggcagcctccgtggtgagggtggccatcgccaccggggcgtcgttggcggtgcatttgttcgtcaagtcgttcttgcaggcgcagcatcctgctctcaccttgctgctgccggtggctgtgtttgccggcattgcggtgggcgcgaagggcgggaacgggggcgacgggaaggcgccgccggggccggcggccgtgccggtgttcggcaactggctgcacgtcgggaacgacctgaaccacaggttcctcgcggcgatgtcggcgcggtacgggcccgtgttccgtctgcggctgggcgtgcgcaacctggtggtggtgtcggacccgaagctggcgacggaggtgctgcacacgcagggcgtggagttcggctcccgcccgcgcaacgtcgtcttcgacatcttcaccgccaacggcgccgacatggtgttcaccgagtacggcgaccactggcgacgcatgcgccgcgtcatgacgctgccgttcttcacggcgcgcgtcgtgcagcagtacaaggccatgtgggaggccgagatggacgccgtcgtggacgacgtgcgcggcgacgcggtggcgcagggcaccggcttcgtggtgcgacgcaggctgcagctcatgctgtacaacatcatgtaccggatgatgttcgacgcgcggttcgagtcggtggacgaccccatgttcatcgaggccaccaggttcaactccgagcgcagccgcctcgcgcagagcttcgagtacaactacggcgacttcatccccatcctccgtcccttcttgcggggctacctcaacaagtgccgtgacctccagagcaggaggctcgccttcttcaacaacaactacgtcgagaagagaaggtacattccatttttcttactttactgcattccctatccattcttgtcatggaaaaaatgaggattgcaaggtaaatttgttcgtgtctaatcaacaaaaatcttgatatgaaatgcaggaaggtgatggacactccgggagacaggaacaagctccggtgcgcgatcgaccatatccttgaggcggagaagaacggcgagctgacggcggagaacgtgatctacatcgtggagaacatcaacgtggccgccatcgagacgacgctctggtccatcgagtgggcgctggccgaggtcgtcaaccacccggcggtgcagagcaaggtccgcgccgagatcaacgacgtgctcggcgacgacgagcccatcaccgagtccagcatccacaagctgacttacctgcaggccgtgatcaaggagacgctgcggctgcactccccgatcccgctgctggtgccgcacatgaacctggaggaggccaagctcggcgggtacaccatccccaagggatccaaggtggtggtgaacgcgtggtggctggccaacaacccggcgctgtgggagaaccccgaggagttccggcctgagcggttcttggagaaggagagcggcgtggacgccaccgtcgccgggaaggtggacttcaggttcctgcccttcggcgtgggccgccgcagctgcccggggatcatcctggcgctgcccatcctggcgctcatcgtcgggaagctggtgaggagcttcgagatggtgccgccgccgggcgtggagaagctggacgtgagcgagaaaggcgggcagttcagcctccacatcgccaagcactccgtcgtcgccttccaccccatctctgcctgaactcatcgaatccctttaaattatgattgtgtcaggagcagattaaggatattatacagcattaatttcgatttgtcgaacaaaattagacaatagtaataatgcaagggattttacatgttctgttagaaaatatattttgtgaactgatcttatcattgtcagtaaacaagtgtggatagtactgttttccataaaaatcaaatttagtcatttttatttttatctggtgttggtagattgctctggtcgctgactgaatttttttattaattttctttttttatatattttttagaggagggtaaaaactgttttccatgaaaatcaaatttagtcatttttatctggtgttggtagattgctctggtcgctgactgaatattaattttattaattttctattttttattaattttatttatttttttagaggagggtatttttactcgtcctctacatctaaccggatatatggagcctttttaaaattattaggaacttagcccatcggacagagaacttaacttagccctcaaataacccaattcgaaattcgatactcaggtcagtgcaatcactaggctacatgccctttcacactgcaaccattattaatttatttttgcggggaacaagggatttactcgaataaacgagtcctcgcacacaaggtgcgagatcatattacaattatcgtctggccagaattccatcatggattcacaacggcctttatttgctaaaaagtgactaactctattttggttcctatgcactttggcaaaagacacttcctttgttccagtcatgagaaagcgaatctccctgactataaatccttcggctgacagcagcttctcctttgaattcaacagctgaataatttccagacaatcagattcaacggcaatcggaagcagggtccactgcaacgccaggttgaggccatctctgcaagcaatcagctctgattccagggccccattgcatctgccaatgaaaccacacgtggagaagattactcttccgaaactctctctcaagacagcaccagtacctcctctcccatcttgagggccatacgacccatcaatattaagcttcatccatcccggttttggccttgaccatctgggtgggttagttgaacatttaggggctgtttggttcaatgcttcaacttgccacaccacacttcacactttaggctgccacacctccttagccttgtgtttggttcattaccttagttatggcaagccacactttcttactatcttaccctatatgtcatagactcaatcttttgcctaactttactacaagtgtggcttacaatttgtaggccacaaaaagtgtggcaagccacacttgcctaacattgactaaagtgagttatggcaatgttagttaagaaccaaccatgctgttagccttaactctgctccccattccttcaggtttacaacatgcctccctttcataagatttgcaaaaggatgctgcttgatttccactagggaatgaacataactcaggataaaatgagtcgaggcctctagaggaggggccggctttccgtgagttaattcgttgcggatgtaccagatgcgctaaagcatcatcagcacaagggcctgttcatcgtccggtaccaactgaagcatgtttaaaatccagtctggccctgcccagccagctgaaaataggcttgagatatgctttccttcaccatcgactgccacatactcctagcatgagggcatctgtataacgcatgacccacatcttcctgttcatggccacaaatactgcacacgtccaacaattccaaaattcctcttcttcttgttttccatagttggtaagctatttgtggctgctctccaaccaaagattttcactttttggggcacattacaggaccagatcaggttccaccctttcttgatggcgtagtccgaggagcacgagcattcatcctgtcgagcaatttgcattgccaactgataagcacttcttaccgaaaaacgaccaagccgatcaggaaaccaaacaacaaaatcctcctcttggcgggaggatatcttgatctttacaatttcttcaacatccaccgggaggaagattgcagaaaccaagttctcgtcccaagaaccatccggtttcaggatgtcagaaacccactttaatctattgttccttttcattgtgattggccggcgagacatgttcctgggaatccagggatcccgccacaaccggatagaacccccatttcccactctccagatagggctgca

SEQ ID NO: 46109 - DNA, 46224 bp, Oryza sativa
  unsure (1)..(46224): unsure at all n locations
ggtctgaccggcctccaaccggcggtctgaccgcccaacacacggcggtcagaccggcctacctcgaaggaaaccggtagacttccaaattttggcaataattcatattttaagcctaggtgccaaatttaggtgtaaacatatgccccctgcctttttgatgaacgacgtgaatctaaaagcatagaacatgtttttgatcttaggacgataatccaattaccggccatagttcttcctaagcgtcttgccaaacactcggaaagtatttcttcaagtatttcccattgattgctcgctgaaaacgctccccttgtagtgtctccaaaaagtatacgttccctcgaacaatgccgcaaactcgataaggaccttcccaactaggagaccacttaccgaactccttggatcgagtacccaaaggcaaaattgtcttccaaaccaagtctccaactggaaacaattttgccttcaccctcttgttgtacgccttggccaccctcttcttctctttctctatctcttttaatgccttgaagcgtttgtcgatgacttcatcaaggttgcctcccatcaacgtcttgtaatcttcacttgacaaatcatcttgcttgatataacgaagagaaccaagatttacctctaccggtaaaacggcttcttgaccataaaccaactcaaaaggagtgactttaggggcaccatgtttagatatcctatgcgcccacaatgcttcggaaagcacctcatgccacctcttcgggtgttcctcaatcttcttttttactagctttaacaatgtcttattactcgactcggcttgtccattagcctgagcgtagtaaggagaagaactcaataatttaatgccataagattcggtaaaactctttacttccttagacataaaagaagcgccttggtccgtagttaatgtttgcggaataccgaatctatgaataatatgcttcgaaataaagtcaattacctccttatgagtcatattcttcaaaggcacggcttcggcccacttggtgaagtaatccgtagcgactagcacgaacctatgcccttttgatgacgaaggataaatttgaccaatgaaatccaaagcccatccctagaacggccatggtttgattatagggttcaacacggcggcgggcgccaattgaacattgccgaactgttgacaagcctcgcatcctctataatatttgaagcaatcatcaatcatccttggccaataaaaccccgctcttctaagcaaccaattcatcttgtgggccgattaatgagttccacaaattccttcatgtacttctcccatagccactttagattgatcttcatctaagcacttcaacaagacaccatctatgtttcggcgatacaaatctccatcaagcaatgtatatttgaatgcttgtcgccgaatctttcgatcaaccttaagtgtgggatctttcaaatattgaatcaaaggaattctccaatcctcttctgtatcctgggcacaaatatccgaattcacaattaattcggcctcaaaattacttgaaacgtgtccccagcatcctgcctagaaccggtcagaccggccacacagggccggtcagactgctcggggacgccggtcagaccggcggcatgcagccggtcagaccgcccctggtcaccggtcagaccggccgtgcaacgccggccagaccgcctctggtccccaactttgccaatttcgcacaaaaatttaaaatcaagcaccggctcttctaatatcagaaataaccccctctttacattataaccagatgcttgttgtgccaagtcatttgctctagaattatcacacctagcaatatgtctaatagcaaaattatcaaaattggcaataatatctaaacatgaatcgagatacctatttagtgatccatccaagcacttgtagatcccggcgacttgttgcaccaccaattccgaatcaccaaaggcctccacatatttagctccaatcatctccattacttgtaagccgaacaataaagcattgtattcggcttgattatttgtgcaataatattccaaacgaaccgatgcctcataacacatgccattaggtgaaatcaaaactacccctatgccttgaccttctttgcaagaagaaccatcaaaataaatcttccaaggtataacttcaactaagcaaacctctccctcataagcaacatctatatgatggtccactataaaatcacatacaatttggccttttatagttttcaatggttcataagccaaatcatattctatcaaagcatatgcccacttgccaattctcccacttagaattggcctttgcaacatgtgtttaataacatcggcttgacaagtaactatgtatgtactacataacaaataatacatcaatttggtacaagcatagtataagcatagacaaagtctctctataaaaacatacctcgtttcggcatccaaaagacggcggctcaaatatgtaatgatatattccttgccatcttcctcttgcgtcaaaacggcaccaatgactttgtcttcggaggcaatatataaccgaaaaggctttccggctttaggcgctcacacaacgggtggagtagacaagtatcttttcaactcttcaaacgcctcttgttgttttgccccccaagtaaaatcggcttcttttttcaagcgaagtataggaacaaaagcatcgattttacccgctaggttagtaataaacctcctcaaaaaattcaccttacctagcaacttttggacttctttcttgcatgtcggcgctttgaaatcacgaattttttctatcttcttaggatcaatctcaactcctctctcatgcaccataaatcctaagaacttccccgccgacacaccaaaagcacatttaagtgggttcatcttcaaaccataccggcgcatcctctcaaaagctaatctcaaatcggctatatggccttccataccatccgatttgacaacaatatcatcaatataaatttttaagataatacctagcaaatcatgaaagatcaaattcactgccctttgatatgttgcaccggcattcttcaacccaaaagtcatgacaacccactcaaacaaaccaacaaaccccgggcacctaaaagccgtcttgtacatatcctcttccgccataaagatttgattgtagccggcattaccatctaaaaaactaatcaccttatgacccgaggcatcattaatcatcatgtcggctatagacataggatactcatctttacgagtagctttatttaaatctctaaaatctatgcaaactctaatcttaccactccccttcttttccaccggaactatgctagaaacccactccgcataacgacatagcctaataaaccccgccttcaacaaccgatcaatctcctctttgactcggtcatataataaaggattaaaacgatgaggtggttgtttataaggcctaaaacccggtttaattggaagccgatgctcaacaagctcacggctgagacccggcatctcatggtattcccatgcaaagcaatcaacatactctttaagtagctcgattaccttaaccttataatcggctttaatgtttttgtttacaaaagtcggccttggtttagttccatcacctatgtctacttcctctaatggatcggccgatgtaaacccttgtccaagcttctcaacttcatcaaaatcttcaacggtttctccaatatcgttctttgtagaccgatattcttgcaccctcttttgtaaccactctaaactagcctatttactcgttatacaaatttatatggcttagccgtgctacactagccggctttacagagataggtacaaatttgccatcggagatactaataaaatcatagctagaaagatccctccccgataagcattggatattcccatgacgccactcaaaagtagcatcggccattgcaacctcggccgatgtatccgcttgaacaatttcaacatcatcgccgtcccattggattaaacattgatgcaaggtagaaggcacacaacaatttgcatgaatccaacaacgacccaaaataacattgtagttaccttgcacatcgacgatgaagaaagcggttggtagcgtcttgtttcccacggtgagctccgccgaaaagatacccctcgcctccgttggttcaccattgaagccattgaggatcatgttggtcttcttcaactcatcatccttacgccccaacttcttgaatagcgaatacggcatcaagttcacggcggcacctccatccactagcatcctagagaccggtttcccatcaacatggcctttgagataaagaggcttcatgtgacggtttgactcatcgggcttctcaaaaaccgcgtctttaggacctaatgagaattgggcaacttcggcttcatccatagcacaaaactccataggcaacatacacaccatgttgatatctatgtcttcctttggagacgatttatctttgtcaaccgattgttcttccttctcctctacatcaatcggttttgccttctctatggatttaggcctccatactggtggtggtcgcaactcattgaacattttatctctttgttcttcggcccttttctcccttagttcttgggcccgaagacgttgcaaccttttcttttgagtagccgtcaaatccttaggcatccacctaggattcggctctgttccaggaggtaaataatgtcctctattaaccttatttgaagacgatggagcccccacatcaccctttgcagccctcttatcaaactggcgctggagcccggtcagaccggtcgcagaccaccggtcagaccggccagacgcgccggtcagaccgacagcgggtacacggtcagaccggcctgaagcctcggtcggaccgctgtctggttggcggtcagaccggcctgatggcccggtcagaccgaccgcatggctgcggtcagaccagcctggaggcctggtcagaccggccgactgcgaagagctggtaccggcttcggattttttgcttggggactttccaactccatctccagaaggtacaggcacatcatgggaccctattttgatagtaatcacctctgaagtcctctcttctatcttgacgcgctttccttccctcttctcttcattaacccgatttttaccataaaatcgacttttgtttgatgaagacaaacgctcatgaattggcctccgtggtcctccccacccttggttgcatctcattggcggcatatgattgtacattggcggcgttgcccccatggcatgaagtaaggataaggataacccggcggcgccattggatatggaccccatgacatgtcttgtggatgatgatatgaaggtgaatgcgatcgtcttggtgaatgaccaaatcgctccctagggggtgatcttggtcttttccctttgttgcgaatcttctcaccaccttgcttctcatacttttccaaaagcatatcaaaagtcaccttggtcttcctaggggccttagaagttgaagcttcacccttattttccttccaaacaccaacttccggcttctttggcaccatcatcttaggtcttggctcaccaatgaccacttcctttcctttagtagattcggattgctccgaccgaatcaacaccttcttattattgaaattaattgtattcaccggaaaaggatcatggtcaagcttcatcttagagccatcggtgaatttcaatcgtccctcatctatggccgattgaacctttcgtcgaaacacattgcaatcattagtagagtgagaatgagaatcatgccatttacaatatgctcgacgtttcaactcttcttgtgatggtatgacatggcctttaagaaatctaatttgcttttcttgcaaaagataatcaaaaatcttatcacacttggctacatcaaaactatacttaacctcactttgccgatctttacgaggagtcggcattaagttagaacaaacaaaaggtttatttttgttagtccatgaccattcggcaacataaatatcatgatcaccctcttcctcactatcactagcatcagagtaatcaactacattaacattaggctttttgtcgaatggtctagcaaattttttatctttaacccagctttcttgaaccagagccctttgcataagttgactaacatcaagaaattgttggccatctagtttctctctaagaggagcaactaaaccattaaaagaaagcccggccaaatctctatcagttatattcaaagtataacatcggtttctaacatctcttaacctcttaatataatcaacaacagattcattatacttttacttaaccgatgttaaatcacataacctaaactcagtttctccagtatagaaataatcatgaaattgctcttctaattgagcccaagtatgaatagaatttgccggtaaagaagtaaaccatgtaaaagcattaccggataaagataaagaaaataagcgcaatttaaaagtatcagtattagcctcaccacattgcgctaaaaattgacctacatgttcccatgtggtcttaccatcctcaccactaaacttggcaaattcgggaactctataatttctaggaaacggcacattattataataatcgggatatagctttttgtaagctctagcacgattcctagtttcaatcctgaatctattcctcataatatcactaatcacatcctccatgttattaggcccttgtggatttggtggtgggtttggtggcctaataggttgagtttgtggcgcaatatgattatattggccttgcctagtattgggaggatatcccctagaaacatcattataaacgttaggaatatgtgggggaatttgaggattagtggtaacagtagatacaggaggatcaaatgttctaaagtgatacaaataactagcattggtcgttggatcaattccctgtatcgggacaattgcgccagtctgaccggcccagggcccggtctgaccggcgtcaggttgcgcggtcggaccggcctgaaagccggtctgaccggtgggataacacccggtctgaccggccatctggccggtcggaccgacagctgtgtcgcggtctgaccggccgtcaggcccggtcggaccggccatgaacgccgctccgtcggttttagaccctattagatctataggatgttgattagcagtggtataggctttatcctttaatatgtaatcatccataagagaacctagcctattccttaaaaacccatcaaccctttccttaaacattacatctaatctatctttaaaattaggcatagatgaatctattgtagatgcaatttgttggttgatagattgcgatacctcgtcattacttaccacgtcgggagcgagcttgggacgtggcccgggcttgatgatcacgccttgacgagtcctagtagttgctctcatcaacgcctcccgtgtgagctcgttgatgtactcctccatggctttgcgatcctcaccttcaaagtcatctaatgtgaccggtatcatatgagatggctccacctccgtcttggatgatggcttcgtcatggcgaagtcgaagtcgagttgacgatgaacggatctcttccccagcggagtcgccaaaaatcgtgttggcaactttttgtgacaagttgacaagcacgatcgcagcacctcaagccttgcggtgattctagagtcgccaaccacctcgatctagcaaggagctaaacctagatgggttttgataactaaaccggctagcggagccgatttctagataactacctgtctcgtgggcaaaacggaagattcgattgattgatagtagattgatttttgcaatgaaccggccttgtcccttatataggggttggtcttgccctctacaggcccttctccacgtccaactcgggatagaaaccaaaggaaacccgaaacatgccttcccgagcaaggaaacctcgaaacccgacgcaacagaatcggactcgggcctgctggtcagaccggccacataccgccggtctgaccggcctccaaccggcggtctgaccgcctaacacatggcggtcagaccggcctacctcgaaggaaaccggtagactttcaaattttggcaataattcctattttaagcctaggtgccaaatttggatgtaaacaactctaataccaattgaatgatcgtaaagagtttttttttaccctaaaaaccagccaattagttgaggggcttctctaattttatttgatgtcccttatctttccataactaatgagaatattcgacagtaaaacatgcttatgaagtacgtagccgttttgagttgtcctttacaaggctgtgatctaaattactcgtagcagtcaacgaatctgtgtattattcgtgccatacttttcctctttaatcagtataagcaattttcatctatagtcctcgaataactagaacactggccattgctctttctccggattttagcgtgtattaatttagttaattctgtcttttttttaggatcgaacacaagaaaccaagcataccagagggggggtgaatggcagggaaaaccaaaaacccaaaaacttttagcggaaataaaagttaccctcaaatcgatggaaatctcgacgtagtcctatcgccgccgccgccggtcggaccgctcgcacgccgccagtcgaaccgcttgcacgccgccggttgaaccgccgtcttgtcgcctgttgaaccgtcggtatgtcaccggtagaccgccgaacccgatgaaacacaaatcaaacaactctcaaagtagatgacaactttattacttctctctgtgtttacaaagtgcaacaacagcactccttacaaaaatctcaactaaacttgaaaccctaactaaactagcaactcaattgctctcaaaagcgatatcgaaaagcgatatcgggaagcctcacgctccctctctatttataccacaaaaacccctactcaaagtagatgtagaactcctatttctaataggactcaattcctcaatttcctttttcttcaaaaccacagccggacttcctaaaccaatcgaactcctgcgcgaaaccgactgcccgtcgatctccgtttcctgtcaacacacgtgagcctcctcctctactgattcttcacgcatgggtcgtctcctcgtcatggcccatcttgccttccaaccgagccgccgttgctgctcctcccagaccaagcatcggcatgcactgatgcacacagcacacatgcacatcacgtacatgcaaactacacgctacagtacatcgagtactgtagcaaccatgtactccaccgtacatgaacatctctatcttctctcattcctcctcgcgaacaccgacgcttgcacgcacacctcgtgaagcccgttgcgaagatctctcctacacggtgtccatctaccctgtgccatctcgtatccaacttcgtcatccggtatccttgaccgtctggacctcaactcctccctgagtctagtcccgatccccaccgttgacggaagttgacctccaagaatcctgactctagtcaccttctcacatggtatcccgaccgcactagacctctgttcctccctgaacatagtcccggtcctcaccattgaccaaggctggcctcaagtcccctgcccacaatcagacaaaacaaccgtttctgggcacagatatcataacctgacccacattagtcacacacactcacaccaacattcacacaaattctcaaaccaattctttgattaaatcatttgcatagccaattgttcatcacaaatgttaatcatgacaatgatttcacaatcttccccttgatgaacacattggcaacatctccaaaatgcaattttatgtttttgaaaaataaaaacaaaaatcacaaaagtgaaaaagaaaaactctccccctttttaaaatcgactatttgtaaaatcgaaacaattcaacgattctccccctttcaagaagtatgaattttgtatatttctccccctttgacaatgatttcatcaagaatgcaaaagagaaataataaccaataaagcacaaatgcaatgatatcatgattgtcacttgtaataaccaatttttattttattttattttcgagagctttgaaatgtacctaaagcaattcatgatcatgtgttgcacaatagaggagataaattcatcaactagttatcaagcatgcatcatagtataaacatgaatcaaaaatattacaattaatctcaaatcaacaataaagattcatgatttcaaatgatttataatgcaatatattcacaggcacataggttgaaaaacaaacactatacatatatacctactgcatttatcattctttctcaaattagctttagcacaaaacaatcaagagaattttttaacttttatttgagcctttttgctaaatttttttctctcaattattccgggtacgttcttgtcgtcaagactgtttccaaggattcggcacccattattttgctcacatcgaatacgtcattgtcgtcaagactgtttccaaggattcggtattcatttttttcatattttttattctctttgtacaatgagcaattacaaagctatttgatgaataacaattcaataaagcatatacataagcatttataaatcaaaccatatgctagcatcaatattgcatattttcttaactcaagtaaaagaattagtgtcatgcatcatctcacttaaaagcaatatctaagcttcatataaagactaaaatacacacaagctaacatagtaacaaatatacatcaattattttgctagcatgcacaagaatatactagatgtataaaacaaagctcttctttttctcatttttatttattttcagaattagagcaaatgcataaaaataaacatgaatgcatgaaaaagcacagactccccctcgaattaacctccaattctccccgaagaaaaatcaagaagaaattaaagattttgaaaattacatccaattgccaatgatatcaccaaggttctcatgacttgacatgtaaccacttgtattaacaaaaactactacctcaaacactagcatatgaaaagctaataatcgagagagtagaaccaaaaatatgtcaatctaaaagtaaattgatgttaccatgaaaagcaatcgtcatctcaacattgaatgcacatggggagtatgccaccaaaaatacctacgtacgagaagatgtcgaggcctctgtgttggggttagaaataagaaattttggaatccaacactgagtcacacgacctgtagaaccagaaggtacatatgcactaacaaaatcagtactagacttacctgaaaacttacctcgtcgtttcacaaaagtccgatttgaattacgtgcaaagtttccctgaggccggtctgaccgcccgttcaactgcggtctaaccgtgctcctcgaacaaaaacctgatttttgccaccgtcgtttcgcaaaagcaatttatctttcctttttctgtttgtgggcaagtcgaaaacaaaaaccaaccaaatgtccatcttttccaaaaaagaacaagtgtacttctcacgacaagtttgtgaagtagatggttttgaaattgatggttttacaacaacataagattttgcattcacaacatttgattccgaagaagatgcattcaaagaagacatgatgtcagcagattgaaacacagtgctcttaggctcagtttcgatcaaaatttcacctctcctagcagcacccaaaacaataggaggatgtctagcatgataagcataaaaatcaaaacataaaccacgattgtgtgtgctaactttagattgatcaagaattatgttgaggttctttttaccatcagaaaatttttgcaaagaacttttcaaataagatacctcctgagtaagaatagcacaatttttgcaagcatccaaaagacctttttgttttctacgagttgagcaagaaaacaccttatcttgtttaacaatctcttccatgtgtttaacacgctctaaagcatctttcaacctcaactcattcaaaacacactttgaacaatcttgagaaatcaaagcaccattgttttgttttgccttatttgcacatgatgcattgactaaagaacttgcacaaaaagcaactttgtattttttcaaaacgttctttgtcaaaatcaactcatcaacaacacgagcatgtaaagcaaatccaagagcaaaagaagattccaactttttagatttttcaatctcaaattccaattttttgcaattaacaaaattgacatctcgcaaagcattaagtttagaaaataaaacttcacaagattgacaattatcatcatcaggaatcgaagattttaatctatcaatttcagcatttagaatctcaatagtgtgatctttctcatcaagcacaatagaatatgtttgaagtttcttagcaaatttgtaagcagcatattctaattgatcataactaagcttttcttcattatcatcatcagattcatcaacatcagaacatgcattacgagcaataaaagatagatcaacaacttgcttacctttgcttttgctctcgtcttcatcctccgattccgaatcaatgtcacttgcacacacctgattatctctcttcctgtttctcacattattcaaagctagagaaaatttgttcgtaagcaaagccaagtcctcttctgagattttctcgagttgatcattggacgtggccattaaagcgggcaaagcaaacattgacaaagaatccaaataagaactcgatgaaaaaactaagtgttccatcttatctttccaaacatgaaaatcaattccatcaaaaacatgcggcttggttgaaattgttttagccattggaaaaactcaagatcggtaaagatcaaaaagagcaaatgtggctctgatactacttgtaggatcgaacacaagaaaccaagcctaccagaggggggtaaatggtagggaaaaccaaaaacccaaaaacttttagcggaaataaaagttaccctcaaatcgatggaaatctcgacgtagtcctgtcgccaccgcaggtcggaccgctcgcacgccgccagtcgaaccgcttgcacgccgccggtcgaaccgccgtcttgtcgccggttgaaccgtcggtatgtcatcggtagaccgccgaacccgatgaaacacaaatcgaagaactctcaaagtagatgacaactttattgcttctctctgtgtttacaaagtgcaacaacagcactccttacaaaaatctcaactaaactcgaaaccctaactaaactagcaactcaattgctctcaaaagtgatatcgaaaagcgatatcgggaaggctcatgccccctctctatttataccataaaaaccccctactcaaagtaggcgtagaactcctattttcaataggactcaattcctcaatttcctttttcttcaaaaccacagccggccttccgatcctaaaccaatcgaactcctgcgcgaaaccgactgcccgtcgatctccgtttcctgtcaacacacgtaagcctcctcctctactgattcttcacgcatgggccgtctcctcgtcatggcccatcttgccttccaaccgagccgccgttgctgctcctcccagaccaagcatcggcatgcactgatgcacacagcacacatgcacatcacgtacatgcaaactacacgctacagtacatcgagtactgtagcaaccatgtactccaccgtacatgaacatctctatcttctctcattcctcctcgcgaacaccgacgcttgcacgcacacctcgttaagcccgttgcggagatctctcccacacgatgtccatccaccgtgtgccatcttgtatccaacttcgtcacccggtatccttgaccgtctggacctcaactcctgcctgagtctagtcccgatccccaccgttgaccgaagttgacctccaagaatcctgactctagtcaacttctcacatggtatcccgaccgcactagacctctgttcctccctgaacatagtcccggtcctcaccattgaccaaggctggcctcaagtcacctgcacacaatcagacaaaacaaccgtttctgggcacagatatcacaacctgacccacattagtcacacgcactcacaccaacattcacacaaattctcaaaccaattctttgattaaatcatttgcatagccaattgttcatcacaaatgttaatcatgacaatgatttcacaatttttcttttgtgaattaaacaagtcaaggactcagcgcatgccacagatctcgggtattgccattttatctttttcatgagtcctctcgttatttgtatatcagcttggttaaaatttgaattttaaaactaaggtttagagttgattttagttgttttagtcgtagtctattttctagtattgttaaacagaaaataatagacataaaactgttgtccattcaatatttctggatacttagtttattttatatattaacagcacgataatgagctctagttttagactttccaacttaatttttagcactattgcgactgtttgagtgaatagtgggtatagaaaggtcatagatataccacagtagataaaatgtaagtaccggtagtaatatctagagataatccaagaaatactattgccaagcattcaaatccaataaataccaccgacaagtgtaagtttcaagaaatatcatcgtacaaacgactttgtcctagaaatgccattaccgctagggatccgtccatttcgcgttgttaagtgatataagatgaacaataatgtatttaactaattggaatggacgaaaccctaatgacgattgtatttttggacaaaatcatttgtacgatgatatttcttaaatctcatacttatctatgctatttcttagatttgtatgtttgtcaatggtattttttggattatctcatatatcagtaacggttgaaactagtgttcaccaggacgaaagcgactactgcttgcgacacatctcgcttccttggaggcttgtcatagtcaacggtgatgatcgccgagaaaggggcagtgagaccttggaaccttcattgtctcatttttatttctctcaccgagattgattaacaattgaaactaacaaggcgagtcttttttaatctctgccctgaacgatatatattaattaatataaattaagattctgtaaaacgaaatatcaatcactaattaaaaaactattatgaaaacaaacatagaaaagccattcaaattattcaacgttttgtaaagtctcatttggataaaagtcaagacagcatgcttttaggtcccgttcttttctccaaccaagagttggataaacattaagattttcgtggcacgcttttcaaactgttaaatagtgcgtttcgtgcgaaaactttctatataaaagttgttctaaaatatcacattaatctatttttcaagtttgtaataattaaaactcaatcaatcatacgttaataccacctcgtttgcgtaaaaaacttaatattcatcttaatcttcatcttaatgagaaaagaacaccaccttagactaaaagtttcaacaccctcctgatctctaggtgtagcatcaaaaaattaagatccgtacacgccaagtcgattgatgcgcactcggaaaaaaaattaagatccgtatacgccaagtcgatagataagcactcggaaaactttgttgatcaagcaccagaataaacaaagatcgagctgtcattttctgactatgtgttttgcatgcatccatttctagcacgagccgagaaaaaaacctcagtcgtttgtcttttatagtagaacagtttactttctctgtagccacagaagtcgtgtccatattggtttgagatcctcagataaaccggcacagaaaacattatgttcaagcgacgcataaaccgttaacaaatatacatttttccgaactacacgcaagtagggatgaaaacagacggatacggtcggattatggtattcccatatcctaacctatattgtcctctaaattaggagtcgggtacgtatggttagtgccggataatatatcactcatcccgtatcctatcccatattattttcttcgaatcagattcgaaaacagatatctatttgtatctataattcatagacaataaatataataaagtaattaaagtactaaaagagatacatcaagagaaaaaatatacaatattacatgtaagctcgtaaaatacttattaaccaatcttttatcatgtttgtaggtcgatttataatagtttttcatacatatttttaaaatatgggacatacgggcgaatacatgtcttccctttcctaacccatattttctagggttaattagatccatgccactgcaactttgccaaattaaaaaaatgccactactattcatcatatcgactacatgccactgaaaaattttaaaattggagccatgccactgccgtccttttttccatctcctatctcacgccgtctcgtttccccgtcagatgtggcgtcatctcacgccatttccctctttcttcctgcgaactcggcggccacggcgagcgctcacgggctgaggaggtcggagaggaagacggcgacgcccgtgggggagtggaggagggagcggaggaggtcgcagaggtgcgggaccgcgaggcggcatcggcatccaccgggagcttcggcagcctctgcatccgccggccgaccattcgttcctcttcttcggcgaggaggccgacgccggcggccgctgtcacatcctgatttttgtttcaggatttataaattatttaataaattattattagaatttatattaaatgttcgttaatttacaagtgaagttaaatgtgggaaataaaattttctaaatataaagcatggatggatttaatttttattaaattctccatggttaattatactctctggaatattctcggatttttcggagctcaattattaattttaatcatacaaagagaagttcagcaattatttaaatattaaattaatcattaaatggtctaattataattttgttaagtactttgagtgtccaagtattttcaggatttttcttgaaattatttgagcattggaagtatttttaacaattcaaagatcatttaagtgattattttaattgaaaaagttcaaaaaccctttccctctaggcactgacatgtggggcccacatgtcaggcccttcttcttcctctagcagccggccggccgagtgaagccgtcgcccgagccgcctccttctcctctcaaatccgctccaatccgaccccgattcctccgggtttttgaggggttttgatcctctcgttctcctctatctttcccctcaagaaacggagcaatccgttgagtattctctccgaatcgagttcgtttcgagtttatccctaaaaaccgagtttggatttttcccgagtcgattcctctcgtttggagttcgatctcttcaatccaagcttatataaagcatcccctagtcgtcctcttccgtttgccccaagtcccgagctccctcgtcgcccgtagcgctgccgccacgttgccctagccgctagccgtcgccggcgatctccagtcgcgccgcgccatcgccctagccgtcgccgccgcttgccgccgccgtctttaggtgcgccaaggtgaagagaagcccggccgcacctcctccttcgtcgccggccgccgtagctcgccgtcaccgtgcaagccgagccgccgctgccgtcttcttcgtcgccggccgtcgtcggtcatcggtagacgttgtggtgagtaccgttgggttcgcctcgtcgtcctctacgcgtaggtgtcctccaatcacccggccaaggtctctatctccggcgagcttgccaaccctagccggcctccgtgggtgacgtcatgctcacgtcatcatccttccttttctccttttttctaatagattaaatcttcggaaaatcataactaaataaccgtagatccgttttaggtggttcaagttgctaaatttttctaaaataaagatctatatattaaaattgtccataaatttaattaaatttatttaattctttttaaatgggctttaattagatttaatcttgtaaaattcataataaattcatttgaagtcggaataaggccgttcaagtctcataattcatttaaaatcatgatctacatgtttgtttactttttatgtactgtttatttggtttttattagtctttttcttcgttttgcgtgttagcttgtcgtttccgtcgttgcgaaggttcgtgagtgcgtcgaaagtgatcaagaagattaattgaagatcgattattgcaaggcaagtcacacagatcctaagcacaatcctttgagcatgttgatcctatatttaaattctctatttatttcaactgtgcatttattttcgaatgtcaccgggtggtgtgaacctattcctttgttatggccaatttgcattgaatactctattccttgataccttgggtaataaattgattagcttgaaccttatgtattggtttggttcagctaaatgttagatataattgcttagcaaagcttagaaacattagctcattaatgggatgaatcatatatactacattattatttatggttatatttaatggtcgctcacgatggttaatcgtgtgatgttaattaattgataattaaaacctggttaaggtgggttgtgagcatatggttttgatggttgtgctcatgacaattaaggaccggttcgcgagctactgttgtgaaacatttaccgtgccaaccacaagccagcgtgggcaacgactttaccttttgtatagcatggttcattatagtgtgccagactgagaagcggcgagaagtccgtgggggtcgctggggagtccatgccttgttttataagggggtgattatgatccaggaacggtgcactgttttgagttgtgttgtgcaaagggtattgtcacgattttccccctttgcaatgccgtggtggtatttcggggcatggcaacatgtgcgaaatcgtgtcttgtgggtacagtggtacacctctggccagagtaaaactattcgaatagccgtgcccgcggttataggcgggttgagcaatgtttttcgtgattagtctcacacctttcacaataattatggatgttataattggtaataatttgtttagctcctggtttggagttagatctgtacagccgggtatggttgttcaggatggttgggcctgtacagcatgggtgtgctgttcagtgttgattaaaatttctaattaattactctactgttttacttatcttaaatctttgctaaatgctgcttttgcaaatgagcctatattatgccatcctttggtatccttgtgcacttgcatatttgctgtgtggcttgttgagtatgtcatatgctcattcttgcaataataatcaaacctcagttgaagataaaggatccagaaggagaagacgtttggcttataccccagttgagctgcctatgggagtggagctgaagccatcgctagaccgttaattccgctgctgttttttttttcttttcttttgtaagtatgtaacgttattattatgatggatttgtatattaaattgtcagtttgtgtacctcggctgattcctggacgagggttttatgcacaaattagttcggaaattactagtgaatttccgggcgtgacagccgccacctccccccgggctcactcctcatgctccaccgcggcaggagagcgtcggggagtggaagtcgcgggccgacggccaacgctggccgtaagccaccttcgaattcgccggagacgacgacgatgacgacggtgacgagagttccttcccctggagatccgcgatgatgatgaggacggcgactttctggtcgccgacatccccccgcccccgtcacgccgcagctgctacgtgcccggccggcgcagcgtggcgccgccgccgtcgcacatggcgacaccgccgtgctcgacgatgcgccgggcgagctcggtctcgggagctgccgccgccgccgtcctcgacgatgcaggtgcacgacctcgccctcgcggtcgtcggagttgtaggtcgccggggagcgcagcggccacgggcggcggaggagagctcgaacggccatgtgtagacgaagctctcgcaggagctgagcagccgccatggctggaaggcgatgccaagcaacgcagtgaccagcgccccttggcgaacgtgaacttccgcgggctcatgctgacgagcgcgtttgccggcgccaccatgttgcgcggccaccgatccaggactcgatgcagaaccacccgcagctgacgagcgcgcggatgaccgccggcaagtgcgcgctgcgcaccctgaacgccgcacgcgcgagcaccgggaacggcagcccgtgcgcgcgtcctcctccactgccaccatcgcgctgacctcctcgcaacgacctccagcggccatggatggatggacgatggaacaaggaggaagcgggatgaggacggcgtgagagaggtggatgggaaaagggacggcagtggcattgtttcaattttagaaattttcagtggcatgtaaccgatatgatgaatagtagtggtatttttttaatttggtaaagttgcagtggcatggatccaattaaccctattttctaacgaattcggattcgaactcagatagtattgggtatcctattttttctcccatattcctcctactagcctcgggtcgggcggatggtcgggaaataccggccccattttcactcctacatgcaagcaatgtcgacataaataaggtatttacacagacgctaagtcagtcgtccatggagaaatacagtcgtccatggagaaatatttctgtgagtagtgagtaggatagaaccccaaccagagagaggtaaatggttggatcactaaaaaccaaaacttcttacgtaattaaaaataccctcgaattgataaggatcggtttgaccggagttgatgcgccagtctgaccgcatggatgcctctagtctgactggtgtagaagctccagtctaacagtccgttgagccaccgtcgcctgtcaccttcaccgatccaaccgctgaaatgctatcggtctgattgggtctaactgccatgtatttactggtgtgaccgtcgaacttgagaaaacataaatcgaagaactcttgaaagtgcattaaactttattgcctccattcgtgtttacaaagtgtaataacagcactcctctcacaaatctcgactaaacccgaaaccttaattttcctttaaactcaattatcacaaaatcgatatgtagaaacctcaacacctctaccatatttataccaatagataggcagtcttaatgtagcacccttgaatttttcgtttatttaaaaaatctgtcatttaaaaatctggagtttaaatttggtgcttacttgattttgtgccaaattagatctcaaatcctcccttaaagaaaccccctcaaattattgtcaaactctaggtcaaaattcaaattcaaatccttccaagtttcctcaaaattccagagaaaattagaaatgtcactgttcaaatgggcctccttttatttttcttcccctcgggcccaactcccttccactctcctctaccctcctccaccccgaagaaggctggctgttggtatttcttacaaccacagataaatccgcaagtgcacggaatacattccgctgtagcacttcaccttcatgtgaccccaaaaggatatcgaacttagggaacgtgtgtaatcttcataaggttaagactatacaaggacaacaactactggcagactagctaggctagagaggactttctatgtgttttaattatctaagctaagtaaaggtaatttccaataagttgtttcgggcaccgacccctactggtctgccagcgtggttctggctatagctctatgatgtatccgaatgtggaggattactaggacgggagtcatggctgtcactacatagcaaagacaagatcttgtcatttggaatgcagaagcaaagccatctagcttaagatttatgttttctaagattttgtcattagcagctagctttttgctaagagcatctatggttttagcctgcgcaaagacaagatctttcaaggagggttggttagaaaagttaccgttattattgcctccttggaaatatgggcgtggctggttccaccactgacctccttgtggatagaatccgtcgttgttgttgcccatgtacatcgcctcttcacggatttctgggcagtcgctccagaatgacccatgctgccgcagacttcacacgtaacgtgtgagtccaaggccttgacggtgccttgtgacctcttctcgtgatcgtccaaacgtttcatgaggagatcctgcttggcagcaagcatctccgtctccatgacggtgtgcacgccttgctgacgggtctagaatcgttccttgctctagcccatactggagaccattttttctatcaagtcgacggctcctcgaacagtttttgggaaaaaggcacctccagtcgccgcgtccagatggtcgcatgacgtgggagtgagtccattgtaaaagttctgcgggatcagccaatcatccatctcatgatgaggacatgcggccatatattcccgaagttgttcccatcccttaggaatggactcgtcccttgtctgctggaagcttgaaattctttcgcgaagggtgttggtcttacccatcgggaagaagtttgacaggaatgccttagagcatttgtcccaggtgttgatcgtggcacggttggcataaaaccattgtttcgctttcccaaggagggaaaacggaaacagccacagcctgacgacgtctggcgtgacacccttcattgtgtatgtgttgcagatctccaggaactattgcagatgtgtgttggcatccttatttgacttgccacagaatgggctagcctatgccattgtaatgaggctggacttcagatcgaaatccacgtcttccatgttgatttgtggcccagtggccatgttgtcagcgaagggagcagcgaatttgcagagggtcttatcagccaagtctcgaaggttggtggcgctggaatggctggtttctgtgttggaagagttttcttcggagcaacgactcgcgacttgacactccgaaagaaaacttctagattttctttgaaattttccgaaaagttaaaaccagtcatgcactaccctttttccacaataaatgtgaaaacaaccaaggccagcctgcaaaggacagtgattatatagaggtaaatataaagtattagtaatggtgatctcttttataaatcttccccggcaacggcgccaggaatgcttattggtatttcataacgacattactagaaatataattcctagccatggcgcaaaaatactcctggtatattatggtaatagagtttatccgcaagcgcacggatataccattatagcatttcacccgagagtattcgaatggtatcgtatttgtttaatcccgtgggaagataataatagagagaaccgtactaaaaatttatatattacttgtaataaacgaagtctaagcaagggttaatacaattcaaagggtagggtgacactaagcagaagcattcatccgcttactcatgatatcaaattaagtggaaagaatatagaaagatcctattcctatacttttagtatacatacatattatacatacatcctaattatatcattacttagctaataccctctttccaatggcctcttggtgctttgagaagccacccctgattgccgagttccttacgacaatccgtcatgaccatacaactggggctaaatttggaggagtaccatccctagaaaattaacataggactatatagcgcggaggaatacccgtactgagctgtcatcatcagcggcccacctcgcttccgcagcatataaccccaaataatgatatccaataatctaaacaccacgcttaaattaccaaatactactctaatatcatcatcataacatatagtcattgtaaatacgatcattatacccacaccattgaatctcctagataagctagcatcataacgaatatagacatataataaagttggtattcatatactcgcaaaataatataatatcaaagtagtataaagaggagtattctaataaaagtacaagtcttacaaaaagaaggaaaatatagtagagccatacccgaattcttccgaagactcgaggactgaagattctattgtatttcattttttttgcgggggagattctattatatttctattccactatactctagaaactatactaaacttaagagatgaaatgaacttcttgcttgaggtgtgtggagaaatagagagagtgaagtccttttatagcctttcaatgatggttgagatggttagaatggtcggaaattccctccaaacaccattggggagtgatccaagccgtacagaagaaggcttgtatccaacggcgccagggagggttcggccgaaccgtgggatgggccttcctggcccattttcagctggtggcctcctcttccgctcctttatgtagacttgtgaattttgggttgttttggtcgtgtcgatttggtgttttcagcccacttgtccgcaagtctaattctcgacagcgttcgattgattgatcgtccgtattgctatcgattctcctccattttgtgttcattccctgcaagaggttagtaatcctagtgctagtagaatatttattatttagcataaatatgcattgcaagcataactagttctcctttatttaggtagtattgacgggcgaaaatgatcgctaacgaccgtcaacatagtgctaagtggagtagtatagaatagtgttcggaagtcctcggaagagtttttggtatgactctagcagtttttgtagcctcttcagtaataccttccaaattaatgaaatactcttctttatatatcttcggtactttgtttagttcgagtactggtcttactttatatctgctttatgttaattgtttgggtaggctaccagagaggtgtaatggtgcgggtttaatatctgatttatcagttgctctatgttgggtgcacaggtatagagtacttcctccatttcatattataagactttctagcattgcctacattcatatatatgttaatgaatctagacatatatgtgtgcctagattcattaacatatatggagattgaaatactcttgtgcatatgcgtcccatgttcgtgtgccctcattccatagcctttcgaagtcatcgattatcggttcaaggaacacatcgatatcgttgccaggttgtctcggtccttgaatgagcatagcaagcataatatactttcttttaaagcacaactagggaggaatgttatagttaacaagcagaactggccatctactgtgacgactgctcaaatcaccaaatggattaatgccgtccgtacacattgcgaaacgcatgtttcttgggtcctttaagaattcctggtaaatcctattgattgtcctccactgtactgaatcagctaggtacctaagcatactatctactttccgttcttcagcatgccagcgcactagcttagcttgttccttattcgtaaacattctcttcatacgctccgcaattaggagataccacaccacctttgcggggcctcccctatttgacttacttccttcacctttcgctctttgctcgtttgtatctagatgccccacagacagggcagacatccaagtcagcgtattccttgtagtacaaaatacagtcgttcggacaagcatgaattcctctgacctccaggctcaacggacataatacttgcttcgcttcatatgtcgtctgcggtaaattgttcccctctggcaacaggtcctttaacagctcaagaagttatgtaaaactcttgtcggaccagccattactagcctgaaacttcatgagttccaacacgcatgacaacttgttgtggttcgacttgcatccaccatacaagggcatctgacaatcttataccaacttactaaacttctcaaaatctctgtcattgtcctctgcgtcttcaatgtcatgcaacatagtagatagacattgagtgtccaaatctatggtctctccacctaacggagaaggtacaaacatgccttcacgagctgcggcggtgttctctacattctgatccaacacttcttcagctgcggcatcaggcgcctcttgcgctcaatgcttggtccagcaagtatatttctttatgaatccttttgttattaaatgagaatgctcttctcagctatcaaggatcatcttttcattcttacagtccctacatggacacaatatgtatatgctcatcctactttttctgtcattctccgcaaatgtgacaaattcagtgaccccctctctatactctgtagatgaacgatgaacatggtacatccaactacgattcatctgaaatcaataacataggaagaaaaatatatgatgatcgatatattgagaatgaagggaagaataatgtgttttttaccttgaattttagcaaaaattcgccccccttgacccccaaccgatttgtgaacaatgaactggtcggcatggaaagccgttggcggtttggggggtatttatagacccaacacacctcaaacaggttaggtaaaaaaagtccgtcaaaggtgttggtcatacctttggtgggcttcaattgagttgcccgtcactggtatcccctcacctgtgatgggccggaaaacaaatccatcacaggtggctgcccatcacctgtgacggcccgtcacaggtgaggggataccggtgacgagttggaagaaaaacccgtcactgcctcacatgtgacagcttttcctttcggcctatcacaggtaacaggatacctatgacgggccgcggcagaatgcctcaccgatgacgacatcccgtatgacccgtcaaaggtgacggtcatcagtgaccaaatcatttgcccgtcgtaggtatcccgtcagaggtgtgaggatctggcgtagtgggcattccataatcccaccatcgatttttatttaaattggtgggcctattttacaccgttagattggatctatttaaaaagtttgtgctagagaatccatttactggaaatacttacatacgtatacgtatgaaaatatttacatacgtatatgatggagtatatctttaggtactgcttattacagaagaaacaaagaacgtacgtatgtacgataaatattagttcacttggatggaaaaatacaaaggaacatacgtatgtacggtgaacgcacgataaatatacgtacgaagttataaccgacgaaaaaaatatagacggtatttttaaaataggatcttctgtactataaaaataaaatttattgctccacaaatatagtcacgtggtgcttgtataagcactcttagaccatcacgtggcactatataatttcactatcgattttcatttaaattaatgatccgttattttatacctttacattagcccgctgccttttaatatcgtatattatatattgtggcatgccccccagcgctctgtctagaaccggtcagaccggccatacagccggtcagaccgcctggggtggcccgtcagaccagcggcatgtggccggtcataccgcccctggtaaccggtcagaccggccgcgcaacgccagtcagaccgcccatggtctgcaattttgtcaatttcgcacaaagatttaaaatcaagaccgactcttttaatataaaaaataatccctttttcacattataggcagatgcttattgtgccaaatcatttgttttagaattatcatgcttagcnatatgtctaatagcanaattatcaaaattgacaataatatccaagtatgagtcaagatacttatttagtggtccgtccaagcatttgtaaactccggcaacttgttgcaccaccaattccgaatcaccaaacgcttccacatgcttagctccaaccatctccatcacttataagccgaataataacacacttaagccaccacgtagcactcctacaaatgctcctacgccgtcgcatgacattttaataaattaaaaaattcacaaaaaaattaagagtaaactaaacatttagccatcgattttcactaatatacatcgattttcactaatatacagtagacccattgttttctaacattaaatttatttatccaagtaaaaaaggataaaaaggcccacatattcctaactcctcccatccagtacataccacgtatttcctttttctcctattttcctattatctttttgtcattagatttatttagtcaaatagaaaaggataaagaaaaagctcgcatatcacatcccctcccgtccagtacatatgtgcatacctccctatctatttcctttctctcctattttcttcttctagatagatggaaaaaaaatatttttttgataacaaattttaaacaactatattatctaaatcatatagctaattttttattggtgcactccattagattatttaaaataaaatattttaaaattgaaataactaatattattaaaatcatatagctaatattattatagaaattcattattttgtgacatatattctacggactagctattgtccacatatccatatatttttaagaaaaaatcaaatagatttttaacccttctgattaataacatccacttaaattagaaaaagttatttctaatagccctaagatgaattgtatttacaggatcattcgatctatcctgaaaaacaataatctctcatatcctcttgccttacatatacctccgaccttccctctctgactctcccatcctctcctctctaattaaattatcccatcttctatttttttaactaacataatataaaaacagtcatagctattgttttattttataactaaataaataaatcaagatcacattagctatattttactatataaaagaaaaaatacatcgtttgaaggtagacactataatttgcattgcaactaaataacaacaaaaaaataattgaaatatgtatcatgctgtactaaatcattgtacataacaaaaatcaataaacaccctccagaatgctcattactcaccgtgtatcatgtcctaaatttctaaaaaaatccaattaaattcttgtatccattatttttaactattagatctatttttatgaaaatcttaagtcgccatgtgtcacctcctataaaaaggaaataatcattgaaattcttagaaacaaatgaaacaccccatcaccggctttcacttaaataatatagaaaaaatagaagaataaaatctcctccacctcctcctcaccctcacatgcacaaaacatcgtccatcccctccctattttttttagctattatactaaaagggaaacaatcaataatattcaattttttttagaaacaccgtacaacacatgcactttgagtacgcgcacactcacccttataagaacacacatagagaaacaatctataaaattgcgtatttgtttaagatacaccatacaaacgcaggcgctcacaacgcatgcatactcacccttataaacacacacacgcacatcctacccctatgagtatcttctaaagactgggccgatatatttttgagattgacgaaatcaccacgagcgcctcgctaccaatgggtatgtcaacactgaaataatagttaaccataaatgcgagcacccatgtcaaatctaggacttaaatccgggcaggcatgttccatcacaaggaacataaccagttgagctacactcacttcgtaataatattagacattgaaacaaccataattttcaagctacatttttggaatactactatgtcttttaaactggtggaaccattattatttctaaccgttagatctatgttatatagaaaaaacagcgtgtattcatgggacatcacatttaaaaaatattactacgcaattatattttgtcattattgtattcatgttaggttgtgtgatcctctgacccactctaaatgaaaatgttcatggatggatcacctctcaaattacatcaatcatattaggctatataaacccatacatttagtgaagcctcatgtcccacccaatttatcctctaacaaaccatgataatatatatgcaattaaaaaaagaaaacacattatttttactttcgttgacatgttttctatagaaaataagactattcttttcaaataatgaagaagattataaataattgcttatagatattacttaaatattatataacataaaagtaataggttaaaaattatataagcaattaataccgacgaaaacaatttatggagaaatcgtgacaattgatctccggttaatatttcgctcttataaatgtctcatacttagcgtacgatacatatccgtgtgaatgcgcgggctaccttcctaattttaattaatagtaaactaaaattaaatatttaaataccactttagacaaagtgcctgcgcatgtgcgcgggctacttgcctagttctactaaaaagacaatacagctgggcctctgttttctctgctcgtgttagaaaaaaaaatgacaatgcatgcaacacatgctaagaaacaattgacaaaattgacagctcaaacttcatttaggctgtgtttagtaccatgtcaaaattgaaagtttgaaaaaaattagaacaatatgatggaaaagttggaaatttgaagaaaaaagttgaaatctaaagaaggccttaatcttcttcgtggtatgtaaattattagtccatgtgtggtagtaaaaacaaaacgtgtcgacttgactttttatggaaacgtatcatttgtttaagttgtcaatcaatctcggtaaaaaaaaggataaagataggaacgttccaaggtcactgcctgccatactcccggcgaccttaaccgttgactacagacaagctagaacgagcagagtactccctccgtaaaaaaaaaaaaaaaagacaaatcctggtttccgtgcccaacatttaaccgtccgtcttatttaaaaaaattataaaaaaaataaaaaaacaagtcacgcataaaatattaatcatgttttatcatctaacaacaataaaaatacgaattataaaaaaatttcatataagacggacagtcaaagttggacacgcaaactcagggtttgcctttttttaggacggagggagtacgtaaaaagggaccgagatgtcactataaaaaaataattttcgccgatgacaaaaataggttctcgctagcggctagaggtgcggccaacgacctaacgctaatgaaaataatgcattttacgccagtgaaaaacaagttccgtaggtgacaggttaagacgcggcaaccgctagcaaaaaaaaaatgatttaatttctctagtggcaagctaaagagaaccactagctaaaacattttttagagaaataaatttgaaaatagggaattgataaataacagaatgcctgatcaatcgagtatagtacaatttgataaataaattctaggctccaaaccatgaaagcgtcgacggcgtcctcgacgtggcgtggctggccccagccttggcctgctcgtcgagctgcgctggggtcaggtcggtgaggtcccgtagcgcggcatgcatggccgtcagctccgccctgacgaaccccaggatgacatccttgttagcctcgctgtcgccacgtccaggctggcggaagggagggcaaacgtcggtgatgagggggctgggtacattggtcactaactccagatctaagctccagggccatcttcaggaatttgaggccctagtgcgaaatataagttgtgcgtctaaaatttctaaattatatgtctaatatgttgctccctctctttcatattataagacactttgaactctatattttcgtttagattcactaatatttatctaaatttaatttagacatatatatgaaacacacatccatacataaatctattaaaaacccaaacttataatgtgaaatagaggaggtatttctagtatttgtcccttacgcttttcagcaccaaaatcatatttcctatctctatacctagtagacatgtctagggtcgatgaaataaacatctttatgttttaacaaaataaaaataatttggatcaaacattcaaagttcaaacaaggtccagtcacagtcaggaagatacgaagtcgatgagcattcttgcgtcggctgtcgcgggagtacactactccagttgaaggattgatcgtgttagataatgtgcaggttcggattaggagtattcacggttctgctcacatgggataaggattcattctgttgctattagcgtgtaggttgttattctgttatcgcatgtgagttatcccctgtaatccggcttggtttgttccttctttccttagctcaaagtatagctggttggacttaagtaatggtttcctttctccttcggctccggatgaaggccgtcgcgttgattcatatacttgagatcattacgtgtttcaagtctatctttcgatttcccgtatacacataggaatacaagcaggttgatgcacaggttcttagtcaagtgcatcacgtcgattccatggcggatctctaagactttctaatagggtaactctccaaaaacaaacttcttcttccatatcgcaacgtgaccattgttggtatttcttaatgacattactaaaaatacgaattcctagcaatggcacagaatagcactgatatatttatggttacagaagtaatccgcaagcgcatgaatatactattgtagcatttcacccagaagtattccaatgtatcatatttatttgatcccaagggaagatttataaaagagagaactctgccaatatcttatatatgttatatatatctatatatatatatatatatgtcaaagtctatgcaggggttactttaatcatatgggtggagtgacacagagcagaaagacttagattctctcacttaaataattctagactaatgtggaagaagaaatagaaaagtaatcattcatataattctaatacagactcaactttcgtttacatctgttagtatacagttgtactgaccaataccccgtaacagtgccctcctggtgcttcgagagaccaccctaggttgtcaagtttcttatgacaatctgtcatggccgtccaaccggggtaaatacggaggagtgccgtccccaggaaattgtcttagaaatatatactaacgtgtaggaatacacgtactgaactgttaccatcaatagtccacctctactgtctcgcagcatatatgcctaattaatgatatttaataatctactgtctcgcagcatatatacattatcaaatactactctatgtcctctagaataacatagagcaatcatttgcatgaacattaaacccaaactattgcacctctctggtgggctagtcattcaactatattgacacaaacataaagtaaaaccagtactcagacaatgcaaagtaccgtaggtatacaaagaagaatattccattaattccgagggtcttacaaaaaaggaaggaaaaactactagagccataccgaaatcttccaaagactcgaggactccgagaactatcctattccattccacttagcactagagcactaactaaacttgagagagagatcaaagcttcttgcttgagtgtgtgttggagtgtgaatgagctcctccttaaataggcaggtatgacggttgtagagtatgcgaaatgtcggaaatggcccgcaacggccatcagcaagcaatcctggacatccacgtgtaaggccaggctgaaccgacattgccagggtttggctgaacccctggttcagccgaacctgagcggcccagcaggcctccaaactttgtacaagggctgacagatgggtactcatgacggttgtgacagttatggcggtttctaggatggtttcacctgcatgtgggcctctctatccttgagcttgcttaagagtgagtttttccttttttttcttctccattaatttatgtgctaatctctgcaaacaaataatactccaagtacaagtggaaaaatattattctaaaataaatatgcattgcaagcatagctacttcttctttattttaagtatattgatggtctaaattagtctataatgaccgtcaacaaccatcttcacgtgctataggttagctgtcagatcctttttccaaatactacttttagatcttttagatctctcttattttctctttttccataaacttatttaagagagaagacgtataaaaatatagctagaaatgtaatatgctaaccatacatcaaaatattttcacaaaaaaatttggtagcacatccattcctcctcctttcactttgtagcaatcgcttgagctggaggagcaagaatacctataaaaaggatatgacctttaatactagttggtgttgaactttagtacaccagccaatacataattaatatcacgggggcctaaaaatgatttttagaactggctaaagattttaaagtgccgttgggtattttaaccagtaataaatatcatttttagcaccgattcgttttacatccgagatatttacgattttggccgatcgagcgaagatcggttctccaatagtgctcattgattccactaattaagaaccgctaactacgttgggtttagagcccagcatatatgatgagaggttgacggttaatttagaacattagcccctagtgtgaacatagccctagagttccgtggtgggcatgctagccaccatcggtcactgtcgtatatgccgtagaagtgacggcgtctcgccaatactgttatcacgccacaacaatcgaatctctcaaaaaatctcggcaaactctcacactagaaatgctgtggctttggctcagcatcgctatttatactagtggctaccagcctactagtacagcacatcgatcctacgggcatggaggacaaggtgttgctcgctgtgggcgcatcccttgtgttggtcttcctgtccaagctgatatcatcatatgccaagaagccgagactgaacctgccgccggggccatggacgctgccgctgatcggcagcgcccaccacctcgtgtcctggagcgagagcgtgcacagcgtcatcgggaagctggcccgggagcacggccccgtcatgcagctctggttaggcgaggtgcccacggtggtcgcgtcgtcgccggaggcggcgcaggagatcctcagggaccacgacctcatcttcgccgaccgccacttgaccagcaccacggcggctatcaccttcggtggcacggacgtggtgatggcccagtacggcgagcggtggcgccacctccgcaagctgctcacgcaggagctgctgaccgtggcgcgggtgcggtcattccggcgcgtccgcgaagaggaggtggcgcggctcgtgcgcgacctgtcggccgccgcagcgtccggcgccaccgtgaaccttaccgacatggtgaacaggttggtcaacgacaccgtgctccggtgctccgtcgggagccggtgcaagtaccgtgaagagttcctggccgcgctgcacgccatactacaccagacgtcggcgctcagcgtcgccgacctcttcccgtcctccaagctcgcgtcgatggtcgcgacagggccacggaacgttctcgcgaaccgcaacaaagtggagcgcatcatagaggagatcatccaagaacggaagaaccaaatcgaaacggacatgatgagcggcaacgacgacgttggcgataaggcggcggtggagagcaagtcatgctctctcgacgtgttgctcaggctccagaaggaaggcggcacgccaattccaattacaaaccaagttatcaccgttcttttatgggtgagtaagcttcacatcactgttttttaatcatttagcatgtcgtctttggtttaggaacagggtgttatttataggttagactatccattttttttaagggatggaccttttttttttttttttgagatggatggtatgattcgcatatgagtgacaagaaaaaaagtgggttggattagtccgtcaggttttgagggatatggttgatccagatcttagtgacacattcccttttaggaatgaatacagtctaactgttccaagccaaacaccctcaaaaagagttttgaggtttcgacttgtccaatccaccccattcaacaaacccaacacatgcttaagttaagttttaacttaacttaaatgaacccaacacatccttccatttaaaacttgccccatgaaattgtgtttttaacaagatatgggaacaacaacctggtaaattaattgagtaaactttccctttaatatgtgcatactcattcaatctatgtattcatggtagattaggggcaatgttcaatcatgagaaacaacattaataggggaatgaaaattacggtaagtgctacttcctccgtttcacaatgtaagactttctagtattgtccacattcatttagatgttaatgaatctagacaatatatatatatatatatattcattaacatctatatataagtggacaatgcttgaaagtcttacattgtgaaacggagggagtaatatgtatgaaatttgctactctctccgtcccacaatataagagattttgaatttttgattgcaacgtttgaccactcgtcttattcaattttttttgcaaatatagaaaacgaaaagttgtgcttaaagtacggtagataataaagtaagtcacaaataaactaaataataatttcaaaaaattttgaataagacgagtggtcaaacgttacaagcaaaaaacctcaaaataccttatattatgggacggagggagtagaaattatgtttaacatagaacatcaatgttatactatattcagtttaatggttatggtaaattgaaatattttaaaattccaaaaatattttaattttatttcttacacctaattaaaatatgtggttttaaaataaccatttatttctcttgcaagtattatatttgttttgcacattacttggatgcgtcattgaaatgtagaaagagttgttatgggtcattgacacaagtgcagaaaatatgtttctaggtggcttataacatgttttcacgggtgtttcttgacccaccttgtgagggcttgaacaaaggaagtacatttgcaggctcatgaaagaaccacacgtgaaaatggatttagacagacgtatatcttatgttcccatcagcaaaatacatttacaaatgatgatttcttatatatggtggccacctgtggatacaagtttttgcaggcggttcagttcagaaaaaccgccggcacaaaaaaaaaatctagctgccatgtagcacggcgagcccatacaaaccattgggagatctcttgtcagaatatattcacgtcaatcacattacaaattcttaaccacattcacattaactgaacattatagattgtgacacttgtgttgatcatatatatatatatatatatatatatatatatatatatatatatatatatatatatatatatatatatatatatatatatatatattatccatatccactttggatgcaaaaccccncnngnnaatgatagttttaagtcatacaaatccaatctatacatctggctcgcatgagatatatatatagcataaattctatctacgctgtcttctctaaacatttgctcaatatgaatcaatgcatatagctaattaagcactttgttttgcatcaacataccgatccactacacttctaaggctggtttcttaggtgagggttgggaaccctcacatttgacacagaaaacggagcaatggatgaatgcgtgattaattaataattagcttaaaaaaacttcaaaaatgaattaatatgattttttaaagcaatctttttaaaaaacttttgcaaaacacacaccgtttagcaatttgaaaagcgtgcgcgtggtaaacgagagagtgaggttgggaacatggacataagaaaagattgtgaaaaggctctgctccgaaaaaaatagatgaagcactaatgcttgttgtcgcaggcaatttttcctatggctgatttctctgtaatttccctatacctcccatgcatccaatatatacaactagagaagcaagagaccgagtagatctattaacaccctaaatgccaccagatgaaatcaccctcggcagtgttcaaataagcaacaaagcaagcaactgtcattatacacaagcaagcttaaatctccgacgatagccgtcgatagcagtgtaaggacaatgtaccaggatgttttgtggttatggtgggacatcccgcaggaggttgtcacttagatgcggatgcatcacctttgccggaggcgtatgggaaaagtaggatgagtggagatcttgcagggaatggcggcgttggcagagcaagtggacaaccggggtggagctcgtggatctagcgggtaaccatggtggtgctggttatttcggatagaatactactcctagacttaaatcactgaaccactctggtcgatttattatgtctaaatgatttttgcatgcagcttcttttgaaatacagctataagttaaaaatcttttcgtatgcgaatgacttagcaaccaaccgtggaaacactttatagaggcagatgcgcaccgctggttgcatgcattggtgggcttgcttgtccataaatatttagaaatatttgcgtaggtggacaacctaattatgcaggctccatgtgcatgtaattctaagataaaaatgaatttcatagagaattcacatggattctgattaaggtaaaaaaacttatctatgtggtacttactacatgtgcttcattttggttaggtatctttatccttaaaatactttcattacaagggtcactctctattgttaccatgcgtaccatgtgaccttagcttgctagatatcatgacatttgtgagaatacatagtattaaatttattagttgaaggagttattgacctaaccaaattgaaggaattatagtaagggtcactctggaattttgttaatcacaatcggccttcgtacaaaatttctataaacttttgaataaaaagtaaaaccagttgagaccacatgtcattgagaagactaatttctatgcgtccacttgtaaactactctagataccatattataagagattagattcagcatatattaatttgggttaaatatttagttttaacatatactccttccatcccaaactataagacgtgcaacaaccactaatgcaaaggccaaaaaagaattactatctcctactcattttcatcacagcaataaatacaataagtacacccgatgggattaaatcttgagggtgaaggattttaaaaacgacggatttagaagagtgggtgtgctagttaattgcttgcatgcatgcctgcacgcacgccatgtattttgaaacattgaaaaaatatatatagttgtacttatattttattaggatggagggaattattacttgcaacaaaagatttaacatatattttaatttgaacgaaagatttactagcatataaaacatggcaatatattaaaaatcaaaactttatccctaaattacatactgcctgggccggtctggtgtcatggccctagcagctggcccatccaggagtacgtgctaggaggcggggccatgggccgtggctttacgtcttcctccgcttgtgccggcggcccctcccagctggtcggtggcctccacctcgtcttgcagctccacagcctctcactctggccccccacctactgtgcctcagttgccctggccggccacactctggcacctcgccttcacaccgtgaccaggacctcgtcctcgggctccacatccatgccgtccataggccatgtacaacgctccactctgacctgtggtctcacggctcccacgtcagagctgagcccacgtcagagccgagccgagctcgtagccgaacgaggttccacaggccggaagcgcgcttgcagagggaacgcttgaagcgccgcacctaggctcgggagccgctaagccacgactcgaagactagcattggaggagtcggagccccacgtatcgcttcgtccggtcggtccccgcgtgcacctgccccaaatccccatctcgctgtggttgtcgtcgccactcaccgccgccattgtggtcgcgtcgctgctcaccagatccgccgccagatccggtgagctcatggtcggagaagcaccgtcgccgacgcttgcgaagaacggagggggagaggaactgccgtcgtcgttgtggtctcgtcgccgctcgccggcaaatccgctgctgttgtggcttgtgtcgccagatccagcgagcacgaggctgtatccgcgctgcccaactctctctcgttgtcggagagctcgagctcgagcgccgccgatcccgtcgccctctgctcacctagagagaaggaaaggggagatggggatctcgcggcggcgtgagggacaaggagggaataggtctcaccggcgagctcacggggtaggggaggggtctggtcggcaaggtggactaggagaagaaggagagcgccggtttctttggagaagaagaatacgagaatgctcagcagagagagggagagagaataaaatagatggtttctatggagaagacgagaaggctcgggagagagaataaaaaagagagggggagaggctgacagtgggtccatatggtgtttaggggtgcatatatacttcttttaattgttataaggaccaaaatataaagttttaataggttttataataagatacactatcagagctgacatataaatagatagtggctgaatgcaaaatacgttttggagtggtttccgctgtgagtagtgtgacctttgtgtggttctatcctatgtggcgtcttgagatcactggtgcctgcagtggtctccattgtgcatgcccttaggcccatcttcctccacactcacctcgccctcccttgtcctcatcatcatcgtcgtttcattgctgtcgtttatgtattaagagtaaaaaaaatcaatgaaacaaagaaatagttcaatgctcaagattgattttttagctcttacttacctgaggtaagatggagcattgtgagctcgtagtatgaagatagacagagaacctacgcctacaaaacatagttagcttttttaaaagaaaataagcaagatgattacatcctaacctctctatttagaataaacccaaccataaagttttatttacataaatagcctcgaataagggtcaagacctcctatgagattaaataagaaagcatacatataacaatattgtatacaaaaagatagtaatgttttactgaaaaaatggcatcatgctttgtacagcaggtttaggctgtatgttcaggcgcgtattgtgcaagtttaggtggtaatggataaaaaagatttctggtgattagtaaattattaattacaaaaaccatcattccaggacatgtttggggctggcacggatacgtcgtctacaacactgatttggaccatggcagagctcatgcgctccccaagagtaatggcaaaggtgcaggctgagatgcggcaagccttccaagggaaaaacaccataactgaagatgatcttgcccaactaagctatctaaagatggtattaaaggaatcgtttcgattacattgcccagtgccgctattgtcccctcgcaagtgccgtgagacatgtaagatcatgggctatgatgtacccaaaggtacatctgtatttgtgaatgtgtgggcaatatgcagggatagtatgtattggaagaatgccgaggagttcaagccagagagatttgaagataatgatatagaacttaaagggagtaattttaagtttcttccatttggctctggtcgtagaatatgtcctgggataaatcttgggtgggccaacatggaatttgccttggctaatcttctctaccattttgattggaatctgcccgatggaatgttgcacaaagatcttgatatgcaggagtcgcccggtcttgttgctgctaaatgctctgacctaaatgtgtgtccagttactcacatttcttcgagctgtgcgtaaatgccagtgtaacacaatgcatcttcaaaaagatcagaacagcgcccatagtatatgtatgtactgccagatatatatatggggttggtatatatgtgtgctgttagatatggggtcttcgcgatttcaagataacttatgtacctgagcagaaaaaacatattgagcctacttatgtacgtacttatgctcttaataattgtactgccaatgaaataattaagtgtgtatcttgtacatataaaatactaggtgacccgtaaaattacatcctattaagtacttgcatatctgtatatttgtccactacaagggattaggctttcagtgatgaactctagtgatgaaaccctcacttctctcactagtaagtggttgtatagtgacaaattattttgctgtcaccattggacggatatctagtgacaaactgttctgccatcacaatttcacctattactagtgagaaaatgtgtttttatcacaaaagatgtaaacagtgatgacccagttgtgagaatttcaggtctggtcactattgtatattaaaaattagtgataaactaccctgtaatcactaatcatatcaatcgtgaggagtgaatggtgatgaattagagtgctctcgctatcttgcagataccttgtggcaacaaagttgtatcgttgagacaagtacctgtgatgaataaatgtattcactgtttggttctagtagtacagtacaccatcactaacctccttttcatccctctctaccgctttgcctattcaacagtcaggctcacacagagcaggcagcagcacccggcggccgaaggcgtgagcctcggcacgacggaaggattgcaggccaagacgctgaggctgctattagaggtagagctgctgcaacatcaggccccgtaatggtggctacaggagctctgcgacctcgatccaacggcgggagcacggcgaacttgatacggcgcggcggggtcgcggcgagatccatcctgcattcgagttgcgtcgagttcaatccaaaccttcagagggaggttgagcagtggtagcaggacgcggcacgatcggagcaccccgggcttactgacggcagaaccagaagtggtaagttccatttcatctgcttggtgctgccggctactatatcttgatgctttgttgattagtaccatggattggctggatctgtgtgagccaagccaaaacaacagattcgagtgggagtcagttcagtcaaaaaaccaaaaggggaaaccgagagggaaacatggggtaaggtgaggaacgtgggagaaatactcctgagcagatggatatacagatgtctccagatccctatcctctttatctgaaaaaagctattatccagcatggtcagttggtcaaggagtatggattatatatctgaccgtgacttacagagtagcaacagggcccaatacttagtagtacatgctagtttctactaatcagtcaaatagggctcaatatggattagttacatttcataatctgcaagaaattaatttacttagtatattgtattaaacatataggcaattaatgtcctcaatatcaaagaattgtatttcaggccaacatatttttgctgtgtttgtgtgtaaatttgcagtaacatgaatatagtttataaattaactgtcatctacatcttcttcactttggatgtcactttcatcatctgtatctgtatactcagcgccatcactttcagaatcttcctcttcttcttcctcttcaaacatatcatcttcagaatgtgttactggttctgcttcaatgggttcacattcgactccatctttactgagaaccgtagggaagtcaccatcatcaattgtagtgtaattcaatgcagccgtgatatgctcattctcttggcatgcttcagaactagacttatttgataaagttggatcattttcttcttcttcttaggaggaaagtcatacaaatcacgtggcttcgtcttgactacaacaaaccatttagggtctctagtatctttgacataatatacttgctcagcttgtgttgccaaaatatatggctcatcaattggcaatgtacgggaagtattaattaaggtaaatctatgcttgtcctcttttactacccttttagtgtgtacatcccaccattcacatttaaacaatatgacactgaaagtaccttggtgtcttgacagatattatcaagctaacaaacatctgtcaagacaccaaaatagtctttgcttccactggcttcatcacctttaacaaagactccactgttttgtgattgaaccaacatgtctcggtccctggtgttaaatctccatccattaatcatataacttgtgtaatgggttactcgagcatcaggacctcttgctagagcaaacaactcttctgatatatctggagatcctttggaatgtttctcaaatatctggaagaatgtttatataggttataaatagttgtaaaatgtaaaaaaaaatacttttattttggcgtgtacatacaggattcttgaaccatacaaaaaattctttgtcatggcgcttttccacacctttactgttctggatgctaagttggtctttgtgaatgttgcaagacatgcacatgtatgttaaattttgacagcatttacatattagaaaatgagagtaagtagtagttgtttactctgcgtattctgatatttcttcgcaattctttagtacatatatccgagctttctccaactcattcatatccatctggcagtatttgttaccaaggagtggcctgccaacagtaccaaatatctgaaattttgtactgctgttgtcactctgcacatcctcgtttcgatttggtcgattgattcttgtttcaaccccttgcaggtacatagaacaaaaatttacacattcttgcaaaatatatgcctcagctatcgatccttcagggcgagctttgttttttacaaatgacttcaaccttcgcaaaaacctttcaatgggatacatccaccgatactggacaggttcaccagcaatagcttcctaggctaaatggattggtagatgcaacattacatcaaagaatgagggggggggaatcatctctaacttacagagggtacagctattgatgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaatt

SEQ ID NO: 46110 - DNA, 802 bp, Oryza sativa
tgctttctctcctctttcaattgcagcagaaaggttgttctcttccatacccactccctgtccaacgacttcttcttccatcacctcatcataaaccttattaagcacattttccattgccgcctcaacaacctcctctgctgccatctcagctctgtccttctctaaagtgcagttgccgagatcatcatttgctgccactcccgttcctttccctgcaacatccccttccttcccatcctcttgcatatcatccccttagctctcttggtttccctcgaaatttctttatcaacaccgtgttcctcctccttctcagcctcctcatctcgatccccatcctcctcctgttctatctccacctcgtcaccattctcgtcaacccccaatttctccacttcaaatttcaactcaaaataatgatctccaatcactacgtccagatttttcggaataatccttggatttaaaacagcaataaacacccttccaaactcacttttccttgttgttttcatatcaactgtttgggtggcccctaataaggatcccacagcccaaagaggaagaaactctctcatcttctttcgtagccaaacaccctaacccacactttcggtaaaagaaagccttcctctttctccgaccactcctcaaaaagtaaacggatgccatttgatattccactttctttcacatcagccctaccaaaagcaatggctctcttcaaatcagctctcgatggaaagggaactaagtaagagctgatatcatgctcaaccagttcccacttccactttgc

SEQ ID NO: 46111 - DNA, 4838 bp, Oryza sativa
cttttcgagcatgcggttgtgccgcacaccccccctgaacgcgtagatcaccgcgtgtgcagggatgcatggtatggtattgcggacttggcagaaccgctgaatgtacgagcgaagcgactcatcatcccctcgctgtacggcgtgcaagtccgcttcttcgcctgggcgcggatatgtgccttgaaagttcatggtgaactgttggcacaaatcttcccaggagtggaccgacgcgggtggcaggttcattagccaaccccgcgcctgtcccttcagggccatgggaaagaaattagccataaccctgtcgtcacccccagcggcctcaatcccggtcgtatagacctggagaaactcggtggggttgacgctcccatcatacttctcggtgatggtgggccggaaccttgggggccaacggacattccgaagactcgccacaaaggctctacagccgacaccaccagccgggggcacggagggctggtcctcacgtccatgtcgaggtgacactctggacgaggaggcaccctccgtttcacggggagtacgccggctattacgccggcgctcgatgttgaggcgggcatccggctccccatgctgatcctcccgagtcgaaggtgtcgatgagggagtggcagccgaatgacgtgcagccgccgccgctcgccgcgccctccgccttgatgacacggaaccggtggtggtggcgccggaggtcttggtggtggcggaccgtccaccagcacccaggcgctgctgggccgtcatgaccaagttggccacgtcgtccagccatcgctgagctggagactccgggtcatggacgacgggcgggtgacgtaggagcgcgccagcagcctgaagcgcgccctgaggcgtgctgccgtcgccgtagacgaggaggcgacgctccccatctcgccgttctcctgcatcacccacgaccggtgatgctgcggatttatcaaccctctcgagcgcctccccatgcttaggattttggtgtggaggaggtgggggagtacgagctcgacggcgtgggtttggctccccgtcgtcgccgctcacactcggagagaggtcgtgcgcctttgcttgctcgaccattaggctgaacaagggaaacttggcgcacacggaagagtatgagagctcagaaaacacacgctgagccccctacctggcgcgccagatgacggagctcgtggctcctcaccgggagaccgcgcaggcccccctttgccggttcgaccgggggcttagggtgaaatcccaagctctcgctgtatgtggaaagatcgcgaacccggaagaaacgcgagacgcaggagacgtatacaggttcgggccgctgggaagcgtaataccctactcctgtgttttggtggatctgtgtatggacaagttacaaagtatgaaccagccaaaaagatccccattctaggtgggcaaggtcctccttttatatctcaaggggataccacatgcccctctccctttccaaactggactgttcttctcttcataaatggacggagatcggtacggttgctgtccgagtgcccttctgacgggacagcccatacctacccccgcttccgccggaaacaggtgcaacgtgggattatggctgtctgtggatgacgcgaccagtgtcagaccggtcacagattagtcatccttgtctaccatgcgtcagcttagcaacgtgcatgtttgcccttcttcatgtaacatcttgcatgtaatggttgggatgaagcctggtataaatctaaccagggctaacgtgccatctctaagagataacacgctagctccggcttgagacaagtgcctagaggctttcgtcttgacgggatggggcaaggcgtgcgtcagaccgccagtcgccacctaacccgtgatctgaccggtctgtgaccggtcacagaccggataaaggaacgcgctgcactgcgctgcatgcagcgtgacacgcttgaccagactacaataaatgcggttaggtgagcactgccgtgttcacctatcccatatatgtggcgcaaacttcctcaaggggtcggggtgcctcggccctcggggccggggcaggagtaacccgaccccccctcgggagaaatcaggaggagggcagacacctcaccctcgggccgacgtcctcgaaggtgccaggccgcgtgggcgattgtgtctgcctcaagcctctggtcacgatacccccggtcccatatcaccgacagagagcatcttgcattcgagtcgatttgcccgctcccgctaggaccacttgtgcatccgctcccctggtaacatagccccatcctcctattgccccctgtggtctaaaagctccatctatatttagtttcatagtatccaacgtcggtctctcccagtggcttggtcttctagcctgcttgacaaccgccagcagatgtgcctctcttcttccatccccctcccttctcctatttctctcattccaccaagtatacagcagcaatgaggccgttaatttttcattctcccccagtgcagagagcgcttccacaatcgccctagcagaatgcaaattggctaactcgcatgttaaatcttccagatttaactccctccaaattttcttcacttccttgcacttgaaaaataggtggccaccatcttcatcaagcctgttgcaggcaacacacttggtatccaggtccaaccctcttctcttcagtgtcatgcgcagggcaatagaatcatgtcccaaccgccacaaaaagtgtttaattttatttgggcagttgaacttccaaagcttcttccatacttgatcaccggagggatcgcccgatgaggttgccggagacctggtgtcgtttcttcgctgcatagccttctgaaccttatatgccgatctgactgaaaactgccccttactgtcaaagtgccacccaacaacatccttcatatctgtatgaaccggtattgacaggatgtgttcaacatcttcctcccagaaggtttgtctcactagtggctcatcccactcccacgtgtaaggatcaatcagctcatttactcgagtaaccaggtttgtgcccctgcaggtgattggcttccttgtccaatccctcggtatccagggatcatcccatatccggatattttcaccgttgcccactctccagatcatgccatccttcaaaatttgtaccccttttaaaatacttcgccaagtgtaggacattcccggtctcggtgatgcctgcaaaattgatgcccctgggtgatactttgctctcaaaatttgcgcacacagcgagttaggttcctgcaacagctgccaacactgctttgccaacattgagagattaaaagtatatatgtctctgaaccccagccctccctctccttttggccttgtcaatttctcccaactgagccaatgtattttattttccttatcctgattattccaccaaaacctggcgatcatggagctaatctggtccgccaaaattcttcgttatgtcaaagcatgccatggcgaaaattgggatggcttgtgcaacggctttgatcaggatttcctttccagcccgtgataacatcttttccttccagccctgaatccgtttccagatcctgtccttcagatatgcaaacaccttcattttgtctcgaccgacatataccggaagacccagatatctctcattcatcgtctggcgattaatttgtaaggcctgcatgacttcatttcgcttactgttcgacgtgtttggactgaacatcaccaccgacttgtccttatttatcatttgcccggataactcctcatatagagataggatctcttgtaggcactgtgcatcacctttcattcttccttcattctctgcttgcttcagtaaggctgagaaaccctctgcacacagtaagaacagatagggggaaagggggtccccttggcgaaggcccctgcccggatggaaaacatccgtcaattcaccattaaccttgattctatacgacaccgaagtgacacattgcatgatcaaatttgtccatccctcgtcaaaacccagccgcaacatcatctcccttaagaaatgccattcgacccgatcgtaggctttactcatgtcaagtttgattgctgcatatcccaacttcccctttctctttttcctcatgaagtgtgtcatctcataagccactaaaatattatccgatataagccttcccgggacaaaagcgctctgagatggagaaatcgcatcgggcagaatacctttcaatctatttgccaaaaccttcgacacaatcttgtataacacattgcacaaactgatcggccttaggtccttgatgttctctggcttattcaccttgggtatcagcactatagttgtttcattccactcagtcggcataggagctcccctcagtactgccagggtctctttcactacttgatcaccgaccacgtcccaaaatctcttatagaacagtgatggcattccgtctggccccggtgctttcagatccccgatattatccagtgccttcttcacttcttcttcagagaaatcccttgttaactcttcattcatctcagcattgattcgctggggaacagcctccagaatttgccggggatcacgtactccatttgatgagaagagctgcataaaatagttagtaataaactgttttttttcttcctcctgttccacccatcccccatcatcctttctcagccttcctattctattacttctgcgcctctccgaacaagccgcatggaagaaagaggtgttacgatccccttg

SEQ ID NO: 46112 - DNA, 27728 bp, Oryza sativa
ggcgaggacggcgagcacgatggccgagaggacgagcttgtctgaagctgatgccatgaatatgtgagcgttgatttttgctaagttaattttcttgttgaatgcttggtactgaaacgtatttgaagcaaaagaaaaggacgtgaagacaaactctcgatcgatcactttgcaccatttttagttaattaccttgtttttcttgcaagctttgttataaattaaagctggattgcaatgatattaccttgtttttctagcttgcaagctttgttataaattaaagatggattgcaatgatattaccttgtttttcttgcaagctttgttataaattaaagctggattgcaatgatcttttatctaaaaatcacttttcgttttgtctggctcgcactggtgacatatattgtagagttttgtgaagaaacagaattttggaatagccgaaggatgtgttcgcttcaggtttatatattggatagttttatacgtggacatattgtagtgttgtgaaatggctagagtctagatctacttatttgatatcgtattggaaaaaaaaaggtcctgaaaaggtgaaaagttacatgattgttgcttgctagtcaggtcagctagttcattggaaccgaataaatcgttcacttaataccatcaaatcacaggatatttagtttgataccaccaatatatttttggcttcacggctcgccctattacgattgaattgccccaagtttcatgtgcatactactgcattcaatttcacatttgttcattatttttttgcatgttcacgtcgtttcaaaagatatatcagacacattaattgttcatggaaaatacgtatgaaagcttggagttttacccctcactatcagactttagagcaaaccctgtggactatgatgtttctgacgtacgggaaaaatgaatttttgtgatgggtttaaataaatgcacagagaaatgatatttcgcaacctcatatacatatttttagaatttaaacagaatttatttttatatctgatcataatctatatacggcttcatatgcggtttttattagttttataaaggaaaataaacatgcaaaaaaagatttttaaaagctaagttgaactaataaaccatgtatggaagttcttaaatggaacaaaagtcacgcaaaagcatgactatgtggctagttatatttggtggctggaatatattttcaacatcatgagaatcccaattgtgcaatgatgttttgacaatagagatcttacagttcctgagaaagcaatatgttatgtataaaatttggtacaaaacatcaaggaccataaaatttctcatcataataacctcactgtcactgatgaccacactgaagttatcagtactgcagactgatattggccagccatatcaaataattgcaatgaaagatgtatgtagttcaagtcttcacatattcgaacaatccgaaggttggatgatcaaggtagccaccaaacaacataagttacatatatatttcacatgggaggaaatcctcccaaacgagcaacctaaatattgaagtgcagattcaaggcaattaaatgacttaaagtgtacatgtccatacatatatacaaaccacagagtgtttaacgaccaaggatcctagctatttccagaatacactcacgaggtatccctaccccaacatgacaaacgtaacctgtagggttgggaggcagtgggaacccagcttatacagcacaagtatcaaccctatgggcatatggatcctttgctaggttgcaatgtcagtgaactgcagacggatcttctccatgagtataccgtgccaggtttacatgctgccagtcctagattgggtagcttgcgactacatccattggggtagcttactcgtgctctgccacatgatgaatctcgtgctcgtgctcatgctcacgtacatgtccaatgaaggatctctaaatgcgtgcaagttggtggttttcaaaacaaatatttagagggccacatcttgttttgattcaatagcttgcatacaaggttggcttttggggtattgtgaaactgaaattctagggacgtacatgtatgatgatgttcaaagtaatcactaagatgattggctgctataccaaacaactatagttcatagtaatcactaagatgattggttgctataccaaacaattatagttcataggaaactgccatatatatgaatagttcacggtgcacaaaataaatcaggtacatactacaaattcagagaaccggagcgtgactcttcatgatgtactgaagtgcatgcattctatccattcttagaatcttcatttgcaagttattttaatccgctggactttaattcctaaagaagcctggcttgcacatggagccggatgacacaacgtttaaccgtgcttatatttcactggtacatatctgggcattcttgacgagccatctgtgttgggctaatgcgactcgtttcggataactcatctcaacggttcaaaaagtagcccatttaagatatgaatatacatgaagacctgtcaacgatataaggtcatctttgtcgggtcgtatttctaagacgtcgcggattacctataacaggtcataaccatgcccagccacagataacatgccatccatggtgggtgtaatgagatgacccatcaaagatgagagcactcatccgtgacctatgtcttaattaccacacttatccgtgaagggaggtagttatgaaccatcaatttacatgttatgtagaccttgatgagatctataacttcaaaactgagaacatttgaatttgagacagtttacatgctcgaatatgcattataagtggagagatctattttgaataacgtatttttaattttttttaaatgatcttggatagaaacatggcctatgtcaaattcaaagggtttgatgagatctacaactttctaattgacaatatttttcatttaagattgttttcatccccaaatgtgtgttataagtgatgtgatctatttccaaaatattttttgaatttttcaaacgattttggatggagacataccttatgataaagttgtagagctctctgagctgcaactttgtagttaaaagcattctcatttaaagttatctagagtttcaaatttatgttccatattcggacaagaatagttaagagaatagcatcagatgacctatcaacatgtggtctccaggtgagatggtaaggttggtttgcatgtggtgagagatcttaggttcgaatcccacatatgaaatgcatgaatattatcacttgaaattcatgattttacaaacaactgtcacggatgactctcaatgtgacaggttgtaactagcatccgttacatcttttatttaggcctgacaaagatgattgctatcagagatggctgctgacccaacatagatgagttttcacatcactgaccaataatgcgtgacgaagcagctcgtcaagacagatgagggtccccgcccgacatagataactatatccgcacttgtgctttgtccctcagtgagtaaaatataacctggtgtacaaggctagaacaccaagccttgccattataagatgattatcaccaatctaaacttctgaggtggtattgaatcaccaagtacaaccaatttgaggccacatataccagaattacaccactactacatgttgctaaaggattgggtgttacaatcttcttctactaggtgattccacgcgctttgctgcgggaattacaaagaaattcttagtattttttttcacaatcaagctagaagtaaaaagaaaaaaatatttgaacatcaggatttatcagtcaaatgatactcgtgcttcagtgtgaatcatattgataagtatatgttaaatattgtaaaagtgatagatagatttgtaaaaatattatgcaaacatcactacaaaacatcaaataggtatcggtactatatgtgccgtaaatactgaaaccggcacctataagtcttttcccacttctgcaggttgaaatcgcaaaaaagggcacctttaagcaattataggtgccggttctaaataagaactgacatctattctataggtgccggttttcttaaaaaaacgggtgtcgattaattaaaaattgatacctataatatgttattggtgccggttttttataaaaaaccattacctactaattgagccgagctggcaaatcgatgagccggtgggccccaccagcacgagaagaagataaggttcaactcgcgtctcctgttcttctcactcccatcgtcaatcttttactcgactcgcatcccctctccttccctcccttctctcccatggccggtggctgcgccctcccctccgccagatccagtggaaggggaggcggcgggcgtctggccagcggaggcggaggcggccgcgacctcccctgccctttgcttcctctgccagatcccgcggaggggtggccctagggctgtcaacgagccgagctcgagcgagcttaccagtcttggcatgagcttgataaatagtcaaaccgagctcaagccgagcctcgtcagacttcgagcctcaagacaggcttgagctcggctcgttcgagcttcgagcttttgccgagcttcgagtgtgttatatagtgggaagtcaatccttgtcccacgctgttagaaagccaatatttgaagcagtagtactactagaatatgctatagtacatgctagcaaccatacattacagtttacatatgcagctgttacgggaaatgagtgcactccattgatggcgatgcactctatgccatgcatgcagcctttggccgagtttagttccaaactttttcttcaaactttcaacttttccatcacatcaaaacttttctacacacataaacttccaacttttccgtcacatcgttccaatttcaaccaaacttccaattttagcatgaactaaacacaccctttgttggtatgtgtgctttggtctgtatgcttgctgcctgaagttattgagagctagcaagtggaaaagtcccagctattcgagctattcgagctactcgaaaacgtctgatgcaaacaaggtagagggcatgacagcttggccagaaccagccaatgtcagagaacatcgaggatttttagagcaaatgtgagtggctgagctcgtcgagctattcgagctcgctcggtgaggcttgcaagcctggatacaagctcgggctcgactcatttagagttcgagacgagctcgaattgagcccaatgtgaatcgaggtcgagcagtttgcgagctccgagcttttttggtaaccctagctagggggcccagcggaggaggcgtcatgcggcggcggaagggagggggcggcagaagggaagggaggggggatgcaaaggcagcgagtggcaggagggaggcggctggaggccgcggatcgatctcttcccctcccttcttgtccctccctctttgtgttttgtattatttcctcttcgtgatttgttcaatgtgatctaaatgtgtttatggatttgaggcaatttagttcatgtgttcatggttttgatgcaatatttgggatcggcttgacggcttgcatcgactcaagccgattttttttggctcgtgtgcgcctcaaaggtgccggttttaaaaccggcacctttaatctcctgtgatttgtgccgccttcgtggtcccggttgggaaaaccggcatcgaaaggagtttcccaaccggcaccgaatccctattctgtggtagtgaaatgatatgacgggtgattattagatatgcttgcattttgatttgtatcattaaataaattgtacatcatgttctatgcttgcatgagattatgtaattattgctagtgggtgatgatgtggcacggttgcatgttgagttttagatttaataggctttaactttatacaaagcatagataagtggaggattagtacatactataggagttgatctttgactgataataaagggctagccagaccgaaccatcccaaacatggacaattcccatatgagctaacttacatcagactatcagagtgcaagtaaatggaacagcaaccatagtgggagggcagactgtttcagtgagcgtacataggattaggaggcactagaaaccaaacatacacacattcggaagtgatggaaatctgattgaactcacatatataggatcaaattacatatccccatgaccacccctcctctctatgcagcgacggcggcaggggtggagaaggacgccgactgccatcgtgtttttgatgttctagatgttaatgttttttatgtccctgaagttcacgtgttcacgtgttctttgaccttgtatgtgttctttgattcctgtggggatgaactggatctgctcaatggatcggctcgaatcgagttaatacattgagccgcttttttatctttaggttactggaacctcaaggtgtcggctcctaaaccggcacctatgagaatacgtcaaagttcccaactaatgagccccgattgggaaaacaccaccggatctggcggaggggaggacgcaggcgccatcgctgcctcccatctcgccgcctcccctgtggccagatttggtggaggggaggtcgtggccgccgccaccgctgcctccaccggactgccgccgcgacagagaagcgagagagagagggacaaagagaggcgagagagagagagaaagagggagagagagggagagaagagatagggccgcagatgcgcgcgaagtggataaggcccgtgctcggctcggtttggtataggtgacgattttttaaaagatcatgtcggtttttaactaaccgacacttataatatattaaagttatcttgttttagaaaaaaaagcacatatatgtagtataggtgcattttttttctttagaaccagcacctatagtcgcttaagggtgccggttttatatgttttcagctcatggggagagaaaagcactataggaggtgttggttttagcttttccggcacctataattttgatctctacgtgtttttttaagtagtgataagttaaatctttagctacaattattctttagaatataggttttcggcatatcaattcaacatagcatagctggtttgaataaaagctttcacattattaataactcctttttgatgtttttgaaattaagtgctcaaagttatattcttatatattgatctcttggaaaagtctccaatcgatattctttagtgaacaggttggagtaaaattgtaatttattgaaactagaaattgataggtacaaattactatgttatggatcaaccttaagattcatggttgcaacttctgtgttttgtaatggataattaagtaccgattaagtatgcagccttcactactatacaataatacaaaaataatggccattggaaccgacttatccatggatagttcagactatgtcactagcggttttcttaaggaatcatctgtgaaaaatattttttacatgtggagaataaatgtaccttcagggctgaggccaccctgggctcgtcacagcagggtgcaccttttattaacctacgtaaaagaattattactcgggactatgaaagtaaattttatagtaatgcttgtatgtctaattatttttggaccatcttcttatgattgaagcaaccagaaaattaattagagtttgcctgatatttaagcgatcaagttccgtaaattttaaactacatttttgttggaaatatggtcatatatcggcatattttaatccaaaatattaagacaataaccatggcatgaacaatgtggggtgatctagtgataaaatctaacataactaggagcatgcttaagatataataagcatcatgatcatacaatgaacgcaatagaattgcgactaacagaggtatcaaaagaattaacagtaagcgaaggttataccctgtgaatatccctccgctggattgtgaggcagaactgcctccgttgatgttgtcgttcgcaacggctccggctcccggtgcgcctccatctctaggagcggcagctgcggtggcaccagacatggtgtagcaaacgacgacgacgaacagaagacgaggagcagtcgtgcggaagcactccccaaaaacctgatcacccgcctacccggtgcagatctcaggcgaaggtgtggttccggaggccctgctcgttccgatctctcgtgcgcgcaagcgatcaaaagcggggaagcagaaccgtagcagcacagccgtgcgcaaggaggatgaggaagaacaccagatggaaagtaagcccggaatcttatcggattagatctttccttataacgcaggagcgatatccggccgttgccgcaataacgacgtgatcaattggaattgaatcgcctgcccgttacggaggcaatctcgggattggtccattgcaaaagaatattaagacaataatcatgacatgaacaatgtggggtgatctagtgataaaatctaacaaaaccaggagcatgcttaaaatataataagcatcatgatcatacaatgaacgcaatagaattgcgactaacagaggtatcaaaaattgaattaacagtaagcaaaggttataccctgtgaatgtccctccgctggattgtgaggcagaactgcctccgttgatgttttcgttcgcagcggctccggctcctagtgcgcctccatctctaggcgcggcagctgcggaggcaccagacatggtgtagcagacgacgacgacgaacagaagacgaggagcagtcatgcggaagcactcctcaaaaacctgatcacccgcctactcggtgcagatttcaggcgaagctgtggttccggaggccctccttgtttcaatctctcatgctcgcaagcgatcagaagcggggaagcagaaccgtagcagctgtcacgcccggaatttctatccaaaattccaaacgcttacatgtgtgttaaactctcgtccaggaatcaaccgaggcacacaatgacaaattgataatagagtacaaataaataactatttaatattcgcaaataataaaagattacagaggtagatagttcctctcaaagaataacattttacgcagcggaaagataaaactataacaaactacggaacagctatggcgactccactccacaggcatcttaaccaagaacaagcctaatcctccagatcatcaccttcactgagatactcgtcttctgatgaatgaatattacaagaatgagcatatgacatactcaacaagtcacacagcaaatatgcaagtgcacaggataacaaaggatggcataatatagctcatttgcagaaacagcatttaataaatatttaagagaatagtaaaaacagttgaataattaatcaatattaaataacaccatacaacacacccatgttgcataggcccaaccacatttgaacaaccaaccccagttgaacaaattaaacctccaaaccaggaattatccattccaaaccaggagccaaattaattatcacattattaacattgatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtgattggcacgataaatgtttcacaacagtagctcgcgaaccggtccttaattgtcatgagcacaaccatcaaaaccatatgctcacaacccaccttaaccaggctttaattatcaattaattaacatcacacgattaaccatcgtgagcgaccattaaatataaccataataataagaataatataatataatttatatttaatcccctttaattagctaatgtttctaagcatggctaagcaaacctacatataacatttagctgaaccaatccaatatataaggttcatgctaatcaaattatgacccataggaaaataaagtcatcttcggccattatttaattgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaacggaaacgctctcctccggaacgtcagaaactaaagcaattaaacaaaatcaacaaaacagtacaaaaacaagcataaacagtacatgtggatatttttaacatgtagatcttgattttagaaaaatttagcaacttgaaccacctgaaacggatctacggttatttagttatgattttccgaagttttaatctattagaaaatcgggaaaaaggaaaactgatgacgtcagcatgacgtcacctacggaggccggctagggttggcgacctcgccggagctagggtggtcggccgcggatttggagggcatgtacacgtagaggacgacgagacgaacccaacggtactcaccacaacgacaaacgacgaacgacgacggccggcaacgagaagggcgacggcggcggctcggttgaccggcggcggcgagctacggcggccggcggcgaaaggggacgggcggccgaggttcccctcaccacggcgcacctaacggcggcggcggcaagcggcggcgacgacgcaagcggcggcgcggcggcgccgaagatgaccggcggcggcggcgagctagacacgcgcggcggcgacactacggagcacgagagagctcgggagatggggaaaacgaaagagggcgacgaggtggtcctatttatagccttggattgaagagatcggactcctcccgcaagaaatcgactcgggaaaatctaaactcggtttttggggataaattcgaaacgaactcgattcggagagaatactcaacgatttgctccgaatcttgggggtaaagatagaggagaaagtggggataaaaacccctcaaaaacccggaagaatcggggtcggattggagcggatttggaggcggaaggcggctcggtcgggcttggcaagcggcggccggccggaggtaggagaagggcccgacatgtgggccccacatgtcggtgtcccacgtgagggaggggtgggcggctcggcttgagccgactcgggcagcgctgggccggcttgggccggcttgcccgcgggagagaggaaagatgttgggccaaaaacggcccaacggctttagggaggggttttggaacttttaaaattaaaataatttgtgaaatgttgtttcaattattaaaaatacttcccttgctcaaataatttccagaaaaatctagaaaatagaggagcaagtatagtatttaataaaattttatctagctcatttttatgttgaaaattttcctagataattagggtttagtttgtaggcttttaaaataatttctaaaaatgatttaaacaatgtatttttacattaggcgatttttagggcgtgacaaacctaccccccttaaacggaatctcgtcctcgagattcagaagaactggcgaacagatgaggatgagttgacttcgattcatcttctcgctcccaagtggcttcctcttctgaatgattgctccactgaaccttgcagaaccgtataacgtgattcctggtattcctctcacttacttccaaaattctgactggcttctcaacataagttaaatcttcttgaagctctatacgatcaggatctgcttcctccgtaggtacacgtaaacatttcttcaactgagacacgtggaatacgtcatgtattcccgccattgacagaggcaactctaactgataagctacttcaccttttcgactcacaatcttaaaaggtcccacaaaacgcggtgccaatttccctttggtctggaaacgatgaacacctcgtaacggcgtaacccgaaggtatacataatctccttcttcgaaagccaaatcttcaatgcatgcaccacagctgccaattctaggtcatgcgttgggtagttattctcatgaggacgtaattgcctagatgcataggcaaccacctttccttcttgcatcaacacacaacccaaaccgagtcgggatgcatcacaatacacttggaaacctttcctcgaatcaggcaaaattaatacaggcgcagtcactagccttttcttcaattcttggaaactttgttcacaatcctctgtccacttgtacttcacttccttctgaagcagacgagtcattggtctggcgatctttgaaaagttctcaataaacctgcggtaataccctgcaagtccaaggaaactacgaatttcggaaaccgtcttgggttgcttccaacttaacactgactccacattgcttggatctactgccactccaccagacgagatgacatgaccaagaaacttcacttcggacaaccaaaattcacatttactgaacttggcataaagctgatgctcacgtagtttctctaaagctagacgaagatgctcttcatgttcttcctttgtcttggagtaaataagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtctttggtatatcttcctcacggattcgaagttaataatatccagaacggagatctatcttggagaaaactgtagcaccttccagttgatcaaacaggtcatcaattctgggtagaggatacttattcttgatagtaacctcattcaacgctcgataatccacgcacattctctaagtatgatctttcttctccacaaagatgactggtgctccccatggcgaagtactgggtctgatgtatcctttctgaagcaaatcatccacctgtctcttcacctcagctaactcattagctgccattctgtacggtctcttatggatagggttggttccaggtaccaagtctatccgaaactctatgtctctcttaggtggcatacctggcaaatcctcgggaaacacgtctgggtagtcttgtactatggggatctcttgtagagcaacttggtttaagatcacaccatgagatttaggagaggacacaaagaaagaaactgtttccccattgctattggttaaagtcaccttacggttggcacaatctataactcctctgtgacgagataaccagtccatccctaagataacatctagatctttggattctagcaagataagcgaggatgggaaaggaacttcttctatttctatagtagcggaaggacaatactgtgtcgaaaatacttgattgcctggggtattaactagtaaaggtctcccaagactaataacttccatcccatgattgctcgcaaaacttttagacaaaaaagaatgcgtagcaccggaatcaaaaagcacagatgcgggtatagagttaacaggaaacgtacccaaaaccacatctggtgcattctgagcttctgctgctgcaacatgattaacacgtgcctttggtgctggagcattggagttattcggggctggagcgttcttcacgcgccgaggcttaggacacttatcagcataatgtcctggatcaccacaattgaagcacacccctggcttgcttccctgttccttcctgacgggctggttctgagctggagttgctgcaggacgagcaaccatgttgcggttgtcattaccacgattaccagtattgttgttgtagaactggcgttgggggcggacaactgatgaagatcctccttgagggtacgatggagcttgaggtcccgtaacgagacgcggcctctggttactgccctgttgtgccttgaattgggcagccctgcgcttcttctgctccatccggttatacttgtcttcctgacgaatcgccttgtccaccaactgctggaaatcccggaaatccgtagacatcaaggcataagacaactcatcattcagtccctccaagaacttctcctgacgctcttcatcggtgcgaacatcttccggagcataacgagctaaacggttgaaatcatggaggtactcggtgaccgaacgagatccttggttgagtgctctaaattctctcttctttagagctacaacacccgttggtatatgtgtctttttgaaagcggccgtgaattcctgccacgtaataggctctccttcagccctgccttggcgaaaatgatcccaccattcagcagcaggtccatgcagttgatgcgaagcaaaagaaactttctcctgctcagtacactggatcaagtccaacttcttctccaccgcatgcagccaatctcctgcttctactggattggtagtgcttgaaaaggtagggggtctcacacgtaagaaatctgccagcttgttttggggaggtgggggtggattctggttctgattgtttgcctgctgattctgtgcctgctgcactaacagattgatcagctgtgtttgttgggccagaatctgagctagcgtgggatctcctccattgttagtagctccacttccacttccacttccacttccagtgcgcgtgttcaccatctgacgataagcagagacaacaggaaagaacgacagagagacacccttagaacggagttatttaattaatttaaattctatattgctcttaactgtgtatgattacatttaagttgcattaacactgtctcaccaactatcttacactctgacaagcaaaagaactagactcatgctgttacatcccaccaatgatgtaagcaacaagtaaaacccacacactcacaagcaaacttaaacaaacaatctaatcacagtgaactacggcaacgatctaactaagcgactaatcccgccttgcgtcggaacgaagcgatggatcttcttcctctggagtagctggctctctttcttcagggtcttcctcctcttcctcatcacttatgatgtcgatgacaggttcagcacgatcgggcacagcttcacccatcacgcgaatcttcgaagctaactggagacgaggtggcggacaggttctctttcttgcagtgaggcgaagcttgggtgttggcggcggcgtttctcctttaagttcagctaattccttctgtagacggtacaccttgctctccaacttgcaaatcttgcctcgattccagttttccctgtcatgagctgctttggctcgctccacacttactgcatccatagcactaagcatatgcaccgcatgcatcagagtggcactctcttcaccatcaggacaggtataggttccatagtcttgaccatgaggcttgtgaggatgatactggaaagctgatgaatccaactcttcttatttatttcttctgattattattatcatcacattcacggagaaagcagcatccaaacatgatagatgctactagcaaatatcgataattaattatccagtaacccggataactaattaaataattaattaagcaaaggcctaattaattaattactaaggaagttaatccatgccacccccaaacatggggcagccaaagaaaccagtgtgctgcaggttgcaccggccgtagtccgtcagcgcgctcgccatcccggcgatcgtcgcggcgtcgcacccgggcgccgcgtgctgcgagatcatcccggcgacgcggtcgccctcctccgtgaccacgccacgcaccagcacgctcaacgcgtcgcaccggcactgcatcggcactgcggcgagctcccggcagcacggctccaggagctgccgcggcggctgcttgccggagtccaggcggcccccggcgacggcgcaccaccgcgcgatgtagttccggcacgatgggaccgggttccgggacaccgccttccccacgcggcagtactcgccgacgtcgccgtagccgccgtagcccgccgccgctgccgcgacggtgaggacggcgagcacgatggcggagaggacgaacttgtctgatgccaatgccatagctatacttcgatgagctttgatttgcttgtaatttagaaaatttaattttgttcttgatcacttgggattgggagtgcaacgtatttgaagtatgagaaaggacgtgaagacaaactctcgatcgatcacttgtaccatttttattgattaccttggttttcttgcaagcattctgatagattaaaggtggattgtgatgatcttttatctaaaagttacatttctttttctctggctcgcactggtgacacagatcgagctcactggatattgtggagttttgtgagctttgaagaaacagaatttggaaaagccgatggatgtttttgcttctggtttacacataggataatttgatactttcacatttatgattgtagagactcatttgatatcgtgttagaaaaaaaaagttccgaaaaggtacaaagtggttgttgcttgcaagtcaggttagttagttcattggaaaggaaaaaagaatcgttcaattaataccatcaaaatacaggaagtttagtttataccacccaacatttttggcttcactcctcactttattaccgtcgaatttctccatggttcaagaacataccactgccttcaatttctccattgttttgtcctatttcacccttctcttaggaactgaattgcatcgtaatacccctgctctgctagcatacgaattatatatatatcctaccacaattgtataatagtcccccaaaagaccttgcctcttcgtctcatgctcatctgattcagcttctgcacgataggctaatctaagttatgttgatggacaactacctcaccattacgtgttagggttaggatgcatcggaaacgaacatagatgttcgtccagtgtttgcgcattaatcaagataaacttcgcttgcaacatcacaaggaggtggagatgaggatatagccagagccgttgcacgaaacacaaaccatcagtgtcagagtatgtagccaatgtaagaggtcggtcatgattcttgaagccctgcggtacttcctattgaaagagatggaggcggtatgtatagctgattgatccgtttgttgccataggagcaaacttctctttatcccccttgactcttcaaacacctttgataaggtctttgctagaagactagagcactagacaaaaaaacaatgggattcacatgttcttggtagtttggccaatttggtgtcttctcggcatagcatgggcgaccttcggcattgaaaatactttcttggtgcttgcagcagaagaggatccgtgcatgtaggtggcagtgctggatgtttccaccgagttgcggagcattcgcatgggcagagtcacaactgcctaactaggtggcaagctcagcaacaataaccacctacttatgctatggcagcatggtttcatgtggttggagaagcggtgtaggctctatgttgccgtgtcattttttgagtgggagctgttgtgccgtgtggtgattcacacccagaaatttttccttttttcagaccaatttgtgtattaaatccttgtttaggaatcaacacaaggtacatcaaatgacatgttattgtacatatccaaacataaataaagcataaatatttacaaaagtgacaattagtcctcataccgaaaagaatgcaacggcggaaaaggactatcctagtgggtgtttagcttcagtccacaggagtactcaactagggtacaacgcttgatattttaactccgtcttcatcacagaggcactaaaaatttgagaatagaaaattaggcaaggctaagtaccaaccactgtactcagcaagcaacaccaatgatgtaattgtgcaaggggaaacaaagatagtagtcttttgtatcatgatctactcttttggataaagacaattgtaaatatttgtagttaaaaatagtaaaatatttgattaattaagaaaagattagtctccacttaacaacggtacaacacattgaacaagcccaaccaaccacctcctcataacccttccctaaccattgacaccccacactgcatgtttcgccaccatccctaaaatcaggatggacaaccccttcattatgccacggttaatctggaagctgcttagaccatcctgttcaaccaaactccttcacggccacactcgcttgtatacctatgaaaggggagagctatactaaaaggttagcaattacacctattggtttgtggtaagtacggtaagtctttcagagattcccgcaaaaaggtccatcattatcatgggtgcgaaaaattaaaaccatgcatccatagtctatcattaagacatattttagttggacaaattaggaccaacaaataatggtacaatatctcgagcttgaattaagctcgtcaatatacaaattatgagtaaagtgattatcccattagatgaactaagtatggctaagcatagcttggtcaacataattaacccaagctgataaaattattatacccaaggattgataaggagtggataccaagtaaattggcgttaagcaagtggatttagtaatcccgtatcccacgtaattagcaatatatatatatatatatattatttctaaatggcaaccatttcataaagtaggttaaacatattcaagcagggaacgtgtgactcaccttgcttcttcaattaatctagcttccatatgctttttccttgcggtcgcagtcctccagattggctaaatttagagttcatataaattagttacgaagttttagaagttttaagccatttaaatcaactactgaaattatattcgatttacgtcaacagtagggacggcgccgaccagaacacggccttccccacgcggcactactcgccgacgtcgccttagccaccatcacggcggcgagttcgatcgaacagcatgattgccgagaagacaagcttgtctaatgctaatgtgatcactagttgacttgatgagctttggttagctaattaagattaattttgttcgtgatgacttgatattgcaacgtatttgaagcaagaggaaggacgtcaagacaaattcgaccgatcacttgtgacaaattcaatgaattatcatgtttttcttgcaagctttgttataagttaaagctgcaggatattgtgatgatcttttatctgaaaagtacatttctttttctgtggctcgcacttgtgacacagattgagctcaccacacattgtagagttttgtagctttcgaaaaaaaaagtgaaaaacagaattcggaaggtccgatggatgtgttgctttctggcttaggccattcccaacctaataactaagatggtgtccatagcattaaataagttgccacctaggataaaaaataatgtggcaaatgtataaatgaagaaagagaaggaaaccatgtcttgcatgaaacatagtttctacacaacatcgaagacatcatgtgagataagtagcattaaatttaagtatggaatagtagtgtttgcattgaaagagtagtgtctagtactagtttcttgatgatgtagagtttatggaaactatgtctagtttcttgggttgggaatggcctttatatattggatcggttgatacgtggacgtattgcagtagtctgaatgaaatggctggagtgtaggggactgatatgatatcgagtagtaaaataagtgttgaaaaggtaaaaaggttaagtgattttctctcaaactttgagaggtatatagctctccatacatgatatatatgtacatctccttttaccctccataaaatggggaatcaaaattaatcgtacaagttagaatataattggaaagttatctttataaatacttgtgaaattttcttatattttctagaggtatacatatttgtgccaattataacgtatgtacctacattctagaggtatatgtaggatcgaaacacaagaactaagccaaccagagggggtgaatggttggtatacccaaaaacctaaaacttttagcggaaataaaagttaccatcgaaatcgatggattgcggtctgaccaaagtagttgcgccggtctcaccgcctgattaacgtcggtctgaccgatgtagatcgattggtcgaaccgccaagaacgtctgccgccgactcctgtcgccgccggtctgaccgccgtgtgcctgccagtcgaaccgccgcgatgctgctggtctgaccgccggtgcgccgccggttagaccgccgaaacccggtgaaacacaaatcgaagaactatcaaagtagatcacaactttattgattctctctgtgtttacaaagtgcaccaacaacattccttataaaaatttcgactaaactcgaaaccctaactcaaaactcaactcaattgctctctaaagcgataccgggaagcctcacgctccccctctatttatacatgagataggcagcctaaagccacgaaccaaactcatactaggagtcctaaacatcttaggaaacccactagtacaagaaagaaactttacataaccaatcgtaccaaatttggattccttccaaattcgactccgcatcccatacgcacacaataactccatcgaatgccatatggaatttccatcaaccacgtgcatcaactctagcctaagtatcccgcatgatctctgaccaccacggacgtcgtcttatccccaagccgactcccggtctatcaccgcaaatactctcccgagacatcgagtcacctacacatggaacaaacaaagaaaccatattccgagaccaagctatctccaacttgactcattagcagcaaacaatagtattacatatgtatagtatccatctagaagttataatcatgaaataaactcggatatccaaataaacaacccgaaactgaaaccgacatagtgtcggccggtcagaccgtgggctggccggtccgaccgtttgatcaccgccagtctgaccggcagcacctgcccggtctgaccggtcacatgaaataatgaacctgtgattcacctgtgaaatccagtcatctccaaaaccacttcgtaaataaatccaaataacagaaccaataatctccaatgcccaattgttcatcacagaataataaccaaaaacacctttgattttacagtatatacccctggattgacatggagagttatatatacctctctatacctcgcaacgactaattagacattaattttttatctaatcaatttaaccagtttaattgtttaaatctgaaattgtgagtaggtatatacctcttcaaatatggaagaaaacctcaaaagttaatggtttttgcttgcaagtcatgttagttcattggtattcaaaaaatacggttcaattaataccgtagaaaatactggatgtttagctctataccaccgatatttttggattcaccttacaacaacagaattggcttcaccttaaacatactacttccttccatttcacaatttctccgttattttgaccaattttgccatccttatccctttgaaaagataccacacatttatccaaagaaaatatacttatcggaagcttggagttaacccctctctgcagcagtgacttaattgcaacatgttgttctgactctgctagcatataccgagtacgtaccctaccacaactgatattgtctcagaaaagcaaacaatgctatttagcatattagatgatggagtgctgaagcgtataaaaggccactgcgtccatttatccatccacacgcacaacgccttgccaccagttcgtctcatattcagctaattcagtttctaagtgcaatgataatcatctaacttcaggcacaaatcaacccgatcaccattgtgcgttagggttaggatgcattcgggaacaaagacgtacgattctcttccttgtttgcccggtaagccagaaaatctctctctgcaaagtcagaaggccatggatcacggaatggtgctcggaattgcagagcacatcaaccatgtctatgtcggtcagggtgcggcggttcatgtgcagttttagtttgggcaaaaaaagaaaaaaggttatggaatgaagtacgccgcttatctttttgttcggaatgtttctaagctctgaactggtgctggaaaaccatggtagcttctgtttctttgttagtagttctctgtagtcctttcttgtacaagactttgctcctgttctaggctttctttcacacacagctaaagcaaattaccaatttttttaacaaaagaaactactaataccaagaaggatggaggcttgggcaaacttctatttattgctcgcaatctcaaatctttgaagaacatattaaatgttttactagaacacaaaataaaataaatacgggattttgtttatgagatttgtcttaaatgtatcagtgaaaacttatgttcttttacccaaaaatatattttgtgtaaaatcaaagtgtttttgattgttattctataataataattggcattggagattattggttttgatatttggaatttattttcgaattggttttggagatgattggattttacaagtgatctacaggtgctgttgttttgttgggtccggtctgaccgggcatgtgctgccggtcagaccggccagcccacggtctgaccgggcgactctgtgtcggtttcggtttcgggttgtttgtttggaattccgtgattgtttcataattatggcttctggatggatactatacgtatataatactgttgtttgctactaataagtcaagttagagagtgcttggtctcggaatatggtttctttgtttgtttcatgtgtagatgtcttgatggcttgggagagtattgctggtgatggattgggagtcggcttggggataagacgatgtccgtgatggtctgatatcatgcgggatacttaggctagagttcaatgcacgtggttggtaaagatttcatatggcatacgatagaggtattgtgtgcgtatgggatgcggagtcgaatttggaaggaggccaaatttggtatgattggagttaatttgtaaagtttgtttcttgcacaagaaggtttcctatgtggattaggacttctagtatgagtttggttcgtggctttaggcttcctacctcatgtataaattgagagggagcgtgaggcttcccggtatcacttttgagagcattgagttgatattttagttaggggttcgagtttagtcgagatttttgtaaggagtgctgttgttgcactttgtaaatgcggagagaagcaataaagttgtcatctactttgaaagttcatcgatttgtgtttgcctaggttcggaggtctaaccggcgacatatcggcggctttgcggtggtcagaccaacggcatacctgcggtcagaccagcgacggcgacaggaggcagaagcgatcttcaggcggtggaccgggctaacaacttcggtcagaccgacggtataggcgcgatcagaccggcggatcaacctcggtcagaccgatctacatcgaatttgagggtaacttttaattccgcaaaaagtttgggattttaggtataccaactattcacccctctctggttggcttagttcttgcatgagaaggtttcctatgtggattaggacttctagtatgagtttggttcgtggctttaggcttcctacctcatgtataaattgagagggagcgtgaggcttcccggtatcacttttgagagcattgagttgatattttagttaggtgttcgagtttagtcgagatttttataaagagtgttgttgttgcactttgtaaatgcgaagagaggcaataaagttgtcatctactttgaaagttcttcgatttgtgtttgcccgggttcggaggtctaaccggcgacataccggcggctttgcggtggtcagaccaacggcttacctgcagtcagaccagcgacggcgacaggaggcagaagcgatcttcaggcggttggaccgggctaacaactttggtcagaccaacggtataggcgcgatcagaccggcggatcaacctcggtcagaccgatctacatcgaatttgagggtaacttttaattccacaaaaagtttgggtttttggatataccaactattcgcccctctctggttggcttagttcttgtgtttcgatcctacattttgaactatgagatgtgtctgaaatatgtatcagtgaatcaactcattctgttagttaattataaacgataattaattaaaacaaacttgtgtggggtacggttcattgttgaaggttactttcagaaagaaaacaagaaaattaaagttgccttgttattagatatacaagcatgttaacagtgcttcccgggatattcctgtttcttggttaattattaaaaaacgaaggataatttcatgccatcttggttaatggtataccgtgatatttccatacaccatcacagtatcgtgatatgttcattgatgtctaagctttcatgatcatcagtgagcaagtatagtagttagctgttgagactgcatggtacatctgtcagattaaatggctaaacacaaatatccaggaaatgaaggcgacactaaataatttggcctgcccaaaataaactaactctaattaaggcgaaatatggcagtggcacaaacaggttgttatagcttgattcgaataagtcttaaaaattggactatgaggtaagatttgcagttgcaacttcagttaatatatgcatggctatattgtagtaattagtagagatttagggatggtaaagatataacctcactaacctcagtcaagttattggtgaagctagctagttatcacaaattgatgctatcagactgattttggtttgataaattgcatatatatcatgtagttcaatacatattaatttatatccatgttctagaacttgcatcccaaatcattgtaggatcgaaacacaataaataagccaaccaggggggtgaatggttggtataccaaaaaccgaaaacttttagcggaaataaaagttaccctcgaaatcgacggatcgcggtctgaccgaagtatatgcgccggtctgaccgcctgatgaacgtcggtctgaccgatgtagatcgatcggtcgaaccgctgagatgcctgccgtgcctgttgccgctgccggtcggaccgcccgtatgtcgccagtctgaccgccgcttgccgccggtctgaccgccggtgagttgctggttagaccgccgaaacccggtgaaacacaaatcgaagaactcttaaagtggatgacgactttattgattctctctgtgtttacaaagtgcaacaacagcactccttcaaaatttcgactaaactcgaaaccgtaactctaaactcaactcaattactctcaaaagcgataccgggaagcctcacgctccccctctatttatacccgaggtaggcagcctaaagccacgaaccaaactcatactaagagtcctaaacaccttaggaaaccctctagtacaagaaagaaactttacataaccaatcgtaccaaatttggactccttccaaattcgactccgcatcccatacgcacacaatacctccatcatatgccatatggaatctccatcaaccacgtgcatcaactctagcctaagtatcccgcataatctctgtccaccacggacgtcgtcttatccccaagccgactctcggtccatcaccgcaaatactctcccgaggcatcgagtcacctacacatgaaatgaacaaagaaaaccatattccgagaccaagctatctccaacttgactcattagtagtaaacaacagtattacatacgtatagtatccatttagaagccataatcatgaaataatcacggatatccaaacaaacaacccaaaaccgaaaccgacacaatgtcggccggtctgaccgcgcgatacacgccggtctaaccggctaccagagccaggtatgaccggtcacataaaatgacaaatcctgcgatcacctgtgaaatccaatcatctccaaaaccacttcgtgaataaattccaaatatgaaaaccaataatctccattgtcaattgttcatcacagaataataataaagaaaacacctttgattttacaattgggatggccgatggatgtggaaaaggagcacggcgccttatttgtatgttgtttgaatgaacaaggcctatgacattgcctccatcgccgtcctccctccccagtaatcgtgcagttctcgcaggtcgcccttatctaatctggtagcagttgcaaaaaaaatgttatgccgcagaatgtcactgcataaacttatagatagtgcaaggtccaattaataggagtaagttcctgcaatttcagatttgttttcattactagtagtacaaatttctcactctacttcccaccaccttactgcacgcttgcactgataaatcaggtaattgaactgcatttttgtctgtcatgtaaaactgtttgcaattgacacccacccttatatatgcagttacacgatttcattacatgatgcctattcctcagaaattacttgcacattattcagggaaccatcgatggcgcaccacaaattgaagagtcctgtgcacctaattacagctttactagttagagatgacatgtgtagtgttttggtatcttgcccaataacattcattcatgtttttattgttggacagagatttggcttgcatgatgactcatccaagaagatgtcctctttgccagctagtttagcttcttgcgcgcgagaagagtctcagctgcaactggcaaaagtacaaagcaacccaatgcactgctggaacccctctattgcaaatactagatgtaaactctctagccccacgcactacatctcatatatccttcacttcacttcacttcatttagtatgcacatattgtcattagatcaagtcttcttccctaatagtgcaactgtcttaatttttaattgtttgttgtagtactatatgttcatgggttgttttatgagagtaactacatctgcatgacatgaattaggtcttagtttataggaattgttacttgtggcatgattaattttacttcacttcatttgtatgtacatatatgttgcttctattaagttataatctgaattttaaatggagaagttgaacacctatagctaaatcttaggtgctatatgtttttcttccatattgctttctttgctcccaa

SEQ ID NO: 46113 - DNA, 7513 bp, Oryza sativa
atattttgtatggttgtggcaggataagttggattccttgaaggaaaagatagatgaatcaaaagcaacaagaaagcaacagttggaagagattggaaatttgaggagaccaatacccttcttcgtcagttgattggccttaataattcttcttttggccagtcttagtaatatgctgattcatgatgagatggttgtagtgttttagttggtgcgactttgacatgtgacttgttcaggtcagttaatttgaatgattatttggacatatgactttgttttggacggtgattgagttgtgactcgattaggatagtaatgtgccaaacctgtttattttgctattcaggacctgatgtaactgcacatgtgaaataatttttggtcagtgaagctgtcatataattgaacttgtttagataatgagcctataatgtattttaatttggtcagcgattgtggttgtatttggacaagtggctgggttggccacgtgttaattcatagtactgcagatgtcagatgtgtggatgttaattgggttttgtattggattttaactggctaaatctgtttgatatatgggcttctcaagtatgcatgacccagatgcaatttcattgtaatgcttgggcatattaggtcttttgaatatgtagagcccactcaatatttaattcaatatagatggatatagtataattgggctgaatttattaaaatctaattggacttcaaataggcctagcccataaataggtttctcagtacatgggccttaacaaggcctagcccaaagataggttgctcactacatgggccttaacaggccacatgatattttatgacgttttttagctagataataatgaatatgagcgtcacaatgttaggacggcagaaggatcgtcactagattaataacgaaaaaatagggtttcgtcatagaacaccattagagacgcatgataggtgacaaatgaattttcgtcacgtgagcgtcatagattacgaaacgtgatgaaaaattcaatgtttgtgacataaatggagtgtcatctatcattagatctcttgtagtgtggattgcaagccaatctctacaccaatgggatcaactgttgtgttggatctcgatgaagatggtgaagttgtggatcaaaggagtgtaggaacatgattggatctttgctctatctcactgttttgagactggacattcaatttgctatgtatttatgtgctcgttttcaagcttctccacgtgcttcacatcgtcaagttgttaaacgcatcatgaggtatttggaatatggtattctacatcatcttctatatgcttgagtggttattcggatgcggattgtagtgggtgtagaatttataggaaaagtacaagtggaacatgttattctcttggtacttctttgattgcttggtcttctaggaaacaatctaatgttgttcaatcaactgctgagtctgaatatgttattgctgctagttgttgttcttagattctttggcttatttcaactttgagagattatggtcttacttttgagaaagttcctttcttttgtgataatactagtgctattaatattgctaagaaccctgtacaacactcacacactgaacacattgacattcgctatcactttttgagggatgatgttgagaagggagatgtttaattggcttttgttgatactcaattgcaattggcggatattttcacgaaatcgttggattcttcttgatttgctttttttcgaggcgagttggggattgttcgtccttttggcatcaattaagggggagttttggctctctgttgcattcatgttttcttttcttctttttatttttctttttgcattcatgttttaattcatgcatggtgtgataaaaatggaaaatataaaaaaaatacaaaattgaaaaagaagaagagctttgtttgtacttttggtatatacttgagcatgctatcagtacatgttagataatatgatgactagactagcttgtatgcatgttagtttttatatgagcttttgatattgtttttaagtgatatgatacatgatacataatctttcacttgaattaacgaaatatgcaatattgatgctagcatatggtttgatttgttaatgcttatgtgtatgctttattgaattgctattccttaaatagctttaaattgctcattgtgcaagagaataaaaaatatctataagagaaaaaaagaattccgaattcttgaaatcagtcttgacaacaaggatgtatttgatgcgaacaaaaataatgggtgtcgaatccttggaaacagtcttaatgacaaggacgtacccgacataattcagagaaaaaatgagcaaaaaggctcaaataaaagttaaaaatttctcttgattgttttgtgctgaagctaatttgggaaagagtgataaatgcaataggtatatatgtatagtgtttatttttcaacctatgtgcttgtgaatatattgcattataaatcatttgaagtcatgaatctttagtgttgatttgatcttattgacaatatcttagattcatgtttacacttctatgcatgcttgttaactagattgtcatgctatctaccttgttattgcaacacatgttcttgaaatacttttgttatagcaaagcttttcgaaaaaaagaaatgttcattaactcattgtcaaaagggggagaacaaggtaacaaattgtgcataattgtcataagtagaaggaatttctttttttttcaaaagtgagagatttttctttgaaactttttggcattgagatgctttttggatttgcttcacaaaacaccacaaaccagttgttgttttccaatgattttcatcaaggggagattgtaaaatcctagagttgatttagattttgtgatgaaaatattggtggtttgctaatgttattttggagtttttttaagacggttgtttttgtgaagtggtagttttcggttgaccctggcggtcagaccggctgagtgccactggtcggaccgcaagtgttgcggcggtcagactggccgacctgacggtctgacaggcatgatcctaatcgtgttcgatttcgggttgttttgttgaatttggatgtttccttcggggatttggcttctagatggtttctataagtattgatactgttattatactaatgtgagtcaagttgggacgaacttgtgctcggaatatggtttcttggttgttgcatgtgcaggtattgcttgaggcttcgggagagtattgccggtgatagatcggagtcaacttgggagaagttgatgtccagggatcaagagatcatgtgggatactaaaggctagaggacaacacacgtcatgatgaagaaattcatatggtatacaagagggattgtgtatgtatggaaagaggagttgaatttggaagggagtccgaattcggtaagattgattgaaataaggaaagagatgagttcgatacttgcaagagagggtttcttacgtgagttaggagttctaaatcgtgttagattcgtgggctttgcacaacctacctcatgtataaatagagagggagggtgaggcctcccggtatcggttttagagagacttgaattgagacaaagttagggtttcgagtttagttcgagattttggtgaggagtgctgttggtgcactttgtaaacactagttgatgcaataatgtcgaaagttataatctacatatttgagtttgtcacctactggtgtctctgtgtcccgacggtctaactgcaggtatgcgcgtggtctaaccggtgggatagtggcggtttgaccgctggtctttgggcggtctgaccggtgaggcttcggcggactgaccgacggtaggaaggcggttcgaccaacggcgatagagctttgtcatcgactccgttcgaggttaatctttaattccgcaaaagatttttgggttttttgttttccctaccattcactctgataggtttgtttcatcttgtgcgatcctacatgctccattcactctgataggtttgtttgatcttgtgcgatcttacatgctccctccgtttcacaatgtaagtcattctagcattttcgacattcatattgatgttaatgaatctaaacatatatatctatctagattcattaacatcaatataaatgttatctagattcattaacatcaatatgaatatagaaaatactagaatgacttacattgtgaaacggaggaagtaactgttatgctaacctgctgttgattgccttcaaattcagcaagtgaatacatcatggtgatgcggctgctgctgcagtgcggcaagcacatgccggggaggcaacccggggaacggccccagaaccagtgaaccacccgatcaaggatgcacgcccgccgcacggccggactagatctggggttctggggcctgggcaccacagtaccggcgacgtgcggccagggctgtagggaatagtgctgccgctggcggccgccatccaaggtggaggtgctgtagagactcgagagattttgggcagaatcgttgtgtacagggaaatagtcaatgagatggttttgtagatgggttttggagcggagaatcacaacctcttccgatagttttgaaggcaaattgaaggagaaaaatcagatcagttttttttattagggacaaaaataaaagatatatatagacggaaatctgactaggtggaccaatctctatctctactacttagaaaatcagtagtggtggtggagagtcctgcgcaatccaacggctcacgtctttttcaggatcctccgacacatccaacgctcctccgtcagcccgcgttgctccgcatcacgcagcagtgcagcaccgcacccccacaacccacatccctctcgtcaccctatctcctctcctccctttccctcttgctgtcttgcattgccgtcgccgccaccgtcatcgtcgcgtctcctcaccatcgggatcagacgtcggccaatccctcctcgcctccatccccaatcccctcgccctcttgcgcctccatcacgaccaacgcatgccacaccggcatcgccacgccaagtgccacgacctccgtcctgcgacgccaccacaaccccaggcgtccatcctccgccgcccactgtcgatccctcgtcgtcgctccacctccaccgcagatcccctcctggaaccccctccccttcccacacaccactccctcccatcggcgcaccttgatgcacgtctccccaccttttgcccggtcgccccccgaacggatggatggatgcctccacgctgccggtcatagaagcgccttggccacctccgccatcgcttcttgcctgtctccttcgcgatcagccgtcccacacggcgtcgacgcctggagaggctctcccattggtcccgtcgatggctgcctctgatacatcacctatgatcttggtcctgtcgatgtctgcctctgctacatcacctatgattctggggtatggaataattgatttgtcttatgatggttagggattcaggttctggattttttttttttttgctttgattcccttcaggctaagaaaggaagaagtttgtacttatccagtgtttcagtatgttgtatctagaactacaaatacaaatacaaatacaggatatggttgatgatctgcaattcttcttctctatatactgtctgtgttgatcttttagattgcccaatttgggattatcagaaaatgtttctagattatcagaaaatgtcatcaatccttatatgtttctaaattatcagaaaatttcctttaaaaaatattatgagaaaatggaagtgttgtaaacatctctgcttgttttccattgccaaacagactccattttggattttattaaccaatatagtatgtattctcctggttattacaacaaatcacttgttgcactcaagtgcgagatttagccatcaaagctagatggtgtaaaaagattttgttgtttccaccatcttctgcttttggtagatggagtaaaaagattttgttttaaacctttctgatggttaataaagctgtttttttggtgatccattaagctagcagcacttaccgttcccatggactgaagatgctgattaagtcttctcccgctcactgacaacacaggtctggcttcctctaggccaatctctcccaacctccatctccaaggtagcaccactgttttccctttctttttattttcttgtgtgtttgctcctagcctcctacagacagctgcggaatcaagaggccctatggctatgtatcttaatgattactcgatttctgctcaagatgtttcctcttttatttttagattttaggattcctggtacccttactgttttagctttattcaagattaaatttctctcttttatatgctcacaacggattactacaaattgaattactgacacattaatagtttgtatttacagattgttccttcatggcaaggaagtgacctgtaaagtacagttgcaactatatattgaatagactgcagccatcttgtttgatttcatttcctttttgtctattcattcttcagtgcctgatctaataattcagaaagatagctttgcaaccctgcatagaattttcaaattcatatgaattctaatttatcttcccggggtactatggccgattcaagaagtgtcgcacagaaaggtgcacgtccttcactgttcaaggttcaaatgcgaggggacagggggtgacgagaaccgaggagacagatcacgtggtcgatttgttgtcaatcggtgtgagaggaaaagaaaaggaagaggtttttgtctgggtggggattaaagagagaaggtttaaattcaagtttactagtggtttgggccggctgcttgcaaacttgggccgtggtaaaagggccacaggaggggaaccgacgccggtacaagtcgaacaggcaagggaatgccacaccgtgcagctgtgttcgctttttacagaaaagagaagggaaagcgagagcagtgcgactgttggcttcctggccggcggcgaggggttatccgcacacaaaggagtaggagaagaggagggaggcatggcgtggaggaatgatcgcagcaggcaaggtggagggggtactagcagggaggaggtgtttcgcgatgaagatgaggctttctttagcggaagccttgaggtcggccagatgggttttcagcccgggtatggctacggtcagcaaggaggccataggagggagtggcagcggagcggctttagaccgagaggaccgcgaagcttcgggtcgcaatggggcggctatgcagggcggccgggtagagagggaccagcctggggcatccaaagaccgtggcagcagcgtcctgcaaaccgaccgatgcaagaaggtaatgagggaaggtggcagcaggggattt

SEQ ID NO: 46114 - DNA, 1684 bp, Oryza sativa
tttcagacttgctcaacatagggttagatcttgggggttcatgcagtaaaatttcagattctattttgagccttagagaagtagaagaagatagaatttctaagagtttacccttgtcgaattgtttgtgtaatgaggttaacaataagggatttagttcagaaggagaagaagagttagataaccttgttcttggtcacttatgtggtgatttagtagaagaagtcatggatgaggagaaagaccacctaagttgtggtgttcaaaaattctccaataaatctaataggaaaaatgctgagataaggaggggaaagaggaaggttagagtcgctattcgcaaaaagagggcatcatgaggggaattttatgaaatagcagaggtctgggagacttggctaaattcagatttctttcggatacctcaaaagagcaaaagctagactttattgcccttttatagacatgtaaaaatgatttctccaacgctagtcttaagagtttttgtggaggccaagatttcttttggcattggacaagacctaggggaagatcaggaggtattttgttaggaattaatgaggcggtctttgacatttcaagcgttgatgaaggtgagttttatattaagttccacattaaaaataaggatgatggctttcaatggatcctcatggcaatctatggggcggcccaagaggaatacaaagaagctttccttgttgagttggttaattcttgcagtaaggagtcactacctgttttgtttggtggagatttcaacattattagaaatccttctgaaaagaacaatgataatttcaatgagaagtggcctttcctctttaacgcggtcattgatagcttggacttaagagagttggaactttctaggtgtaaattcacttgggctaactccttgtcaaaaccaacgtttgagaagctagatagaattttgatgagtaccgaatgggaacataagtatcctctagcttcgaatcgagctttgagtacggaacgttccgaccatacaccactattgttggacacgggtgttaatactcctaaacaaccaatattcaggtttgagcttggatggttgtgaagagatggcttctatgacatggtagcggatgtatggagacaggaagttaatggggggactgagttggaaagatggcaaaataggatacgtcgggtgcgtcaatttttgaggggatgggcgaaaaatacaagtggagcatacaagaaagagaaggcaagaaggctgagaagcaatgtctatcaaaacaagagttaaacctcaagaactatctaaaaaatagattagcacttttgctaagggaagaggagataaaatggtaccaacgggcgaaaacaaaaagaattgtggatggtgatagaaatacaaaatactatcatttgatagctaacggaaagcaccggaaggctcgaatttttcagttggaacaagaggagggtgtattcaagggtgacgtatagctgagaaagtacattacaaaatattacaaaaacctctttggaccccagaggaaaataatttttctatgagggagtctagaatagaggacattcctcaagtctcaaatgaagaaaatgacatcctaacaaaggaattctcagaggaggaagtaaagcaggctatcttccaattgtaacacga

SEQ ID NO: 46115 - DNA, 1404 bp, Oryza sativa
gatcaaatagttagaggaggcagtgtggcaatcaaagtgaatgacgaaatcagaaatttctttcaaacaaaaaaaggactaaggcagggggacacgttatcaccaattctctttaatttggtggctggcatgttggcaattttgattaaaagggcaaatgaacaaggtagctttcatggggtagttccacacctaatagataatggtctatctatcctccaatatgcggatgatacgatcctttttatggaacatgatatagaagaggccaagaatctcaaacttgtactaagtacattcgagagattatcgggtctaaagatcaactttcataaaagggaattgttttgttatggtaaggctaaggaggtggagaaagattatatcttaatgtttgggtgtaattccggtaagtatccttttaggtacttaggaattccaatgcaccacaaaaaactgtcaaacaaagattggttctcaattgaggaaaggtttcaaaagaagctgaatagttggaaagggaagcatctctcggtaggtggtaggcttgtgttgataaattcagtgctcagcagcttggctatgtttatgctctccttttttgaggtacctaaaggtattcttgaaaagctagactattataggtctagattcttttggcaaagtgaagagcataaaaagaagtacaggttggccaaatggagcattttgtgcaaaccaaaggaatgcgggggtctcgggattcaaaatcttgaattacaaaataaatgtctgttaagcaaatggttatataagcttatgaatgaggaaggagtgtggcaaaatctcttgagaaacaaatacctatgaaagaaaactctgactcatgtcgaaaaaaaaccaggggattctcactttttgtccggtctaatgacagttaaaaataccttcctttcatgtggatctttaagggtctacaacgggactcaggttagattttgggaagaccgatggagtgggattagtccttttgctacacgttttcctgagttgtatagcatagtgaggaacaagaatgagtcagtagcaggtgttatgagtacaagacctttaaatgtttcctttcggagggctatagtgggaaagtatctaaaagattggttaaaggtagttgcagaggttattttagtaagtttaacaaatcagaacgatagcttcgtgtgggaggcacaaaaaatgggctcttttctgttaactcgatgtataaatctatcatgtacagctcatgtacagggacgtcattccaaaaaatgacatgatctggaaactcaaggtaccgctgaaaattaatttttttttgggtacttaagaagtagagtaatcctaacaaaagacaatttggtcaagagaaaatggaaaggtagt

SEQ ID NO: 46116 - DNA, 775 bp, Oryza sativa
cctagttattgcaaccccccaccgacgccattataatggccgcagctgcagcagaccgcgctacctttggctttgcacatatatcacggtatgatcgtcgatcgatatctgcgtgcatatgcatatggatggaggagagagatggacggaccggggctggagtccctggacccaaccaccggccggcatggcaccatgcaggtatgcatgcagcaattaagccaaccacctctcctttatcatcttcatcatggatgcacggccggcacccaattcaattcggtcgtagctagcatagcagctcaccccctctcttgcattaccattctactcgaatacccaataaaggtggtgtttgaatcttttaaagataagcattaaatgtttcacgcaaaaaaaattaaattgagtttaaatttttcgcacgaaacatgccatttagcagcttaaaaagcgtgtcatttattaagggtttcacccattgttcccaagatatactgggcgcacggaaaacagaacggtccattagcgcatgattaattaattatttactaattttgttataaaaatggatcattatgatttttttaaagcaactttcgtatagaaacttttttaaaaaatacaccgtttagcagtttgaaaagcgtactcgtgaaaaagcgagaagtggtagttgggaacacaaggtttcgaacgcaccttcagatgcataaatactataaatatatccatcctcatttgaaaaaaagaagtagaaaatgaaatatgctca

SEQ ID NO: 46117 - DNA, 10521 bp, Oryza sativa
  unsure (1)..(10521): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttgcttcttctcaagaatcttcttccagcgcttttgatcgagcatcattgtcatgtcttgccagctgatataaataagtcaatgggcaggaaatatgtcaaccaacttgaattgcacaatgaatcaactgagtgatatgagcacatatggatgcacaatggccaggtttccatagattaacatatgactggcatgatcacatgggaaaaaacaaaaacaactgttccaaaaagtatgctaaaataatcaactggtgaatatatatgatactaaattaagatgctcaacaatgtaaaacatgaaaaataatagcattctagttcataatccatggccacacgtgcattttcagcctaaaatgtgtgaggtttcatagaatacttatgccttataacccaaacctgaacagactcaagtaatgctttatactccatccgttccaaaatataaggcacaaccacccttaacccaaagatcaagaaataattattatcatctcatagtttggatcaccctaataaatataatgcatgcatccaatagaattagagatcttgagggtggaggacttaaaaaagcaataatttaatggagaagaggtcctaattaattgtatgcatgcatgcatgccttatattatggaacataaaaaaaagtagttgtgccttatattatggaacggaggaagtacatgagaaacaaatggtaggagtttgtttgaaatcatgtgaccaataagtatataaataaccatgttagagtcacgtagagattacagaagtcatttaacttattgacatatttttaactttttagtgtaaaatggtcaagtaatgccaagttaattgaccaccttaacagtggagtacccacgaacatatgtacctccttaaaaaaggtgaatctacattctagatatcccctcatgcatccttggccaagacatcattgacgtgaactgatttgatctgtcaagtcagccaggccaggtcaacaagtttcggctaagatgcgaatcacgtctcacagccctgaattcccagctaggtgcaactagtcaattgaccaattccgacttcccaaacattggttggaccggcacactagctaaggtagatggccaggctccaaccacaacatgggagtaagagaccacaggaagaaaaaagttattcacacattgtgaacatctgaatataaattaccctcgtgacctctgtggacgcatcaaaaaatagtggatatttcaccgacttgtagactaatagaaggaaaatgttattccttagctatacagaaatttaataggaaatatgctatctgaattattcacttaatagttgttttaagtggcattatgacaatgcacttgggcccacaaatttgaaacatgacatgctaatcttaactatgaagttatcataattgcctgctatggctaacgtctgctagctactgttaaaatgctacacaccgcaatgcttgactgatgcactcttctctatgttacccgaagccaatccacctcacattgttataccagcaaagaaaagccaaccctggtaatgtcactacttctcaattggatttacagaagtgttatgcccatgttaccctgctgtcaagtcataaagttgagtcaaggtacccctggactgacttggcaacttggtcgactagtccacgacgacgactcggtcgtgtgaaaacaggggattcacttatcacctttactactattatactgtactaagcactatgtgttgtataaactatggactattgagtagccagcaagacaattgagttaacaagaaataaaactaaagtactaaacaaaatgtgccaattagcatggtaaattgatgatttgctatgactaatcacgactaatcgcacaacttgctatttggtcgagtcgtagccctctagtcgtgtggcttgaccaactttacaactaatctatgactaaccaggcaacttgattatgcacgtcacaaacatgtgtaataattcaagtgttactcagatcacaacagtgaaggttgttgatgggggtggtggaggaacgcgactaatgccctccagttctgatgtaattggttggccagttaggtcacactgtgacataaatcactaaaagtgtgggaggaccaaacagtaccatctacaagagtttataaaaacaatgttcaaaccggaagaaatcataaatttgatcccaaagatggaccctttaatcagtagattgaactgaatttcagctagtgaagatcatatttactcgtaaaaatatcacatataacacaccaccaacacaaacaccttatgttgatatatgcacgggatcaaataagcacagggcatttaataatggctgaggctctatctgttcgcaacagcttactcaatactaaagagttttgcagaagcttcataatttatatattgtgggtataaaaacaaactttttgtcaaagaaaacactgctgagcagaacccaataaacatttggtaattattaagaggttccaatacatatactcttaatacttaaatttattcaaatgcactgtgttccttgattcacattaacttaattgctttcctttcctgtgcatcttcaattcagaatgaatttattttttccttgaatacacaaaagaattgcacgccatctcattaagagaagttacaaaggaagaggaacacatccaaaaacaatcacgccacgcttaaaaactaaaaaaaggatcaaaccaacaccacaaggttggactaggtgcctattgctagtgaccgaacaaggaactcacgaagcgcagaggcaacaagcccagcaccacaggctgctctcttccacagtagaacctgaacattggggcttgccccctcgaatacacattcattacagtgattccatattttccagcttactagaatgatcatggagttgagccccttattttggtcttcaggaacacgtctagtagcaccaccagttagagagaagcgcggtagacttagggccttttgggggagattaagattccgagaagctgctgctgagaagctagctggtgagaatctagagaagctgggaaagcttctagttcattttgtagattctacaattacagatctcagaatctgggtaaaaagttggactgtttggggggagcttctggcaactgaagattctaggagaagctgcagctgctagaagctcccccaaacaggcccttaggcttcgttcggcagtgagcttttccagcttataccccacgttttccacgcgcactgctaaatggtattgttttttgcaaaaaaaaacatctatatgaaagttacttaaaaaaatcatactaatccatttttttagtttttttaaagctaatacttaattaatcatgcgctataagttgctctgttttgcgtgcataggggattagttcccaacaagctttgccgaacacagccttaggcatggaaaccaacaaattcagaatgaatttatattagggcaatctactgtagtatatctctttccatacaaaaaatgaggtcgaacagaacaaaaacacatggcacatttataccgaccaaacaataattatggagccccatcctggaaactagaacaagaaagcataagcatttgatttcatatgttggagctccaaaatttaagtgccagattttatattattgagttgtgaacacaagagttgaacaattttcttagtagtttttaacagaggaaaaaaaacaataaggctcaactatgtagtatattccattattccttaccatatttcataatcatctattgctgttatcttggggtaattttactacatgcattttgattttagcactgtttggttcctgaaacttttccctgtgttgtgtttacattaagaaatataatgggggtaaacaggaagcagggaaaaacattgtttgtcacctcattcatgtgattgccatatttatacccatgatccaattttacgctttgcacgcatctgtaataacggttatctgctagcaactagcatgccaagcaagttacgtaatctgggttaatcatttattaagaaaagaataatgtatgattatatatctaaataaactttcattcttcatttgctagctatatcagcatgatttatgcatcacatgtacagcagtagttgtttttcacctccaaaaccttttttaaaaaagataattcacttaaaaaacatattagctcctaatgcatatgcttttgcaattaaaagaagtccataatttctattatttgatcaattgcttagattgatgttgagcatcttgaaatttggattaaaattccttttggttgaagtcaactaaatagttgcatatgtgctgccacaatgtttcatctagtaatgacagatttcctaggtccattgcactacattaggtagcacaaaattaggtcacatagcaagaacatgcatgggaacaactttcaccaaattaaactatatacttgtccatgtaacctttaaagaaagttcactttaagccccaattgcatcaatcacacccacccttttgcaaacgtgatattgcatccaataaagattgaaatacacagttgacatccacaatagggcaggaaaacgatttagtggcaatggctaggcaaagcaaaccataatgtatgccacttatagtgaccttcccatagcacacgatagtacacacacgttgccagaatagaaggtagtttacaagataaagattgaatggatttatttattactcatgcattggatgagaagaagaaatttcagggaaatttttgtcttggatggaaggttttgctatggatgaggaataccaccaaaaaaaataaaaaatctactattccctgtacaaatatacctaactggacaaacacctagatccaatacgatgcatccacgaggggtatcaagcacgcaaagggaaattatctatctacacacacacagtagcacccatctagggagtacatggcaatcaatcgaaagaagacgataaaattcagatgaatcaagacgtcggagggggaggagcgggggatggaggagttggaagagcttactagtgggggagggacttgatgttggaggcgagggcggaggcgtggtggtggacgcaggcggcggcgccgagggcgaaggcgccggtccaggtggtgaccagccgctgcgggtcggagtgcggcaccccggagtcgcccctgtacgcccgcgcccagtagtcgtcgaactcgcccatcctcctcaccggaaaacctcggcctctctctctctcttctcctcctccggccggcggcgctaactccgggaagggattgggttaccacgcttcaggagaggatgtcctctcctatagacctgtggacttggtctatggaagatcgccttgggcccacgagaacgtccccgagcccgggcctcatgctcatgggcccattgggcccatgtggatatggctgaatagtgaatatatctatttgatttttgaaaagactagctaaatacacatgctttgctatggataaaatgcattttttgcgaaatgttctacccattgttctgctatggaaaatattcaccttgatttgattatatagatcgctatccatttagattgattattagttttataatgggagtagttggggtggtagatttaccgtcaccaccaccagagccttttaaagtagtacagattttgaatagggtttacaagtcgagtaggaattcatactagagagattttcttcaagcaaaagttttaaatacagataattttcctagagaagggtttcaattttcacatgagagttttgaatatataatggtttattagtttaaattgatttttctatttgtatttttttccaaaatattttcattcccagtttatagtgaaattcatctgtagatgttttactttagaacctcctatttaaaaaaagcgggaaactcatcttcaaaattcatgctaaaaggaaagttagtaatatgaattcaaaccctaatcaagaaaataatattaattcttgaacttgaatttaatcactgacatgttaccaacatactcccttcatatgatattataaggtgttttgatttttttctaagtcaaacttacttaagtccatctatgtttatagaaaaacgtagcaatatctacaatatcaaattagtctatttaaatatatcattgaatatattttttatactatctttgttatgtgttgaaaatgttgtggcattttctctataaacatggtcaaaacttaaaaaaagtttaataataaaaaagggtagaacattttataatataaaacaaagggagagggagtactttgattcctcgtcttacctttgtaaaccatgagccaccattcttctgtcatccagtcatcctctttagctatcatccagtcatcctctttagcgacattgactatgctagaattgtatttgggcttttggcccatacggagagtagttaaaataaaattctcaaaggtccaccttgtgggaggtatgcatgtgaacttcggtattacctttctagttcaaagatagtggtacaattttaaaagaggtggtgtctcctcgccacttgattaatgtgtgtggttgagaactagataacatgcactgcttgctaacctcacctcattgcgatgggggcgctcggcacttgcatggatggtgcgctaaattttgactcctagtaatggtcacaatctatctaggagtagttcggttatgagttgtggagatcatgtatgtcttgatcagatgctctgatatctttatcattttgagcttgagccaagcttcaagcaagttaacaaacctgagctaaaatttcagccatgtcaatcatgtatgccacctcgctctgctcactgcttgtgcttcgctccaccctacgcttcatttatgataggagaggaaaggtcctattgtgtggcaactgtacccaattcttttgttcgcctgctagtgacgtcatccctcttaatgagcaaacaaatcgatgttttatccctcttaatagtatgtcattcctatactcaaatgcaaatagaagggaattatgccaataggaaaaccgtcatgtcatcttctatatatgtcttgagcaaggttttaaatagcgggctaaggctcttagcggttgagccttgaaacagctaagggcagctttagccggctatagctacagttaaagcatttagcagttttgtaaaatatgagaaaaaaatcaaaaatttgatagaatttgagctaaaagttgacatatcacttatttcattgcacatagagttcatcaccaattcaaagttcatcacaaattcatacttcatacatagagttcatagttcctaactcatacaatcatactttcatagttcatactagaacatacagataccgggcacttgagttcatacttcatagttataaatttaacagtttatagtaaacaaataaacatgccacttgagttcttgacacaaataagaaacagttcatcacaagaagtcaggaacatgaccattaattaacaaaataagaacaacaagttcgtagattagaatattgcattccactaatcagattcaaagacaccatgagacttatcagaatcagaggatccctctgaaacatctccagcgccattgccatcaccatcttctgagtcagatgatgaaggtccgggctgcattgtaacatcattcatcaaagagtgcacactcctgattttcttctttttagggcgcacatgcctcttcctttttccttgagcctgtgatgtttctccctgtgatgctccatcttgtggatcatgttcagcaagctcattagaaagaggtacaataccagtaatgaactcattctcattatcagccacaacatcatttacttccttctctaaaggatccctgtctttgctgcctctcttgtttcttatagtttggagttaaatttcacaaagacaagatctctcatcctatcatgaagtagcttgttgcgcctctttgtatggacctatgaatacaaattatagatagataatttaaattactagactagcaatgtcaatgttttggggcaacaagtagcaggtaactcaattctcaagcaatcataccaatctgaaattatttctcaaacatataaacagctaaactatcaacaaatctaaatgtcatgtcatggtgagttctaagcttttacctgttcaaatacaaaccaattcctctcacaacctgaggagctacatgtcaaattcaaaatccttgacaccaatatcctcaaattgggaatgattgtgccatggttcaaccaccactttgctgcacaacaagttaaagttaaacaacgaagacaaaaaaaaaagatgatttccggcaatcatattaggttcagttcttcacttggattaaaattcttgtttctcctctgcctcatggcaatttcctttccaaatgtcccttgttgttcttgatacatgttgagttctgtaattataatgtcttgggttgcctcatccttaaccatctttgaaacacatgtaatcacaccttctctaaaggatccatcatgctcaatatctgacttatttgggtagtaaaagtatgggttaggggtaggagtcaccgctgctgcttgggggcaagagccactaccgtcgctggtcgcaatagccccgccgtcgccggtcgcaatcactgcccctgccgccactctatgtcacagccgccgggagaagtggagactgcacgagtggggaatggggatggaggatttagggtttaggtatggtctttggaccttgtgggcttcacaggccacacatgtcaaaagcccattttcattttatctctttatccaccgctaagtgcggctaaattccggtgttttagcggctatctccggctaaatgcagctattagcggccgataatatgtagcgtcaaactccgctatagccggagatttagaacattggtcttgagggatgtcagtgctaaaaccattttgctttgtattcttcaaatgattgatacggttacttgtagttttaaaagacctcacattgtccatcacgacaaagccttcactcactatttattattgtatttggtcctttagtgctaagcaccttggctgtcagcttgtccttcaccaccgcatggtccactatgacggagcgaccgagcattgcctgctcttcactatcttgccatagtacagtgaagttgttagttccaacgatccagttgtcaacctccacttgttacaaatcgatcgtatatatgaaaatctatgaataaatcaatgagtattaatcaacaccataagtggtatatactcaaatataagctcaaatggaaaggtcccaattaagtgtatgtgaataacctgaatcaaatacatgcataaataaggtataggatttgctctacataaatctatgcatacaaaatatttgtgtgaagtaagagtatgcataaatagagatgagacattgggagtttattgtcatgaccaaaaaatttagccaattttcatattattttgtgtattaaatgtctatccttgaatcaagccagggtacacaaaatggtaaattaataagcagatcgaaacgtaaataaaacataaatatttatagaagaggcacttagtcctcacacttaaaagaaattagcaacggaaagatgatcctactgtgacttcagctccattctacattagggtataagtcttagccctttaactctgtcttttaaatttaggcacttaacttctaaaagggaggaaatatattaaggttgagtaccaatcactatactcagcaagtcacaccaataatatagttgtgcaagggaagagaaagggaggtttatggatcttttgtataaagacagttgtgtacatttgtagtttaaaacagtaaaatttgattaattaaggcaagattaatctctactaaactacattacaccacgttgaacaagcccaaccaacaacctgaactacaccggttcattatgtaaagctaattaaggagcagg

SEQ ID NO: 46118 - DNA, 7881 bp, Oryza sativa
  unsure (1)..(7881): unsure at all n locations
gggcttttagaaatccagtggatatggatgtggatgcggatagtatgatgcggatgcggatatggtatctctaaaatccggcagatgtggattatccgacattttggtcggattatccgataggtcgtttgccaaataatccgaaattatcaacatatgcaaccactctatctattgtataaacataagttggtacatccaatgggctaattcatcaattaacatagtttttttagtctaaggcttttatcgtctcatatcacactcgcgtagctactccctccaggttgataatacttgtcgttttggacaaggacacggtctccaaaaagcaactttgacaattattttccattataatatgtatgaaagtgttaacaaatatatgattttattaaagtactttttaagactaatctatacaagtagtcaccatatttgaaagacaaatattttgaaaatgattcataatcaaagattataaagtttgacctcacccttatctaaaactacaagtattatcagcccggagggagtatattttatattatggacatcatgtatgttgtttagcacttaatcatataattattacgatgggtcatttattgattatagtattattgttccttgcattgctaactcgatgttgcattgattgcatatacacgtaacatcagataaatttaatccatttcccaaattggatcttggcctcaactgggggaccgcaccaaagatgtcatgtgtgttgaacaccatgcaccacaagaaaaatgctttgtagaaacatttttcgagtactatagacacacttttcaaattcctttacaatactgtggaggcattttaaaagtgcccaataagtgccttatggtgaattgtctctacaaacgaagatgcattttataaaatgtctataacatggtagaggcattttctagagacattaaattgtatcacaaccatatgaaaccaatgtaaaaatgagaataaaatagtttcccttgtttttgccaatccttgaactcatgacctgttaaacaaatcattcttatcttcaaggcattaaccaactcaaccccatgtcattcattgtatgtttgtgccttaacttacttatatatttagtcatttagtatatatttttattctaagaagtatctctacatagtttaaagtgtctcaagcaaatgtctttacatgttaagcacattttaaagtgccgaaagaatgcgtctacaagataaaatctaataaaatgtgctaaaaatatttctaaagtgtctctagagtaaaagttttctagacaatttttaaagtgtctctacactataaaactcctgatcttagaggcaatatgcaaaacacctctacaaaagtgtctttatataaggttttttgttgtagtgatggccaccagcgcaacctcttggcccttgccaccgccacttccagatgtcatcatcatcgtacatcatggccaccagcacagccttgacccttgtcgtcaccattgccaccgagaaggaggaattgggagtgtgttgaggttgcctgcttttcccccgtcagatctagataacaacctcatctcctgcacgcccatgatgaactggggctgccactccaaagaggggctcagtgactggtgctaccgtcaggagaggagctcgctatccatgattgctggtgtagccatggccctcgccgctgtcatcgacaaggaggagaaagtgagaggtcttcgaggttgttggctttgcccccaccagatttggatgttgagcttgcccacgacgatctcgggtcatcgctcttgacaagggctcaccgcctagggctaaggagaggacgacgatctcatctagaaaggagagagagggtgtggaaggtgacctcgacaagaaaagaaagaaaaaggaagggtgtggattgtaacatcttgtttgtgttactaaaaatgttgtaacactttttggcatgctaaacactggttacgtactactagatactcttgcagtaacatgacctataagaatacttattggttgtgttactggaaactacaataacacctctttagttatatatatagtagcataaactacaataacacttttttagttactgtatagtagcacatgcttagcccatccccaatccagaaactatcaagtagttttcatacttaccatgttatatagacactacataaaaactatgtatctaatggatggtgtctcaaaattaaattatcatccaatcatctctcttttctctccttttatccatctatccccttgttttcattcttggttcttgtgtagagatggtttcttcatctttttatctctcttctcattaactcttttgctatattagatttttgcttatgtgacaatgtatttaatactatgggcactatatgacatcgagggttggggatggccttatgttactacaacccagtcctagggtagagacccttaagccttaaagcaagtttaatagtatagctaactaaagctaacatatataatgggttaactataaggttcactctattttttccctctcctctctctttttttcactatgaatttaatataaatttcttggagtaagtgcatagctaatttctgcatgagatttcaagtttaatagtatagccaactactagctccaaatcatctatagccaatttaatagcccattaatacaatagtttcctacaaatatatactacaccaataatatatagtcctgtctcatacacacacaacgtttagaatccctgttacagttggctataaatctgttgcccgctttccttccttctcttctcttctctcctctatatgtgcttacagccgacttgtagcttgctattgtactcgctttgagagccaacactattcacttttctttatctttcccttccacataagtttatactagttggcttacggtaagtactataaaatatctttgtcggaggcgtagttggatatggctagaaaagagaatcgaggtggtccaaagtgaaaaaaaaagagagagtaaatttaactagtccaaagcgataatattgagaaagaagatgaaagaagatgaaagaaaaaggggattggagaaacaaataaaataaaatcatttggattagtatactagagatagtgtagatgtggtgtatcgtttatatcacctcttatcttacattacatatagaaaattagggattttttaagagtacctttgggtggatgttggctgtctatgagatgagatcgtacggaggagatcaatttgtactacagatggtagcaagtgtagtaggtgtagtaaaagggtaaatgtggaaaaggaattcgtgggactgtttaactttgcagttaatagagggtgtaatccgtaatttaatcacgggagcaagcctggcacttggcccagttggttcaggggcggatgctaggcttccgtcgagacgccgtcgtgatgtggaggccatagatcgctcccgccgccgccgtcctcttcatcgagcaaagcgtgagacacagaaatcaccgtgtcccatgccatcactggccgcccttgccttcctgcagtcgcgctcgcttgcgtctcccctgtgggctgcgaccagaaagctcctatgactctcctctcaaatactagatatcttaaagctcctagctttgccgcaaccagggcgatttggactccgtcaactaatcgtatcgtgacacgtatctgcaaacctagttgatccacgccattaatttttgcagaaaagcccttataattttggtatttacgattgagtccatcgaatcagagccgttcgatctcacccgtggacataatctgatcgttcgtctcctatctagatggttccgtccttacccagacgtggaatccacgatctctcgtctctccacgtcgcatcccaatccccatctcgcttctcgcttctttgaccggcggcgccgatgctcctccgccgcggcgccgcctcctcctcctcttccatggcctttccagcgccatcgttttacccgtcctccaacagtgcttccctaaagtgtacggtggtggctgcgctcgatggaggggctcaacggcggtttcaacatagccttgaggtcggggacctggcggcggcgtcggagcctctagcacaggggtttggcagcggcggctgctgctggaggtcccagcgatttaaggtcgctgcggctctcccaacagttttttggaggtcttcgacgtggtgacgacgcatcgagttcgacgggtcactgtcgccgctggcggttaggtgcgtgattagcagctccctgtgttttcccctttcatcaatgggcttgtgattcaagcgattacattgatttaaatgtggatttcgagtttctactgtctactgggtaggccaatggcatagaggaggattaggacgagaagaagctgtcctctctgttgcctctcctgtacagcccaacatactactatcatattgtctgtaggtgagtttttggagcaaataatgagttctctttgattgatttttttgcaaataggtgtgtgccaaacaggatcgctttgcactgaaaatttgttctatctcagagcaaacatggtgcctaatgaaatgatttatgtatgctgtcatgcagctagcacatgcagaagatagactggcaggatgaggtggtggtggttcttccccagacccgtcactgctctggttgcatttattaccttttgggttgttgtcctatgaattgagcctaattagttgatattcaacagctggaggttatatttcctttttacattgcatcttcttggttgttcaacagcagtgatagcatttgttcccttagtgaaacagctatcttgttgtagcagtgatagcttttgttcccttagtgaaatagcttttggcaaattgtactatcttgttgtattggctagatgagtgtcctagatgtttaatatggcccgaggagtttgctaagatgtgtgacagaattcaaaatatatttcaatagaatttttgttgttacctctaaataaagaataatgttctaaatgataactatattatgttgaatcatctctaaagagttccttctgtttttgttcccactggttccatttacatggtcatgaagcagtttgcttgctggaccttttgcgtcgcttacatggctcctcccattatatctggcttttaggtaaagactattcatttctttgattgttggataactaagccagggtgatgtgaattgctgattgctgattccactgtatttaatacaaatttttcctatctttttaacagtgcttcagagggcaataaattcttctgagttcttccattgttacctgtttttagtttcagtaaaaaactaagctcttcaatgtaaatgggacaacaatttgaatagttactataagatcttttgggatcaaaagatttacttgttgcaggcttaactttcatttacattgcagaaacttatcattggtagataaggatgtgttaaaaggggcttgcttagtacaactcaaggcgaggctaatactatggtgggtatgaatttaaaattacaatatctgagttcaaattatttggtataagattgtagtttaagatgttgactgctaataattttaaagttgtaattgcatagctcactggccaaccacgtgctataatgaaatatttttttaaaaaaaaattgtaagcaagtactattaaattgaactctatgttgttttgcaaatcatcctaccatgtaatttatgatggttctcatgatcactaggccaagtagctctacaatgatgcactacaaagaatccttttacacaaattatttgtgggttttcagcatatgggtgaacagacggctagacttgccccatttttagagttcaacatttactagctttgtaaaatattagtgttgcttattaatgaaattattatatacccaaattaagagcaatcatttcatacttttatccatcgcatgagcttcttgtgctacttccttgccaacctctgattcatgttcttatgtagccattcagaacacgatagccatgacagccaggcaaaggcaacggaaaaaggtaagctgcaggaatttctctttttacctcaccattaaacatttgcctttcattgtttgtacctttttatgatatgccatttgcatgtctgatggccacagatggttctgaaattcaattatatttttgtgtaactttgcaaacagatcgccatatgcccatatattgccattctttgtaaatgacaggcgtagacatcaatcactcagtccagtaattgcataatagtagtatttccttgtttttatcttatcatgtgaaaaagtcccctataaaatttggctttctcactattattgctttgcagaattaacatggcaagttttgtacaggaactacatatgcttgcattgaagtttctttggggaaccaggagatgctttaatctttatctcgatgggtattgggtncctataggnntttgtctggatagggtcgatttctcacaaaattannatcctagggcactcnnccaatattacctnnacaacgagagtatnntncttaggatagggctacaacatgttacgntcttggttcggncttttgtcaactgacanaaatcantgaggatttctagatcgcctgctatattcatgtgatattatctataatttgatatatattaaatttatctgatctatacatgagtttatatatgcgacaccattacgaactgctactatagtctccccgtgttctcttcatacacatgaataaccatatatggtacaataaaagagaattgtagtttcacagcctctgtgcaagtagctttttaagtttaaatggtaaatatttagttttacctaagagaagtttaccaaaaaaaagttctttcaactgagatgcttatgatgtgtgcttgatgtcgccttagtcaatcttgataggcccaagatccccgctcaatcttcaaggaataggtttacttcatgataattcatgtctcatgttaatattgggagaggcaacccactatgctcagctcatggatcttcaggaatggagctgccagcatcttattgacaaacaaatacaaggtaaatatgcattggagatcctttctgtgatttgctctctgatgttctccttagagagaaagagaaaaaaaaaaggttaatccttcctattatttctttttattcattaattatatgtaattaccattttgaccaaaaaaacgagcactccatctgatcattttctaaaccatacaggaaaaatactccatgcacatcaacggttaatgcttttctatgagctggtcttaatatctctaggctgcactgtgttaggctggagcaccccggtccaattcttttgcctaccaaataaacttaccaacaccaagccagttgagtgctgcaatgtgcaaattaaacaatatggtctctgtagcctgctcagcaggaaaaccatttgaaatacctgtggaaatatccctaaacatgcattaaccatgatgatcatttttttttaaatactgtacggtaggtagatcgatatttgtcaacgccttagctatactagaatacgaggggcatctaagagaaaaatacaaatattgaaggctctcatggtagtttggtagctaattaatcacataggtgatgtatatttgtttctagcatttatatcagtccattgattcacagtggatactcagttattgcatttagatgtctcttttcaggaacctttatatttaagttcctttacatggctatt

SEQ ID NO: 46119 - DNA, 1326 bp, Oryza sativa
ctagttaagtaactaaacgagaagagaaatagaaaatctagctctagaagatcctaacgggtgctcgtgctggaaggtagcagcggcgacgacgacggggcgttcctccggatcaaatgcagaggcggccgcgtttctgaatcaaaagcaagaggggcggcgacttcacacacaagggttcgtgtaagacggccagtggccggtgggagcgcagcggggtcgccagactgaggcgccgctgcacaggacgtcgattcgccgctgcatgtggaatcgccgattagagcgaggggacgacggcagaaagcgcggcccggcggcggcagtcttgcatcccttgttttttcagaggacgcttgggccaatcgaacgagtcaacatgcaaggctgtcttgcctctcgggatcatcggaatagactaaactgcccctccacgtcaatcaattaaaagtctaaaatacccatagcaatgggtggttagagttgattcctagtactacactactaggggtaaaacggttacggaaatttccgatcgactgggcgccatttctgtttaaggggtaccatttccgaccgtaacgtttttggctatttttaaatttttgctttttctaatttctttatacatcatattaatgtcgatattgagttgtttaaataataaatatggtcaatcaccggccgatcgagcatcgcttccgaagagatgctaccgattccgaccgtttccgatcgttttcacccctatacactactaccaaacccagtgggggtatggtaaatggcccaaaattagatgtggtaactacccctactataaaacttgaggtgcctacaaatcaggcgtccgatttttgtttgaaaaaaatgagcgctgttacagcaagtagatcagaattgtttcactaagtagatcgaaaatgtttcaatcgtttgaaaagttgaaacacaaccaaatcacctcatggaatattttgctacaacgtataaaacaaacggtttccaaaaaaacgggtgttgtttcaccatatataaaaacaatgtttcagcaaatagcgaaatgatgtttcaatttcactgcaacatttgatatatacttagtgaaacgtcatgagtacacttgctgacattgttgctggaacaaaaatagaaacgaattcccttaatagatcatttccataatatgtggataatttgttgcaacggtgcatatggtggggcgtgtggtggggacagcgtgggaagcggcgggcgcccgatttttttggcgctgatcgggcgcctgatcgctggtattttcctatcaaacttgcccttatagct

SEQ ID NO: 46120 - DNA, 5713 bp, Oryza sativa
gccgtgcacgtcgtcgtcgcagccaccccacgcggtcgtcgccgccgctgccccgcgcggtagccgccaccgctgcccccgcgggcctcccccctccctcctccggccagatctgggagggagggggaaggggagccgccgccgccgcctcgcgccgtactcgtcgccgctgtccacgccggcctccccctccctcctccggccagatctcgaagggaggggggaggggagccgccgccgccgccgccggccttccccctccctcctccggccagatcagggaggggagggagggaagggagccacgccgccccgccaccttccacgccgccccgtgccgtagccgccgtgggagaggccggccttggagaggtgaggtgaggagagggccggccgtgggtgagggaaggggtgaggttttgagacttagaaaaaatctagggctcctatccaagtctatttatattcaagtctattttcacaggcggaccactgaagtggcgcctgtgaaaatcacaggcgccgcttaggaggtccgcctgtgaaaatagatttttggactggcacattcaccccgatttatatttttgtaggcggtcatttggctctaaggtatgtccgcctgtgaaaataagacccccacgtcgagaaaaatgctttttctagtagtgcatcgcccttattcatatagatgctaataaatctagacacatattagcatctatatgaatgtgggcaatgctagaaagtcttacattataaaacggatggagtattaaatcagctatagatgatttggagccaatatttggctatactgttaaacttgctcttattattagagagatttttttttgtttggggggtatataaaattatactccacttgtgtatcgtgtattcattcattcatgtagttgttttaatttacacatttatatatatgtgcttcccagcaacaaaagaggacactattaaatatgctaattcattgcttgacctggccggcggatgacatggaggtagttgacaacataatggcatatagtaaaagatttcaataaagaaattaataaaccatgcatggcatgcaatagtttgcatgatatataattctaatatatatataaactgtatagaatagtatgttggggaactctacttggcaagaatttagaaactaattttgtgacaaactgcatatagcataatataatttgctctaaaaagagcagcacttactttaatatgtttatagtagaaccatgacaatagtagtagtagcttttatccgtcacacattgaggtcttaaactagtagtagtagcttttatttatttggcacttgtcttaatttgatctgtttccatctgaaacttctcctgctcccagctgaaccagaattatataggacgactagcatatactctttgccggcccgttccggaacttggagagaaaaatgttttggaaacaaaatgagatcatgatgaataatctccggcagcaggcatcaacggcaccaaccgaggttgctgtagcacttccaaacaacatctccctcgattgcatcctgcccttccttttctgcccccttttgggggccaagtgaaaaaaaaggtcgcatcatggtgtggcatagaataatacttccttcgtcctaaaatgaagccatttttgatgttagcatgggtattaagaaagtaggtgagaatgattggagaaagtgtgtgattggttgaaaagagaaagtaggtgaagaagaatggttgtgattgattgagaggaggaggtaggtgaagaaatagcttcattttaggacaagacactgtgctaaaaatagctatattttaggacggagagagtagataagctagtcccgacccccctcctctcctctcttgccccgcctatataatccccaaacatcgctttctcttggagtaggagaagggtagtagtttaagctatagctctaaagacatcaccatgcaacattacttgcgttattactatacctatccaccacctacacattttgtcatctccctctctctttctctctgatctgtctcagatgtttatgcacatatacaagttaatagttctgtggatctagcaatcccggcttgtttgtttttgctgctttggtttgatgatagctagatatatcgagagggagatgaccagtaagcttggaagaggaagaaagagagctgctaggcttgttgcggtctttttgcttgggtaaaaagaggtattggcgtgcctcaatccgaaggcatggctgattacaggcacctcgaccgatctagcgcatgcagccatgtttcttggattgagccgcgtcaatatctctccttgcttccttacttcatgtactgtgtcatgctcaagcatatgtcccctctccgatcttcctacctcgtcgagttcgtcggatcagttcccaaattaaaggtgttatatatatatatatatatatatatatatatatagtaaatttgtttggtgctccatggtgcccgggcaccattgttgaaattgagtatatacccaattcaaatgagtatgaaactttttcaattacctaggtattaacattaactactttactaactagtttaaagcaagtttgaactgaatttgaacttgtttttgttagattttgattctaggtatatagcatccatacatataattagttaggtatgtaatcatgtattgtgaaataaagttaaatttgagttgttttgttgataagtataggtatgaatcaaattattataactaggtatatactcacaatttgaaaattttaaaaaatttgagtgattttgtgcattagataccatggtgcccgggcaccatggtgccccatatgagtgtcctatatatatatatatatatatatatatatatatatatatatatatatatatgcttcatcttttctggggttcacgagtcacacagactagctgctttagaagtagtactatgtattgtgcatgatgttcacagttaaatctgcaattttttccatgctggagtgtttttataggtttgcggaaggaattaagttgaatatatatagctatataattatatatatatttatcttgcgatcctgagtcttctgacattttccatccaagttgtaggtctgatgcatggcttatttcaagatgtagtttctggtttgcttactaataacatctcttcaggtattcattaattaggaactactatactttacctactggaaggaggatgttgtttaaatctataaatttgtgctggttgcatcctcaacaataagttacactgtatctctctgaaccaagtacttcctctagcagataatatatgaagttagattttttttttcaaggtccaatgcatggcttaaatcataattttatattagataaatattataagatctaataagtttatgagattacaacagtacttattggtgacggtcaaaatttgaaaaaaatcttattacaaatgttaaattaatatttgtgaccggtgggagcatgtatctatcttaattattgttttgggatgcttttattatatttttctgcataataaaatattttttgagctcttttcattctaatccccccctccccccccccaacctgtgtgtgctcctaaaaagattgttccctcttatgataagtaatactccattatttcaaaattaaactaacgtatgccatgtaaaggaaaatagagggattatatatacggttatgcttctaacttcacacaagtttataactatactagttaggcacttcgtagtagctcacacataattagacgggaagatcttggatgaattgtattgttatggctgtagatttgcatttaacatcgttctgcatattaaaaacccaactgttctgaatgttgggtaatttagagctcatctattataagctatgggcttaattatgacaagttggcatatattaactatgaactattaaaacataaaaaaaaatctgtaactgatagtctatactgaagtagaacaaaataattacaattttcaattttataaaattattaaaacaagaaaaatgatgtaattgggaccccaaaaccgcgtacaactacgtattattaacaatttttttattaaataatgccaactctataattgagtctccaaacacgaaacaattcaatttttattaatttcaaattttagactcctcgaagcccttgtagagcaaaagagctgcacgttaactcctcacactacttaaaaaaccatttttccaaacggtcggttcctatttttgcgtgtggttgagccgctcatctgccctaaaatgtctgcaaaaatcgctattttttcatgcaggtggcgcaaccgcatgcggtaatttgattttcgcgtgtgggtgcttatgtcgtcctcacgcaaaaacaaaaaaccaaaaaaaaacaaaaatctcaaaaatcaaaacatcttgccgtcgacgctcgttgtcgtcggtgctgccgcccgccgtcactgtcgccgagtatgtgtggggttaggctcctctcgtcgtcactgccagatccgtgcggagccaggtgagggacagcccccgccgagcccgtcgcctgctgtcgagccgatcgtcgtccactgccgcaagctatcgccatcaccgagttcgcgtggggccccgctccttccaccgccgctggatccgtgcgaggctaggtgggggacagccaccgtcgccaaatccgagtgggcgatgacaccaccgagcccgggcgtcgcccgctaccgagccaccagccgctacccactaccgagtcgtcgccgccgctttggaatgagagaggggaggaatgagaaatgagagagagagagagaggaggtgtgaatgagggagaggaggttggagaggaggggagataataagggacttggaaaaaattgtagtgttgagagggaaaagaaggcaagttagaattctagcggatccccttaagaggcctgcccaccaaaatatattttctcatgcggtcctttaaaagatccacatgtgaaaatatgctcatttttttatgtgagtaagttaagaggtccgcttgcgaaaattgatttttgcatacatgcattttaaggagccgtacatgacacggttaattatggtccacttgcaatttaaaggggtctcattcacaaaaatcatttgtatagtagtgtcactagctgtcgtcgttgataattcatgttttatttgtggtttctctcttttctatatatttaatatgctctatggagaactctttaattatgggaaaataagatcgatacttgaataaagatatatatagatagagagagtgagttttccattcttttaggttgacggaaggattgctatggtttttctagaactagcagaaagaccaaaatcgaaacgaatggacattagtatatacaatttggcttggtagtggtacgagttatctcttggtgtagcaagaaggaatttttttttatatttatatttatttttaaaaatatttaaaaaataaattaccattttaaagtttggcaaaaatatactcctcccgcccaccctaatagagggagagaagggcctaaatgtaaaattttctacaacacataagacgtagttttgtactaattgtaaaattctcatatgatgtcggatga

SEQ ID NO: 46121 - DNA, 6347 bp, Oryza sativa
ttaaatgaatgaatggctaagtacaaaattatagatctcgtcgagctctacatctttgctatagagcttgtctccatcggaggttgtttaaaatgtagatatgagaatttgtaaaaataaatctaagacattataaggaatatttggacccataagttattttaatgaaaaattaatcaactacaaagttgtagatcttgtcgagctatataattttcatgtaaactttaacttcatccgacatcatacgagaattttacaatcatacaaatacttcatgctatgtgttgcagaaaattttacatttagagggtgagaaggatttaaatgcaaatatttttgaaccccgtgctgctacatcacataaatcgctctctattagagggcgggaggaggatatttttgcaaatatttgaaacggtaatttatttttgtaaatcttttaaaaataaatataaatataaaaaagttctagcaagaagcagctgtatgggtggtgtgggtcaattgggttgggctgcaaggaggaggggttgggttggaaggggtctataatagttgaattggatacatctgatttacgcatttttacatatatcttattgaattgaattcctttttgatgaaaaaataaagagcaaccatgcttctacagtagttgtgactaggggtgaaaatggtacggaaatggacggaaaccatcttttatcggtttcgttttcatattttttttcggaatcggaatcagaaaccccggatacgaaaacggaattgaatattatcgaaaccgaaaacgaaccggcgcgaatacggtaacgaaaatttatcggaaaaaacccctcaaactgataaatccaattgtcaagtctcaacggtcaacaattcatcataaaacacaatcatataagtccaattgttaagtatcaacggtacatcacaaaacacaatctatggaataaattatctatctttaaaagagtaatgctgttgataaatcctaaatgcaggaaaaaaatattcttatgtaattttagatttgcataacaaatattttttaaaaaaataacagccaaacaccatggtattcaatattcaatgcttaagaaaaaagaatccagggtatttcagttacaaaaattccagtaattccgagaaaatttccgaaaagtttctgaccaattctggagttccgatggaaactgcccatctcattttttagtccgttaccgagaaaatattgctgaattcatttccgtttccgaaaaattctgactgatagattccgttttcaaaaataggttcggaatctagaaagttttcgtacagttttcactcctagttgtgaccatatggtgcgatcagatccggcctgcattcatcttggcgattaaggcctcgcaagaccaagcaaagtagcatgcatcccaataaaagtaaacaccaaggtgatcttgacatccggtgatttccggcgaagcggcgtactatattccggcccccatcatttgtcttttagatggaacaagccaaatggcatatttataaaaaaaaataatttgtgaataaaacttttatataggtgttctaagcgatctaaaagcaaaatctgaaaaataaacttcgatgaaaaaacgttaaaatcaatttcaaatttatggttgaaaatttaaattttggctgataagcataagcgaaaagatgaggctgtcgatacgacggcgggtttcagattgatgagtgttgataccaactgtaggaccaagcaacgtagttgagaagagttattgttccacatagtatgtggtattgaaaccttggaaactgaagcatataagtagatgatagtataaacaaactgaatataaatgttgttagaatgcattttgttggaccaaaatgctgcagtttggtgggaaggaaattggaggaaatgactgattcatgtacatcaatacaaattgatggggtagagccgtagagggatcatcagactgcaggagaatttttgggaggaggatacatggggcaagagaaataaatctactcatttattggttcaaaacataactggaaatgtaaaccgaatttattcaagaagggtacaatctatttgtgcaagtaccctatatatactacttagatagcttttcagactgaaaatgtaatagacaaccttatcagagtgcttaaattcagagcacaaatggtaaaagagaataggcaaataggcattccttccctactccttcagaaacatttttctctaaaagagaaatagcaaattgaaaattgtagtatccggaagaaagtttaccatcactaccatgcaggaacaatgtgccaatatgtatgcatactaaaatgcgccattctgctatttttcttaaattcttcatgcttcccaatttttacttgaattttcgaagcaaacttaatagttttaaagcaacaaaaaccaatttccgagtttataaaaatgataaacctaaatataatcctctccttctctttgggccgaatctgacccaaagctcttactctttcagcccgtgcaaaagcgtccacttcttatacccctccactcttctcctgaaaaaaaatgcatactaggtcccttatttttacatcggattacaaagtcatccctcaacttagggtgtgtttagttcacgctaaaattggaagtttggttgaaattggagcgatgtaacagaaaagttggaagtttttatgtgcgtagaaaagttttgatgtgatggaaaagttggaatttttttttaaaaaaattacaactaaacacggtgttacaaaaccaagtcactctagatagttttgaccggttttatccgatatggcagctgagtcagcgtgagaccgatatggccagctaagtcagcgtgagacatgtaaaccccacgtgtgagagtaccctctctctcccttcctccttccccatctctctctctctcccacttttctcgtttcaagaaaatttcatctgggcaggccagccgacggggcgatcgaggcgggagaggaggaggtccggcggcgcggcaatgcgggagaaggggcaacgcggtggtggcggcagcgacgcgggagaaggggtaacgtggcggcggtggcggtggccgcgacggggcgcggaggaggaggcggggccgcctgctggagcgtgcggatgcggctccgtcgtcaccgccggctgtagagcgtcggcgcggctccgtcggccaggcgctgcaagaactagcgggagtgcgcaggaggaggagccagacgatgaggtggcggcgacgatgatgtccggacaggttggttcaaacatgaacctagacggcgagctccggaagatcaaggaccaattcgcgacatggaagaaagactacaagtctcggttgaaggagaccaaggtaaatattcagaaggttggtgaggagaaatgccggaaaagatggcgggggaagaagagctcaaagtgaatgcatttaatctaaatccgagtgcatttcgcttcattccctgctactgcatcaaagacgagacaatggaaaagactggggagtgaaaagattgcagcctcgatgttgaggttcttgtcttcctcatcacaaggctgacaagatgacgacgacgatgagctccatcgtcaatggcggtgctggtactcgtccggagttcagcttatcgaagaaaggattatatatgtgaaagcaagaagtctgtacatgcatattagttcttcgttgtcagtgcatgtatgccatcttgtatgtagagagatgaacctgagatatggaagggtaattaaatacagattatccgccatgagcgaatagagataatgtaacatcagtcctgtaatatgtgtacagtaaaaaatcatcgaatttgcaaggtgtttttactccattcctgccttgtctgcaaatatcttgtctctgtcgcaactgaagtctgcaaaaagattgttccttcagaaatctgaatgatgaactctggtgtactttttccctcttctcccatccctcgtgggtctccttctccccgttgggccgcagccgcccctagcctcctcggcccgcagccacagtggcccagctccccttcccccctcctctcccgcacgtggtctgcgtccaccctgtcggcccacgccgctcgcccctgcgcggaccagccggcccaagaaggcgacgcgtcatcgtcttcctccagccgcgcctgttcctctctcccccggccgaacccgagtgccgccaccacgcccatccacctcctcgctcgtttccacttccgattgattgcaaaaattgtttcctggcattgtggtcgtgggcattattacccccataaaatccctttcagcggagctttcaatcgtcggtttcaagtgcaacaactccaccacggccggccggccggcaagcttctccctgccgttcccgtcctcctcggcctataaggccttggtaggcacgtggggaggattttcccgggaaacgtcaccagggagggattggatggatcctctcccatcaccataatcccctctacccttccgtccagaaatttaactatttgccacttttagatttaccaattatttaaatatccttcaaaaggtttgtacttaaatttttttttgccctgcttaatttttttcccctctaagatggtggcatcttaattatttgccacttttgtctatctggcatgccaactaggggtgaaaacggtacggaaatttccgagaattccggctaccgtttccggtttgcaccgaccgtttcaatcggtatcggtaattgtcggtatcggaaatggaaacggtaatctttttcggaaatggtagcggaaatgatatggggttttttccgaccgttttgtcggtaaccgttttttatcggtaatttccgtcaaatttccgacaaaattccgaagaaggaagtcggctgggcctggctagcaggaggaggagcccattaggcattaaggagcagcccattccgaataaagaagccaactaggcctgaccgcatcgtcgtcttcatcggcgctagggcaccgccgcgccatgttgggcgccgccaccaggtcgccgacgccggccgcaacctccttcgccccgacggccttcgtcgcagccggccaccttccctcccccatgctccatcgccggcttccgtgccaccgagccaagcaccgagcgccgccgcaccgccccagcctcctcctccccaccgatgccgcccctttctcctctctccttcccccaccgccgccctgcgccaggccgccatctccggcgcctctctcctctcgggcgcgcgtgaaggagccaaaggcagagaagagaacgagagagaaaacagagaagaaatcgagagagcaggaaaaggaaccgagagaagggaaggataagagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacagtgtcaacataaaagttcttatgcaatgtgccactgtaggacgacgatatagctatgtcaattgatgatgaaataatgaatgatgtttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttatcaatcttattgtcaacttattaatcatcatataacggtgttgtgtggcagcgtaatgatgcaagggtgaaattataaggtcatcttcatacatagttaaatgcgggatgataccacagttcgctgtttccgacatgaattttcgacttccgtccgatatcggtatattcccgttccgacggttccgtttccgagataccgatataaccgatatcgttaccgtttccgagtataccgttccgattccattttcgagaaaataaaatgaaaatggaaatggtagagggtttttccgaccgtttccgaccgttttcatccctaatgccaacaccgtgtaaaaatcgacgtgggacccacttatcaaccgcacaactctccccttcctctctctctccggtctgcttgtcggcgtgctcctctctttcccggcggcggtagtggagcgccggctcgcggttgcggaggaagagggggagtcaagcgctgctcctttctt

SEQ ID NO: 46122 - DNA, 3070 bp, Oryza sativa
gcaccccggcgctgccacccttggtgttgcagccacctcctgttccccaggctccccttcgtcgagcccaaaacaagctagaaaaccgttctcgccagtgaccagtggtgatgccatcgccttcctcctccggcaacctttcccgactcaccgaagcattgtcccgctgcatcgtcgtcgccgtcaattacgcctcgtcgatctcttccttgagcatgcctccatatcaagttattgtgtgtattcaattcctatgagcaattcagattacctttttttttatcttgttcttacttgtttatttgatttgcttgcagtcataaggttgatttgcaccagcaagatcaacaacccacggagtggtgtatcgatcgctaaggcacaacacaatagcgtctcgtacggttgtagtaagttctcccaaattagagttatcatcaactccccgaaagatcaggccaatcatagccgtgagtgtattgagtgcagctcagggtttatcaagacctcaggaacaccatcccctcctttgagcacgtcgttcgatgaagttgcgtcgccctcaccgactcgaagaatgttcttatctctgcttttaccatggaccatctcggggaacccagtccttggtgaactacctgttttacccatgggtctcgacaatcagttgctcggtcctttctctcctcgagcgctgatgtattacacataatttaatagtacaataatgattaaataatttggaagtctccatttaaattatagctaaattttggatggtcgtatcttggccatacgaggtccaaattgacccgtttaaattgcttaattttttataacttaaagggcccaaaaatgttatttttatgtaatgtgatcatttctttcttagagttttagtcttgttttgttattggtgtagttgctatcattttagaggttcccatctcgcaatttaggtccatcgtttgtggcagcagaaaactgttcgttgactaaggtcagtcacgctctccttgagcatattgaaacataatttgcgaaatgtattttgacttaaattattacattcgctttattaaatttgttgtgttataactattttgttgtcgagagatcgtagccgatgccccaacttgaaataagaactcgtcgaaaagtaaaagaaaagggtggcgatacgctgaaagttgtattgattggattgtctcccctattacaatggtctggggtttatatttttaccccgagtacaaaacttgtccattatggacacgactcaagctttcctaaagataaaatacaaacaagtccataccatggactcttaccatatctctaactcaaaccgatataaatatcctaattaatagatacaattgccttaaatgagctctatctctaaacgacaatgacggtcatctcaatcgaggcccaaaccgagcccaagtcaggctagtcggctacttgtcaaatcggctaaatcagactccaactctatttccaaccgatgcaatgcccaaccgatgcgtaatccatatttggaaagatccaatcttctttgattccccttcaattccaactcgaaatccgagtctatcttgccaaatttcgctgttaacacctgttggtatttcttaacaatattactagaaatatgaatgtctagcaatgacgctagaaatggtcctggtatatatatggtttacagaaaggatccacaagcgcacggatataccattgtagcatttcgcccgaaagtattataaaggtatcgtatttatttaatcccaaaggaagagtgtaagatagaactattctaataatatatatatatatatatatatatatatatatatatatatatatatatatatatatatatatatatatatatatatatatatatacatgccacttacataatcaaagtctaagtaggggttaagatatttatttgggtagagtgacacgaagcaaagcactcatatatctcatttaatcatttctaaactaagcataagaagaaatagaaaaacaatcatttcctataattctaatatacactcaattttagtctacatctgttagtatacaaccatatagccaatacccctaatagtgcactcctggtgcttcgagagaccaccccggattgccgagtttcttacgacaacctgtcatggccgtccatccgggggctaaatacggaggaataccctccccaggaaagttttttaggatcgtactgagctgtcaccatcagcggcccacctcgactgactcgtagcatataaacacagataatgatacctaataatctagacaccatgtgtacattataaatactacactatatccctcaagatgacatagagcaactgaataatcagacattaaacccacacaactgcacctctctggtaggctaactatacgactgtaccgatacagacataaagtaaagacaatacttagataaactaaagtatcgagagcatatgaagaagaatatttcattaattccaaaagtcttacaaaagaaaggaagaatgctattacaaccttaccgaaattcctccgaagactccgagaactccgagatgctattctattctactccacttagcactagaatactaaactaaagtgtagaagagatatttgagcttgcttgagtgtgttgagagagtgaatgagctcctccttttatagggttgttatgacggttgtagcctatgcgaaatgaccaatatgcctgcaaccatcattggggagcgatcaagagcgtccaggtgtaaggccagccagagccagcgtcaccagggttcgcagcaggcctccaaacttccctatgtggttgacaggtgggtccctatggcggttgtgacagttatgacggtttccgggacggttacacacgacaaagtgggcccatcttatccataggcttgcttaggagtgaggttttctcattttctctttattttatttgctcaattcctacactcaaataaagtccaagtacaagtggaaatagattattctaaaacaaaatatgcattgcaag

SEQ ID NO: 46123 - DNA, 3739 bp, Oryza sativa
aggcttaatgcatcgattagtataataataaacaaaaaagatacgtatagaggcggatgaggtcctagtatgggaagaagatttacatacttccaagagttccctaggggatgtgatccaaattacattggtctaaaacaaaagaaagaaacgacaagacaacaatcttcctctttggtctccagctccgacacctactcccccgctcgaaggaggcaactttaacggttgcctccacaacagctacgcgcacaatggcttcactcggggacctcatcctgcacaacttccaagaaaaaggttcatgtcgcgggcgtgctacgatgccaggatatactcgaccaccttgaggacgccacctcatgtacatgagcaggcagcccgacaagccgttcttatggcggtcagctccatgatgcggtggctgattgagccaatgtccatggtagaacaacgcatgtgccctaggtaggcttagtgaagtgccaaagcatgacgcgtcgttttgcatcaagtactgaatcgacatgtttttcacaaaccacccaataatcaaagaccacgtctaatcatggcaaaccttctggaagccataagcggtttgaaggagggagaaattaaagcagagccctgtcacgtcacctgggggccgcaggtggcccacaccatgctgtgttcccttgcttccgaaggaagccccatggcagacctcggctcggtgacgaggccagggggctactgtcgaagaatactcggggcacattaggacccatcatggctactatgtgccctccatggagtgccacatgactaccccgaactccaaaggtatgacgcccgtgtgtgttagcctggaggtagccctgaggtaggaaggatgccctaaagatagtgtcagctccgacgttctttgaccggtagttaatgggctaggaccccgaggtcatcctcggggctagaggcctatatcagctacgccacaacaattaaggaggtatgacctgaccatacacgctcccttactgtgtcattctgcattaatgacaaatggtgtggctgctgtggagaattgtgggccgtcgtggacgatagggcgtacctccctccacttgccaatgccacccctggataagtggtgacagtgtggcttcgtactatgctacatgtctcgcccgccggttaatgaccccctagccagcctcaaaggctaacaaatgggcccaacgatgtccaggacacctaccttgatcatcctacaccatgcgtcagaaggaggagaaggtgttcgcatcaacggggcccctcaagatgggccaatgcaagatcaagattaccagttgctgatgtagaatcacgccgcaaaccttgagcacgttatatgcagcccacggtggcactcagagacacgccactgtagggagtgatagatgccactgaacgaacaactgggagggaccccgttagggtgaacatacatcggtttgtcctaggcttggcaggccagctaggacgtcctctaacaccatagatacgagagatgacgagcaattggggacttgaggagaatagacttgggataggtagcaaggagggagatgtagaatatagagggtttggatactaaattgaatttgacgatgattggttgtttcttcagtcgatcttagcccccttatatttataggaggggtggactcttcttaaggtctttcacatgtctaattaggcttaaaaatcaactaggtctcgataaatcctagtctaaaaaaggaaacacgagaaatatctaaattagactcgaaccttgtgctgaagatctgaccgctcagacatacggtctgaccgaccacattaagcggtcagacaaaccttcaccggaaagctccgatatttttcaaatttggttatcaacgtcaactcctatacattgggtcgtgcttgtttgtccaggcattggggtatccccttactattataaaataaggactaatgccaccaaaaagatgggttcgggacctaggacaagaggagaccacctctgttagccactgggaaaaagaccttgaagaacacccttaaaccaagtgatctaagcaagaacacaagagtagagtattacactcccaagtagcttaaacctatctaaaatgctattccactacacctgagctcaacacctgcaccattgctgaatctcaaagggagcgtatcgtgccttcccgctagaagggctcatgctccgacaccgaccatctattggggaaaaaaattggtgtagcatggatgcaaagcattacctttgcaaccctaccacagatggttgacacatggacattataacgatccaacgactttatctgctcggtaccaagcggtgggacgaggatgcgcggttccttggctcggctcccaggcccatcgactctctccacaatccccttcctcacgtgttctcctatgccttcctcatcttccattggacctactgcagcggcatggcctccccttgtggtgtcaactcgaacaagaatcccacccgcaagaaggaagcctaggccatgttcatgtacaccaccggagcctacaacgttctccaatttcttgtcacggtttattttgatcatatcatgcgatgggaatgatcttgatccatggatcatcagtacttagtgacattgagaacatgatggtgtataactagtacaagcaggaaagaagggctcaaaggggacgcactgctagtggtggcaatcacaatacgggtgccgacaccacagcgcgcaccaagaagtacgccgtttgggacatgggcagtggccacttcagcatgttctcccatgaccaaggtggtcgcactcctacgatggtggtgccactggcgtcgcagatggatctttgtttttttctaccacagatcctcgttttctgctatgtccatcttccttgtgacgccgggtgcttcttctgctgcgttgtccacaaaggtttctcttttcatggtggttgtagtcaccagcgatgtagtcgctagcgatttggtcatgcctgaaggcgagtcgtcccgttccacatctgcacaatccccttttgggagccgggccaaggcatgccatgtgcagccttgttggatagtgccaaacaaggcaagctgttggattggtatattatccacgcgtcggacatccgaagtggggctgcaggcaatgtggtttgcacccggactgcaccaattttttttccgatccattgcactctctttgtctctatagactcctcccctttctcgctgccaccacacttcctctccgtgcttactggtgtgacacttccatgcactcttctcgtatctcctaatcattctcctaggctctccatccccacaccacacaccacagcattttgtccatatttcagcccctcttttctcggtctactctaccatatatatctcccagtagtcccccacatacaccagatgcaagcatagcaccaaaagtacaagaactcctagcatcagatgcctccagtccatatatagccctttggagagcaaaaagggagaacaacccagacaaaagagacagccatgtactgcccttggccttaacccccaccaccacagcccctcactgcctttcacctgcaaaaaccacttgcaaccctcacaaaaccaaaaaacgccagcagccagcttccctcccccctccaattttagcaacttctcccttaaaatctcccc

SEQ ID NO: 46124 - DNA, 19256 bp, Oryza sativa
tctccttctctacccacaccacccccgccgtctccgccgccgccaccaccaccgattctttctccggtgccacctatggaagagatgatcaagccggcaccggcaccggcgtcgtcggaggaggagaaggaggtggtggctactgctgctactggagaaaggaggcatgaggaggcgacggccgggagagaggagcaggaagaggaggaggaggaggaggaggcgccggtggtgctgaagaaggggccgtggaccacggcggaggacgccgtgctggtgcagcacgtccggcagcacggcgaggggaactggaacgcggtgcagcggatgaccgggctgctccgctgcggcaagagctgccgcctccggtggaccaaccacctccgccccaacctcaagaagggttccttctcccccgacgaggagctcctcatcgcgcagctccacgcccagctcggcaacaagtgggcgcgcatggcctcccatgtaagtaaagccccaaatctccggttgatcgatcgatcgagctgtctgttgttttccatctcaaagttgttgatgtgatgtgatgcgttgtgttctttgttttgtccccagctgccggggaggacggacaacgagatcaagaactactggaacacgaggaccaagcggcgccagcgcgccggcctgccggtgtacccgccggatgtgcagctccacctcgccttcgccaagcgctgccgctacgacgacttctcctcgccgctgtcgtcgccgcagcaatccgcggggagcaatgtcctctctatggacgcagccgatgccgccggcgccgcctcgtccgggtacaccagcgcgcgcccgccgccgctcgacctcgccggccagcttgccatggggagccggccggttcagctcctcgccgcgacgccgttctccgcgccttcgtccccgtggggtaagccgttcgctcggaacgcgcagttcttccagttcccgcactcgtcgcccgtgtcgccgacgacgccgaccgggccggtgcaggtgcacccggtcacgccggagctctcgttgggctacggccttcacgccggcgaccgggccagactcccgcctgtctcgccgtccccgggtgccagagccgagctcccttcaagccaattgcgcccgtcgatggcgcctaccacagccgccgccgccgccaccggcggcttggtcggcggagcgctgcaggatcacccaaacgcggcgagcctcgaggccatgctgcaggagctgcacgacgccatcaagatcgaaccgccggcgccgccggaaaacagaggaacggaagaagaaggcggcggcggcggcggcaatctgcgcggcgtaagtggtgagtagtgcatgtcgcgcgtgaagcattttcctcacattttccactcattggatgcatctcaagttctctctctctctctctctctctctctctctctctctctctctctctctttttaagtgtgttgctttattgtagaagagaacaaattggcatgattatgatgtgaacacatacatagatcagaggatgaacctttttgtttgtgcttccaaaatctccatttgttttcttgctgaattctacctacttcctgaaaagcaaattaaacaacaccaatttcatttacctcgactcacagatcactctagagttaacctgcttagtgagaaaccaagaatgggaaaaaaatatatttcttaccagcaaaaacaatagtacatattagttttaggagttagcaaaatcagaaacaggacagctctgcttggaaccttcttttgcttttctttttgatagttttaaggtaattagcactgcatctgcatgtactgatgtacagaggcttcagaggatttctttttgtccttgcaagacagtgacagcctacagtgactgcctttgatcttgttccatgattacttttccttatcttaccaagtagtactttaatgcctttatttccctttcgactttttttttctctctttctcactctgcatctgccgctttcctatactactacctaatctaatctgcagccaattcatgcttcctttttgttcttccatgattgccttgctcatcacctccaataacagtacgtcacattggtgtcatatgattcataggttaattgattatcataatcaagcaaatataaataggatcatatctaggataagagtactttttgggagattatctataggcacctatccaactagtgctgagcagaatcgatcaaaaattaattctgcgtaagttaatgaatcaactagttgagttggtaccaagaatcgaaatcgtgcaaaacaaaaaaactttcttgaaataatttcagttccttcatgagcaaatttttgacaaattgatgcccatcaagtctgaagatttttgcatcgtggggttgcattctgtactaatttcacttcaatttccaggtgacggcaaaccggaggtagagctcaaggacgacatcgagacactcttcgaccttatcataccggcgacgttcccggcggcggcgccggagcccgccgccgccgcgacggccgcctccgccgcgcccaaccactccagctccgtctcgcagcacagcagcgacgaccaggaccactccaacggcgccgacgtcctcgacctgcccatcctcaccggcggcggaggcggctcgtcggagcaggacgactggagcctcgacggcgccgcctgccagtgggacaacatctccggcggcatctgctgacatgaatttcgatgatcaacgctgcgtctgaaacattctgtgatcccaagaaccgctcaagaagagctcttttttttttcctttttgcgaacatttttcttggccttctttttttttttcatgtacctggggttaattaggttgtatcgatcgtgactgagcaaagtgcaaatcttcgatgcccccagtgaggcttttaacttcgtttttttttaattacaaatgactcggtctgagctgatcatatcaaagtttttatcggcatatatatctagtatctctgttaagacattaactgcctgattatcttgttagaatgttattgtagtgatatgttcttccaagcatgcaagaggcaaagattatagcgatcgatttctgtgatgttttgataacggtcttgtttcaagctggcagttggcagtaggtacacgctgtgactgactagtacttgtcccaaaaacgggagactgcaggagcacggagaacatccgtgtgttaggttgtgatcaatgtgttgctgccttgttggagaccaaggctcagattggctggcacctgatcgaatcatccagcaaccgagtctgtgactagatgccctgctagagcattcaggtgttgtgcctagctagttcgtgtacttttggggatattgcgaatgcacgaataaaatttggggaaatgagatcaaagtgccctccgctgctttagttgtagttttgtttttgataatgatttttttttgggcgaaacacactatacgcacgcttatatgcaagcacgaacagtcaccttatgaatacatacatgcgtaccctacctcaatttgatccccatttaaacgatatgatgtatttggccataatttaacttaagttacagttacactaccaattgcaatagaatcaggtccattttatttagtggcggtttttaaaaaatgttgtagaatgaaagtcatgctaacaatctccagtgtccagaaatatggttatctgcatcttagtcggtgcacaggctggaagttacacttggctataggagctccttaggagcatatactcttaattctctctgaaacaaattgagaaaacgagcttgcttatctgtgtagcatcagctttggatgggtaccccaaaaaagaaaaaaaggatggcattatgggaaacatatcttagtgaaatgtgatacaccaatctcatattttacaataacaaaatgtcaaattcaagcagtagcaggtggtcataaatccgtcgtgagattatagtggcgaaccatgcaaaaggtggcctctgctgccttccggtgtctcgtacgcagcagcggcaccgctggtcgaagaaaaaggagcagttggattgcatgatcagcaagtaccctccccatgctaaatacgtgttgcccattctttgctccttgcttcctgccataagttcctcccaaagagaggcttctctcttgttgtgactccttactgctctctgtcacggacagagtcctttcatttcttttcactctgtttttttttccttccttggggacaaaagaagcttctaatgattcttatgggactagaccacataatgcaacataggccaaggacatagcactcaaataggtattttccactatattttttttgacaccatattttccactgtatattagtatagctttaagcctttaaaggtggtttcaatcttctttgatactttctattttagccctcatagtttttcaatttatgtgaaagtccaaagtgttacactaaacacccagaacctagaaactaggccatgtttgggggagcttctagctgctgcagcttctcccaaaatcaaaagctcccccaaacagctcagcttttggtccagattctgagtagctgtagttgtagaatccaaaaaatgaactagaaaccagaagctaggaaacccagtttttccagattttcaaaagttggctaccaaccaattgtttctcagaatcttaagcttcccaaacagaccataaatctctcctctacccctccactctcccctctcttggaccctgcctcctatctcctctgccctctcccaccacctgacactagcagaatattttggttccatgatttcggtttaatatatagttaaaatattggattttggttttctgattaattttaccaccactagagtatatggttcaatgcagaaccatcgacaagctcgtgctggctgagtgaccgaataggacccaaaaaaaattaggggccccattttttctaattttaatctatcttaatgtgttccaacatgtttaaagctctttggttctatttttaaaaggcaaattttgctataggacataacgacttactgttttagctgtaggacaccgcacgaagtgagtattgggtaaagacaaatataaaaagaggaacttatggacttgaatcagacattgggttgacatccaaaatagagaggaaaagaggaagcaaacatagctagatcacgaaagaaagctcttgcaaatgtagctagctacgccttctcctccatttttccggtggcttttaccacccgatctgccaccaccgtccagtgcaaactatctagtaggccaagattcccccgacctaccctcctccttagtctctagcggttctcggtccatcggcgccatccttcgcctcttaaccaccccactcaactttgccccctactgtcggacctgcccaccacccattgccaaccctaccgctccagcgccgccacttagctctcctcccacccccactctcaccctgacccaaacccccaaaccctatctggttaggtcaccaccatctcgctgcatggaatcgctgcgacttgtcagagctaaggaagaaggatgctaagcacgaatcacccaaaatctataagattcattccccaaatttccattgaatgctacttagcaatccaaacaaaaaagagaaaatctctcgtatacctctgaaattttacctaatcccttctatacccctgaattttgcttactttcttgtatacccccaaaatttgattttgattccttccatacccctcccgtcagctaaccgttagttggccatctaatttctataaaaataaccattttaccctttggatgaacatagaaatttatgaattacattattaaaaatgtaaaagtttgtcgcatgagactattgtagttatgagtttttttgtgcgatacattatttatcacaaaatttagttttagataataaaataaaaaaatatgtatttatttttaaaaatcataaaaatgaggagcattcatacaaagataggaccaccaatgctcacaatattttttttatgaatgctcccgataaaaaaaaatcaattgtcctattaaaatttcaaataaatattttaatctattacatttgttttattttcaaaatttatgtaaaaatttcctgcactaattatttagtctcattagtttcataaaatgcacatactgtgcattcaaacaaaattttcaatcatttttcaagtttatattcaaatctaaagtatcaagggaaaaaatgatatttgcaaccaaacgtaatactgaaatgaaggaaaatgtaatagtagggacacggaagggatcaagttgaaattttaggggtatagaagggatcggataaatttcaagggtatgaaagggattgagtaagttttcatgggtgcacagggaattcacttaaaaaaaagatggacaatattgcgactaaacagtacatgtacaccaattagtttaacctgctaccattcttatatatctgaaaataaatgatatgcatgcatcatctctctcccacgtgggagtatgcaagaatgcaacagctcctaatagataagtttcaaataaaatcttcttttaaattatttatccgattatactattatattagttctaattaaacatttataataagaatttacatgcttatattctaattaaaaaaatatatgttgtaaattactttattatgtatgtagtattaattttatcgtatatgtacattatttttagatttaattaaattacttcttagatattcataatggtgtgagttatttacatttattgttatttttaagttagttctataatttgtgctgactaaattaaatttctcgatagactcatatttttaccctcgtagcggaattagttttattacaatgataacttactttcattttgtattaacctacttttatgatttatgtaaattactttatgctttattgaatttataaatatctaaaaattaatctaatcaaatttaaaattaatttaaatatatgacaaaagtagtttacaacacatatatatctcttattagaatataggcaaattttgctagatgaaattgtgacttcatggttttatctataggacaccgtacaaagtgagttttaggggaaagacattcagtaaatatataaattggctcatgggtactatgcccattagaatatttatttctagctgaatatgaaaccatatgaaagttataaaatacccatgggcacacatgtcaggtcaaccatctctcaatctctctctcgcacatgaacaatgaaatgggaaaagcatcatggtggtgtcgccgtgccatactcttcgaggtgtatggcgaggtggaagacatcgcggcgcacaccttcgtctccatgtagcaggagtgggcgtcgtctaccacgatggccatggtgctgatgacggtgagggggttgaaggagccgaagccctgagtagcttgggtggggcaatgtggaggagagatgcccgagtctggcacgaagccttgccttgatagcctcgttgctccgtgcgagcccactccatgccttgctcttggtctccgcctgtcggagccgctcctaaagctcagtccagcggcctccacctctacctccttctcctgccactatcgtgccgcggtagctaatgtcgcgttccgtatccactcgaagtccatccacactattgtgttgatctctacgctttgctcttgctcctgctcaacaccatcggctgcagtatgcttggcactatcatgctctagcgcattctcgcgcccctcactccttcttgtatgactttgagagagagatagagataggagacctgatatgtgggtctagaggtattttagaattttcacgctatttctctcccctactctactagaaatgattattctaatgggcacgatgttcattagaaaatttccacgtttacaaagtaccttctcccaaaagtcatttatgtggtacctcaaagttacgatgaactctaacaaaatttgcctagaatataattatgtgagattgtattataaatattttattgcaatgaatgtaacggtgtgaattagatggtaaattagataagtattttaaagaaaaaatataagaaggaaaaacctacatacatgacctaacaaaaacactcaatcaaacattatcccatagcgcacatggctaccaatcaagcctcgtcttacaagactaaatattgtgtgtgtactactatttagattttgtgttaattgtagcatatgtatcaacttgcctgcagcccatttgtcgaatggttggttggcacgacacaacttttagacgggttacaccgcgacaaacgagggtgatgcgattgctcgcgtttgatcagttacgaagtgggatgcaaatgcaagcgataacgaaaagggagcatcgcttacgaaaatcgatcccaaccaatctgctgcgcgcgcgcgcgccgccaaggccactcgcaagtcgcaaaatcatataccttcatcggcgtacgtgagtgagctcgagcaacttagcaagcacaccgcacgccgcgtcgctccagacccggccgccggcaacggtgacatcggccgcaggggcaattactgctcgatcgttgctccactcctcgccatggcccagggatgccgatgccaatgccatcataggcagcgctggcgctgctactacacttgttaataaatggcccgcctgctggctaaggaggaagccaaattccactacgatgcggcgaattcttgaaacttccttgtggcgatcgaggcccgcttgttaatgttcaatagcggcatatataagtccaatagaatggatggtacacccctactgtgtttcccttaacatcataggaggggtggtaatgggttaccctccaagcgataactaggggaaatttgtgcttcttctcattgattcaagtgttttacttgatttgtgtgttcctgccaaaaattcacttgatttgcgcgagcttagttggactgctgtgtcaccagtgctgggttgtacatcgtcgctgtcgggtgagatcctctatcataatgttactatcattatagtcattgttatatgggttccatccttctattgtcccacacgtcagtgcctgtaatgtgagtgtcattatggtagaggatgtgaacccgtcgccgtcgccatgtgagggggagactgactactaagttccatatagtttctaccttggactaccatgttgacatgttacatgggcaaatgtgacaaatagttgaaaaaaacaaccaccttagagggaaaaaaataaaagcaattttaagatgagcattggataattgccaaatctaataatggcaatagttaaattccccaataactagggtgcgtttaggagagaaggttgggaattttctctggcgcatgtaaaacatgataattcatgagcacgtgattaattaagtattagctattttttaaaaaaaataatatgattttttaaagcaactttcctatacaaatttttcaaaaaaaacatctttttacaatttagagaacgtgggtacaagaaacaagagagtagaagttgggaacatgtagttccaaatacaccgtaaacatgtggttcttaaccaaaaccaagaaaaaccagagaaattttaccgaaagttttttttatttaattgcttttaacttagcagatattcccttcgtctcaaatataaacattttgtccagatttatagttaaaagttattacatttttgggatgaaggtagtatatcagattgttttcattacacgaccacaagtccacgacgataaacccggttaccgcagtaaccgacggtaagaaaaacccagcgcggcactcaactgcacggtacattggtactacttcggcctttatttgccaaagatcaaattctattcatctcaaaagatatactccatcatcaaatgtgacgtcagttatcccaacatcaaattttgggaattttggcaggatagagtaataataacatggcccatcacagaggatgggccatggaatggtccgtgctaaacggtgtctggcactaatgcactgcagtctatgaaatctacgcaccacaaaaaagtgtataggaacggtgaagtcgaaattttgtttatactatggaagaagtgataattgcgtaagcaaatttttaaattcatttactaaattttaaaattcaaaagaattttcagccttatgccacaaaggcatgtcagggccacgttaaatctgatgcaagattgaaagtgacgatactttagagttgaatagtgttcaattttaaaatttaaggctgatccagtctctgcaaaagcttgggggggttctaaaatggacattttccttgatataggaatacgtttgatatatttttattttattgcttacaggtaagtaattatgatagtgaatgcagtttgctagatctagagttctagacagaaacatgatatgcttccagtaccctgtatgaagtaacaagcaatagaaagcacatgagcagcctatagcaatattagttcaatcatgacaaccaggccatattaacatgttaatcatgtacttataaacagataacaagaccaaggcataatcttccattaatacaatgcaactacattagttacgcatagttggcaaaaattttaatgtacattaggcagtagcatagcacatagcacattcataattcatagattgatttgacttaaaaagaaaaggggttgtatttgaagcacatattacagaagagcaattaaaatgaaacctactcaatttcgatatggtgatgcaagatttatatatacaaatctatgagatggtagaaactgactcacatataagggaaaattgcaaatattttttatcacaaagggatgctatacgattggcaatatattctataacgatgtttcctgaatcattgaagtatcgaaaagttacaaattcataattaaggaacagacttatattaaagatattagaagtcagcagtttatgacaggaaatggcatcactaaatcaccaatcagacaagaaacattgcatggagtccagttctcccgcttataaacaccattccacattcttccttatcgtagtattccatgtgcaatgtttaatgtgtaaatgtttcattgccacagagcaccgttatgttatcttgttgcatatatcaggtgtatagcaaaactgaacatttaataactaaatttacaaactgagattgttggtaaaaaatcgtgcaggataggagaccataccatagcaactaatacattttatagcaatcgactagttagtgtaatctgagttgattttaacagggttgtaaatggcaatccaaaaaagacgagtataaagcaactatttttttgcttcacaaggggggcaatttacatatcaacaattcagtgttcccattcatctagaaatgcgactaaatgcaacattagagcttcattcagataacaatacaaggacctatgatcagtataagaagctagaatgctagagcaatcccaacaaatggggcaaatgaatcccaattgcacaactactaaccttttcagaggccaaccaatgtctgaaacttttgacttcactaactgtgatccaagttttcatcacccaagtatcacaaaatgtccttgatgaagtcaagattgagcgtgtcgcggacaatcagaaacatgccaaccatgagtaccaccagtatacctgacgacatgatcctctgttcgatttcacgggggatcttctgcccaccacgggccgcctcgagaaggatcaacgccaacgtcccaccgtctaatgctggcaatggcaacaagtttattgcagcaaggttgaggtttatcacagccgcaaactgaaacaagccctcggcgcttgacctggccacctctgcgccaaccgcaatgattgcaactggaccagacaccttctccgccgtctgcgagaagttgaggaacgtctgcctgaggccgtcgagcaccgtggcgctcaatgcggtgaactcgcgcaaggcgaggacggtggcctcggccaggttgttggggtggacgcgagtgacacggaagtagggcgagagctgcacgccaatgcggccggtcccgtcgacgctggtgtccggcacgacggtgaggtcgatggacctccggtcgccgggtcctggccctgttcttgagacggtgacggagacatccttgttggggcttgccttgatgaggtcgacgaggacaggaacggaggggtccggtgcgaggccggggacggagaggatgacatcgccggggaggaggccggcgcgggcggcggcggagccggggatgacctcggggacgaggacgccggggagctgcgcctggacggggacgccgacggtgagcgcctgggcgtagacgatgaggaaggcgaagaggaggttggcggcgacgccggcggagacgactaggaggcggtcggggacggggcggttgcggaggaggtcggggtcgtcgggcgggaagccggagtccgggtcgtcgtcggggaagccgacgtagcccccgagcgggatggcgcggagcgcgtactcgacggggccgaggcggaagcgcgcgagggcggggccgaagccgacggagaactgggagacgtggatgccgcgggaggtggcggcgaggaagtggcccgactcgtggacgaggacgatggcggcgaggacggaggcggcggaggcgacggactcgacgctggcgaggaggtcggacggggcggcggcggagacggagatgggcctggaggaggggtggcggtggcggcggaggagagggaggtgggggtggagggatagaggaggaggaggcttgagggtgggagagaggtgggtggtaatccgaatcatggtgggagggggagggggaggggaggaaggcggaggagtggataatctggcattctcttgttggggagtttgaggcgcgtggggactttggtggtgcgcctccgccgccggtgagagagtgaagtcgggaaatgtttgtgtggatgataagcgggtgacgctgcacagcagtaagccagaaaagtgagcatatgtttttctttttctctcgtttttaggcgcagaagcccgaaattcatttctcctgttgggctaaaagtcacacttatatgggcctgggaatctgggatgggcgtgggtcagcccgctggtaatgattaattggtccattcagattcaagtaatcaagattcgaaaaaggctatttatactccctccttaaagatcagatccgattgttattcctcaactataaaactgggtatatttactcctccaactattaaactatgcaaaactatactctctcagtggttttagaatggttttggccacatggagtccaatggatagcccaataattagagaaattaaaaactaaagtgaggctcacctgtcggtgattctcccatcttctcttatctatcctctctaatccccattcttctcggcctcctgaaggtcgacgctagtattgtcaagacagaataggtatcagtcggcttcgatatcgaaagtagtcttggccgtgtttggctttaattgggccaaaaacactagacgcaaaacttacaacccaattacacccaacacttcacataaagaaataagttcactttaggtccatcatcttaacgacgagtttaaattgcgtccttgaaaccataatacaaagtataacgcatctctcaacttgcaatataggtgtacacgagatccttaggcaatagagttattggttttagctgacatgacgagttgactacggtcaacccatcttaattagcacaggacccacatgggccccagatgtcagtggccaactcttctttccctccctcaccccttctctctacaatctctctccctcacgatggccctacacgagatggtggcgcgtgcatttgccggtggataaaggtggcgagcgatgggaagaagcatggcaaccagtaggggtgggcgttcggtttattagctcggcttggtttcatcagtttaaaagatattcggttttctagttatggcaaccgagttgtttataaaagaatacaaaaccaagccaaataaaccgagttacttcagtttggttgttcggttttaccgaacaaaccgtaggaacacgttgccatgagttccaaagcacacaatacttttttttttgcggggaaagcacacaatacttaagaaatcgcttgacggcacatgcaatggcagatcaagagacaaggagttttcttacctcacataccaagactgcaagagagtcatgaaacttggagaaacctggcaaccagtagactttaatacagatactccctccgtcccaaaaaaagacaaaccctggtttccgtgtccaacgtttgaccgtccgtcttattaaaaaaactataaaaaaattaaaaagataagtcacacataaagtattaatcatgttttatcatctaacaacaatgagaatactaattataaaaaaatttcatataagacggatagtcaaacattgacacggaaacctagggtttgtctttttttgggacggagggagtatgtggtagttgtacgtgcacacgctcagatcagtcgtctggagggagttggaccggcgcaacggctgcgacggctgcggcgatggtggtaaggtagccatccagccacgacttcgcacgatgatgagacgacgccgaacaacgctgggttttctaggagatgtattagtgttagattagtaggccttgggcccaattaaagagctgttggccttaaagtttgtacgttgccaggtttgtgatatgtgtctaacgtgtggttcagtttctcccgttttctcatattgtttggttcgtgagaattgaaaaccgtagataacaccgaagaccgatcagatgcaaaacagaagccgaagaataaaccgatgcccgaaaaaaccgacacttcttcagttcggctcagttttattcggcttgcggtcttcggggattctaacacgttgtagggttcttaatcttgaagggctactcgagccgctgcgcggcgagtttgaggccttccagtcagccatagctgcggttgccacccgtccaatccgcctcgctcgccgcctctcttcccgtcggtgacagcctttctctccatcacccgacgcccgcttcctagcctggagagatgggtccacgggaaggagaggaagaggggaggaagaagagttggcaattgacatgtgccaagttgatttagccaagttggtcacagtcgtcgtcacgttagagcatctccaacagcttctccatcccactctccaagcaaaaaattagctattttgaacaaaaattgtactccaacagcctctctattagaatagccaagccaaatgacttgccaaactcctctcctcaatggccaaatttagccagcccaaactgccttgccattggtgggtcccacgcgatacgtcttctctcacctcactctacgcgtcgtgactgctgcaagcggagaaggatgtggcggtggggcagcacgatggcaagcgtcaccatggcctcccgctcgccggccgccggcgtcgagggcatgaagggagcagcagcaacgaggtattgtcatcgcccgagctctcgcccattcctgcgcctctcctctccaatctctccatcacattcacgcgccattgcatcatcgatcgagcattcgactctccaagtagggagctggagccaatggccaccgccaccctccacatcgacggcgacgacgtcatcctcgacgtgggccatctggccgggcaggcgagcggcgacaatggcgacgcggtggacaatgcgttgatgaggctcccgtgtgctctcaacgcggtcggcgtcctcaccggcacgatggccgctgcggctgccaggagtggtggaggtgtgggccgcgatgtggatggccggggattgccgacagccagaggggagctcgacggtgctcggctgccgggagtggtcggcggggagagggagagtacctcggcgagcgttggcgttaggggaccgccgtccgtcggcatgcgttggcaacatcggtcgacgcctcgacgagaattcgggaaggaaggaaaggggaaaagaatgaaagagaaagaaggggggagagagaggggaagaagaggggagggaggctgacatatggatccgattttattttggagaggattaatagagagtttgttggagtgagtatctaatttgactgtctaaatcagaaggagagttggccatatgtatgtttggagagttcgatttggagagactatcggaaagactcttagccagaactaggcactgcccctgtgaccttggacacattgattttacaagttaagaaacataatttaaacttgatgtcaagatgatgcatcatgataacccggtccacaggggtacacagggtgaccactcctcttcccctctctgcatatgcgtcagccgccaggcgacggcggacggccaccgacagccgccgcatgcagctagggtcgtgcccgtgcgtgccggctttggcggtggcgtgtggcgatcaccggcgtcctcggaacgagcaagccaacgacgcgaggatgggacgggaccaggggaggagggcagtgccgcggcctgcagcggttgcgtgcaatttgcaaagcagtctggagcttggttgcgctggagattggagcagccgggtgggaaggagacgatcgagggtggatcatcggatcctgtttccgacaccaccacagtaaaggaaggctcgttcccaaatcccatttttatctgttggtgtgtaaaatgagaaatcaatgtacttcagttggttaatttttttttactgtaaactgtggactttatcactgcagagaccaaaatgaaggaagtatgtggatttgaaatcacactcttcttgttgtaagaacaccgaaattaataagcatcatgttctggatccatcagaaatgcctctcaagtcccatgaatcttttcgtatgctatatatttgtcaacatagattatagtttgtcaattgttgtttcattcatggattgaattttttttctaaatatgaaccttacatttagcttttagatacttcctctatccaaaagtctaatacctatttcattctttggttttccaaaagtctaaggcctatttgtaatctctatatgctaaattaaattgttgaccggaaccaagacgtccttttagtacttactccctccgtcccaaaaaaagacaaaccccggtttccgtgcccaatttttgaccgtccgtcttatttgataaaattatgaaaaaaattaaaaacacaagtcacgcacaaagtattaatcatgttttatcatctaacaacaataaaaatacaaattataaaaaaaattcatataagacgaacagtcaaagttggacacgcaaacctagggtttgtcttttttttgggacggagggagtattgtcacatgcatgtgtgtagttcattagttttgtcactgggtggatgagttaattacttcttggtcatggtgataaaagaaatatgtttttagatttttggatgaagggagtatctcttaatttctgagatatacatgcatttaaggtgctcgataaacacgtagctaaattattttattgttaactaacctgtaatctctctatgttaatttgtggtgttttgatattgtgtatattgttttcttttccatttaagtatcccatagtaactctgaataccaatagaaatcttccatctgccacagttttgcagtgcattccattgtatgggcttaaacataggaatctcagtaaagaaaagaatgtgatagttacaaccttttcaatcaagattcattatcagcggtgtaatgagatatatgattattccaaattccaatgcaatgtgcttgcttgatattatgtgaaatcacatataggtgaatttagctttggatgtggatttgtactgcacagtatttaactgcaggcagcgcacgctatccttttttcccactccatacagttctactattcattattcaatgtatgggaaggtagcctatgctcatgtatcaacagagtattttcattgtctgtttcttgcagaataaaccatgcacatgctgatgaaaagtgacagccagcatgtatcatgcatcccgtgagagctactatgcactgaaaattggtagtgttattctgtgttacatattgctactgatgacttgatttttattttattttttcaattaaagctgaaattaaacctcccattctggctgttgttcaagacaaaaggtccatcttttgctattttgttccatagcaataatgtcagaaaaagcctatataacatgtacaatacaacatatctgtgttagttatttaatttcttgcttgatctgtgaagtgaaatcagatttatgcatgattcttctttgtggtttatcagctgggatcacatgatgcagaaatatccaactttggtcttgtgttatgctacaataaggtaagtcattctttgacaaggggaagaaattccagcattcatcaaaattagtaatatttagtaaggaaaagtattacattgtattgaaagggtttcctttgtgacctaaattacaggtgtaacatgtttgcaagtgtaaaaaattatactaagcttccaagcatgcccttacatagtacacgcaatgtaatgttaacaaaaaatttggccatgaacatcgtgttgaatgtcaatttcatgagcacttttagcttcttttataaattcctacttccattgttggatacagattcaagatgatagatgatagacttaggctgtgttctttcccccattttcccaacccacctctctcgttttccacgcgcacgcttttcaaactcctaaacggtgtgatttatgcaaaaactttctatatgaaagttgtttaaaaaaattatattaatccatttttttaaaaaaatagttaagacttaattaatcatgcaataaaacaaacttcgttttgcgtgctagagaggaggggttccac

SEQ ID NO: 46125 - DNA, 39559 bp, Oryza sativa
ttccaccccctcctccgaacacagccttagatgagcacatgatagggtaattactaagaaggtaaaatggttatgaattaagactacgcaggtagttgggagactattgtaaaagactaatgcttttgttgccttctgatttttccttttcagaacagttgcaaatggaagttagcattatagaacttggaagccatcttgattgtgtggacaaacataccaattccaaagccgtctttttaatctagtatatcatgatgccatggggttatttggcctagcttatttgcatatgtcagaaagaactagggaattgtgttggggggcacaaatagccattttattagttctcttcttttcattgtatagttggcctggcagattttagctgattggctgaaaatatgatcctattgcttcacgctcatgagaaataaagggaccaatttgttgatatgcactgcaaaagtcgatggtcgatgctattcctgacttggtgtagagaatcacggacctctatagtaaactaagtttttgttctaatcattgatcttagtgattctatacggtcaaataattcagtttatactaaccaagcctcattgaaatgcccaaagaattttgtcgccttcttactgacaactggaaggacttaattctgtcatcttgcggtaatattcaaattaaaatgatgaactaaacaaggaattataagaaatcatacatacatattaggagacagaaactttggcatgggaacactatgttcttaagaagtggtccagccttcagaagagctctgatatttcgagttttcaggtaatgcttctttcccactacacctgaacatcaacggtgtgttgtagctgcttcaatcttcagacttttgtatgaagtttcatggtaaacatgtatctagctttcgttccagctgtgcacctctaaagctgtactctgcaaaacatgcatctactcattatattactttgcattgattttcatcaagtgcatgtgctactttaaaatattttctgttaagtcaactgatacgtaaatatccgtgtgaaactataatactctagagtctagtgggaaatattttgtagttaatgtataggtatcagttccaaggggctattactaagttgtatgtattgtgatactctagtagcacctctaggtcctgggcccaactctctatagaagcgaatttcaggtctagttaaaaaaaatcacttgctagccctcgtaaaaaaatgtgttaagaatcgacctattaagggtgggccctcgtataggggacaagggctttaaagcaggattaaggaccgatccatacgacgtgagtccgcgtgttaggggccaggtttcgtggcttttcttagtcggtttggttgaggcttcttcttcttaatgtggggtggtcatgcctccactggtcgagtttttttaataccaagttatatatatgcttattagtaaccaaatctgtgggatgtttgactgtattacagtgaaatactggagaaatctgggagttagtattaatgaggacttgttgctgtggttttctgactatgagctaccacaagaaatgataaatagatatctattattgaatctggagatataatgtgatactaaagcataaatagtactgctgcactgcaccatgcaaggacaagtggtccagtataagaaaacaagattatggccaacagctgcatgaacctccatgtgcagcttcaaaataaccggctgcctttgaatattctactgcttcccctcaacagagtcaacattagccatattgttttggttgcaagttgcagcttgcaacactcatttctcctgagaaacccaaccttcttgcaggtagaggaacaaggagggagatggctggcctgatttcttcaggaatcatcaagtggacggcaagcaagctttcttcactggtttcggcatcacctggagcatcagcatccaatgagcagagttctgcactcagggatgtgaggacgctgcagaggacgatggcgaggatccagcgcacgcttgctaccaccgatgagcacagcatcagagatgcatctgagaggcttcacctgagggagcttcagcagtttgcctacgatgcccaagatgcaatcgatctgtacaagtttgagcttctgcggcgaaggatggatgatccaaacagtcatggagatggcggcagtagccgtaaacgcaagcacaagggggacaagaaggtaccaccagttcttcgatctcctgtgatttttcttttccttttccgtttgattcatcagaaaagttttgcagatttaccattttagtgaaatgcaagcatgtggatggttggtctaattactcatgttaccataggtagacaatattgattcttgaagtatattgacatattccattatctctaacataagaatcatcgataaaaccgttgctagtctgcagctgttgtcatgtcaactacagtgaaataaatgagctaggtaaaaacatgggattgaatgattgtaataatttaatgaagaaattatcaaataaaaaataaatttataaaaaatggttttataaatggttttataaataaaaggcactttctacaagcaacttactagaaaaatattattttctatttttttattcaagtattttatctccaggaacctgaaactgaaccggaggaagtttcaattcctgatgaattggctgttcgggtaagaaaaatcctagaaagatttaaggagatcacaaaggcatgggatgatctccgtctagatgatacagatacaacaatgcaagatgaggaacatagcatgctcccactgcctactaccccatatgttgacgagcccactatctttggtagagatgaagataaggaaaagataatcaaaatgctgctctctgtgggtggtgccaatgaaggagatgtgtcagttcttcccattattggaatgggtggagtaggaaagacagcacttgttcaactagtgtacaatgatcgaaggattctgaacagatttgacttgatgggctgggttcatgtctcagagaattttgatctcaaaagcataatgcgtaaaattatcatgtccttcacgaaaaaaccatgtcagatgacacaaatggatcagctccagtatatgctaatagaacaagttgttggcagaaagttcttgctggttcttgatgatgtgtggaatgagaggaaggatatttgggatgcattattatcagccatgtcacctgcacaatcaagcataatattggtaactacccgcaatacaagtgtgtcaacaatagtccagacaatgcacccctacaatgtgagttgcctaccttttgaggaatcctggcaactattcaagcagatggcctttttgcaccaagatgagagtatgaaaacagattttgaggttattggcagaaaaattgttcagaaatgtgctggcttgcctttagcagtgaaggcaattgccagtgcacttcgctttgaggaaaatgaggagaaatggaatgacatattggagagtgaacaatgggagttaccaacaacagaggatactgtgttaccggcgttaaaattaagctatgatcaaatgccaatccacttaaagcggtgctttgttttcttcgcattattccctaagaggcatgttttcttgaaggaaaatgtggtatatctgtggatatctttgggcttccttaaacggaccagccagacaaaccttgagactattgcaaggtgccttaatgacttgatgcagaggactatggttcagaaaatactatttgatggaggacatgattgcttcaccatgcatgaccttgtacatgatcttgccgcgtccatctcatatgaagatattttgagaatagacactcaacacatgaagtctatgaatgaagcatcaggaagccttaggtatttatctctggttgtgagttcttcagaccatgcgaatttggatttgcgtacattaccagtgtcaggaggtatcaggatatttcaagttgtaaattctatggatgacaatagaagatatttttcatccttcttcaaaaataacagaagatgcttctccaagttgttctcacatcacattaaccttacaattgataatgagctatggagcagttttcggcatttgagaactttagacttaagccgcagctcaatgacagcattgcctgattcaattagaggactgaagttgctcaggtatctaagtattttccaaacaagaatctccaagctcccagaatcaatttgtgacctccttaatttgaagatcttagatgcaagaacaaactttcttgaagagctaccacaaggcattcagaagctggtcaagctccagcatctcaatttagtcctttggtctcccctgtgcatgccaaaaggaattggaaatctgaccaaactacaaaccttgacaaggtatagtgttggaagtggcaattggcactgcaatattgctgaactacattacttagtgaatatccatggtgaattgaccattacaggattaggtagagtgaccaaagttgatgatgctcaaacagccaacctgattaataaagagcatgtgcaaactctaagattagattggtctgatggattctactctagtgaatgtgatcataattctagtcatatagatgtaaaagcaacaccagaattagcagaggaggtatttgagagcttaaagccaactagcaacttggaggagttagaggtagctgactattttgggtacaaatacccaagttggtttggaggttctgcctattcacaattggccaagataactttatggaagcaaggctgcaagttccttccaacacttggccagttacctcagttgcgtaaacttgtagttatacgcatggaggaagtagagagaatcgggcaggagtttcatggcgagaattccacaaatcgattcccagtattggaggaattggagtttgagaacatgccgaaatgggtggagtggactggagtttttgatggtgacttcccttcacttcgtgagctgaaaatcaaggacagcggtgaattgagaacccttccacatcaattatcatcctctttgaaaaaattggtcatcaagaaatgtgaaaagctgacaagactgccaactattcccaacctaacaatcttacttttgatgggcaatcttagcgaagaaatacacaatagtctggattttccaatgctccaaatattaaaagtgtgtttcacgcaaaaacttgtgtgccttgaacttgacaataagaacctaccaatcctggaggcactagctataagtggatgccgggggctattttctgtggtaggattgttcagccttgaatccctcaagcttctaaaaataaaagattgcccaaacctgcagtgccctttacaaccacttcaacagcagcttcagtaatgtattatcacgaactgtcctcaattacaggaatggattgagtggcaacagtctctaatagacaaggaagataaggtaagagctttttttttttatctgtgctttctttgtgccttttgttttttgttttcttcactgaaattgatgtattttatcctcagcagcaaccagaatttgataatgcaagttatgatcaagaggctcttggtgcactgagcgacaatagtgaggatgatgttgaagttttcaatgaagatgaagatgacgatttctatgatgaaatgctagaagttgggcagtcaagcgggacagcaattaatgacgatgatggaagtaacgatgctgtttgaagtatgagagcaatatttttgaacatcacgtgcaaatgattttgtttgcatgtcgttctccaacttcaacttgattaatccaatttgatgtgctacttcctattttttataaaaaaactacagtgcaaaatataccaatttcaggtcgaaaaaaatatgtgacatacattccattagctggatagctatggttttaatgtaggaaaaactgttatataagtgtcttacaaaatatttctgagctcccaatcttgataacaaatgaaaaaaaaactcatagaagtaggaaacatgaaccgtaagtagaagtatttaaaaaacatgtggtttgagctttctaattttatgacaaacttggctaccatcacggatttccagtgctgcctcaaatttccctttggttcagttgcatttctcggataaacaagttttcttgttagcgacaattgcatattttttattaataatttcatatttttgcaactaattgattgtcactatcactattcatgcatcatgtttatgcgtctgcaggactgcaattcgtccagttgtccatctatggtgacaaattgcaattgtctagagcaagacagggtagtaaaaaggtacagctatttcacgcgtaccccaagttgaatgtgtgtatgcaaccttggttgaatgatcgttagttatgaaccatacggcagctaagatccagatttagccgtttggttaaatatcgatccaattatatgcattgaggcagtaccagatacataaggcgttaatttctcaattatcaggaacgaagaaattggaggaaacaaattaaaggttaaagacatcaccatcaactttaacaaaaaaatcatctttgcataagcatctactacatccagcagcatgaacatatagtgtttaaggtatcggacatggaagatacttaaatactaagccaaacggttcatatttcaaaattcagctaacacctcaaacggtttcactaatcatgcagatcacacttcatgccagatgttcacttcttatacttctttggtgccctgcatcattacgaagttgcagacgataaaactttatgaaaacaagcatacatatttgcaaatggatggttcaatgctacttacgccgcagtttgagcaggcactgctggagcagctggctctcttgggccctgtttgtcatcataaaagtattaaaaacacatggccagcaaataatcaaatatgaacaagccaggcaaatatgctttaccatggaacatcttcaaaaaattaatcatgatttgacaagcttattgtaacatgaatgacgtcccagtgtcatttaacatgaatgagttgacagcattgctttactagcatttttttatttggtggaataagatatatttcaatattgaaatgcaaatgctaacacattagatattccaatgaaaaaaaaaaaactataaccatagaaatcgtctcacctgagccaacctctcgtcacgcctggcaatcttcctctcacgactggccttgctcttggcacgcttagcctcaaactggtcagagagtgtcttctctcttgccttctcagccttagacttgtggatactttccatgagaacacgcttgttcttgaacatgttacccttgaccttcatgtacatgtcatgatacatgtgcttgtcaatcttcttggcctcacgatacttgcgcagcaaacgcctgagcacacgcatcctcctcatccacaggatcttggtggggagcctagcctccctggtacccctacgcttacctgcaaaatggcagaataaggaatacgcagagacattttcacactaaaataacaatgaacttaattgtacacaacgcaccatagccagagtgacgtcccttctgcttggcctcatgggctctccgtgcacgggacctggagtgaatcttctggggcttcttgataatgaacccatccttgaccaacttacggatgttctgacctgcaagcacaaaggaaaaaaaatcagatagccttccaagaatttcaggcatgtgatatgagtcacagatatatacagggcaacaaacttcagtatctagaacagtaaataattaataggatattttattggttcttgcaggaaatgagttgtgacctattccaataggacattacacaaactcgcttgcagataagctacaccataattcatacgctcagacaggatcataccacagttgtacaaatggtgatgcagaatcaaaatgaaccaatgagctttagaagttggaattgcaattgcaaaactgacaaaaaactgatcctttaatggtaatcatcatttgggcatgaattgccagcatcctaactgatttaggtaacgaataactcaacgaagaagcacaaatgcacatgcatatctaaatgcgccaggcatccccttgtctctttgtatattaatcactatagaggacagttagtcacattcccagaacagcgccttggattagaacccctaacgacaaccttgatcaatcggtaacaacactgcatggtccaatctagatagcatacactccaaggtcaatatactggccatttctctaatgttctcttccaaacaaatacacccagcacaacaacctaacaactcctatagaactgggagcacgcgattcccacgaagcaataaaatattcctaccagaatcgccgggggcaaaaattttcgcgcggattagcagcatggcttcagatctaagcaaatcacgcatcaacaccacacaagtagcaggcacagaacatcatacggtagggcaaggggagggttatgggggggagggacgaggaggggagttctcacgggagttggccatggagatctcgttgacctcattggggtcgagccagaccttgcccttgccgcatttgagcacgctggaggcgagccgcttctgcagcttgagggaaaccatcgccgccgccgccgccggcttcttacctgtgtggagtgtgtggtgaggggggtgcaagggttggccgcgtgcggcgccgggggtttatatagtgagaggggctagggtttcagcccgagcggggagactcatgggccttgggcccatcagtgtgttggggtttgcagcgggaataagttcactttatgaccctcaaatgtccacgaccttaaattacaaaatcggatatctcgacccccaaactcctaaaaccggtgcatttgactccctggaccgttttgggaggcggttttgctgatgtggcgccgtgcggtgcctacgtggcaatattgaccgagttttcggtccacgtagcgttgacgtagcacctacgtggcggtagaattaaaaaatatgcatgggacccattagtcattcacacaaaaagaaacatgggcccactaacatatgggacctatatcctcaagaactcatgtcgacgatactgtggggacgagggctactagttcctaccgcacgatcggaactgtggcatgctaaataggcgcggctcttacccccagatgggccaagtttgacaagtactccctccttcaaaaaaaaaaaaagacaaaccctgggtttgcgtgtccaactttgactgtccgtcttatatgaaatttttttataattcgtatttttattgttgttagatgataaaacatgattaacactttgtgcgtgacttgtctttttaatttttttcataatttttttaaataagacggacgtcaaatattgggcacgaaaattagggtttgtctttttttgggacggatggagtagtactgctgactttgttagtttgtgctttaatattagcaaaaaagtgtggtctgtggtgtattgcatgggctgttcctaaacatgcatgcacctaattaatctaaatgtactgtgtgggtggatcatttatttgctggtctgatagtttgtttagttcaaaaatgtatctttttttcccttccgataacgtttcgatgcacctttttgattacgattgtcgacgggtgatacccgtagaccggatatagagggtattggggtacgctggtacaaggatctacgtagtacgacatcgagtaatcaaaagacaagaattatactggttcaggccccttgataggtaatagccctaatccagttgatatgggattatatggtggaaaacacaggttacaaaggaaagatggaacttgtcgaatccggcgagattgtagtcgagttgattcgactagctcttgacgacgtggcccctcgcaggctccggcttcgtaggctgtgtgggttgtgttggctctgagattcgatcctctatgccctccccaggggtcccttttatatcgcaggtctggtggtctccgagtaggactcgaacacaccagacccagacccagctcaatacgtaggtaacccagttcttatccgagaaggactcttcccgtctattgatttcgtgaaaggtttccttagatcataaaggaaatatccgcatacgcgtgggtatgccatgtcgatacgtaacgtatatcgaagggtagagggtatgcctgacccgtaaccctgacagtagctcccgacttctgctcaaaatgaactcgtgcgaccattcgcgacttcgggtgtcgagaacgttatcattccaggtacgagaaccacggagatgacgtgtagtcgaacatgccgtttgaagcccaacggtcacgagtgaattttgaacttaagtcaaaaactgccgcgcgtaatggacctagaaatttccggcggggatttctctcagttccttggaattcgcaccgtcgggggtgcgcctatttaaagggattttgggtgcgcattttgaagtccgcccactccatcaagcacacaccgcccgttagcgctcctcgccttctccactgccgtaaagaaccctagcttcgtcagctttaggtccatctctggcgatcttccagcagcgatggatctcggcaagtcggcttccaccagcgcgaccctgaagaagctccaggaggatggcgcccttcctggccgtgaaaacgcggagagggaagcaggaggtacaaatcctcagcccatcttaggtcgcatggttgtgatcgaagattatgttgtctgcgggtttctctcttcaccctccgaattccttctgctggttttgaatttctatgggctttctcttctgcacttgaaccccaattccattgctttccttagtgtctttgtgcatctttgcgaggcctacattggggtagagccctttcttgatctgttccgcttttattacgagttgcgctggatggaacccaatagggtgtctggttgcgtcgggttccgacttcgtgacgggatgaagtcgcgctatgtccccttccagtgtccctcttctcgtagtaaatggcggaacaggtggttttaccttgaaatcaaggattcaaatccgatcctcgttgttcccgaggaacaacaagattctggtctggaccgccaagccccccttgaccccctctctccaatcgtttatcgacatcatcgatgatctccgagaacggggcttatcgggatatgaagtcgttgcagacttcgtcgataggcgaatccagccgctccaggctcgggcccacccggcctataactattccgggccagatgacgcgacccgggtttctcctcggggtatctttctcgcattcattttgatatgcttgtactcgcgttccttttcgacttatcaaaaattgattccttcttgacaggtctgagcagcgaagccgtggagcggcgtgttggtcaggtgatgatcagcggcccgactacggcgagcgacatccccgcacccttttgtgaaaggggagtgacggagcacgacgaagcaatcaatgtgagttcattcgataagcgtccgccttctttgctcaaaatcagcttatgacatgatttagtgtaggcccttcctttgactgatgtcgtcggtccgctcgcggatcatcaggtggcggcatctctgaaagagaaggtcgtcaaggtggcgtctgacgctgccaccactagtggtggcaaagctccgactaaggcgaggaaattctcgtctgtgctcggacaccgccgcaaggcggcgactccctcagtaattttcaccttgtcgtcaggttatgtagcaaggaaggtttgttctcactctatgttggttgttttgtaggcttccgacgtgtctcctccgcctgcgcgacgtaagcgcattgtgacgatcggcgagaagtaagtaaagaaacttttagattctcgtgtcttctgtttgagtggaattttgattcatggcggtttatagggaggcgcgggcgaacgttgctcgggccaagtccgggggaacgtctagcgcgtcccctgtcacggcgtcaacagatgtcgtgcccgtggtcgggagtcgggaggcgacgccaagcggccccgtcagcgatcccgctgggggtcgtggtctgccagaggccgtcctcacctgggaggagctccaagtcgaaatggggcgccttctcgaagccggtgctcgcggcatcggccgcgagatctcagaggcgagggcggagacggcggcggccaacgcgcgtgccgagcgcttggtgcgggaactggctgaggcccgcgaggacctcacgaagatgagggagctggtggccggcaacgagcgccagcgcaaggggctcgaggaccgcatgtcggaactcggggataacctctccgagatccgtggttcgctgcgggtcacctacaccggtctccaccagcttgccgaggagtgcggcatcaagtccacgatcccggcgaaccccgacgagttctcgttgacctcttctcttgcggagctggcgacggcgatggggaaatcccctccaagcatacggccaggatcgcggaggagacgtccaacggcatctataccggggcgtgtcatgtcctcgcgtgtgtgaggttgtcgcgtcctgaactcgatatgcgcgagatcttggatcagggggcggcaagcgacacgcgtaagaaggtgatggaagaagtcgatgacctgggggagtctgtcctccccctttttgaagagtaggacttcttgtattttttgtgacttgtaaatcttgaactctggttgccttcgtgcgtgtgattatcatccttgttcaccgttgatctcggaagttttttcttgtcgactgtagagatgctgatgacgaggatgtccagcagcgcgggcagcccgagtcactggcgataattccggtattcgagtttgaaccacacgtcccacatgacgtcgaggaccaaactcttgatgcggaggtcgaagtgactacaactgcctcaagtgagtagccattctaccttcgagttctacctttgtgttgttttggggatttccagcttgtcttagtggtcgttatgtttagcagatctcaaggatgcccttgcgacccaagatcgtcgtatccaatactggaagacgaaatttgaagtggtggaactcgagagaatcatgctatccgtgaagaaagagcaagccgtggaaacgctccgaggccgcgaggtgtggtttgggtcatacttgaagaattgttgcacctcgatggctagggtatgcagggagcttcgagtagtccgcggcgatcctgaagaatcggcggccgggtacatctcgtggctcaacggggcctgtgcccaactcgatggcatcggcaagcgaatcgacgaagccttgaagcaagagtgtcatcttgcgagccgatatttcggaggacatgtgttagcttgcctgcgagatcaccgcccacgcctggatctcgaattcctccgtgaaggtttttcttgttctcggaggaatccggcggagatagaccaccttgcgaggtcgatgtcgccgttggccgagaagattttccagtcaatggactggcattggctttcttggtagtatttgtaccctgcgaccagatatcttaggggaagatgtaatgcagcgaaatatttatgtacaaactgtaagaaatattttgtgaataaagaaatctatctttaacaaatgtttcttactctggatgtcgtgtgtatgagtgtgttctcagttaatgactttagttagccgtttgagtcgtacactctccctagcccccagctttgtcgtcggaggaattttctcggaggacaaggctcttggacccttgacctgtcttggttgaataagctctgatcctagcacccagccgtgaagttggaaagctcggtttccgattacacgacttggttaatacgcacggcgagaactcttacacgaccagatcttacatggtctttcgtctctaaaggatctgacaaggccttatcggctctaggcgtccccagtcgaagatcccttaggttcctcggaggccttgtcaagacggcgtaaagggacataaggacaggtttcaacgctaggtgtcgtcagagtaagggatcattgggtgaaaacactttggtcgtgacatgtgacttagaaataggctttattgatactgtaagggtgcttacaggtacagtggtattgactcatacatagaatttacgtagttggtcaatgttccacgaatttgctagttcgcgatcgtcgccgtctgcgattttgaatgcgcctggccgcaagacttgtgtgatcgtgtagggtccttcccattttggtgagagtttgttttgccctgcttgggtttgaactcgtctgaggacatagtcgccgatcgaaagtatgcatgctcggatgcgcttctcgtgataacggcggagggcttgttgatagctagctgctcgaacggcaactcgctcacgatgctcctcgagaaggtttacatcgatgtctcgctgtttctcctggttctcgtcggaatgcttctgtactcgtgtactttgatgtcgtaactcgccggggaacatggcttcagagccgtacacgaggaagaagggtgtttccttattggatgttgtcagtgtggtgtgcatggcccatagtactgatgggagttcttcaacccattttttgtcgtgtgacatgagtctgtcgtagacgcgggtttttatcccttgtagtactatgccgtttgccctttcgacttgtccattgctttgagggtgagagaccgaggcgaaacatattttgactcccaagccgatgcagtaatcctggaaatcggcgctgatgaattgagggccgttgttagttatgatgcggtgcggtagtccgtatctgcataatatacctctgatgaacttgatggcgttatcggccttgatttccccagtgggtactgcttcgatccatttggtgaatttgtcgattgctacaaataggaatctgtagccgccctgtcctcgtgggaatggcccaagtatgtctagcccccagcacgagaacggccaagtcagagggattgtctggagtgcttgtgcaggtagctttgtgtgcttgctgtggaattgacaggcttcacatcgctggactatgtcgcatgcatctttaaggtcggttggccagaaaaacccttgtcgaaaggctttgccgaccaatgtccgaccggcggcgtgtgacccgcatatgccttcatgtatgtcgaggaggagttgtctgccgtcgtcggtggagacgcatttgagaagtatcccgtttggcgcttttttgtataaatcgttgccgaccatacagtagatctttgctttacgggttattttctcggcctctgtatcgtcctcgggcaactcctcgctgctgatgaatttgattaatgggatgcgccagtcatctgtggtttcaatgtcagcaacggcgcgttctgcctcggtgacctccaagctgatgtcgggggtactcgggccaacttcaccgctaacttcttttaccgatggctttgtcaggacgtcgagaaaggtgccgggttcgagcggttctcgtctggatgcacgtcgtgctaggtcgtctggctcgatgttgtccttgcgatagacgtgtcggacctcgatcccgtcgaacctcttctcgagcttcctgacttctgcgaggtacttggataactcggggttggtgcatttgtagtctttgtgcacctggtttgcgattagctcagagtcccctttgacgattagtcgcttggccccaagtgcggctgcagctcgtatcccggcaagtagtccttcgtattctgcagtgttattggttgccctgaagttaaggtggattgcgtgcttgaattgatctccggagagagatgtcaagataaatcctgcccttgctccttggctgttgagtgcgccatcgaacgccattgtccatgtctcattgtcaccttggttgtctgacttattatctggcatggtccaatcggccacgaagtcggcgagtatctgagatttgatggctgttcgcggcacaaagtggatatcaaattggcttagctcgactacccatttcgcgatgcggccgacaacgtctttgtttctcacaacttcgccaagggggaaggaggagacaactgtgactctgtgggcttgaaagtagtggcgtagcttccttgatgtcatgatgactgcgtagagcagtttttgaatatgtggatatcttgtctttgcgtcatggagagcttcgctgacgtaataaactggtcgctgtattttctctgtctcgacaacaatgacggtgctaacggaatatggcgtggcggtaatataaaggaataattcttcattaggttggggagcaacgagtacaggggggtttgataggtagcgcttgagtgcaataaatgcctcttcggcttcctgtgtccatacaaatttgtcttgtttcttcaataaggcgaagaaaggctgtcctcgttctcccatcctagcgacgaatctgcttaatgctgcgatgcatccggttagcttctgcacctccttgagtcatgtgggcggcttcatgttctcgattgctttgatcttctcgggattcgcctatattcctctgccagaaacaaggaatccgagtagcttgcccgacggtacttcgaacgtgcacttctctagattgagcatgaggcgatatcgtccgaggttgtcgaacgtttcccgcaggtcgtcaatcaatgagtcacttgtcttggttttgacaacgatgtcgtcgacgtaagcctcgacattgttgccaagctggttgctaagtgcgccctggaccgtacgctggaaagtattcccggtggttatcagtccgaaaggcatcttaacgtagcaaaataccccgaacggcgtgatgaacactgtcttctcttcgttctcttttgccatgctgatttggtggtagccagagtaagcgtcgaggaagcttagaagctcgcaaccggctgttgaatccaccaactgatctattcgagggagaggaaagtgatccttggggcatgccttgttgaggtctgtgaagtcgacacacattctccattttccgttggccttccgcaccataactgggttggctagccactctgggtgaagtacttctctaatgaagccagctttcaaaagtttgtcgagctcttcttgtatggcttgttttcggtctggtgcaaatctccgcagtctttgctttactagcttggcatcgggtcgcaccataagtttgtgctcaatcacctccctggggacccccggcatgtcgcacggctgccaagcgaacacgtcggcattatcgcggaggaatgtgatgaacgcgagttcctatttctcatctagtgtagtcccgattttgatagtcttgtcggggttagcactagagagcggaacgatcttgatggtgccgtctggctttggcgtcttatttggcttgctcactttcttaggtggctcagacgtggcgggtggggtgggcgtttgctcgaccatgtcgaggctccgcttgtcgcactgcaccgccagctttgcgttcccctaaatagtgattgttcccttcggtcccagcatcttgagcacttgatatgcgtagtgggatgtggccatgaacttcacaagtgcagttctcccgatgatggcgttataagctgtatcgaattcagcgacatcgaaggtgatcagggtgcagccccctgccacgtcgaacagacttcacgttccactttcttgtattctcgcttggaggagtacgttgtggaaccaccgaatatgtgtgagacgtggaggtcggagtctgggtacgcagaatccgattcgtgaggaggtgtctccttgttcttctcaacaacgcgtactcgcttgcctttttcaaacgccatgtgcttctcgagcgactttttgaaaacaaggcaatcctccagagaatgtctgtccgttttgtgtatggggcaccatgatttctttgtatcgctgccctgtcggtctgggcgcttgggagggttcgcgtattctgctgcgaggacttccgcttgagctttccttttcccgtttttgcgatttttcttcttgcttgactcagatgcgtctgcggatagtttcttctctcccccagtcttcggcttgtcgttcttgcgtcttagcgcgtcatccacatgggctcaccgctcaacgatctcgaataatcttcgagtagttgtgatgcgtcttgtcgccaactcctgggtagtgtagcgatctctgacaccagacttgaaggcgagaattacagaagcgtcggtaatctcgggaattgtgtttctgcactcgttgaagtgccgaacgtattccctcaatgattcccccgagttctgtgttaacgcatgtaagtcgtcttagatcgcgtggcgcttgtatgttccttggaaattggcgacgaactgttgccacaggtctgcccacgaggagattgagtagggaggaagatgcatcagccatgaacgcgcagaaccctttaacgcggatggtaaatagttcgccaacgcgttgtcatctgctccggcagcataaagcactgtcgagtagacttgaaggaattcttctgggtcggtgctcccatcataattttcaatggctctgggtcggaatctctcaggccatcggacatcacatagggaacgaccgaaagccctacacccagcactgggggcggtggtttgtcggcggtcgcgtgaccttcgtggatgtctgtccaacgatgaagaggacgcggatgatgacgatgacgatgggtcgcttggttctggcgtacgattacgaggatgacgacctggatcccgggcatcctgtcgttgtctctcgctgttgtctcggcgccgatcgccttcgtcgtcgtcgttgcggcgacggccatgaccagtattgtctggcccccgccgttcgcgatcgttgtagtctcggtcctcgtttgggcgatttcctcgatcatggcgtcgtgaagagacatgacgccgggagcgatttgcgtcgtcccatgtgcgtcgtgcttctcggcgatcattgatttgatctcgaagatctccaatgccacgaggtggaggggtagcctgtcgaggtaattccctccgctccggatctttaccattggtgtcgccgatcggtggctgatcttggtgtgctgcggtagcggcttcttcgaacgcattgctgaggttggtcaccgactcccgtaatcgttccgtccaacgctcgaggtcgtcgttcagaacgggatcgtaaggagtttccctctgtatggcttgaacaaccctgatgtgctgggctggagtagtcgattgatttgccgcctctgcattggcttgtgctgacgtgccaacgtcatcgatagccaatacctcccgcgacgcacttgttgtcgatgacccacagtcttcgaggagatgtaagaccgatggttcgtgggggtcgagatcgattaccccaacgaatcgatctgaggctggagtcgctccttgttccttgccgttatccctaacggggacgtatgacttaggagacggagttttcacggcgccgaggagaactttgcagctcgagaggtcgtgattctttgtcttgtggataggacaatagacatcccgagttagagaagtacgctgaattccgcgttctttgcaggcgcgaatttcagcacggacattgatgaatacctagcaatcttgaagggtatgtttcttggttttgtggataggacacaaagaccagataacttcggaagtcatctttgttggcccgtggtttatgtcggagggacaagacttggccgcatcagaatccttcacgagtttggatgtagtcgataatccgttctctgtttcaacgggtggatttttcgacatggagccgtcctggttcatagccactgcgttctcgtttccagtcattggaggaccggttgagatcggcatcgtggtgtaaaccgggaagacgatttcgccgacttgagtccataccagcattattgaagctgagagtgcttgactggagctggtgttgacgttgttgtcgacgaagcttgatggcatagtagtagaaccttgagtaccaagtgcccctacctggcgcgccactgtacgtagactggatatagagggtattggggtacgctggtacaaggatctacgtagtacgacatcaagtaatcaaaagacaagaattatactggttcaggccccttgacaggtaatagccctaatccatttgatatgggattatatggtggaaaacacaggttacaaaggaaagatggaacttgtcgaatccggcgagattaaagtcgagttgattcgactagctcttgacgacgtggcccctcgcaggctccggcttcgtaggctgtgtgggttgtgttggctctgagattcgatcctctatgccctccccggggggtcccttttatatcgcaggtctggtggtctccgagtaggactcgaacacaccagacccagctcaatacgtaggtaacccagttcttatccgagaaggactcttcccgtctattgatttcgtgaaaggtttccttagatcataaaggaaatatccgcgtacgcgtgggtatgccatgttgatacgtaacgtatatcgaagggtagagggtatgcctgacccgtaaccctgacaacgattgagatttagtcatcgacgagtgagagccgcattgtcacaccctgaagttctcctcccaaacctaaattgaatttataaatggtcccaagaaaatatcggtgtaaaagcaagagtaaaccctaataaaccaatgcaaataataatcggaattggcatgtggaatttttcttgagttctacatgtcgaaatttactaacaagatttttagtggaattttcagagccctagaaataattttaaccaattaaaattgagcacatgcaatttttaatcccaggaaaaaccctttcttccttttctttttcttttccctcctttttcctcttcttgggccgtcggcccagtccaccccaccgccgcgcgcgcccttttccttcttgggccggcccatgcgcccctccctcctctctctaggacgccgacaggtgggccccacctgtcggggtcatccccttcctccggccgcccgccccacgacggcaacagccgccgaaaccgccgcgcccaccccctccgctcctcccgcgccctctccgccccactccgcgcgctgcgcccatgtcaccgcctctccctgcgtctcccgccctcgcgcgccccaaaaatgggcgggattcgacttcgaatcccgccactctctctctctctccccacctccaacttcccccactaactcctgcgaaatcgagccactcccggctgttcccgacctctccgcccctatataattcgtccccgcgtcctcctccacattttccttttttccaccggcctctcccgtgctccccatcgctcccacaccgcgctcccacccgccgtcgcctttttcgttgctccggccgcctctagccgccgttagggtcgccaccgcaccgcgccgtcgccgccgtcgggttcgcgaggccgagctccacctcgtccacccctcctccgccgagttccgccatcggaggccgcttcggtcgtgcgccagtgagtctctccataaccgccgccatcggccacggtttccgctcgccgtggactccctctctccctctaatctctctatttccctctcttagggtgtctcggaggtcatcgccgttcaccgtcgttccccggtcgtcgccatcgccgttcgccgtcgtccttccccgcaccggccaactcacggtgaggcatccctcctcctcttttcccctccctctccctcctagccgagccgggtcgagccgccgcttcggccatgcgccgccgccttcgcgccgccgtcttccgccgccggttgccgtcgccagcgacgcgcgcgccgccgcccttgccatggcaggccggccggcttgatgccgggccaggccggcgtctcgcccccccttggagccgcgcccgtggggcctgcttgttagccgcaccccctcccgccttgtgtctctgccagtggggcccacgtgccggcgccccttcctctctctcccgagccgctgacccatggggcccgcatgtcggcgccgcccgcttcccgtgatgacgtcagccctgggatgctttattgcgcaataattcattaaggacttttcttttctagtaaaaacacagagaatcttcttaaaatcataactaattcatccgagctccgtttaagtccattcaagtctcagtaaatcaagaaaaatgtgtagaatccattaaaaatggttttgttctttgtttcagtagtcttatagcctgtttgtattgtttgccttgtatgtcgcttagattccggctctcctgacgctccggtgtactttgagatagtcgccgaggttcctccagcagcagagcaaggcaagtcatgcttgtcacttgaacatgttgatcctatattgcaaatgttctaatgttttccatcaaatactgcattgttttacagtaatactatgagatgtttacctactgttacagccatgctattttggtaccatgctcctttgttagcttgggatataacatgactagatattggactagggattgcttagccatgcttagttcaactagcacacaatggggaaaatcctattaatgtatagactgtaggttctaatggtaatgttggattaatgccaccgcttcggtgtgggtcaattaaaataaatcacatggtgggctgtgggtgcatggttttgttggttgtcacgccctaaaaatcaactaaattaaaaatacattgtttaaatcatttttagaaattattttaaaagcctacaagctaaaccctaattatctaggaaaattttcaacataaaattgagctagataaaattttattaaatactttgcttgttcctctattttctagaattttctgggaattgtttgagcaagggaagtatttttaataaatgaaacaacatttcacaaattatttttaagtaaaaagttccaaaactcctccctgaagccgttgggccattttggcccaacatccctcccacatcccgtggccgagccggcccatccggcccaacccgccaccaccgcccctccctcgcgtggaggccgacaggtggggcccacctgtcggtggtgtctcctacctccggccggctgcaagccgagcccgagccggccgagccgccgccttctgcctccgtttccgccccgatctctccacccctagtccggatttttgaggggtttttatccccacatcttcctctatctttcccctcaagaatcggagcaaatggttgagtatcttgcccgaatcgaactcgttttcgagtttatctccaaaaccgagtttttgattttcccgagtcgatttcttgcgggaggagtccgatctcttcaatccaaggctataaataggaccccctagtcctcctctttcgtttgccccaactcccgtcctttcccgtgctccgtagctccgtcgccactgccgcctagcaagccacccgccgccggccggactccggttgcgccgccgcgccgcctccgccgtcgccgtcgcttgccgtcgccgccgctggtttcgccaagaggtggggaagctcggccgcctcctccccttcgccgccggccgccgtagcctcgtcgccgccagtcaacccgagccgccgccgccgccttctcgacgccggctatcgtcggtggtcgttcggtgtgttggtaagtaccgtcgcgttcgtctcgtcgttctctacgtgtagatgccctccaaagttccggccgaccgccctagctccggcgaggtcgtcaattcgggccggccaccattgatgacgtcatcgtgacatcatcatcttttctttttcccgtttttctaatagattaaaacttcagaaaatcataactaaataaccgtagatccgtttcaggtagttcaagttgctaaatttttctaaaatcaagatctacatgttaaaaatatccacatgtactgtgtatgcttgtttttgtactgttttgttaatttttgtttaattgctttagtttccgacgttccggaggagagcgtttccgttgaggaaggttccgaagcgtttgcggaagcccaaggcaagtcacacagatcccaaacaaccctttgaacatgttgaacccatttaaagctattattttatttcagctatgcattgttttcgaatgtcatcgggtggtaaacctttcccaattaattaatggccgaagatgatcttattttcctataggttataatttgattagcatgaaccttatatgttggattggttcagctaaatgctatatgcaagtttgcttagccatgcttagaaacgttagctaactaaagggattaattataaactatgttacattattattttaattatggttacattaaatggtagctcacgatggttaatcgtgtgatgttaattaattgatgattaaaacctggttaaggtgggttgtgagcatatggttttgatggttgtgctcatgacaattaaggaccggttcgcgagctactgttgtaaaacttttaccgtgccaaccacaagccagcgtgggcaacggctttatcttttgtatagcatgattcattatagtgcgccagactgtgaagcggcgagaagtccgtgggggtcgctggggagtccattgcctctggttttgagggggagattatgatccaggaacggtgcactgtggtgagttgtgttgtgcaaggggtattgtcacagttcttttccgaggtatcgtggtggtactaaggcgcatggtaacatgttgtgggattgtgtcttgtgggtacagtggtacacctctgatcagagtttaatctattcgaatagccgtacccgcggttatgggtgagttgagcaatgtttttcgtgattagtcgcactactcattaatggtaataatgtggtaattaatttgactcctggtttggaatggataattcctggtttggaggtttaatttgttcaactggggttggttgttcaaatgtggttgggcctatgcaacatgggtgtgttgtatggtgtttatttaatattgattcattatacaactgttttactattctcttaaatatttgttaaatgctgttatgcaaatgagctatattatgccatcctttgttatcctatgcacttgcatatttgctgtgtggcttgttgagtatgtcatatgctcattcttgcaatattcaatcatcagaagaggagtatttcagcgaaggtgatgatctgaaggattgagcttgttctggttaagatgcctgtggagtggagtcgccatagctgttccgtagtttgttatagttttatttttccgctgcgtagaatgttattctttgagaggaactatctacctctgtaataatttattatttgcgaatattaaatagttatttatttgtactctattatcaatttgttattgtgtgcctcggttgattcctggacgagggtttaacacacatgtaagcgtttggaattttggatagaaattccgggcgtgacattggtcgcgcccatggcagttaaggaccggttcgcaggatgccctggaagaacttatcgtacttaccacaagccaacgtgggcaacggctgggcttatagtgtagctttcctctagttgacgcatccaggcaagggtgggcgtgatggagcggggcgggccctgcgacggcctctgtcgcttccggattcacctaggcacgagaggggactgcccgttgcccgctggggacgggggtgaaacttgaggtgtggtgtgcttagctagagggggttatgcgaagggtcctgtcacagtctctttctggtatgtcgtggtggcatgtcggcgcacagaaacgtgttgtggggctgtgtcttgtgggtacagttgtacacctctgatcagagtaaaactattcgaatagccgtgcccgcggttatgggcggtcaaccagattcaccgtgattagtctcaccctagtttagtctaatggaattagatagtataggtggatggttgggcctgtggcaacgtggtatagcgttggacagtggatgattaatattgattaattgttacaactgttttactgttctcaacttctgtttataaatgcccgttttacgcaaataaaccagtatagctatcccttgataattccctgcatcatacccctattccggtatgacttgctgagtacagtgggtagtactcagtcttgctctatttttccccaaaccctagagtatgagtatgcgtcagatggtggtttctccgaggagtaggcttcgtccgtgccgtcgaggatgcctgtggggtggtgttcccgctgcagatctagtcaaggcttagccccttttatcttttgtttttccgctgcatttatgtaagacttttataatgtttgtaagacgtggatctgtatgtcaactttgtcgcttgtgtaccccagccagtcctggacggggattttaatgcacattctgcttggaattctattcgggaatttctgggcgtgacacgcatgggagaggtgtgtgcaaagctagggccacctatcggcacggaaaagaagcgtcgtaggggcgtgggatcggatggtgactttgcctgtccaagtagacatttaccaccttttagttgtagtgaccttttagttgcagtgacagagattttgactgttgcgcctcgtgagccatgtgggccacacccatcacccacccgcacgcactcgatcgattaaccacccaaacaacgccaatgcaagcagctcgttcccaagttgccacaacacaccatgcatcttcgagttcgactcgcgggcgcacttgtggagattatgggtaccccatacccacacggcacggttatccgactagttataggggataacttatatatatgaaatatgtaacagatcatgacttgggtattacgtttccttgtatattacggaacggcctaaagtcctggtttgataagattgtaaagtagatttaggaaaccgataccgtattggataaggtttctatcttgtaatcatgtcccccatcctatataaggtgggcaggaggccctctagggggcatgagacaattagatcgtcagatctatactacactcggcggattcaaatccccaaacaggagtagggtattacctctcattgagagggcctgaacctgtctaaatccttgtctctgcatccatatacttttaggtttcgtgcgctaccccgttttattattgccgaattcatgttttgacagctggcgcgccaggcaggggatgcgtcgagtttcccgtcgacgagtgcgatggaatcaattcaagcattgagattaatctcaacgagttcgacgactccaaatgttaatcggtttgtcgtttcaatatattgttatcagattgatctataatcacaattgattttctgttgtttttcctctctggttacatgtgccgccgcgctgtgaattcttctgatcactgcgggttgaaaaaaacataagccatggggaaaacggccggagttacgcggggtcatcagatcggttctgtccatgcaagcacgggatcaatcaactgaattaatatgaatggcttttgcacctatctatgcaaatatgcatctacgttacatgcatatacagtataagaaacatatatttctgtgtactttgccattgctaatcagattgatttgtctggttgcatgtgttatcggagctgtcatcggattcttctgagttatggccacgcgtgaacgcggctatgccacctcgtcacccgagttcgtttcccatcatctgaaccctccggctagaatttaatccagactcgggtcaatgatttacacacgcatggcagcagcatggatcggtccaatgacatgcacgcatccgggaagaccaatcttggcgagttcaacgatttaatctcgacttcgccgggttttttcctttcaacttattgttgtttattagattgatctctaaatatcagattaatctcttggtattttctgatgtttacatgtaataccgcggcactactgttgccgactggtgccttcgtcctcatggctggcctgctatgccgctgctgacgggcgtattgatcttcaccgaccggtagcctccgtcgccgccgactggtgtcctcgcctatatggttggttggtcacaccaccgttcatgggcgtccacatcttcaccgaccggctggccttcgccgccgccgactggtgtttccgcctgcacggctggcctattatgccgccgttgttgggcgtctacgacttcaccgccggcctgcctccgtcgccgccgactggtgccctcgcctatacggttggttggtcataccaccgttcatgggcgtccacgtcttcaccggccggttggccttcgccgccgccgacaggtgtctccgcctacacggctggcctattatgccgccgttggtggacatcttcgctttcaccatcgaccgccttcgttgccgccgactggtgtcttcattgttattgatggacgacttttttcccacattggccacctctgccatcaccaaggggaatattacaaagctaagtcatcattgttttattccttatatgatattttccttttcctctgcctcactacttcaactggttcgctgttgactagtgagtcggaggctacagatgttatatcatatttttcaacatttttcataatatttatcctgattggttgcaaaatactccgagttcaaataaagtgcctatcgagttatggagttctatcttcctatgccttccatttggtttgtcgatggatagttgcctttgggccgattcctagcacccgggggctcgttggatggaccaagtaacgcaaggtgctaaatattattcggaataaatcaaaagcatagagataagataaatctattttctgctctctacaattgcaaaagtacccgagtagtaaattctgattcgtgaaactttgttccattaatgacgaactcatgtcactcatatgcatgtttgggaagtgcctaggccgactcccgatgctcgggggctatgactagtcggacagagtgtttaaacgtacggagtcatctgctcggggaaatcaaaattgagtagaggagaaatacatatttataaatattttaaaatacttgaatttttctcgagtattatatttatatcagatactactcatcctatatgtttgttttacaggatccagatccagatatgcataaaagggattcatggctttaagcttatctcttacgcttcaggaatgggatcagtcagaacatcaccaccggcttgctttcgccgccgccgactggtgtcaccgcctgcacggctggcctattatgccgctgttgttgggtgtctacgtcttcactgaccggcttgccctcgtccgccgccgactggtgtttccgcctgcacggctggcctattatgccgccgttgctgggcgtctacgtcttcaccgaccggccgcctcatccgccgccgactggtatctccgcctgcacggctggcctattatgccaccgttgttgggcgtctacgtcttcaccgaccggccgcttcgtctgcagccgactggagtttccgcttgcacggccggcctattatgccgctgttgttgggcatcatcgacttcaccgaccggccgcctcgtccatcgccgactggtgttttcgcctatacggttggttggtcacaccaccgttgttgggcatctacgtcttcatcgaccggccgcctcgtccgccgccgactgatgtttccgcctgcacggctgacttattatgccgccgttgttgggcgtctacgtcttcaccgacaggccgcctcgtccgccgccgactggtgtttccgcctgcactgttggcttattatgcctccgttgttgggcgtctacgtcttcaccgacaggccgcctcgtccgccgccgactggtgtttccgcctgcacggctggcctattatgccgtcgttgttgggcatctacgtcttcactgaccggtcgcttcatatgacgccaactgatgctatcttcttcacggctggctacgtcgtcgtcaccgctaataggcaccgtcatcttcaacgcaagctgtctacgcctgctgccaactggtttattcacttccatggctggatgattctgcccctggttattggccttatcgtcttcaccaccggtcgtctcgtctgctgttgactggtgtcctcgcctctacggctggtttatgccgctatcactactgatggacgtcattgtttttattgctggtcgccttgtctgccgccgactggtttgttcgcctccacggctacgcgtcttcgctaccggtttgcttctgttgccgccgactcgtgttcacttcatcacggctgtgcaactttgtcaccatggtggagctacttcatcttcattattttcggcaccggcaaactctatagcctctacttcgcatgatttgccacttcaccaaccacgacgtctacaatagcctcgacatctcggcatgtgtcacaaaatatgatgccgtgttattttactacaacaagtgatgttccaatcttcaatatttatcttcactcaagcaatgattacacgacgacaagaagctacagttctcgactctatgttcagttgtttcccaactaactaaagagtcgggggctacacaaatacaagactctcaaaattcgacaagctgaagcaatcaattaatcagccaactagtcaactccaggagtcattatcttcatctttgctttagagcagagttatcaaccaatcagctcagtttcgatgagatggacaacatcatctactttcctccaagtgaagcatctacaacagctataacaccaatttgatggattattgtcactgacttcatcaccagcacctctacttcattggccctgacatctctgccgttgctaatggatgactacgtcttcgccaccggttgcttccgtcattgccggcttgttatttcgccttcacggttgacctactatgcaaacgctgatgagcgtcttcatcattatcattggttgctacactgctattgactggatcaccgacatcgtcatcttcatcatgttggttgcgtttgtcgtcgccgactatttccttcatcttcatgattggtggatttcgtcattgcctttgatgcgtgtctacatcttcaccgttggcttgctttcgtaaccatcgattggtatcctcgccttcacgaatggcttattatgtcgccactaatgggcatcttcatcttcttcaccagctgcctcgtctgtcatcgactgattatttcgctgccatggctacacaactttatcgctgggcgccttcatattcattgctggctgacctgactgctaccgactggtttcttcgcctccacggctatgcaacttcatcacttttgattggtatcattatcttcactaccaccaatatttttgccacctctggtaggcaatattatctctatattggtcgtcttgtctctatgccaactgcgtcagctacgatcaatggacaactgtgattacgacagaaggacaagctatatgctcaggggcttagctcaaacacaagtatcataccttcaatttggacttgctctggatacatgcaacatgaattcataaacatgggtctattttctatgctcaaagactggactatttattattccctataagggttatcaaccgaatacttgtgtcagtcgggattcaattattatatctatttcggagtatcccataagggataatcactcagatcagaagctattcatatgagctatacttggtctatatcacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcatctttttgcttaggcaaaagtgcgcgtgattatgtgcccaataccttaaaatccttttatatcgcagttactcaactttttaggagttggtacattgcattttaaaaggtgccaaacagtaatgctttatatagctgcccgctgacttttttatataaatcaaggcgttgtttgggttcataaagcaattgattggatacaatatcattgctttttgccacgtaagtgtgcacttttattgaccaatattatggcttaggctgattatatattttggtcattttccaggcggttggtaaatcctttatgagtttatttactcgaattttacaccacatatgccgtatatttttgggtgtagtgaaaccatgtgtcttttagggacttaagcacatctgttaaagcagtgtgcgcatggcgtatgtccaatactttggaaatttctttactcacagcattcgagcttttttatagttgttttgctatgtgaattttcaatgatgtagtcagctttaggttgcatgcatcaatttttacaaagcagtcggtatatcacttggatcatgttgctatatattaatattaagtcacttggttgactacaattatcaaaaccacttggttggttggattatttattccttgactatatgcttggtttgttcaattaaccacatgatcgggggctaaaccaattaggtgcatctagtcgatgcacctgactttatttttcagccatccacagtcttctgatttagtaaaagtactcggaggtcatggcgaagatgattgaagcactcggctttggagtaatctagttcgagagaagattatcttttcgactgtgaaggtctcaggggctactgtggagattatgggtaccccatacccacacggcatggttatccaactagttataagggataacttatatatatgaaatctgtaacagatcatgacttgggtattacgttttcttgtatattacggaacggcctaaagtcctggtttgataagattgtaaagtagatttaggaaaccgataccgtattggataaggtttctatcttgtaatcctaccccccatcctatataaggtgggcaggaggccttctagggggtatgagacaattagatcgtcagatctatactacactcggcggattcaaatccacaaagaggagtagggtattacctctcattgagagggcctgaacctgtctaaatccttgtctccgcatccatccacttttaggtctcgtgcgctaccccgttttattattgccgaattcatgtttcgacagcactgctggttggctacttgcctacctggctcgctcgctctctgcaccttctatgaaaggaggcaagcaacacagtccggccgccctatcacttggccacaatgtagcacgcaagatcgtcgagaagctccgccgttagtagcattcaacgagatgatgcaccgcgttgcctctcttctttgagttgcaagccaagctccaggtctcaacatcttcgccgaagccaccgacgaagcactcagtcgcgacatgtgtcacatgatgacgaagcagagcaacctcgcgttttggcccgtgaaaaggcacgatggcaacgggaccctaccgctccctgtctccatcaattggcgcaacaagacctgcgaaggccagccgtgccttggtccagtcatgttcatgggggtgctacggctcttgctgggcgttcgccatgacgggcgcgctggagagccaccgcgtcatcgcatgcaggggcaaactacgacaacccggtgctcctgtcagagcaggagctcgtggattgccatccaaggagcaaaggctgcgcagggggcctcgccttgaacgctttccagtacgtcatgaaaaatggtctggcgttgtcaaccttctacccttacatgggagtggacgatggtacatgccacgccagcaccacaccccgcgtgaacatgatcatgcgaaggttccaggagctaccacgccacgacaatgctgagaccatcaacaatacgctattagcctatcggccaattggctatcagtcaattgattctgcttttattctttattgctgattgcaggatcaaatcagttggcacgcccttgagacacttgaggctagccttggacctacactagagttaagcagatctcccaggctgccgtattttcacatcaacagtgggtacaatgtttttcaccgaaacgaattagttcaaaaagcaccgtaacatgagacttggacatattggaatggattgagagcgtttgtttcaaaaaaaatctctcggtgactcgttgggtgagcttttttcatttagtgtcgatatcgggtcatgcgggtgtgatgtttttcaccgggacgaaatagttcaaaaaaagcactgacacctagacaaaacatgggtattttgatagttttattaaatgttgcatcatttgcacgcactcaatgtttgtgtacaaacttgtccatatgtggttgcaaattgctattgtctggagtaagatgctggggattagggtatgattaaaacaagaactactcgtgtaaccgcagttgaagttgggaggcaattcttagggatctgaattgatttttatatcctggttagcttgattgaaccaaatgctacttagaaaataaatagggaaaaattagaaccatgccattataattttgtaaaatttgatatgtttgttagctcaacgtcaaacatttttatagccttgcatatttattgccgctttctgatgttgtgatgtcaaagaagtttgtccttgtctatacataaatttgtttttgggataatgtgtggctgaagtggcggtctgccctatggaagatagtcctcctgatcagtgaaagaaaaaaaaatcataagagttaactaaagatacttattattactctattatttttttgcataagtatactttgatcctatctatgtccatgggcacgtggtccagtccgaccatgcgaacacactgtaacagtctcgtatccttgatagaaggaacaaaatctgaaactggttttgatgttttatgctcaccttgttagaggaatgctgtttccctaaattttgcctcttcggttactatcagttcattggtttttctcctgtgcaaaattgtacgagttggaagcaatgtttaacatgaaatgccacatatctaaattttatttttaaactagtaacagggaaggagaaaagtaggatagacctgccctcatatttagcaaaatgtgcagctgctagtgtacgtttgcaaaactgaacacttacagtgaaaatagttttggagtatataccaggtagatgaagggacaacaatttctctttataaaacaaactacaattggactagagatttttttttctggtttaactataagattccttgcgcggtgttctaattaagtgattctatagattgaactatgctgttctcaacagggcttggcaatataaagcaattcatggttctacagagcatatgaaccacagaaaatggttctatagtggccctttacagactagattagggacacagaaaatgcatgtcaccatacaagaatagttctgagcattacattgatattctgaaatgatgtgtccacgcagacaatgcatttccccgcaaaaaaaaaaagagcagataatgcatttcagctagtggtactgtgtgcgcagttatgcagttttgacactataataacaggaattggttgaaaaccaatatatgcctcttgttgtaaggaggttggaaacataataacaggaattggttgaaaaccaatatatgcctcttgttgtaaggaggttggaaaccacagcttgtgcattaaaaattgcattgcacttgtccacaaggtcaacaccctgaacttctatatgttcctcttgccttgttaatctgattcatctctcagcttggtctaactctgtctttggatcagaaagagcagttgagaagagatggctggactactagcatctggaatcataaagtggacaacaaacaagctttcttccttggtttctcctcaaatcgtttcatcatcatctgacgagcaaagtgcttcgttcagagatctaagagatctgcagaggacgatggcaaggattcagcggaccctcgatgcgatggatgaacacaatataagagatgaagccgagagacttcgcctgtgggagctgcagcagcttgcatatgatgcccaggatgctgtcgatgaatacaggtatgagttgcttcgacggaggatggaggaccaaagcaatcaaaggcagagcagcagaagtcgcaagcgcaagcgcaaaggtgacaagaaggtaatattatccccttatcctagctataaccaatgctacatttggtttatcagaaaaaatagtctgtgtttcttctttgatgaaataaagcttccaaattgcagaggcctcctctcaaagtttcttgtataaaaagataagctcccaagcaatttgtttctctcaataatacatgagcaatctgcatatcatgcataagcaaccattgacatagccatataaaagtattgggatagtagaggagcaaaaaggggtccataaaggagcatgtacatatgtgtgttttatttaactcttgttagtacacagtatactacatgcctttggattataataatattagtgcatgtacaggaacctgaaccatcccctatcaaagttcctgttccagatgatttggcagcaagggtgaggaaaattttagaaaaattcaatgagatcacaaaggcatgggatgatctccaactcaatgagagtgacgcaccaataagagaggaggcctatgacatcaagatatctacaaccccgcatgtaggtgattttgacatagttggtagagaagaagacaaggaaaacatcatcgaaatattaatttccgatgaagctgctcaagcaaatatgtctgttgtttctattgttggcatggggggtttgggtaagacaactcttgctcaaatggtgtacaatgatgaaagagtcagcaggtactttcaactaaagggctgggtggatgtttctgagggtcattttgatgttaaggcaattgcaagaaaaattatcatgtcgttcactaggaatccatgtgatatagaagatatgggtaatctccaaaatatgataacggcgcaagtacaagacatgaagttctttctagttcttgacaatgtgtggaatgtgcagaaggaaatctgggatgctttgctttccctgttggtgggtgctcagttgggaatgatcttattaacaacacgcgatgaaactatttcaaaaatgataggaacaatgccttcttatgatcttagcttcctaacttctgaagaatcatggcagttgttcaagcagatggcctttggatttatagatcaacatatggatcaacagttcgaaggatttggtaggaaaattgtgggaaaatgtggaggcctaccattggcaattaaggcaataggatcctctcttcgcggtgagacaaatgaagagacatggaaagatgtctcagagagtgatcaatggggcttacctgcggaagaggatcgagtgctgccagcactaaaactcagctatgatcgaatgccagtacaattgaagcgctgctttgttttcctttcactgctccctaaggggtactatttctggaaagaagacatgataaatctctggatgtgtttgggactcctcaagcaatattgtactgggcgccatgaaaacattggcaggatgtacttcgatgatttaattcagagggcaatgattcaacgagcagaatctgatgaaaaactggaatgctttgtcacacatgatcttatccatgatctggtacattttgtttctggaggagatttcttgagaataaatactcaatatttgcatgaaaccattggaaacttccgctacttgtcattggttgtcagttcttctgatcatacagatgtagcactaaattctgtgacgatacctggaggtataagaatccttaaggttgtcaatgcacaagataatcgaagatgttccagtaagttgttttctagtagcatcaatgttaaaattcctaccgaaacatggcaaaatcttaaacaacttcgtgcattggatttcagtcatactgcacttgcacaagtacctgattcaataggagaattgaaactactcagatatcttagctttttccaaacacgaattaccactatcccagaatcaattagtgacctctacaatctgagggtcttggatgcaagaacggacagccttagagagctcccacaaggcataaaaaaactggtcaacctccgccatctcaatttggatctttggtccccactttgcatgccatgtgggataggtgggctaaaaaggctacagacattgccaaggtttagcattggaagcggaggttggcattccaatgttgccgagctacaccatctggtgaacatacatggagagttatgtattacaggactacggagggttataaatgttgatgatgctcagacagctaatttagtcagtaagaaccaattgcaaatcctgagattagactggtctgatggtgtttgccccaacaactgcagtcatcctagcagccaaaatgatgtggctaccccagacccagagcatgaggaagagatctttgagagcctacggccgcacaagaacatcgaagaattggaggtagtcaattatagtggatacaaatatcctagctggtttggggcttctaccttcatgcacttggcaaagataatcctatgtcagcaaagctgcaagttccttcctccacttggggaattgccacgcctccgcatactctctatggagtgcatgacagatgtggagcatgtgcgacaggagttccgtggaaacatcaccacaaaggcattcccagctgttgaggagctggagtttcaagaaatgttgaaatgggttgagtggtctcaagttggtcaggatgactttccttcactccgcctgctaaaaatcaaggatagccacgagttgaggtacctcccacaggagctatcttcctccctcacaaagttagttatcaaggattgcagcaaacttgctagtctaccagctattccaaacctcactactttgg

SEQ ID NO: 46126 - DNA, 7310 bp, Oryza sativa
  unsure (1)..(7310): unsure at all n locations
aaccactgtcaacacagcttcagcgacttaccatcacaaagtgcccattgctagcagactggttggaagtccaaatttcgcaccagcaatgccaggtatagatctctatcaccatctacgtacaaatactttatgctttaagttttattagtgcatttgcagtactaggaccactgtttattttcttagttcctttttctgaattttttatttataataattaatgtcccttctctcagttacatgagtctaaagatgcttggtatgaagagcaacaagctctgaatgaattgaatgatgcaagtgaggacgagcacagagaggagtttgggcttttgtacgaagatgacaatggagaggacaacgatgagcaagaccatgagcagtcagaagatgaggaaattcagtacggcagtgatgacagtagcgaagaggatgaatagatagcttaatttggtataaaaattagaaagaacactgcaacctataagtaataatcacctaatcaacgtcatgctttacaggtgaggagctcataccatattagctacatatatattttaccgtctctcatgggtcatgtggtgtgattgtgtgaattaaacaaccaactattatttaccttttgcggagaaaacagctgcattatgtgtagtggttcctgagtggtgtaattggtactatttggacactcatagcagcctggttccttttctcttatcgctataagaaatggcatgcaaaccttctacgtattctttaaaaaaaaagatagttaaagtcaaggctttggattgaatcaggctagtcacaaacctgaaatgcatataacgtatagaagtataatagctgcagtaacaaattatagccttataggcccagttctaggttcaaactcgaccaagagatctgaatggcaacaatactgcatccaatctccagctcagcaaagaaactatggagcaactagttagctcaaatgtagattaattgtggatttgcgcataaccaaaaaaaattaactcattctaaataattttacctacacatatcgccggcggcgagaactgggaggctcagcggggcgcggcatttgtgcggagtttgcagcagaggccactggggcaagagaaaagggccgcccggagaagattctgccgctggtccccgagtcccgagaggcaggtgccttagccgttcgccgttcgtgcttccggcgcccgccgccgccgccgccgccggcagcaccggtagcttggcctggggaactactagacgtgtgaatcggacggtgggccgtggggcggtgtgcttggacgaacaagcacgctggcccatatggcccaacgacgcagatctggaaggcccaacataagctggaatcctggaattttgatgggccacgaaccacgtttggaaaaagttcactgccggtctctcatctaaggttgagtttcgatcgagtctctcaaccgcgaaacaatgtactaacgcaatccttatctttaccgaacagaggaaatgtagtcccaacgaagacggtttcaacgtgccatattgatttgttctttatctaatgtggcgtctatgtgaaacttatacgataaaacaacaacaacaaaaaaaagtgggtcaacgtacatgtaatccatagagaagaaatatagtgtgcatatggcgggactatatatttaaagtggttttagaagatgaggggcactatccaaactcaaccgttatatgcggaagagtaaattgcactagcggtccttaaacttgtaacgaggtttcacttaggtcaacgaacttgcaaagcgcatatcgaaatccctaaacttagtttattgtatcatcccggtctaaagccgcgtttgaccgtggtcttgcctacgtggcacgccacatgaacgatgacatggcacaaattttaattttccttttttttctctccttcctccacctctagatgcatctgtggcaggcaaagggagagagggagccagcgagaccggtgcgaggaggccgtgggcggggtcggcgacctggcggcggcgcaggagagaggcggggagaggcggttgacgaccggtgcgaggaggttgtggccggggtcggcgacctggcggcggtgcaggagagaggagctggcggctatcgagaggagaggaaaactcggcggcggcgtcgtcttggctcgagcggaaacgggcggcggcgatggaagggagaggccggcacgggggagctcggggcagcggcgtcggcgcgggctgtcgcgtgcgaggcagccggcacgcgacgacgcggctgaggcgacagcggcgtgtcggcgcggcgcagcttggcacagcgccgggagaggggcagcggtgggataagggaggggagctcggtgtgggagaggaggctgcccacggcgggcgtggcatgaggcagcggggcggtggctgagcgcggcagcacggccgggcgcgcgcacgggagggaggcggcacagctcaggaggaaggtggtgcggcgcagtggcttggccacgcgcagctaggaggcgacgccgaggggaggaaaggaggaagggacacgcggctgggaggcgccgcgcggcgtgtcctcccccaatcaccgtcgtcctccctccctcccgtcaacgaggctttggctgccccggcgacacctcccccctcgcgcacctcagccgcttccgcatgaatgacgtgccgccctcctcttcgtcccaccactccggcggtggcccccacatggccattgtcgccgtcgagctcgcgttgcccagctcgagctcgccccaccgccccgctgccgtcgtcgagctcgggcccgccgacgcctccccccgcacgcgcggccgcggtcggcgacccctcccccgggagcggctggcgacaccaccccccgtgcgcgcctcggcctcttcgccccaccactccggcagtagccctcacatggccgttgtcgccgtcgagcttacaccgttgagcacgagctcgccctgccgccccgctgcagcggcttctctcctcccgccagccgacacccgcgcgccgctcctttctcgccggccgctggccgcgcacgcgcgccgctcctctcctcccgtcggccggcgcccgagcacgcccgcgccgctcctgccccgcgtcccctccgaccatacgaggtgaggaaggagagaaaagatggggagaaaaaaaggaaaattaaaatttgtgccatgtcatcgtctacgtggcgtgccaagtaggcaagaccacggtcaaacgcggctttggaccgggatgatacaataaatcaaatttagggatctcgatgtgcgctttgcaagttcgtggacctaagtgaaacatcgttacaagtttaagtaccgctagtgcaatttactctatgcggaatctaaagtgaatttttcctgccacgttttgagcgctagtatccctgaaagaaaaattgctgcaccacaaatcttctcgtcttggtaagtactatagctgtctgacaatcttcaataatcacttgttatgattccgaccccaattccaggtgaatttctgatgaacttcaacaatcacttattatgaatttgctatattatatgattctaccgctatatgtaccaatcgtaagtaaatacactagtatactttacatggtatatagtagtatatttctatggctgtacttgaagcttgaaaaaagtggaatctcacaagcagctcgatcgatcagtacaccgtgaagatgagatgaagcctacatagcagcgagctgcctaatgttcacggggaagacgagcggcggcgagccgtcgaacgcgacggcggtgagcatccgcgcggtggcctcggtcgggtggtagaagtcccagaacacgtagcccgtccggttggcgcagtagaagctgaccggggtgcagccgatcttggcgttcatgtccccgaggccgcagcacgccgcccgcgcctccgcgaacccgtacgccgccggccgctcgatgtaccggagcagcgccgcgctggagtcgaacaccgcgtagcggaggcccgcgcgccgctcggccatcccgcgcagcagcgacgccgccgccgcgttgtaccgcgccgacgcgtcgttggcctcgccgctgcagcccctgtcggcgctcagctcccgcagcgacgggcagcagcccaccggccccgtccccaggaacagcaccctgcgcgccccgaggtcgtacagcctctgaacacaatcgatcgaacaccattagaacgtaacaccatgaaattgatcatttgatgatcgatttaattatctgtcgatcggtgacctcgatcctcacctgtagctggccggtgagcgactggatgagggcgtcgacgaactgctccatagggttggtggccttggcggcggcgctggacctgacgtagccgatgatgtcgttgctgccgatggtgatggcgaagagggatttcgccaggtggctcgccgcctgggcctcgccgaggctctgcaccagcgacgcctgcaccttggagtagtactcgatctgcttgtcgaagctgatgcactgatcctgcattaatgtttaacacaagtaattaaaaccaattttcaactctaaaacaagttgaaaacaaattgactatatcactgtcgacagaaatatgtaaaccatttgtattatttttttaaaaaaaatgaactttatatatagtgcgttgacgactaacatgcatacatataatcctacgtcctggtaatctatgagaaaagtttgttattgcaattacgtgtacgagttgaaactaattagaactaccttgtttgtagagttgaaaactccggcgccacctgaagcaaagttgacgccattcacgtagttagcactgctgcttgacgatatggcgaggtacggtggagatgtcgccaacccaaggttctcagctgcaatgcaccattcatatcaaaaatgaccaagtgataaattaatttatgatcggatacacaaggatcgggaagcttgtaataacatgattaaattaacgtactatatatgtaataagcaggttcaaaattacggactgaaattttcaaaattttgggtctatcgcccccctcccccccccccccccccaaaaccaaaactattccacccttttttccattttttgtgaatttggcaaattttgtttaaatgtgaccaaattttattaaaattcaaattatttcagtacctgatagaaaatagccaaaataaaaatttgaaccctggtggttagtatgtaagggctaagctgtgtagaacgtacgtatgtacaagttgaaaattgtaattgctaatgcacatatatatatttcttgtttttctgacttttttaaaaaagctgtttgctagttgtcctctcacacccttcttttttttctcgtcaataatgtagaggtccccttccaaaatcgaaacttacatatcttttatggactaattcatgagaaacttatgcctctagcctattggagctccaccatatggcacataacctatacatagaaggtcaatccagcaagcttgcaagagataaattaaagaaaacagtgttgtagccaaactaaagaatgataaaataaaattccaaattaattaaccacaacattttttagaacaataataaccagcttgtcaacatcaaataggtaaatcgcctaaatccgatcctcaaatgtagaataattaaggacgtacacgtatggtaatctgacccacgaaagtgaagtagagaatgacaccaaatttgttctcaattgattggcttcgccaacggacaatttccatttcactttcttgggggaaaaagttatggccaggctgaaaaggacatatcggaaaaaccctttggctagatatctgatatctcatatgatgtgcttgacctatcattcattaggtaatatgtctccagttatctttaaaaaatataatttgtctccacctaaatttatagctaccaaaaaccaaaattaacaaaatagagaaggcaatactatggtgtggcttcacctagtaggttgaaatctaagtgcacacgaatatatggagaaactacaaactatagttcattatagtgtacatccaactattgcgtgaaccttaaaatttatatgtgtctatatatttttataggtataacaaccaaggaaataaacatatcttgagcgtacaagcaacgtcggatgaacacgtacagaaattgattacaagctgtatggaatcatcaacaagtagccaacgtgcatcaatcaacattttgtcattggttctcaacgaatttagaaaagaaaataaaattactccctttattttataactaggaaggaagcccgcacggtgcgcgggctttttatttattgttttatgaaatagtgctaaaagaagtcatatctcaccatttctacgtcgtgagatagatcgtagacttcaatatagttaaattataagaatgtctcccagaattaaaaacactttgtcccgattacatataaattttcctattatcgtaacaactcattatcactattttaaaagctcgctaactaccaatacatgaaattgcgcataataaaataagcctaatatattattaatacactacttagctaagtgtttatgtctcacttatttccaaatccacatataaatattctaaaaatatcactaacgggtgaagccggtcatagccgtagagactttctttctctattaccttgaaaattgggtagttgtgtcccctcaagatcagcccgaagcacaattttaatgtctaatttactataaccctttcatagagtcctatgacacactgggcccactcaactcggccatttgtatgccacgttagagggtaaataacgggtccaccaatttaaatgaaaatcgatggtgagattatacagtaccatgtgatggcctaggagcacttatagcagcgtcatatggcgacttaggaatattaatagaaagtttaatgaacgtttagtatataatagtttttcttgctgcgaatagtagtaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46127 - DNA, 1734 bp, Oryza sativa
atgccgccgttgttgggcgtctgcgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcgtcaccgaccggcttccttggccgccgccgactggtgtttccgcctgcacggctggcctattatgccgccattgttgggcgtctacgtcttcaccgaccggccgccgcatccgccgctgactggtgtcaccgcctgcacggctggcctgttataacgccaactaatgctatcttcttcacggctggccacgtcgccgtcaccgctaataggcgttatcatcttcaacgcaagctgtctacatctgctgccgactagtttattcacttccatggctgcatgattccgccaatgttgattggctttatcttcttcatcgccggtcgtctcgtctactgctgactagtgccctcgtctctacatctggtttatacagcctaccactactgatgaacatcatcgtcttccgtcgccgactagtgcttttattttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcacaagttttgctacatcaccaaccatgacgttgttgtgaatctcgacatctcggcatgcgatgccgtgttattttactacaacaagtggctctccaacattcatgatttctacttggacatcttcaatacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttgggcaacaacatcaactctcctccaagtgaagcatctacaacagctataacattaatttgatggattattgtcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcttcttcatcatgtcggttgcgtttgtcgtcgtcaactattttctt

SEQ ID NO: 46128 - DNA, 4713 bp, Oryza sativa
tactatcactttatcggatgaaaaaatgaccaaaataaaagttatagatcttgatgagttatacaactttgttgttgatgactttttgagttgaaataatttagtatatgaaaaatgttgtttgaagttgtcatatttttaaattcaaacttaaactgttaaaaaaaacgttagatagaaaaatgaccaaaataaaagttatagatcttgatgagttgtacaactttattgttaatgacatttttagttaaaatcatttagtatatgaaaatgctgtttgaagttgtcatattttcaaattcaaattcaaactattaaaaaaacgttatatagaaaaatgaccaaaataaaagttatagatcttgatgagttatacagctttattgttgacaattcttccatttaaaatcatttactacccgaaatttttttttgaatttcttgtattttaaaatacaaattttatacagttcaatcaaacccggatagagaaatgaccaaaataaaaatggtagatctcaatgagttctacaactttgcctacaactttgcttttgatagttttttcatatgggttcatttagtatcataaaattcaatttgaaattcattttttcctataagtctgatttgcatcttactcatgataatacttgcaaaatatatatttaatccaattaactcagatttgctggtgaaatatgtgatcaaaatggatgttatgtgaatgtggttgtgttatgtgaatgaatgtatatgaataggggatgctaggatgtgacatcctggcccaggccttaatatgattaatagaatactcatacaaatttttttcttggaagcagcttccaaagaaatatgaggttaagtgtgctcggcttagagtaatttcaggatgggtgaccgaccgggaatttgaggttacgcgtgctcggtttagagtagtttcgggatgggtgaccgaccgggaaattcgtcccaggtgtgcatgagtccggataggtgaccgaccgggaaggcacacgagtgagggcaaaggcctgaggccaaaaaaacaaaatttatttttttgcaaaggcctgaggctaacaaaaaatcaaaatttatttttttttggattatactcatctgtgacgggttataatctaggcccgttggagatatgagtcatccgtgacgggctataatctaggcccgttagagatgagagtcatctatgacgggctataatctaggtctgttagagatgagagtcatccatgacgtgctataatctaggcctgttagagatgagagtcatccgtgacgagcttttgtgttggcccgattgagatgcgtcatccgtgacagccggatgcccgattgagatattttctcacatcactaaccatgtccgaaagagatgatattttaagcccgttagagataaccaatctcgttccgttgaagaacaaattaattagcttctttttcccatcttcaaggaaaggagctagctagccaagaacttttgtgaagtttctgtttcgaaaaaaatgtgaataatgtaagtaataacacagacaacaaaaggatgtgataacgtaaacctgcacaaacggccaacctctgttttaccaccatgcacaaaacatggccaacgtaaacctgcaaaaatccgaaatcactaaaccaaacccatcaattctcatatccatcttaatccatcaatctttcgagaaaaaaaactaaagcaattacaatttactgagtgatagtttgggtcatcatctatatttttcttaaataagcttccaaataagcatgccttggcctcctatccaactgacgcaagtacaaaaaagaaagacacaaattaaattcctaaaattatgttattttcaatttacttatcggattattgttgtaaattttctctccactttgtaaaaatacgtttttatataaaaaaaactttcttttatgcatgcattgcttataccacttatttgaaatttatttttaagaacgaatttatcctacccttaaatgaagtaaaccctctatccaaaagtttaaggtatatttcattttttttctaaaaatctaagcatatttctgtctctatgtgttaaattaaattgttcattgtaccgatgagccatcttgatactaattggttatatgcatgtatataatttttttcatttttatcacatgatgaatgagttaatttcttcttatatttggtgataaaagaaatatgtttttgacttttagatacagggagtagataattaatttatgataataatatctggtctgtcaaacgcgtttgtgcgagtagtactagtactacacatcttacattggtcgccatctctggattaattttagtccaagactttatcaaatcgaaagccatacatgatactaagagcaagtataatagcaaactataagccagctataaatacatatcgagaagatacatgaggagagataagagcagcggactataaattttgtagccagttgcagcacggattacaagatgtaatatgtttataacaggtgagattaggttttacttgtgtagatatgtttatatgtaactattgcataaattggctattaagttgactgtagttgattttgagccaacagtgcgctatactattaaacttgctctgaggccaactttgtcaaagcacctttccaacgccgcacagatctaactcacactgttcacccataaataattccatggaaaccctcactagctctccaactacggactctacactctaaaggagaaaattgacattgtgccatcatcaaaagtgggtttcgtccaaataccactctgcaaaatggattcgataaaatgccactgtcaacacttggttacacgctaaaatactatctcggaccaaattaccctcctctcatcttcttcctccctccatcaccatcagctctcaccggcggccaccatcccgccttcgcgtgagctctcctccatggctccatggagaaccacaggccacaggcccctgcgaggacccctcccatggctcccctccccgtgccccctcccatcgccccatcccagccccgcctccgcgagaccccgcaccccggctgccgccgccatcgcctccacctccgatgaccaccacgccacgccttcgccatggtcatgctcaccaacgactccaccgtgcgggcgcgcctccgccgcctggaagaacaggagcggctgggacggtgggttggcacgaaagatggagatcgccgacatcggcggcagcggcgcggatggtgtggagcgtgaccacggggtcgtcggttgggggtggtcgaggcggggaggaaggggagcggaggtggaggaggatgagtcaggcgtggtggaggaggggaggaaggggagtggaggtggaggaggatgaggcggaaggggagcggaggtggaggcgggcgcggtggagacggcgaggaaggcgagtggaggtggaggcgggcgtggtggagacggcgaggaaggcgagcggaggtggaggcgggcgcggtggaggcggggaggaaggggagcggaggtggaggcgggcgcggtggagacggcgaggaaggcgagcggaggtggaggcgggcgcggtggaggcggggaggaaggggagcgggggtggaggcggatgaggcgggcgcggcagaggcgagccggcaaggcatcccttgttagaggtggaagaaagtagtaacaggggcatttttctccgttcgggcattatagcgtgtagtctttaattgaaagtggcattttaacgaggcccactcccagcgtggcatttgggcgaaacccacttttgaggatggcataatgtcaattttctcactctaaagagtccctttcagtacagttaggcagtagccatgagagctatacgtacgtgcaagtgcaactgcacaagaagaaatcatggaattattaactaatgcccttgttgtgattaagaccatctaatccatctgatcagcgagtgacacgcatgagatgagcgagctgcgcgcagcagctagtagtagaagatgctagcgtagtccgtgtaataacctacccgacttaaattagcagcagttactaccacctgcttcgcaacccccaccgccattaatgcggtgatctactgcttgctgctgctgctactagcgtcttctttccttgagcttcagcttaattaagcttcatctccatcggtcgccacctgacctccccaactgtgaattgaaacggagggaaatggtggagcagcagcataaaatccaacgtgattctctcggctggctgtgcctgtgtgtgcagctaagctaagcttgcttgctctctcttcttcttcgtgttgttgtttctctctctgtctcgctgtctgttgccaccattaatggctggctccgtgggtagctgagctctttgctggccgagctgagctagcctacctagctggggggagagagagagagagagagagagagcataaggatcttggaggaggtggagatggagtacggcggcgggcgggaaggaggaggagggatgaacggcaacgggacggcgtacgcgggggcgctgtcgccggcggcgaggtacgcggagtcgggcggggcgagcctgacgtgggagaatctgacggcggtgctccccggcggcggcgggcgggcgacgaagaagct

SEQ ID NO: 46129 - DNA, 10632 bp, Oryza sativa
  unsure (1)..(10632): unsure at all n locations
tcatggggccctccggctccggcaagtccaccctcctcgacgccctctccggtatcctttcttccttcctttgccacctccatctctctttgcttcatgcatgctcagcagcaaaatcaaaataaatattcttttgaggagattaacaatttaacatggtttaaattcatggaacagttaatttttttgcgttgatttttgtgataggatttgtattcaaggcaaggatttttgatagatgggatattggggttgttttgagtgtggcatcccattccatttcaccccatgtactgcacgaatttcaccccatgtactgcacttcttgctggcttgctccatgcatgcccagcagtcaaaaaataaaaaaataaatcaaaacgcggtttatcaatgaattcttttttcgaggaaacatggtttgaattcatggaacagttcaaatttcgcattgatttctgtgccaggatttgtattttaaggcaaggatttctgatagattgatatggggttgattgattctgtttttgagtatggctgcagggaggctggccaggaacgtgctcctgacagggaaggtgcttctcaacggcaagaagaggcgactcgactatggcgtcttggtgagtttgctaatttagctcacaatttcaacatgcagatgctcatacaatttctaacttttttcactctgaatcttactcatcaaccgtattcatgttttttctattgctgattaatcaattcgtcagcttgattagagtgttccaagttcgacgctgcttgagtgttaaattacgcacgaatttatcactgatactacatcttaaccccactagctgcaaggacgaagaatgtggacttaacccagggaacaaatatagattcagatcttgtttggaattgaaggagtgtaggataaatcgcagatttgacgttggggtgtgtgagacttcctgatgactggcagaactatcacacgtgtagccactcggtgcgccgactcggggtattcgacggctaaggatgcatagatagatgtatggcacctagctagatacagtcatagagtacagtactgagcatggcatcccatgtgcacactctttaattttaggtgaagcattggaacaaatgcaattatgcttggtaccaaagtagtgtataccaaaccaaagcaagccattaatttagctagttagggtgcaacaaggctttttatttgatctgctggtgattgcttagttcctcccatgttcatggtttcctcttcagagttcctatgttcctttcactttgaatacaggaatgtactaattttgcttgtcttatcttcaaattagtatatattgcttaaaaatatcactgtgagtctcttgtagcagtctgtatagttgcactcagaatggagtgtgagagggacagtttggtgctgcccaactaatttttcatttatgccaattaataagaggacacatgtatagcatatcagcattacaaatgtagttatgagtctctttcatatgtttcaatatgtgcacgcatgcactgtcactgatatttcaaagccagatgggcttctaaattaatacagtatcagatacccgatccctccggccggtcataaaaatatgtcgttttcaacatcctaagtcaaacttttgaaacattaaacatttctatcttttagatatttgggttagatatgtatgaaaatcataaaatccgttgatgaaaagtactttttgtaatattgcaatattattcggttttgcaatggcagaattaattatgacagcttcgtatagttgactgctgaagcgagagaggtcgatcagaaatcacttaattgctagtgctactaactctgcatcaattcctacaatttcataacagttttaggagctatctgatttccttggaagaccctttttacatgatgactgattgattaatttcaaatctattacatactatactatactagtactataagtttttttttgcgtaatagtataagctaatttcactagcttttttactataaattgaaagattgcttgagatttttaaagccctctggaaccacagtaattttcataaaaaaatttcatagaattcatagctagtcaacaacatgattctcacatacacataaataccacagaattcctcatcattggcaaatctgagtgtgcctatcatttcaaatttaaccactatggtaaaatttgatttgctgaggtaacttaaatcaaataaccaatcaattagtgatgtagtaatagcacgggcatatgatgacaggcgtacgtgacacaagagaacgtgctgctggggacgctgacggtccgggagacggtgacctactcggcgctgctccggctgccgtcgaccatgtccaaggcggaggtccggcgggtggtcgacgacacgctcgacgagatggggctccgggagtgcgccgaccggaacatcggcaactggcacctccgggggatcagcggcggcgagaagaagcggctgagcatcgcgctggagatcctcacccgccccaggctcctcttcctcgacgagcccaccagcggcctcgatagcgcctccgccttctccgtcatcgagacgctccgccagctcgccgtcgacggcggccgcaccatcgtctcgtcggtgcaccagcccagcagcgaggtcttcgccctcttcgacgacctctgcctcctctccagcggcgagtgcgtctacttcggtgacgccaagcttgctccacaggtgtgtgataaatcttcagagaaaagtacttgtagtaataatcttcctttttgttttctccaattagcaatgaacaagtagatgatgattataaaatgagttttagatataatttatgtgatggtttctgtaattgttgctgttcctgcagttcttcgcggaaacagggttcccctgtcctagccggaggaacccgtccgatcacttcctccggtgtgtcaacgccgacttcgacgacgtcgccgccgccatgaaaggatccatgaagctgcgagcagtatgtccagctactgaagagatgtttgtaaatgtgatttttatctgatggaactgaattccgacaattttgtgtttttttcaggaggcagattttgatccgttactcaagtactccacgtcagagatcagagaacggctggtggacaagtacaggatctccgagtacgccatgatggtcaggaacacgatacacgagatcagcaaaatcgtaagcacaaacctgaatctcttaccacatccaaaattaagatcaattcaaaataaaaatgaaaaacctgatcaaacattccaaaaattccaaacgcaaaatgcaggagggagtgatcgaggaggtggtgatggggagccaggcgagctggtgcaagcagctgacgacgctgacgaggcggtccttcaccaacatgtcgcgcgacttcggctactactggctccggatcgtcatctacgtcctcatggcggtgtgcctgggcaccatctactacgacgtcggcacgagctacgcggcgatccaggcgagggcgtcgtgcggcggcttcgtgtccgggttcatgaccttcatgtccatcggcggcttcccgtccttcatcgaggagatgaagatgttcacgctggagcggcagaacggccactacggcgtggccgcctacatcatctccaacttcctctcgtcaatgccgttcctgctcgccgtgtcctgggccagcgcatccatcacctattggatggtcaagttcaggcccgggttcagctacttcgccttcttcgccctcaacctctacggcggcgtctccgtcatcgagagcctcatgatgatcatctccgccctcgtccccaacttcctcatgggcctcatcctcggtgctggcgtcattgtaagctaaaataacctgcacatttctattaattgctactctcttcgtttcaaaatataacaatctaagatccgtactagaaatctgacataactcctatctagttctagattgctatattttggaatagacggagtattactgaggaatgccttttctagcttgtatgctgaatctttccatggatgtatatatgatgtaggggatcatgatgctgacttctggattcttccggctgcttccggaacttccaaagatcttctggcgatacccggtgtcctacattgtctacggctcgtggggtttgaaagtaattgacttctgaatgacttaccatgtgcattcttacttggtgcagagaccgaagttacgacaatggtgctaatcactctacctgcattggaattgcagggagcgtacaagaacgatctgatcgggctggagttcgagccgatgatgccggggcagccgaagctgacgggggagtacatcatcaccaagatgatggggctgagcctcaaccactccaagtggctggacctctccatgatcttcgtcctcctcttcgcctaccgcctcatcttcttcctcgtcctcaaggccaaggaggccgccgcgccttacatccgcgtcgcctacacccgcttcaccatcaaacgactcgagcgccgcgcctccttcaggaagacgctcgccatgtcgtccatgtccaagcggcacaaccagccgccacaccccatggccgtccaggaggggctcaactctccaatgccatactgaagaactgttattacaagttacaactactactactgatgatgatgaagatgaagatgatgattgatcgatcgagcaagaagaggccggtagtttgggcgaccttgcgacgacgatgacaacaaagatgatgatcatatagatggtgttcgtgtgccacgaatcgattaattaatacttgtgtatgtgttgcccttggattgttttcagctcgttggaagctggaagggttcataaactgatagcgtattcttttttttaagatcttgtattttactgtaagaactcggtctctgtgaccaatacacatacaaaaaggatgctgtgtagttgagtgtttgttgtttcttgtttttttccctgattatttatctggccatgtcgatctggttagaacatgcttgtgctacattgatctggaagaaaatgcctgcagactgattactatcgatctcaaaggacaaaacgatgagaaaacaaaattttcatgagggcagaatggaggtaaaattgatacggcacgaggatcatgggtattgggaagtgcccttttcccctatatatgatggaattgaagtgatttcctgaatagtatgcatccaggtgatttctgttatcacaacagattcaacagtgtagttctgagagagaaattataaagcagagtattgaagaatcatccaatgttgcaagtgcaagaataggaaggattcatttattcattgtactattatatcacctgaacaaaagtactaacaaaatatagtggttgagtgtagcatgacaaactttttgttcaaattaatgctcaaaaagcacagcacaaaactcatgatacggttaaaaaaaatctacttaaaaaactttcacatgttttttcggtcgaaaacttccaaatgtaactacaatgtagtttacactgtaactaaaatatatgatgcacatagctgataaagggtaccctggtttgatccccgcccagcccgcgcgaggtttttgttctgcccgtatatgtagcacaaatcttggagcggatcagacagctagaaaataaagtttcccaaacaaaaaaccatcacaaattttctagtaaaacaaaaaaaatcacatgagaatcaactggatctaggaaataccactctggttttcaataaatgacgatgccattgactttttaggcaaaatttgctacgggactcttaaaaaacgtgtaattagctgtgggacaccgtaaaaacgtgaattggctatagaacaccgcaaaaaagtgataattagctactagacaccggaggtattattttattattccctataaaaacgaagagagaaagagtgttgaaagtaccaaaatacccctgtgtcgttttgcttgttctggagtcccactgatgccgctgccccatgccagcgagctgccacgccatgaccggactaagcaaggagagaaagagataagaaatagaagaagaagacaagagaaaaaaaaaaggaagagcaacctgtagccatcgcgtggccgccggcgaacagcacgccgtgccgtgccacgccaccacggcaaacggctgccgccgggcagcccacaccgagaccgcggcgctcacacgcgcgccttggcacgcactaccgtcgctcacgccgtgcctctgccctcgtcgtcgcacggtcatgccggcgccgtccgaccattcctcattgctccaccgccgcacatggcaaggaaccatgaaaaggaggaagaaatggaaaaaaaaaaggaaaaggcgctgatgggcgtcgccgcacgccgccaccgcatagtcgaatggcgccgtcgccaggcccccacaacgcgtgaacccatcgtatctaggtggtgtttggttggagggactaaagtggggctaaactttagtcccttagggacttatgtttttgtgagagcgactaaatttagtccctagtgtggagagaactccttcagcgaggagtttacgtgttaattacttaccacaaaccgggcttaacagaatacaggtatatatagctcggatagagttgttgtgcatctactaaaacataggaaacttatcttatctatctaaacagcccaacaactcttatccttcgctatttgttacattatcatatgtgagaaatatctaacactccccctcaatctgaacctgtaaggtttagattgtttctaaacatctctaactgtctgactgacagtgtcttggtgaagccatcagcaacttgatctttggtagatatatattccacttgtaaaaattttcttgcaacccgctcacgaacaaagtgataatctacctcaatatgcttggtgcgagcatgaaaaacaggattagctgtcatatactttgcaccaatattatcacaccataccttagcaattttgggtgcctgaattcccagttcatgaagtaaggtttgtatccacataatctctgcagtaacattagccaaagccttatattctgcctctgtactagatctggatacagtagcttgcttgcgtgcactccatgacacaagattaggccctataaaaacagcaaaacccccagtagaatgccgatcatccaaacatcctgcccaatctgcatcagagaaagcacttacaagaagagaattagacttgctaatttttagcccaagcttaactgtatgtttcaaatatctcaaaatcctcttagccgccgcccaatgcttagtggttggtgcatgcaaatactggcacaccttatttactgaaaatgataaatctggtctagtcagagtcaaatactgcaatgctccaaccagacttctgtacctggtactgtcttctggtccaaaaggattaccttcatgagcacttaatttttctgaaatagacaaaggagtattgactgctttacagtcactcatattcactctctttaacacatccatagcatatttctcttgtgtcaaaactatgccattatttacttctttcacttcaatgcctaggaagtaatgcagtcttcctagatccttgagtgcaaattcttgattaagattcttaagcaaagcattagtggcatcaatagatgagctggctactataatgtcatccacatataccaacataaacatagcaacatctcccttactgtaaaagaacaaagatgtatctgacttagatgatttaaaacctaactcatgcagcttagtacttaacctggaataccatgccctgggagcctgctttaaaccatataaggccttatctagtttgcacacatagccatctttctgttcataacctggtggctgcctcataaagacatcttcctctagaaccccatgaaggaaggcattctgtacatctagctgacgaagggtccaacctctagagattgctatggacaaaatagttctgatagtagcagccttaactacaggattgaaggtgtcctcataatctataccatatctctgtttgaacccctttgccacaactctagccttatatcgatctagactgccatcggcctttcgtttgaccttatagacccacttacaatctattatattctgccctttcttagaaggaactaggtgccaggttttgtttttcataagagcctgatattcactatccattgcttctttccaatttttatcacctaaagcctcatgcaaagtttgtggttctccagaagatgtaaaacaactgtatctaactgtcccatcagtgtatattttctcttttctaataccactttgtaaccttgttttaggtcgtattacctcagatagctgtgcagactcagacggcgcagatgatcctggctgatgtgactgctgcgcaccacctgacgaagacgcgacagcacgggcaggcgatggaggagcagcagtaggcgatgcagcaggcgacgtggcgcgcgctggttggatgcccgagcgctgctgctccgactccccctgcgtcgcagatccggaggcctgccgctgcagctgcgcctggaccgacgctgaatctgaggcggattctcccgccaagtcgccatttgctccatgtacccggccaaatgcccccggtatatctgaattcacatttctgggagattctgcacatgaaatatcagtagcatttggcatagagatattaaacagatgatcatgatgttcctctcccccttgatcagatgttttctcattgattagagtaggaggaagcaaagaaatttcagctcgaagacgggcgccagcatttggatgaagattagcaaagggaaacacttgttcatcaaaggtgacatcacgagatacatataccctgccggtagaaacatctagacatttgaaccctttgtggatattgctaaagccaagaaacacacattgctttgaacgaaattgaagcttatgagtattgtaggggcgcaaatttggccaacatgcacagccaaatgttcttagagatttataatctggtgtttgcttaaacaaccgttcaaggggtgtatcaaattttatgaccttactaggaaggcgattaatgagataagtagcagctaaaaaggcttcatcccagaatttcaaaggcatggaggcatgagctaaaagagatagaccaacttctactatgtggcgatgtttgcgctctacagctccattttgttgatgtgtgtgagggcaagagacatgatgggagatccctatttcattaaagaaagtgtgcagcttaagatattcgcctccccaatcagtttgcattgaaagaattttgcgatcaaattgcctttcaacaagtttctgaaattcatgaaacttctgaaacacctcagatttatgcttaagaaagtagatccaaacgaatttactataatcatcaatgaaactaacatagtatttctttgcacctacagactcagaggcaggcccccacacatcggaatgaataagttccaaaggattatttgacacactagttgatctaggaaaaggtaattgatgacactttgcttgttgacaggcatcacacacagactcattgacagaattactaagacaaggcaatttattttgactgagaattctaagaacaattggcttggagggatgaccaagacgcccatgccacctcacaaaagatggcgtcgcaacgaaggcctgtctcaaagacgatctggctggaagtgggtacaggcctcgtcgacagggaccttcaagaattgtcctcctcgtggccttgtccttaatcaaaaaatatttgccatgaatttcaagaaaagcataattatctgcaacaagtttatgaacagatactagatttttcgccgcttcaggaacatgtaaaacatttttaagatgcaaggggtgactaggagtaggaacaatagcatgaccaacatgtttaatactcgtaccttcgccacttgcagtgtgaatttgatctgttcccttgtatctctccttggttgtcaatttgtctagctgcccggtaatgtgatccgtcgccccagtatcaacataccagttggtatcaacaccgtaggcgtatgttgcagcaccgccaagcttctcatcaggaacatatgagtcatcataacgatgccagcagtcgcttgcaacatgccctcgcttgtgacacacttggcacacggggcgagtatcattgcctcgcccgcgtccctgacttgcgccgctaggggcgccacggccgtgaccgccacgaccgaagccgccgcgtccgccacctctgtttccagtgctgctgccgcgtccaccacgaccaccacctcggtttgccgcatttgccgaagtggtgagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46130 - DNA, 2188 bp, Oryza sativa
  unsure (1)..(2188): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttggcatagcggaagtagacggctcatcttgagtggaggtggatggcttgtcttccacttcaataggcttgacatctccaatggacatgttcttcatagctctcatcaagccttcatcacctacatcatccaaattctcatgtccctcttgggagccattagtctcatcaaattgaacatcggcggtttcttccacaatacctttgttcttgttgtagacccggtataccttgctatttgaggcataacctagaaaaaacccttcatcacaccgactttcaaatttggttagactatcaccctttcggtaaatataacacttgcaaccaaaaacttgaaaataggtaatattaggcttcctcccaacaattagctcataggaagtctttttcaagagacgatgcaaataaagcctattggttgcatggcaagcggtgtttatggcttccacccaaaaggaatcggaaacactatattcatcaagcatagtccttgccatctcaatcaatgtacgatttttcctcaccactacaccattttgttgaggtgagtaggtagcggaaagttcgtgtttaataccaagatcatcacaatagtcctcgatattggtattcttaaactcggaaccattgtcacttcttattttcacaagagtgcaattaaatttattttgggcccttttgcaaactttttgaaaagctcggcaacgatagacttgacatgcaaaaagaacacccaagtatagcgagaataatcatcaacaatcacaagacaatgactattaccaccaatgctcttataggttgttgggccaaacaaatccatatgcaagagctccaatagtctcgatgtagacatgatactcttagtaggatgagaacatgcaatttgcttgccggcttgacaagcactacaaagcttatatttctcaaacttcacatctttcaagcccacaactagatcacgttttgaaagtttgctcaattgattcatgccaacatgggctagcctcctatgctaaagccaacccaatgaagtttttgcaactaaacaagttttcaaatttgcttcactagaattgaaatcaaccaaataaagatttccatatctaaaacctttgaatacacaagacttgtcaagaaggctagaaacaataacttcttgcgggaagaaagcacatgacaagccaagatcacaaatttgagcaaccgaaagcaaattaaaatttagagatttaacaagagagacattatcaattgacaaatcattggagatagcaattttacctaacccaattacctttcctttgctattgtctccaaatgtcactttctcttgttcatttcctcctacctcaaatgtggtgaacatagccctatcatgtgttgagtgcatccactgtcaagcacccaatggctcccaccggtgcggtagttcacctacaaaagaagatcaagctcttttaggtacccaaacttgtttgggtccttggaggttagagaccaaagctttgggcacccaaatggcattctttttaccaccgagtataggggaacccacatatctagcaacaatgctaccatcatgagccttcctaagcatataatgagaatcaaacatgcatgtcttaggaggcttaccaccagggcaatcattcaccaaatgcccaacctcacgacacttggagcaatacttaccattgctcttgacaaaacgagtggcacagtgagaaggtttcttacccttctttggaatgaatccaagtccctccttgttaaggatgcaccattgctcactcaaaatcttgtcaagagtgttcttacccttgaagcacctctccaagctcttgttgagcttag

SEQ ID NO: 46131 - DNA, 1692 bp, Oryza sativa
ggtgtgtcgaaacatgaattcggcaataataaaagagggtagcgtacgagacctaaagtggatggatgcggagacaaaggatttagacaggttcaggccctctcaatgaaaggtaataccctactcctgtttggggatttgaatccgccgggtgtatatagatctgacgatctagttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatatatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgcatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaaatgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgacatagaaaatagactcatgactatgaatccatgtgaaaatgtatccggaataagtccaaattggagatataatcctcacgcttgagttgatgagcc

SEQ ID NO: 46132 - DNA, 2376 bp, Oryza sativa
tctcccttccatcgctgccgcctgttcccgcccgagcagagacaacgccgccgccgagctttcctctcctctccacagctgccagctcctctctcaccgtcgcctctctcctgcgctgccgctaggtccgacgcggccacggtctcctcacaccggtcggccgctgcctctccccaccttcttcggatctcagccggagaaaaaagaaggaagaaagagaaaaaagaaggaagaagggagaaaaaataaaaaaaaaattccatgtcatcgtccacgtggcatgccacgtaggctagaccacggtcaaacgcggctttggaccgggatgatacaataaaccaagtttagggatctcgatgtgcgctttacaagttcgtggacctaagtgaaaccacatgacaagtttaaggcccgctggcgcatttaactcttctcaaaattatccacaaaatcatccccaaatcttaaaaaaatctacaaatcattcacaaaatctaaaaaaaatccacaaagccacagccgccgctgccgctgcttccgccgggccgccacccggcctcccctcccactggatctggcggaggatgaacgtgcagagatgtaacctagagggggggtgaataggctttcctgaaaaattactcgtacaatcgcatcggtcaaattcaacagggcctggaacctcctggtgatgaacaccggaacttccgggtagtgatgtgtaggccggaatttctggagttcttgagccaggaacttccgggtgacataatagattgaaaacagcaaggaaatttaggtcctagctaagtaacttcaagcacagagaaatacagagtactatcaaacacaaccacataacatgcacaagagagacaaatgagattttttcctgaagttcggatcacacggatcctactctccgttgaggtgctccaatgagccaggtctcgattaacccttgcctcacttatgcaaagatcctagaagaagtccacagccttgaactcaacacctctaggtcattttctagaatgagagaatccattctataccaccgagtttgttagagttcaacgatatgccatcgacattgtttctttctataatataccgacgacgttatcaattgttctataatacgccattgggctaggtcttattttcaaaaatacccaaaatacccttacaaacataaaattaacaattgatttaactcattacaagtctcacaaaaatatgaaattttttatgtggcccccgtacacaacatagaagtttgtatacaagtttcaagtttttctggtatatttaatttttagaaaaaaaatattttgtgtcgtatatgagagaaaatatgcttatataagagataatagcacaaaaatatcttatatagtttatgaaagatgatttatattaaaaacaacaataaaaaagtattttatatggcatataacaaataagttatattttttataaaaaaatagaaatgtaaaaaacttgaaacttctttacgaatttccatgttgtataaggaggccacataaaagttttcatatttttctgaaacttctaatgaggtaaatgaattgttaaccttgtatgtctataagggcattttgggtatttttttaaaaaaggctcagcccaatggtgtatcgtagaacaattgataaagtcaccggtatattatagaaagagacaatgttgatggcaaatcattgaactcgaacaaactcagtggtatagaatggattctctcttctagaattgagtgaccaccaagatccaactcacaattccttctagaaaagaccacaagtgcaagttgctctacctaggacaacctctgaaaactcagcacaagaatctttactcacttacctcgtttccttgcggaggtgagaaaaaccttcacaaaccttcctgggacatccacaagatctttggaagttcacaggcgacacctaaccgtctaggagaagatcaccaagagtaataagcccaaggtatccaaagtgctcaatcaaacctactccaaatcactcctacactctcatctattctctcaatatcttaagataggctctagatttgagtggaggaagcaaagggaccttgggaaaggctagaaaaccctaggacttgaaagaactgaagtggaatggccaaaaggtgagctggggacgatatccataaatataacggctaggtgacatcatctaaccactactcacaggtttgaactggaaacctgccaggaagttccgggccaaagtgctaggaacttccgcgcaacacttaggaaaattctcgctatacttcagcgcccggaagttccgaacagaaccccgggtgggactctctgtcccg

SEQ ID NO: 46133 - DNA, 5356 bp, Oryza sativa
gaccggttcacgggaaaccctgggagacttaccgtgcttaccacaagcgggagtgggtaactgcttgatctgaagtatagctcgaccctttcctaggcaccggtggcgagggtgggcgtgatggagttgggtccgccgaggtattcggttgtctaggccggattcaccgcggcgcaagaggggaccgcccactgccttttgaggggtgggggtgaaaccttagtgtggtgtggatggttagggaagaagggttatgtggagggtcttgtcacgatttccccctttgcagtatcatggtgatacttcggggcatggcgacatgtgtggaatcgtgtcttgtgggtacagttgtacatctctggccagagtaaaactattcgaatagccgtgcccgcggttatgggcgatcaaccagattcaccgtgattagtctcacccctagtttagcttattgaactggtgtagtacaggtggttggttgggcctgttgcaacgtggtgtagcgttggacagtgattggttaatattgattaattactacagctgttttactgctatcaactactgctttgaaatgcctgctttatgcaaaagaacccctagcttcctttggttatatcctgcatcatacctcctcttccggtatgacttgctgagtacagtgggtagtactcagtcttgctctcttttcccctacactagagttgaagttcttctcagttggagccgtctcagagaggttggtttcgtcgctgccgtcaaggtttgcctgtggagtagagtcgcccgctgctgaagtcaagcttcccggtttagctcgcttttatctttcccgctgcatttgtaatcttttatatttttgtaagacgtgggtctgtatgtcaacaattgtcgtttgtgtaccctggctggtcctagacagggatttaatgcacattcagcttagaaattctggttcgagaatttctgggggtgacaagttggtatcagagccgaccttgaccgtaggacaagccaactggaaacctaagagccttctgaaccctttttttttcatatgcatatgcccttttgcacttggattttgtttcgggaaaattttggggtttgttcttttgatttgtgggaaaaatcttggtcgcttatttaattggatttctcgactagggacagtctagggatttagtaaaagtttattcgaaatttattcggcagtcggtcgggaattgtcgggtgatatgcattaggtcgtgtctatgttcggtggggtaagtttatgcgtatcagtatgactatgcatctatttcatgcattaagttattgtttagtcagttgcattagtgtcttttgtctcggttcgtgaaaaatgttgttctatgtataaaaatcatcatgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacatatccccttcagatggagacaaggaatggttcacgcgactccaacaacgccagtggcagcgaagagccgatcaatggagcacgtgccaatagtgcatctgacaacagtctgtccccaccgcccgagaacccaacaattgctcaggtgttggacaatcagactcagatgatgacaatgatgatgcaacagatgcagcaacagtaccatcaggtgttgcagcaggtgcagcagcaagcacagcagaagcagcagaacctgcagtttggtcctccacgccctcagtccaaactgttagaatttcttcgtgtcaagccgcccactttctcaagcaccaccaacccaatcgaggcccacgactagcttcatgccattgagaagaagctgaatcttttgcaatgcaacgagcaagagaaggttgcttttgctacacaccagctgcaaggtcccgcttctgtttggtgggacaactacatggtgacccgtccagctggggcagaggttacttggacagagttttgccatagtttcaataaagcacaggttcctgagggaattgtggcacaaaagaagagagagttccgttccctgcaacaaggaaccagaacagttatagagtatttgcatgagttcaaccgcctcgcgcgctacgcccctgaggacgtgcgtaccgatgacgggaggcaggagaagtttctgtctagtcttgatgatgaattgactaaccagttgatctctagagattatgaggactttgagaagctggtggataaggctatccatcaggaggagcactgtaacaaaataaaccgtaagaggaaggcaactcagttcaggactcccaggggaagagttagaagcctcgtttcacgatgggacgtcacggtggaccttccaccatgattatccggcagcaccgtccctaccacccgggtagcttcaacaagaaccaccatagtggcagtcacaacaacagtgagcagcacagcctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagatgtgctggacccaagttcgttcaggcccgtgtcaatcatgcatctgcagaggaggcgcagtcagcaccagaggttatattgggcacattccccgtcaactcgacaccggcagtaatattgtttgattctggtgcaacacattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttgacaaggcacagaggagtgattgattgcgctagccgtaccatcaagttaaccaatgcaaaaggagaggtggtaaccttccagtctccagtgccgcagaagccagggatcagtttaaaccaggctgctggtgaagaacaagaggtagcagtggagaaaaccactaagaagctggaggatattcccatagtcagagagtatccaaaggtttttccagacgatctgacaacaatgccaccaaaaagggatatcgagttccggattgacttggtacctggaactgcaccgatccacaagaggccttacagaatgggagccaacgagttggcggaagtcaagaagcaagtcgatgaacagttacagaagggatacatccgcctgagcacgtcgccttggggtgctccggttatctttgtggagaagaaagacaaaaccaagaggatgtgcgttgactaccgcacactcaatgaggtcaccatcaagaacgagtatcctttaccaaggattgatgatctgtttgatcagttgaaaggagctactgtgttctctaagatagacctacaatcaggctatcaccagttgaggatccgcgaagaggatattccaaagacagcattcatcactcggtacgggttgtttgaatgcacagttatgtctttcggactcactaatgcacctgacttcttcatgaatttgatgaacaaggtgtttatggaatttctagacaagtttgtcgtggttttcatcgatgacatacttatctactccaagtccgaggaagaacatgagcagcatctccggttggtacttgaaaagttaaaagagcaccagctatatgccaagtttagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgccggttcattcagaacttctctaaaattgctaagccaatgacacagctattgaagaaggaagaaaagtttatctggtctgctgaatgcaataggagttttgaagaactcaaacgatggttggtgtctgcaccagtcttaatcctgcctgatcagacaaaagatttccaggtctattgtgatgcatctcgccaggggctaggatgtgtgttgatgcaggatggcaaagtggtctcttatgcttcacggcagttgcgttctcatgaaggcaactacccgacgcatgatctggaattggccgcagttgttcatgctttaaagatttggcggcactatctcatcggtaaccgttgtgaggtatatacagatcacaaaagtctaaagtacatcttcactcaacctgatttgaatctcagacagcaaagatggttggagctgatcaaggattatgatatgggaatacattatcatcccggcaaggctaatgtggttgcagatgccttgagcaggaagagctactgcaatgttgcatgggtagagcaactatgttgtgaggttcaacgcgatttggaacatctgaaccttggtatagttgagcacggattcgtggttgccctagaggcacagcccacactggtggagcaggttcgcatagctcaagcaagtgatcctgaaatagcagagctcaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcagtattccattcatcccggtagtactaagatgtaccaagacctcaaagagaagttctggtgggtcagcatgagaagggaaatagctgaattcgtagcactctgtaacgtctatcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaag

SEQ ID NO: 46134 - DNA, 894 bp, Oryza sativa
gccgtatgctgagttctcttacaacaacagttaccaagctagtctgcagatggcaccgtttgaagcactgtatggacgaaggtgtcctactccactcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgctttcgaaacaggggattatgtgtatctccgtgtcactccactcaggggagtacatcgcttccaaaccaaaggaaagttggcaccacgctttgtgggaccatacaggatcttggaacgtagaggtgaagttgcttaccagcttgagcttccctccaacatgcttggcatccacaacgtgttccacgtctctcaattgaagaaatgtttgagaggacctgaggaacaggcaagtccggatcacatcaaaattcaggaagatctgacatatctggagaagccgactcgtatcctcgaaaccagcgagagaaggaccagaaacaaagtaatcagattctgcaaggttcagtggagtcatcactcagaagaagaggccacttgggaaagagaagatgagttgaaggccacccacccgcacctcttcgccagcacttccgaatctcgaggtcgagattccgtttaaggggggtaggtttgtcacaccttgaagtttccccccttttcttgctttaaaaattggttaaataaattgcccgaagaaattatcttaattaacctagagctaaatccctagttaataaatgcaattaataatcggaaatagcgtggtggaatttttcttgagttccccatgctccaatgcattaacaagat

SEQ ID NO: 46135 - DNA, 1102 bp, Oryza sativa
gagcgtaagagataagcttaaagccatgaatcccttttatgcatatctggatctggatcctgcagaacaaacatataggatgagtagtatctgatataaatataatactcgagaaaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttagtcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctatagcccccgactcactgctcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccagtcggcggcgacggaggcgggccggcggtgaagatgacgatgcccttcaacggtggtgtgaccaaccgaccgtataggcggggacaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcg

SEQ ID NO: 46136 - DNA, 35999 bp, Oryza sativa
acgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcacgccggcggtgaagtcgtagacgcccaacagcggcggcataataggccagccgtgccggcgaggacaccactcggcggcggacgaggcaggccggtcggtgaagtcgtagacgcccaacagcggcggcataataggccagccgtgtaggcggaggcaccagtcggcggcggacgaggcaggccggcggtgaagtcgtagacgcctaacagcggcggcataataggccagccgtgcaggcggaggcaccactcggcggcgacggaggcgggccggcggtgaagtcgtagatgcccaacagcggcggcataataggccagccgtgtaggcggaggcaccactcagcggtaacggaggcaggccggtggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcgggccggtcggtgaagtcgttgttgttatcagcaatggcggtggcgaagacaagccggcagagtggactcgcggccgatcgaccggaaagctgagacgcttcgagtccatgaccagcatcaatcgcctcaatagtgccgcgtaattatatgtgaacaacaacaaaaaatagcaagagattaatctgagattaaaaatcaatatgataaataatgataaaaatcagattgagtttccccctgactgatttggatcaagtcagagaagaggagcttgaagaagtgatcgacggaaaggaagtgaaaactcccaaagcgaaaacgaagtcggcgactcatgaaattgattccatcgcgctcgttgataggaaactcgacgcaacccctacctggcgcgccaactgtcgaaacatgaattcggcaataataaaagagggtagcgtacgagacctaaagtggatggatgcggagacaaaggatttagacaggttcaggccctctcaatgaaaggtaataccctactcctgtttggggatttgaatccgccgggtgtatatagatctgacgatctagttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatatatataagttatcccctatgactagtcggataaccatgccgtatgggtatggggtacccataatatccacatggtgagtctctcatgagaagtctttagctcctcatacaagacctccaaagaagcatgatccttctttagggccatgaacttgacaatctttttctcactataagcatggagctcctcaaacatactcacaagctcatcataggaaacatcattacaattatcattactctcactatcactaagagatgttaccttagaggaaccctttgccatgagacaaagtggagcgaagagtgatagagcctccttgatggcaacaacggccatcttcttcttcttggagcttgcatcatcaccaccttcttcctcggacccggatgaggcggagctctcctcatttgagtcccattccccgatgaaggcttcaatcttcttgccttccttcttgagcttcttcatgagcttgtatcctccactcttcttcttggatgacttgtctccatcatcatctttggaagggcacttggaagcaaagtgtcccttctcaccacactcaaagcacctcaagttggagagagtcttgttgggtcttctatttcttctcctatttgagtttgagccccttcctctctcctttctccttcccaagagatcattgaaccttctagcaagaagggcaatctcttcctccaagtcctcattggcttcattcaccttgcccttgcccttgtcctcaacttcagcttggagagcaatgcacttcttggaaggtgaggcttcctccatctccttcttcttcaacttgtacatgtcattggtgttgatcttccccaagaggcttgccggtgtcatccttgacttgtcggagttgatgagcatggtgacaagggtctcatacttctctggtagagccctaagcatcttttgggcaacctcaagatcggtgtagtttgccccaagccccttgagatcattcacaataacattgagcctcccatacatgtcattcacactctcatgaggcaacatggagaatgtctcatattggatcttgacgaaatgaagcttggcatccttgtactcacttgtgccctcatggatctccgccaacttgttccaaatctcatatgcggtctcaaggttgctcactctatcaaactcctcttggctcaaagagttgaacaaagcattcatggcttgggcattgagttggaggttgcggtgatcaatctccgtcaagggtgtgccgttgatagcaaagcctacatccacaatactccaaatatggaagctcatagctttgaggtgagtagacattttaattttccaagtggaatagtttgtgccattaaacatgggagccttccctacatggttcacctcgttcgacatcttctctctaggcggtgaagcccaatcaagagagaccaagccctgataccacttgtaggatcgagaggtcaactagaggggggtgaataggcgatttaaaactaaatgacacctaatcaaaactaacctaagttgctaggcttggtaagggtcaactctaactaagtaactaagttatgttttgcaaacctaaggtgatagtggctcaattatatctctaggaaaagtaaatcacactcctatgtcaatgtttagcaatcctagggtgatatgatctcaagtatgtctctagaaatgtaaattgcacaaatgtaaatgcgacaatcaaattagacaagtagacaagagatttttcaccgaggttcggaaactcgcctgtttcctacaccccgttgaggcgagcccaactccaccgctcaaccacgaaaccaccgcacgcccctttcgtcaaggggtgggcaaggcgggagcggcccatggagaggactacccaagcctcgatcactagggtagttcttccttcactccgaaggtgctgaactccaaaccactcacaaaccgacgccgggcctcctccacaatcttctcggagaggtcaccgggcaactcctccacaagccgtctaggaggcggcaacctctaagagtaacaagcaatgacccggcgtggagatgatcaatcaagtgccacactagctctacaaatggaagcaatgcacttgactcttggctaatcaaccctctaacacactagatggatgaacacaaagctcaagtgggtgtgagagaggtgcaagggatgtatgcaattgaattgggtgccaagagagtccccttgctgctggtggggaagtatttatactcccacccaccaaaactagccgttaggggtgaaatcccccaactttgtgctctgccggtctgaccggaggtatgtggccggtcagaccgtgctactgtgcaacggctagaaaactagccgttgaagtgctatcagagggccccatcggcctggctggtcagaccggcgttgagtgggcggtcagaccggcctcggctcggtcagaccgccatcggctcggtctgaccgactacggctccatcggctctgtatcggccacccggagcagcaccatcccggcctccagtgggccggtctgaccgcgcatgtactgccggtcagaccggctttatgcgccggtcagaccgccttcttgcggccgttcagactggccaaggtacgccggtcagaccgccactatgtggccggtctgaccgcccctgttcaggccgagcccagtgaaatcccaagtgattgtgtgtgtgtgatgaaaagcgagcacacgtctaaatgcataatgacctaatgtggcaatttaatcatctctttgctaggtcattacccctcttaatagtacggcgaaactagaaaataaactagcaaatttgatcgccctacacctcgatcaattctaaatttgatcgccctacacctcgatcaattggaaaataaactagcaaattttaatccatcgatagtcatccatgcacacacatgatgtggatctaacttaaaatattatcccaatagcaacggttagtccacaattagcgcttgtcattaattaccaaaattaacaacgggggcctagatgcttcaaagcgtatcgacgaagccctgaagcaggagtgccgtcgatcgagccgatatgccggagggcacgtgttggcttgcatacgacatcatcgtccgcaactgcacctcgagttcctccacgaagggttttctcgttctcggtgaactccggtggagatagatcacctggcgaagtcgatggcgctgctggcagggaaggacttccagtctatggactggcattggccttcctggtagtctctgtaccctgtgacaaatatcttagggaaaagtgtaatatagttttgggtttttacggaattgtaagaagtacttgtgaaatagaaaagaaatctatcttaactaagctctcttactctggatgtagtgtgtaagagtgtcttattacttagcgacttcgatcagtcatttgagtcatacactctccctagccccagccttgtcatcggagaattcttctcggaagataaggctcttggacctttgacctacctcggttgaacaagcactgatcctagccccagccgtgaagttagaaaattgattttcgattacatggcttggttaatacgcacgacgagaactcttacacgaccagatcttacatggtctttcgtctctacaggatccgacaaggccttatcggctttgggcgtccccagccaaagatctcttaggttcctcggaggccttgtcaagacggcgtaaagggacatgaggatagatttcaacgctaggtgtcatctgggtaagggatcatcgggaaggaacactttggttgtaatctgtacctgaaaataggctttattgaagctgtaagatgtcttacaagtatggatactattgacttatacatagaatttacgtaattgatcaatgttccagaaatttgccatctcacgaccatcgccgtctgcaattttgaatgcgcctggccgcaagacatgtgtgatcgtgtacggtccttcccatttgggtgagagcttgtttcgccctgcttggctttgaacccgtcggaggacgtagtcaccgatcaaaagcgtgcgtgctcggatgcgcttctcgtggtaacggcgaagggcctgttggtagctggtttctcggacgacaactcgttcacgatgttcctcgagtagattcacatcgtcgtttcactgctcctcctgattctcatcgaaatacttctgtactcgtgtactttgatgtcgtagctcggtggggagcatggcctctgagctgtacacgaggaagaagggtgtttccttgttagacgttgtcggtgtggtacgcacggcccatagtactgatgggagttcttcgacccacttcttgtcctgtgacatgagcctgtcatagacgcgggtcttcattccttctagtactatgccatttgccctctcgacctatccgttgctctgagggtgagaaaccgaggcaaagcagatcttgactcccagcccgatacaataatcctggaagtcggcgctaatgaactgggagccgttgtcggttatgatgtggtgcggcagtccatatctgcaaaatatccctttgatgaatttgatggcgtcggccttgattttccccgtgggtgtcgcttcgatccacttagtgaatttgtcgatcgccacgaataggaacctgtagccgccctatcctcgtgggaatggtccgagtatgtcgagcccccaggacgagaacggccaagtaagagggatagtctggagtgcttgcgctggtagctttgtgtgtttactgtgaaattgacaggcttcgcaccgctgaaccatgtcgcaagcgtctttgagggcggttggccagaaaaacccttgccgaaaagcttttccaaccaatgtgcgaccggctgcgtgtgacccgcagatcccttcatgtatgtcgaggaggagatgtctatcgtcgtcggacgagacgcatttgagaagtaccccatttggcgctttcttgtatagatcgttgccgatcatacagtagatttttgctttacaggttattttgtcggcttcttcgtcgtcctcgggcaactcttcgctgcatatgaatttcatcagtggggtgcgccagtcatctgtggtctcgatatcggcaacggcgcgctctgcctctgtagcccccaagctgatgtcgggggcgactgggctatcttcgtcgcttgcctctttcactgatggctttgtcaggacgtccagaagagtaccgggttcgagtggctctcgtctggatgcacgccatgctagatcatccggctcgatgttgtccttgcggtatgtcatgaccggaattaatccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgagaaacaacggaagactagggcgacgaccacaggcgcttgacggcaggcacgagctagacaccaacgccttcatcttccaggggctcctcttctgggtttgggaaaaattgagcaagactgagtacaaccaccgtactcaacaagacacacccacaagtgcaggataaatgcaagggagtacaagggggttataatataaagggttagggtttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagtcaacccaggccaaccattccacattttagttgttaagcaggttttaagaattaaaacactaacttgggtacattgctcggcttgcccataaccgagggcgcagctattcgaatagattatactctgatcagaggtgtacatctttacccacaagacacatcttcctcatgtgtaaccacgtgccgcataccaccacggtatacggacggaagacgtgacatagtttccaacccatcctagccatagacaagagtaccgacccaaccccacctacggccggaacccccgggacaggtaggcaagactgagccccttgcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccaaccattccatagtgtccaggtgatatgaatatcccaaagtctagagttgtaaaaccacctaatgctgcctaattaagcggcgaaacatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaaccgataatgcaataatttaaatcaacataattttataaactgggattcaatatgttcaaggatgatgtgacttgccttgctcgctttcccaaccgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccatgttatggctatttgaagtttatatgctctttaagtgaatatttgcgaatttcttcatttaaattttaatttaaaaaaaagtttattgcgccagccgaggggagggggcgcgcggaccgggtccacgggagtggggcccacgcggcagcctcacggtccacggtggactgggtgcacccgggctcacaccggccggcgccgtgggccccacgcgtcagccgcacccgagggcgcgggcggctgacagccgggccccacgcggcagccgctcgatgcgcccgaaggcggccacggcggcacggccggcgggaggcggcgcgcccgcgcccctatggtcgccggcggcggccataggcacggcggagcggcggccgagagaagggagggaaagggggaaacgaggcggcggtccacggctcaccctaggtcgacggagacgacgaaaaggcggctggagcggaggaaggcggcggcgcggctcgggtcgacggggacggcggcgctccggcggtcgacgagcgaaacggagggtggacgaggtcggcaaggatgcggcgggaggaaggggatgacgggtgggccccacccatcagcgagggtggcgggcgggcccgcccgtcagtggcgcgcgcgcggggagaggccggatgggccgcggggagaggagagggagggggagggagatgggccgagccagcccaagagggagagggagggaaaggggactttttagagtttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttagaggatgtattttagagtcgttttgggacgtgacacggtatacgtgtcggacctcgatcccatcgaaccttttttccagcttcctgacttctgcgagatacttggataactcggggctagagcacttatagtctttgtgcacctggttcgcgactagttcggaatcccctttcacgacgagtgtggctgcagctcttatcccggcgagtagtccttcgtactcggctgtgttattggtcgctttgaagttgaggtgaattgcatgcttgaattgatctcctgaaggtgatgtcaagatgaatcctgcccctgctcccctgtgggtttggaagtagtggcgtagctttcttgatgtcatgattaccgcgtagagcagtttttggatctgtggatatcttgtctttgcgtcgtggagagcttcgctgatgtagtagattggtcgttgtaccttctctctctcgacgacaatgacagtgctaacggaatatggcgtggcgacaatatagagaaataattcttcattaggttggggagcaacaagtatagggggatttgatagttagcacttgagtgcaatgaatgcctcttcggcttcctatgtccatataaatttgttttgtttcttgagtagagcgaagaaaggttgtcctcgctctcccatcctagcgacaaacctacttagtgccgccatgcatccggatagcttctgtacttccttgagtcttgtgggcgacttcatattatcgattgccttgatcttctcgggatttgcttctattcctctgctagagatgagaaaaccgagtagcttgcccgatggtactccgaacgtgcacttctctggattgagcatgaggcgatatcgtcggaggttgtcgaacgtttcccgcagatcgtcaatcaatgagtcgcttgtcttggtcttgacaacaatgtcatcgacgtaggcctcgacattgtttccaagttggtcgctaagtgcgccctggaccgtgcgctggaaagtatttcctgcggttatcagtctgaacggcatcttaacatagtagaataccccgaatggcgtgatgaatgttgttttctcctcgtcctcttttgccatgctgatttggtggtaaccggagtaagcgtcgagaaaactcaacaactcacaaccggctgttgagtccacccgttggtctattcgagaaagagggaagtgatccttgggacacgccttgttgaggtcggtgaaatcgacgcacattctccatttcccgttggccttccgcaccatgactggattggctagccactctggatggagtacctctctgatgaaactagctttgagaagtttgtcgagctcttctcatatgtcttgtttttaatctggtgcaaatctccgtagtttttgttttactggcttggcgtcgggtcgcaccatgagtttgtgctcaatcacctccctgggaacccccggcatgtcggacggctgccaagcgaaaacgccagcattgtcgcggaggaaggtgatgagcgcgagttcctatttctcgcctagtgatgccccgatcttgacggtcctgtcggggttagcactggagagtggaacgatcctgattgcgccgtctggtttcggcgtcttgtttgttttgctcactttcttgagtggctcagctgtggcgggtgggctgggcgtgtgctcgaccatgtcgaggctccgcttgtcgcattgcactgccagcttagcgttcccttgaatagtgattgttccctttggtcccggcatattgagcacttgatacgcgtagtgagatgcggccatgtacttcgcgagtgcagttctcccaatgatggcattgtatgctgtatcgaattcagtgacatgaaaggtgatctgctccgttcggaagttacttgcttggccgaaagtcacaggcaacgtaattttgcccaatggttcggacgatgactggggagtgattccatggaagggttgatcggttggtgtcaattcgcttcgtgggatccccatcgcgtccaatgtgctggcgaagagaaggttgattgagctgccgccgtcgatcagaactcgtgcgaccttgatattccgaatagtaggttcgaccacgatcggatatcgccatgggatgacggcagtcttggggtggtcttcttctgagaattctatcttctgttcagaccacttcatcttgggtgtagccccctgccacgtcgaacagacttcacgtttcactttcttgtattctcgctttgaggagtatgccgtggaacctccaaagatgtgcgagacatggagatcggagtctgggtatgatgagtccgattcctaagtagccgtctcagtgtccttctctaccacacgtactcgcttgcttttttccgatgccatgtgctttccgagcgactttttgaagacgaggcaatcttccagagagtgtctgtccgacttgtgtatagcgcaccatgcttccttcgcgtcactaccttgtaggtctgggcgtttgggagggtccgcgtattctgctgcgagaacttccgcttgagctttctttttcccactcttgtgatttttctttttgcttgactcaggtgcgtccttggctggtttcttctctcctgcggtcttcggcttgtcgttcttgcgtctcagtgcgtcatctgcgtgggcgcatcgatcgacaatctcgaataatctccaagtagttgtgatgcgcctcgttgccaactcctgggtagtatagcgatctctggcaccggacttgaaagcgcggattacagaagcgtcggtgatttcggggattgtatttctgcactcattaaagcgctgaacataatctctcaaggattcacctgggttttgtgtcaacgcatgtaggtcgtctttgatagcgtggcgcttgtaagttccttggaagttgacgacgaactgctgccacaggtctgcccacgaagaaatcgagtagggcgggagatgcatcagccatgaacgtgcagagcctttcaatgcagttggcaaataattcgaaaacgcgttgtcatctactccggtgtgcgattacaagggcgtcggccgggttctcgagaatcctgtcgtcgcctcccgttgttgtcccagcgccgatctccattgtcgtcgtcattatggcggcgtcctcgacctgtatcgcccggcacccgccattcgcgatcgtcgtgatcgtggtagttgtggcggttatcacggtctcggtcttcacttgagcggcctcctcgttcttcgttatcgtgacgtcgtgaagagacgcgatgtcaggaacggttcccgttgtctcgtgtgcgtcgtgcctctcggcggccattcaggtgatcgcggagatcgccggtgccgcgaggtggaggggtggctcgatgaggcgattcccgctgttcagggttttcgccattagcaccaccagttggtggctgttccgggtgcgctgtagcgacggcctcttcaaacgcgttactgaggttggttactgattcctgtagccgttctgtccaccgtgcgagatcgtcgttcagaacgggatcgtagggggcctccctcagtattgcgttgatggccctgatatgctgggccagtgtagtcacttgattttctacttccgcattagcgcgcgctgacgtgctagtcctgtcgatagccaatacctcgcgtggcgtacttgttgatgatgagccatagtcttcgagcaagtgtagaactgacggcttgtgaggatcgatgtcgattaccccaacgaatcgatccgagatcagtgtcgctccttgttccttgtccgcatccctaggagagatacatgactgctggaccttaggaggcgccgtcttcatggcgctgagaaagaccttgcagcttgagaggtcgtgattctttgtcttgtggataggacaatagatatcacgggttggagaagtacgctgaattccacgctctttgcaggcacgaatttcggcatgtacgttgagaaaaacccagcaggcttgcaaggtgtgttttctggttttgtggatagggcaccaggaccttatcacctcggaagttatcctcgtcggctcgtgattcttgttgaagagacaaggtttggccgcattaggatccttctcgggctcggatgtcgtcgacgttccgttctccgcttcggcgggaggatccttcgacatgaagtcgtcctgggttgtagccactgtgttctcgcttccagtcactgatggaccagccgagatcggcaccgtggtgtaaatcgggaagacgatttcgccgacttgagtacacaccagcattgttgaagcaggaactccttggtcgaggttggtgttgacgctgttgtcgacgaagctagatgaaatagtagtagaaccttgagcaccaaggccccctacatggcgcgccactgtcgatgggggataccggatatagtgggtactgtggtacgctggtacgaggatctacgtaatacgacatcaagcagacaaaaagcacagattatactggttcaggccccttgatacgtaatagccctaatccagttgatatgggattatatgatggaaatcacaggttacaaagggaacaatggaactcaatgataccggcgagatcgtaatcgagctggttcgactaaatctcccgacgacttggctcctgtagattccgacttcgtaggctgtggtggatgtgttggctatgagattcgatgccttaggtcctcccagggggtcccttttatatcgcaggtcaggcggtttccaagtagaactcggagacatcggaccttgcacgatacagtgacgacccagtcctgtccgagtaggactccttccatctgtgaactccatgatgaatttccttaatgtatgcagagaacgtctgtatacgcgcaggtataccatatcgatatgtgacgtatatcgaagggtaaagggtataccttacccgtaaccctgacatagatagcatgtaagtatgggaaatgggcgatatggtcattttggaaaaaatctaacgatcaactcacggtcaactaatggaatagagatagaggagatcaaaatgaaaactcaatggcatgtaggaatgggacaaaatttaggggtatagaagaaattgtgaaacttttaaggggtatgttgggaattttctcttacttgaaagggatgtccacaaaaatacacaacatacatattcaaattcaactcatgcaagtagaaaaaaaatttaactttaaaaataacatgtaatttggagtcaaatctatttttttattattttagttatactagttttgttcctatccagcaaaaagtaccgcctagtactagtacctacaacctataggtgccaaaacaaatccgactgttcaattcattgggggtatgatgggaatcgaagttagggtggttgcctcgacgcctttgcccttcctagcgtgcgctgcctcgccctttcgcccttcccaacccgcgccgccgtcacttctctgcttccattccccgtgcgcccttctccccttccatcccctttcgcattcccagcgcacgccacccatccctttgcgccgcttctccccttccatcccctcgtagcgccgcggcagcagggtgcaaaatggtggcgcggcagcgagggaaagagagatgacgagcaagaaaagaagaataggggaacggcggtggaggataaacatagcagcggcgagttcgatccaatcctattctaggatttttttttttggcccacctcaacccctcacccatccattcagcctcatccatccctactaagcgaaattactatcttaccttttcacctctcttcaccgtacggtactagataagggacaaaagtggtacctcgcggtactgtacactggcagccgttggatttggtccgatcaatgatcagtatttggtcccgtctctcagtgctgaacggtaaaaaaaaactctaattatataggtcgtacttaaaacttatatatttgtataataatatattacatattaatctattttatcaatcgtttaaaaattttgtgatgacttttatactacatggacaaacgataggatgtccctcaagtgaaaaaaaaatccatcagctacagtagttatagtaacaaagaagaggataaaagcatgctaccactatacagctagggatgaaaacggagcggatagtttccatccgctccggacaaaaacggatacggatacttttcggatcggataattctcggatagttcggaagacatggtatgtggtgggtcatgctgagatttagtcaactactattaggtatgtggtatccataaccctgacagtagcccccgacttcaatgcaaatgaacaaattcatattctcaaccgcagaccctagagtaactgttgtcgtgctcacgtgactgttcttgatgagttcagagataatgttagacttcctttatcagcctcgtgcgggcacctaaagggtttgtctgagtcaatctccaacgtcaaccaagaaagtacagaatatacgactaagtctcttgtcttgctgtaatcgagaatttggattgaaatcaagaaattttatctcggcgggtacaccctctcttcattccgtattccttgtcgagatccaccaatcgttctcgagtgatcgagaaggcgcagagtctgcgatggagccttgtcaacatttgtcgtactcgccttagtcgatcttggtataaaaccatagagacatggagacttcaacaatgtcgaatagaattttcctgaaattaatactcagaaaagaatattagatagaaatagcccccgagcgaatgctcaaagggtgacatgttataatatgtatggaaaactgaaaatgaattaaatttacagaccaatgttttgtatgtgagcgtcttctctcttaccgacttcgatcagtcagtttgttaagtcatacactctgcctagcccccagccttatcgtcagagaatcgttctcgaaggagaaggcttttggacccttgacctgccttggttgaacaagcactgatcctagcccccagccatgaagttggaaaactcaatttccgattacacggcttggttaatacgcacggcgagaactcttacacgaccagatcttacatggtcttttgtctctacaggctctgacaaggccttatcggctctgggcgtccccagccgaagttcccttaggttactcgaaggccttgtcaagacggcgtaaaggaacagtaggataggttttaacgctaggtgtcgtcgtggtaagggatctctgggtaaaacacttggcgatattatgtacctgatatcagttttgttggagtagaggtagtgggagaatcgctacacctctggtcgaggaccaggtagtagtcgtaacttgaccacttaaagtggaaatagtgggagaatcgctacaccgttggtcgagaaccaggtagtagttgtaactcgaccattagatgtagatgtacgagagatcgctacgattaattggttgagaaccagtgaataggtgtctctcgatcatttcgactcgtggtacgaggaccactatgctgtcggtcgaagatcagtcgtagctgttcctcaaccatctgaagttaaggtgcgagagattgctacgttttactagttcgagaaccagcgagcgagtagaattatctctcgaacaccaatagaagtttgtggtgcgagagattgctacgtactagttcgagaaccagcaagcgagtagaattatctctcgaacaccaatggaagtttgtggtgcgagagattgctacatactggttcgagaaccagcgagcgagtagaattatctctcgaataccaatggaagttacggtgggagggattgctacgactggttcgagaaccagcgaacgagtagaattatctctcgaacaccaatggaagtttgcggtgcgagagattgctacgtactggttcgagaaccagcgagcgagtagaattatctttcgaacaccaatggaagtttgcggtgcgagagattgctacgtactggttcgagaaccagtgagcgattagaattatctctcgtacaccaatggaagtttgcggtgagagagattgctacgtactagttcgagaaccagcgagcgagtagaattatctctcgaacaccaatggaagttgcggtgcgagagattactacgtactggttcgggaaccagtgtctcgcccagaaatttaacccaaatttccagactattttgtgtattaaatccctatccaggaccagccagggtacacaaaacgacaaataataaacagttccaaacataaataaagcgtaaaatacttatagaagaggcacttagtcctcacaccaaaagaaaacagcagcagcggaaaaaggcgatcctagcggggcttcagctccactccataggcaaaactcaactgggttctaagccttggtcttctaactttgtcttcagctcagaagtactacacttctgaaaagggggaataatagcaaggctgactacaaccaccgtactcagcaagccacaccaatgatgcaaacgtgcaaggggatacaagaatggcttgtggctatttgcgtaaaggcagttgtaaaacatttcattgagcaaaatagtaaaacagttgagtaattaaggtaatattaaatctccacatatcaacgctacaccacgttgaacaggcccaaccaacccacttgaactacagtgcattgggtcgatttattaagtgtgagactaatcacggtgaatctggtcgatcgcccataaccgcaggcacggctattcgaatagttttactctggctagaggtgcacaactgtacccacaagacacaatccaccggcatgtcaccatgtcatcatgtgcccatgatgaacatgtcaccacgtcgagtgattgtgacaagacccttcatataaccctcccctaaccatccacaccacgctaaggtttcacccccactcctcgcaaggcagcgggcagtcccctcgtgcgccgtggtgaatccggcagctggacaaccggtctccccggccgacccaactccatcacgcccacccttgccaccggtgcctaggaaagggtcgagctatacttcagattaagcagttacccgctcccgcttgtgttaagcactgtaagtcttccagggtttcccgtgaaccggtccttaattgccatggatgcgaccagcaaaaccatgcacccacagcccaccattcagtcgcattttagttggataattacgaccaatgcaacatggtcaggtgtctcgagcacacagctcgttctgatactaaaaaggtctaatactgcaattatcccatcaactgagctagtggtaattaagcatgactaagcatatagttctagctatgtcacataagtaacatgagctagtcgatctattacccacggttgacaaaggatatatatcaagtaaacatggcacaagcgagcagataggtaatacccagatcccatgtaataagcaaaacaattcatatttatttgcaaacggtaaaacatttgtaaagtaggatcaaaatgctcaaggggaatgtatgacttgccttgcttcttcaagcaatcttccgaactcttatcctcgcgaccgcgaacttccgaaacagcgaattctacacgctggcacgtaaaatgaggaaaagctctcataaacaacaaggaaacagtacataaaaagtaaacaaacatgtagatctcaattttagatgaattttgcaagttgaatggcctaatttggagttcgaatgaattagatatgaattttagaagttttgagccattttaatggatttctggaattattaattatttatcgtgcaattattaaatattttctcaaaggaaaagaccatcgctaacgtcagaaaggagcggccggcgccgacacgtggaccccgcacgtcagcgggcaatggggacgggtgcatggttgactcggtccaccgcggccggggcagcaccgtggacccggaccacgggagtggtccacgggaccgacggcctaggcagcatggctagggcacggcacggctcaaagccggccagccgaacgacggcgatgggcagcgcgcggccactggcggtgtggaatggtggcaagcggccgagaggcggcgggaagggggacaggaaaggaagggggacgggggaggagggatcctcaccggaagcagcagccggcacggaggaagacgatgacggcgacgattcggtggcttccgacgaaggaggaggggaggccgaggggcggctacacctggggaagctattggagggattagggaaaagggagaaggcgtgagcatggccggccgaagaggaaaaagaaagaagggactcaccggcgacggaaaacatgttttggtggggttccggcgatgaaaaaaagcaaccgaggtgctcctcggcgttgcgaagcgagtggcgcaggcggcgcggtgcggcgacggctgaggcgatggaggtgcgcggctggaggcgacaggcggtggtggagctcgggatgtgaggtggaaaggtggttgcggtggggtttgggggcggaggagtggatgccggggtggagctcggtacggcgatgccgatagtggtagtggcacagcacgggcgcagctagagtggcggcggtaggtggctgaacgacgccgacgagcagcggaggttggtggcgcggtggggcggctttccggtggctattggggaaaatggagcggctgcagggttgcggcagagagcggcgaacgcggtagcgcaagcggcgtggcgcggggacgtcaggagcggcagcagcggccgaccgaagagctcccgcgagcggcggcgcacggcctcaaggggaggagggggttccgggcatgggggagcttgggagagagggggaaacggaggaggggagcccggggatcttttttatgggcgcgggggagggagatcatggctgagaggggtggaatcaggcggcaaccgaccggcgacgtgggcgacatcgtgggtgaagtggagctcaaattggcgccaaaaattggggaaaagtgggggaaaatgtgtaggagatggtggggagccgatttcatgtggtttgggtgcgagggcgcgggcgggagaacccggaatcggcggcgacgtgggcggcaacggccgtccatggcagcttctgctctagagactgcaggtagaggaagggcctgacaggtggggttgccgggcccacctgtcgggaacggagaaagggaggagaacccagggggttatttagactttgcgcgaggggaaggaagatgggtcgatggcccaaggaggaaggaaggaagaggggagggaacgggtcgtggggagggaaggagggctttgggccggaagtggcccaaagtgaaggaggggagatttaacttggtttttctatttattttaattgattaaatgaactttgtgacttttaaaattatttctcgagctccgaaaattctcgggaaatttttagaaaatatttagggcacaaagaatattacaaaatattcctggccgatgattttcaagggaaaattttaatcctcccattatttcacttgatgaatttgttttaacttttatttaatttctagaaaatgcattattaaacgatttttaatcccgaacgaaaatcggggcgttacaactagcgagcgagtagaattatctctcgaacaccactggaagtttgcggtgcgagagattgctacgtactggttcgagaaccagcgagcaagtagaattatctctcgaacaccaatggaagtttgcggtgcgagagattgctacgtactggttcgagaacctgcgagcgagtaggattatctctcgaacaccaatggaagtttgcggtgtgagagattgttacgtactggttcaagaaccagcgagcgagtagaattatctctcgaacaccaatggagacgctagagttggtttattacatgtgcatctcatgtggccagcatgactcacatacccaacttatagcatatccggatatctgttcgcaatcatgtcgggcaatcaagccgacgacattcgcgaggaattatccgttaacaaccttttctcgactattccagccatggccggtgctatgagataggtcgttggtcttcgttggcaggttgggtgcgataactccgcatttgtcgagaatgttctcgataatggagtgtactcgatgacaacctactcatgtgctcaattgttcctgaaaaatattttctagaaggcaagacatatagcagagaatatcgagtatgtactcgaataactgtatggatcttctagcattatcaggatataacgagcagattaaatatcaagcattatataaaccgtgaacaagcatgatttatacagaagaaaataaagcgagcccccagtattagaccgcggtggtctaatattgaagacgctcgtataacagagattgtataaaaaacatgctctaggtaaacataataaattatagatctgacaatattatattatctgaaaaataagtacagtacattgcatataaaatattgcgtacctgtgtagatatctacgaaattagtagattaattcaaaaaactaatccactaattacccttttctttttacagtctgagcatcaagatcaacaagtagacaagaagccacgtgcatgtaactccttcacgtgccctggtcacgtatacgagtgtatatcctggtttttaccaacaagtgccgtgtacagacatctgttggctaccagtccgactcggtgactcatggacaggatctggacgcacacgcacagtgatatgcatgataatcgatcgatgtcgacttctgtcttccgcgtgctgatgtcctcctgatctctggcagctacatgcaagatggcgggtggctggcgcgccgtcctcctgctgtatatgtctgcatctctcgaaaaccaacgtagggccgaccagtcagggcgtcgcgaggagcactttcccttgtagtcgacgagaagatggttcggagatctcgtcgagtaatatgttgtcggagaatccatctcttgaacccatctcgtcgaaatcctgaagcaccaaaacccccctacctggcgcgccactgtcgacgtttgatgtcgcgattccggtatttgcatagtatggggattgttggtactaggatatatgcgagactgaggtaaaatagatggagacaggatttttatataggttcgagcccttgaattgtcaggtaataaccctacatcctgttggccggagccggtcgttgctctttattcaccataatcataccagtacaatatttggggtagcctatctaactgttgtcgacatggcggtctgaagctctgactcgaagtcgacaacagagtagtcttcctcctcgaatccgtgcccggcaagatcagagatagcgctttcatctctcctgacagtatccggagacaccgtaggagactagctgtgcttatccctgaagtcgatatctggcatcttgtcttggcgtatgttgacttgtatattgatcttgtggtttgatctattgttccgtgtatgttgattgtggtggtcgtgtcccctcttctcctagagggccttgtatttatacccataggtgtcccatttccaagtagaactagggaaaccaaaatggatacaatccgagtagtccttgtcgtttccatgtagaactctggttgtctttccttatccaaaactgcctccatatctgaagtcagtttccgtataagacatggtgtgtggtgggtcctgccgagatttagtcaactactattaggtatatggtatccataaccctgacatcttggtaatcctgttagagacttagaccagagaaaaaaagaggaatctggaggtcaccgtcggaaaacgctgcgaacaacaggggcggcagatggggtgggagctgcctagatctgcgccgacggcaacggccgaagaagaagaggagaaaacgacggttagggagagagccatcctccattcgcgtgatggtgacggccaggtagggagccgcctcaatagggctgctacggtggccgaagaaggagagaatacgatggcagctaggaagggagtcaccttgatctgggccacgcgatggtcgacgaaggagaggaggcgatggagtcgcctcaatttgcgccgcctggatcccgccgtgatggtcgggaaggagcctcgatccgctccgatctcgtcaccctcggcctatgagcttgtcgaccgatagtggtccgttttgcgggaagagcgaagggagaggcggcaccactggtggaaaaaatgaagagggagagaggcggagaagagcaccaacagtgggggattccgtgaggagagcgagcaaggatgggtaaggacaatgaaagtgagaggctcacagtagaactaccaggagtatagggtttatatgtgtttttttattgttatagggtgtgaagtataaaagttttagttatctgaaaataaaaaaattagcagaggctgacatgtaagactgtaggagctaaaataaaaaaccactttacaatagtttccattgtaggggagaattttcactatatgccactcaattcgcagcactatcagattttgccactcagttcgtcacactttcagaatataccatggaggatgcaaattgtttcattccgtaccactccgtccatccaatgtggcatccgtcaatcggtccatgcaagcgccatcgttcgtccatcgggcggggagcagcttgtcggtcctccccgcgtgcgccgccagccgctgagttccttcctgcacgcggcgtcggctgccgtcgaagtggacaaagaaggagtcggatttcccgcgctgccgacgagggcattcatctcctccggcgcgcactcgccgctccggccgcgcagcacgcacccaacggccccatccctgtgtcactagcaccctcctcgtccccatatcgcgtcgcctctgaccatggtcacgagcaagaacaacatgctcacaagcaagaacaccccatgaacgctatgaagtaatgtgtgcatgctcgctgataatgtccaggatgttgaggccatgcattggagaagcgaccgacgcggctggacgactggacctcgtcggccagcacgctgcgtgtgaggggaccccgccggccaatgccgtgcgcgaggagtaactcgtcgatggcggccgaacatcccaatgagcccatcgggagtacctcggtagctggcggttctcgatggcgaccggatgcgtacgctgggcaagacatcgactgctgatggcttacgcgaggaggagctcgccgacggcggccacccatggaggacctcggcggccggctgcgctcgacggcagccagatacgcgtgtgtacgtccttgctggccggcggagcgctgggaggacctcgtcggccgatgggacgagcgagctgctccccgcccgatggacgaacgacagcgcttgcacggaccaattgacgggtgcggcatcggatggacggagtgtcacggaataaaacaattcgcgtctctggtggtatgttctgaaggtgttacgaattaagtggcaacagctgaaagtgctgcgaataggatgacatatactgaaaattctactacgggtggtgtacgagtcgtggaatatagaatatgccagtatgtacggtaaagctccatatacgataagaaaatcggcatgaggttatggaaataattcttatgggcaagtacatagtagagtactactcgaaaaggattgagactagatataccatatcgtgcaacattcacatggatgatagaacgctttcagaagcataagaacttaacatttgccttctgcatcactacgttcagtcaaaaatttatgaacattgctgcgtatttcatggaagcttagcaagtaggtagtgattcgattttggcacaataaacaacctttttgttcctacgctaatgcaaatgcaagaacaaacagcacctttgtccgacccgtcctcctgctccaggcgccagagcacgaggcggccgtgggcgtcggcctgctcgagaagaggcaccaccatgtcgaacaacccggcggtctctacgatgtggagcacccggagcctccgggacgcgtcctcctcattggcgtcgagggagaagagcgccatggtgcccgcgcggtcctgccgctcctcaccctgctcctgcagcgtacgtgtaggtggtggcggcgaggacgtggcggaaggggtggtgcgggcagatccaccgcgtcagcattgccgcccaagtagcacgaccccaaatccatccctccaacgacccctcgccttcccgcacgacgcatctctcggtggcgatagcgccaggagggcatcgtcattgggagaagccattgttgcctgcctcggcgagaaggagaggagagacgcggggagaagcacgcgagggaagattgggagctcgctctccctcaaatccaccgagcgaagaaaacggggaagagaactccaaaacattccaccgagcaaataaaacaagaaagggaactctaaaacttttgtggatatgttggatccgaatttttcaaaaaaaaaatccctcaaatttaattttgggaagaaagtaggatcattggtgatgctcttagtgagatggcaaagaatacacttttcacatgccatacagcaagcatataggttgcttcatgtgagtgatggagggtttgaaaatgttgtgtgcgcaaagagtgactaaaataattactatcgtgatctaatggaaaaataaataaataatgcagatgctcaaatgtttgtggcccaactacgtagaaagaaggagatcaattcatctttcttccaagattttgaagtggacgaaaatggtaggttggtccgtgtgttttgggcagattccataagtagaaagaattatagtcactttggtgatattgtatccttcgattctacatacaccactgttgatgaaaaaacatacactggcctaggagatctgcttagcttcaatgcaggtccaaatcttggtgaggtgcgggtgtgccagtcagtttgatcctgcaactgacaagatatgtaaatagtagatcaaatagacgatcggctgacaagccaatgaagtaattccagccgatagcaatagggtttcgagcaatcggctataattcggatgtggagtctgacactatatgtaaataatgatataaaaacaatcggctgatgatgataaataataatatgatccagtagaaaccaatcggctaacaatgatatgatagataagcatcgatctgaaggttaaagcatatatcgactgaagtttcgatgtcataaaatccacaagattagacaaacagtaaaatctttgttgtgatcggctaaatccaatatgtatgcaatccttgtaagccgatgcaacatctagataactcatcagctgaagccccgatgaaatccttattggcaatcaagaagcaggctagagaatatggttctaaacacaacttagtagatcaaacttaactgatgcagcactaagtataaaaagaaatataatatctagacaatcaagccctggactgatttttagggtggtagatgccttagctaatctaatatagtaaaacaatttagccgataccgacaaaaaccctaaagcgaaaggcaaccgatagagctaaattgagatactaagacaagattaactaagacacatgataaataggaaggcaaatatattaatcaaactggagcaatccaagaggtcaaatgtactgatgcagccttgagcaacaccgacgtagacgatacaattgcccgagccggcgaaacattggacttaccccttcgccggagatcggaaagcgatgcagccccgcgtcaggtgccaaatcccgctggacgatgaaataaagtagaaaaggtaaaaggtggcgatgcactgaaatgtattgatcatggagatagattacaacgaccccgggtgtacatatttatacccatgggtagatactatttcttataggacaagaaagaaactttcctaaagataaaaagaaaacataaagtccttatgggacactaaacacactttcctaaaggtaaaaggaaactaacaaatactggctaattaatagataaactgccatgccgcatactccttgaacacggtcacttctagataagcttcctttaacagattaatttccttaacggaatatagcaggaatccgactattggagacgtgataattttcttaggggcttaccaaatttcattgttaacaaccactaaccaatacgacataatttttgctccatttattggagttaatcgtcatatgcaaagtgtgttctatggtgttacgtaatgagaagatcgagtcttacatttggttgtttaagacctttctaagagcaatgggagagaaatcacctagacttatcctaaacaataaagatgctagcatgaaaactgctactattcaagtcattcggaacacggttcataggttgtgcatgtgacatatcatggaaaagatgccgaacaagattggatcgcggtggagagagaattgtaatttaagagaaagtatgagtcatgtatttagcaatcagaaacacctgaggagtttgaatcacaatggcattctgtaattttcaaattcaacttggaggacaatgagtagttgtcaaataggtgcgatattcgtgtatcatggatactggcctacttcatggacatatctctggcaggtattcttagaaccacttcaagatcaaaaagcaaatttattttttaaccgtttcattcatcgtaagcttgttttcgttgagttttggcttagatttgtcacatcattggaatgccaacgtcatgaagacttaaaggcagacaacacaagcattcatacaacatacaaatctgtaacaccttgctagaagagtttttacacatgaggtttttgagaaagtccaagaagagtttgtagcaactagagacctttgttgtgttaaagacatgacacaaaatgatcgaataaaaattgtgaccttcagcgaggtgaaaatcatattattcaagtcatgagaggtgaaaatcaaaatgagctaccaaatgcatacattgtgaagagatgagagaaaagagtgaaaaggtaaatataagcataatattcaatgttctattttttaaaacaattccaattgtttgaccaccatgttattatagagggagtgtttatgatgaccaaggtaaccttctataagaaaaaactattgactccatagatatggcaatgagagtcagctgcacacgcaacaagtttgaagatctcattcaaaaggccaagcactcagtagaaggcattgactacttaacaacaagtgtgttcgaccttgaggcacctttggaccaaatggtcgctggtggcaaacaaactagttagcaagagtttgagtcttttctaggttgtaacatccaccaactgattgatattcatccaccaactgattactgatattcattaaggggaacaagtaagagaataagaagaagcaaggaaaataataatcagagaggtactacaagtaagaagcaaggtgacaaggaactaacaccatgcgtgtgcaagattttcaagaaaatggtgttttatgatagccacaactgtccaagtaaatcagaactaggtattgatactattaacttctctctatttttttctctaagagaatgacatgacttgcaaaattatttgggtaataatcttttcaggggtaacagaaaaagcacaatgagagatggttgcagcgggatatggaaactactgaaaaagaatgtagacgctaccagtagcactttagttgattagcgctaatgtgcttgccttgtttttattcctgacgtgctccagcctgtagaacatgtatgttattggtgatagttagtgctgattctattttagtgctgccttgggagagctagatgtgactcaactcatgtttaatgagcttgtatgcatgtaggggtatactagcacaatgtgacctctcaatagccaaaacattaacaatttgtatccaatgactctaaacctccaacgtcaattaaacagaaaccggaatgagcacatgtatctcatacttttattcgattagaatatgttcaaactttattgctatataaattaaaagtgtgttttatgtatacactgttgttctctctatatgtgatttttattatatttgtatattaatttgtttcttattcaggagctcaaggtttatcgtgaagtaccatactctttggcgcaccagaacgagacaattaatgagctgaacctagtggtcttgtccgagatcaatgccactgcttgtctatgctaagatgtcctacacaagctcttaatagtttggaggttgcaatctcgatagcccagaagaatgtcaagcttcctgggggagactcttacctatgccacagttctttaacaaatacccagctcagccaaacgagagagatcaaatttttaccatggattctaagttatgtgaataaatgtactaggtcagaattgttctcgtcggaagtagaacagctcactaccaggaccagcttacactcaccacttgcactcctagtggccttaacccctccttccttctgctaatcggcaattgcaatatgcatttccacaagtattcattctggcagttcagttatggccaaaaatctaagaatcccaagtttttattgtacaaatacgctcgtatgaatcataaggtgaatgaaactgaagtgcgtgatgactaaacaacaaactactgaagttgcagaccaactagtgcatgacatacacaattttaaagaacttcatgaacaaaaaagcctgacacgatgcgttgagacttatttgtttacgataaatcttcgtcatcaaaatgaggctcatacttgtccaacagaataaaaaaattaactagggtcagtagctatgattacaaccatgacttatctaaccagcactaactggttccaggcataagagcaactacttaacttcagcgacatagtgctaaacaaaaggagactacagggacacaagcaacaccaacagactaaaaagtaaagactattaggtagcaacatcattctctaaaagagtcaactaaatacctaattcaaatgcaccatatgatgatctaataaagaataaaagtgaaagaaattgttacatagtatacatatagtttatttaattgataaacaacagaatattggttttcctaacaatgatctaactataatgacgaccaccaagaaatgaaattgtaagtgaagaagcaaaacaattgttagtgttgttgaaacgacaatagcttcacgtcgaaggacgtgattctctcagtgggatgattgaacagtagaaacaatgttttaattgatgaatttttttggatctccccattacatggccctagggggctatttatagtcttagtataggctcattccttctaaggtttagtatgtaaaggggaatttacatggatacccttatgatatagacattagtgagggcatgcagtgtccattctagctatgggccctcaggtgggctccttgggccagcccacaggtggcgaacggccttcctaggtcgcaacgctccttaagccctttgtcaaaggtatcttaccttcgggcaaactccttctgcttcgtctcgtggctttgcccgaagtggagacatggcgacggggtcgcggacttggtggcgaatcctatggccttcgtcctttggcttcatccccactggttcgccttatggcttcgcctccaggcgaaaacctctaacttagtcgtcgtcttgtagatccgatggtttcggcaggtccagtcgaaggccctcgtgacatgcctccaacagtttgtaactataaatgaccacaaaattgaatttcttaccaatcatgaaaaactagctaataaacaatgtcacaactatcatgaatgatgcatctaacatgtacctatgttctggcttgcaccagctagaagattcaatcctcgaacttgtatacacaggagttgcatgaaaatatgggaattatgggcctgttcagattatagccaaaataaaccttaccaagttttggcaatgccaaaattttggcaagacggcaatattgccaaaattttggcaagatttcttatgtattgaccaaatttggcaacaaactaaacgtagacatttttttggtaactttgccaaaaaaatggtatggttgaaaatcgcatcaaagtgaacagcccctataatacaaaaatgtcaaaataggtgtaaaacatgacaaaaaaaagagtgacttttcatactgctaaaagcaccagagcaggaataatattattaaaaactcaatttcgaacaaaacgccaccaagtcgactccagtcagtatttgttcagtcaatctatgcaagaaaatgaccagtcccatacatttcggttggtaaagcaacaaaccaatggtcaatacataaattcgttctagaatgcaagctatcagttctgatatgattgaaggagcaacctgaacttgccatatatatgtctaaaattcaatactaaagccactggaattgaaaccatttgatgcactgatgagggagttaggtcccgatcttccaacaggtattaataaatagtcaatttgggcgaagttgcgacacaactcgatccagtttccgaacgaacacgctactgagccccgcaattgcagcaccacatgtcctctggttatcaaccgtgccgaaacccggttgacctcgccgagaaggctaatccctgcatgcgaatcgaagaatacaagcaagaacaagatagattgcaacacaattgcatatgaatgattaagcgctcgaatttggggttctacaaaccaatctagcggcgaactgttcttgacagattaatctaagcaaaacccaactttaaacgataacggctactgaataaatatgattagggatgtcctagggtttccctagggcgcacacccccttaggctaagcccacaacacaatttaaagccccaaaacccaaattagattcggactggatgagatacatggcttgttttgcagatttccggcagcttggcaggaattttgatgtgggaccaaaaccatctaaaagtagactccataagcttttcaacaagtactcatgggcccctaaattccttctagatcagcagctaggtctgtttgaagttgatgctatcaggaggccaaatccgaatccaaaacgcgcacaactttatctcttgtcttctatggaccaaaagtggtgtggtgatatgaaagaagacatggaggtcttggtttggtccccaaacaacttcttcaatcatccatgtatttcgtacgctcggtctcttttctttcacccaagcaagtacctctgcaaacgaaaaaacacaaaactcattatgtagcaacgtttgtttaaatatataacaagtaaatctaatgtagaacatatgcacctttggttgattaataaataagatagtcatggttatatccgagctagttgtgtccttatcatgcacatgcacttcaggaacaaataaatgaaaaaactaatagtatactcaacagttctaatcccagtgggcaaatatatgaaaatagaacaaaggaatttaacatagcagaatctaaaagcagggtcagtcacatatgaataataacagacatgaaattcaaagaggcatttttcatcatcattatgggactaagcagggcaaaagaataaaggaacaaccgacacacaaggacatcacacggcatccttaaaatagacagctctagaacatgacattaacatagaacattcaccagagaataaatctgcacatatttaacaatgagagagttactacccaaacggaattcattcatagcatataacatgtgtcccacatagcctccacattgtaccacattaacagataaggattagtagatagtcattaaaatggagatataacgaatagagacaaacataggtggtgtaactgcaagatagtaggtcacagagaggtataagataagctagaaacatagtttgctgatggacacagtaactgacagctaatacatattgatcgatcgatagataaatagatagataggggctaggctaggtgaatcatccatccacctaaggtcagtcagtcttgtccaccatgagacttgaggctgtgatcgtagcgaacccatacagttggggccattgaagtcatcccagtctgcagtctcgatgccgctccagtcgatcttggcccaaacttccttgaactgagcctcaagctccgcctgaatagtgaagtaggtctcgtcaaccatgtaactcaacttcgcggcggacctcatcctgtaattcctcgaggctgtcgtccgactcccggtcctcaggatgtaatcaaggtacccctctcaccgactccatatccatctgctgcttcggcggtcgtcttctctccttcgtcgaaagttgacgctcccatcggcaccacagagacgtccgaggcggccgcaatactgcttctcacacacttcttgatgattatcaagtgggacgctagctgctgacgttcaacgtcgtcatctccacctgtttcttgctccctcacttctatccctcctatagatttatatataggctgccactgtgttcagatagggatcgctgatcggagtcggagtcggcttcgactctgactcgagattcgggacaggatgcacggaaatcttttttaactctagaacacaaagaacacaaagacgtatttgtccttctaagttgactctagagtacaaatatgtatttacccttctaagttgttagacatacaagtgcatcaattggttataatatggcaattatttgaagttggttgatatgcacatgtatatatagctaaaagaatttgtttgaggaacatatatgtgtgatgatggtggttaaaaatcatgcgactgactaagaattcataccttcaatagctagattaatattgaaatgctatgcatacatgtacatgtcaatcaacttcaaataactgccatattacaaccaattggtacaattacatatctaacaagttagaagggcaaatacggtctttatactctagagttaacagtcaatgcatggccaacatacgggagtggcatgagagtttacgcgaatttgagctagtggcatataagtaattctctctgcataaatatgtgaacatggaaaatgcaataatacaataacaaatgattaaaactagataaaattaacacatttaacaggattaggcgtttggatgacgcacagaaaatgcccctgctgcttcacatcacacgcttctttctcttctctgctcagacatgaccattgtgaaggcaatggaataaaaccaggagaggtacagataacactatggatttttgtccggatgaatggaataatgcaacagaatgaaaggagattgaatagcacaagcaacaactgcgaacattttactttcacccgactgctcgcacgaaggccgcctggaagaaatgcagggatccaccatcaaggaaagcactggactcagcaccaggcgtctgtccacacaaaatcatagcaggcacataaaaaatagcaccattaacttttcagcacaaagaaagaaagtataccttatatgttagagcaatttacggtccttgagcaggtaacaataatttagtgtaaatttggtaccttatagtaactcatactacctaagtactaagaagtactaaatttacagtaaaacaagtgataccttatggtaccttcttaaggaccgtaaaattgctctatatggtatgtttgttggcttcaaccattttaggccattcacaatgcgtcacacaaatctgaggagcctcgaatggcacataggctagagcataggctagagctacaggtccaacatttgggttctatagtgcaagtgactttagtttgtatttcagcccctaacactttttgtttcagttctctttttttaatttatatgtaggtccaaaatttacaattaacaccctcaaatctagaaaaattatttaaaccccctctcccctctctctcccttatcttttaccccttatattgttccttcctcatctagctcgttgtagcgcacctcccctccatctccagctgccttgcgcctctccctcctcctcgggcacctccctccccccccttccgg

SEQ ID NO: 46137 - DNA, 38089 bp, Oryza sativa
agtcggcgacggcttgatgctggccactccgtgcccctcgtcgccagatccggcataagggtcgccggatctggccttaggcggcagcgggacgacggcaaggacggtggcagtcgatgacggcggggcggcgacggtcgacgatgatggcggggacggcgacaagaggaccgttgcttcgcgttttaggacatggtctctccaacgcggtgccgcccctctcctcgcgtgtcacggggcttcctcctggcaagttctgacgaggctcggttggccaaatgatgctctgcgtacttcgcagggactcgctccacgtcgagttggctcggaatctccgcgctggcgaggtgaggccgaacaccacctcaccgcattgtgaatggccttggagagaccgtagtttttggtgcacctttgatgtagcaatagcttagcttgttgattttgaaagcttttgtctcagtggatgcatgacacccaatttcagagaaaatagttaaaactagctcattctgtcaattctacgtgcaatacactatgaagttcaaatagaacgaactgaagtatgcgtctattttgtttttaactatatttggtttctcttaaagttcaagaaaattcagatcaaaaggagagaaacaagtaggttttgctagcaaactctgaactgaagcagtttagtgcttgcttaaatagctaaaatcatgcatgacgcatagttaaatctggaccatatctttttgctgatggttggatgtttcgatactgccaaaattacagtcactgcacctgatccgaatcctcgagaatgttaattgatttttctagacgagtttgcagatagaccataactattcccgtgcatagtttaaggaccgcatacgaagacgagcctcttaacaagtctgcactattttctcatgcggacctcctaagagacccacatgcgaaaatacccctctcttcactcttttttctctcctttcctctccctctcccgttcactccccacactccctctccctccccactcctcaccctccctctccaactctcccactcctctccacactctctcccatccacactccctcacgacgacgatgctcttgggctaaggcggcagcagtaggcttgggcaacggcaggcgagggcgagagggatcccagcgacggcgacgacggaaggggtggatccagtcaccgctcccccccccccacgcatgtggatccaccggcggtggagatgggattggcggatccgatggtggcagcaacgggaggacaatgacaacggtgctgccaccggcagtgatgacgagaggatgaagatgatgacgacggtgacgagaggattcttgggttagggttagggtttcagagtaggttttcaatttttggaattttctattgcattttttcttttcgctccggaggagttaagtgtccgcatgtgaacaaaaatcgatttttgcatgcgggtgacatgtgatttctctatcgcatgcaaaatatgtttttcgtagacaactggatgcaggcgggtcaccggaaaaaatcgaatatatagtagtgactttccccatataatcatttatttcagcagcaagcagtttttgttgctgtcatgactcatgaaccttttttttttgccaaacactactatagaaaccttaattggtgcggttaggaaccccacaaaggtggcagatttgccaaccgacatatagcaggcggcactaatgtggaggggaaatagatgcttgtttaggaaccgacacatttgaggttctacgaataaaataaaacactagctcgccatcacccctgaaatcatccccaccacccagagtccacaaagaagaccaagttcatccacaaaaatccagtagaaacaaaatagcattaacatttgcatgctcatccgcaagttaacacatcgtatacaaccaatatcgacattcagacacaatcagcattggcacatgcacaagaaaattcccaatgcccaaactcaccgcaaactgggaacttcgctgttgcccgcaccatccgccgtcggaggccatggtgggcagatctggccacacccgagcttgggcaactgcatctgacagccgccgctcgtgagggagagggcactgctgccgtcggcgctcggggtggggaggagagggaggaaagggtcgcgagagagagagagagataagagagtcgcgcaagactgagaggaggaagagagtcgtgcaagagagagggagtggcatgtgctgcttaccctatccacaagtgcgacgttgtcgtgagtgttaaggacaacgcggtcggctcgtctctgatttttatacaggtgtcggttttttaattaaacgagattttagatgttccgtcacatgtagtgcccgctctctatgtatcttctgcagtggtgtcaatcaaatcaccaatttgaacggcacactagtaccagaacacattttaaccatggaaaaccacaaagagaaaatcattctgacgggcaagcatattagagagacaacaaccgatgatggtaaaacaatacgcagatagagtcattcagttctttatattaaggaacataaacgctacttaaacatactcccatccagactgcagtcaacagatacgcataacgacatactattacatacctaactagtaatacctatgctacgcaacatttcacaccccaaaggcttaaatataactcaaacggcagggttttttcttgccaaaggaagtagtaaatttagtcaggcggttaatcccacattacgtatatgacaatcaagatatattagcaaaatatatgaatgtgatatcaatatgtaacatctttttcatgttgggcttagcatagtttgttataaccaggggattaaatcaaaagaggaaaagaattagaacttgtaaaagccaaatgcactggtagaggaacaaaacttagtgattctgcgtagtaaaataaaaataataatgaagccatggttcttatcaacataatcacaattaaataatatttaaatataccatgtataatatattcaaagcttgctaaccaagaatatctaagacctcgacttctccttgaatagaacttgacaacctcgaatcggacaccacgaatatctcccacagcatggcccttatgcccaaatccagaaatcaacacctcatcccagataatgagcatgaagaaataagtataggtgacagagcaagcattttctaataaagtaacaggattaagaatgtacattttcaattcctcaatgatgttcaggaaactgtgctagcatgcatggccagaagtcatcaaaattcaggattaaaatagtaactggtctcaataattagaaatggactcgtttatcatggaatcagttgggcgtactgaattacaattatgatggtaacatgcttagctaccctgggcaacttgctaggtgaatcactacctgataaccatatgtcttctgaatggtagcaatcttttgaacaaagccaaatatattaaacaaattctgtaggtgcgagaacagcataaattatctactactgtaaataatctatattacgtacagtgtaatcatctattaatttgccgatgattcatgatccagttactccaccaagaaaaacgtttaatcaaacaaaaatatattggttcttatgattcatgtttcagttaatccaccaagaaaaatgccgcattgaaagaattgatgaatatagtcaggaattattctctaggtaaggagcatcaatgttgttgtcactggaaaatgcttaaactgatcgcacaggaatgggctgaaggagaaagtaccttgatttccttgaacatggcctttgtagcatatgataaactcgtcagttatccggatgaatggaataatgcaacagaatgaaaggagattgaatagcgcaagcagcaactgcgacgaacattttactttcacctgactactcgcacgaaggctgcctggaagaaatgcagggagcttcctcaattgatccaccatcaaggaaaagcactagaaaaatcattgcaggcacataaaaagtagcaccattaacttttcagcacaaaattatatagcctcgatatctcaatttttacagctcatccatagcagaaattttgtttatgctaatcttattatctaaagctggcggttatcgccgcaagctaattggttcattttaccccatttaattttacgccacgtgtccatgaagcattcggcaaaccatcgagtgtctcgtgcatgtattgctgtcttcgtgcggcagaaaacaaaaataacagcagcttctggatgtcgtctcacctcacgtccctgctatttgggatatactcctacaaaagaattcgtataacatattacctacattataattagtaatttggctctatattttatatatggagtgcatatatagtattaagctatctatctaaaatactgtgtctagcatatatgtctaccaattaatagacgtacgtatcctctctcctctcactcacctccacatcaaaaaatatactatgtggcattctctcctacacggtgatcctaccattattcatgcccttagtgctaagtgtgattggttaaaactggaaacatgtaacttaaccatgttaatatcctatattatagaaaagattaaacaatattttaacaaaaggtaaaacaatcgatagcaagaaataaaaaatattttattttaattttgctaattctaacagcttatatacaaaattttaaaattacaaacgtgagactaaattcaccgttttgtttgcgtatactgtcacgctataattctccgtaggaattatacaaacataaaaccaagtacatattgaatgatattttttcaatatatgatatttacatagattttattagtattaaagtaattactctaaaaggtatacatgtgccctaggggaaaaaatcacaggataaattatccagcgcgctaataggcgcgccgattttctagtataatgaaaaatatggacatgctttgttgttcaaagggcataaaagatttttactgccaaactatgaaaaggtttctattatgaactttatttaaatttgaagcatctaaactctatatatgtatacaggcagaaaaatgcactcaaattattcttgatcagaaagcatcacgtgagcaatagctctgctaaatatgccatcttactcgtaaacaactgaactgggggaggagcggcagcaccagccaagtggcgacggcaacaggtggtgacggcagggcagtgcgtagggaccttcagtaacctgtggcaaccaccacagatctcgtgcgtttgcagaggggatcgtgcatggaggaagttgatgatggcggcaggggcactgatttttactgaaaatttatgtctcttttaacaatttttgctgatcatctctcttgtgtataccagatctgctgcctagacagttagttattcatcttggtgcatctggccggatccttatattggtttaattaaaaaaactttcaggagaacatagggaacctatcagggttttttcatcatccgtgcatactgacgttgtcacgatcagagcaaacctcttgctattgtgcggtttgcatttatgagatataaacatgtatcaacacaatcaatgcagactaaattggagggtttttttgttgagaaattcctcatagaaattagttgacctaacacacttggtggcggccacttagaaccatcctaccatcaacaacaaaatgtttgacgaacagcattggcggttgtttatgcgggactcaatcgaacatatcatgtgcatgggcaaaatagtttgctcgttcatcgtagtcaaaatcaaatagtaggcaaaagaaacataatgaaccgggaggaagaagaaactgaaaccgaacagcagaagcaaacttgccgtagagctatggagaccggatgtgagggccggaggtgatagggatgtctgggtgaggcggcacgacagtgaaccgatgaagtcctggcggagagcggacggcgatgggatcgacgacaacttcatgcggtgcgacggagaccggcggggatggcactaggacgagttggcgcggtgagcagaggaggcagatggggcgaatcgggcaatgtgcggaggaatgttccgaaggaaaaggggatgcgatcgatttgcgtgtgcagaaggaaatcgacaatcaagcaatcacgtgtgtgattttccattagtgaccccgtgtgcgcgatttgagagagaggaggggagagggggactgtgggagccgatttttggtcgttggatttgatgaataaggtttctataggactgcagttgctcaaatagattaaacatatcccaagcttatggataagagattactaattttttttagagaagagtatttttctacctggcatctacatccaaccggatatgtgcaatatttttaaattaggaacttaacttgtcaaatagggaacttagtcctcatatggagattagaactcaggatcttaaggtgctacttaagtcactgcaaccacttaggctatatttcttttcacatcagagattattgataacaaacagaacctggtaatttattacgcgtccaccaattaataaaccctaattaaccaaacttaatctagaatatgtagatagggtattaataaaccctaattaaccaaacttaatctagaatacgtagatagggtagtataatgatcttctctccgcgcatgcaggcgcggttgccggcagcccgagagctcccgtccgtacgccgccggtggtcacgccctcagcggcgcggccgtgtatttgcctgcgcgacagtgacgttgcggccgccgatgtcctggccgttcatgccctggatggcggcgttcaccgactcgctgtcctcgaagttgacgaacccgaacccgcgtgacctccccatcacactgtcccaagcgatctgcaaccaaaaagccatcagataataatagatcatctactagttcactaagatttcacgattagttgtagatctgcaaatttgaaaaaacgaacagtgcatagcgatcgatcaaccaagtagtgtgtgtgtggagatcaatttgtgaagggatttgtgaacagatcgatggaatggatagccaatcaatataaaaaagatcaacgaaaacccagccaagatttacaaaaaactatatatccactgtagaggcgctaaacttgggatgaacaggcgagacaaaccgatcggaacgctcgatcgacagttcgacacacacacaaaaaaaagaaaagaaatccgtcaaacttagcgaagaacaaacgacaacacaacccacccggaacagaacggaaacggaagcaggagcggcgaggaaagggttggatacagcggagcaagagcaaacccacctcggcgctgatggcgccgtaattggcgaaggagtccttgagggagcggtcgttggcggagaacggcaggttgccgacgtacacgcggtactccagcggggagcggtccttgtagtcggagtccctccacggcgccgccatatccttcccttgccttcctctctaaaccctaattaactaaaccttcgagagagagaagctagagagcttggacttgacgaaacacgacaatgacaatcccaggtctatatagatctattctcatgggctcttgggtttccgctaccgtccggccgtccgggccgcgcatgccagatgaagaataagttcattttaggtctcctaactttacagtgactttgattttgattcttgaaacgaaataacagatacaaggatcccttaacttagcatagtactccaatgcacccgctcagagctccgtgcttcagcaaatacgttcgatgttagccgcattttattacgttgtaagacgttttgactttggtaaaactcaaactgttttaactttaacaaagtttatatacaaatatagtaataattataatattaaattagttttatcaaatcaataattaaatatatttttagaataaatttgtcttaggttgaaaatgttactacttttttctacaaatttggtcaaatttaaaacaatttgactttgaacaaagtcaaaacgtcttataacctaaaacggagggagtacctttcatagatcaacatatccagtggccatttttttttcccgagcttagaccctgcttagattggactaaaacttttaagtccctatcacatcggatgtttggacactaattataaatattaaacgtagactattaataaaacacatccataatcttggactaattcgcgagacgaatctattgagtctaattaatccatgattagcctatgtgatgctacaataaacattctctaattatggattaattaagcttaaaaaatttgtcttgcgaattagctttcatttatgtaattagttttgtaagtagtctatatttaatactctaaattagtgtctaaatacaaggactaaagttaagtccctgatccaaacaccacctaagacttacataaaccggcaatgagatcgagggcctatttgagggagcttctagcagctgcagcttctcttagaatctccagttgccagaagctctccaaacagtccagctttttacctagattttgagaatatgtagttatagaatctggaaaatgaactagaagccataagctgggtttcccagcttctccagattctcaacatctcagaatcttaagctccccaaacatgccccaaattaattttaggcttctaccattttttttcttgattttagttctagacttttactgctaacgataaaaaaaagagaagacaatgtaatacagtagttgttttgcttctcaaacttgccataaccccctcccccccccccaaaggtagataatgaaggtttagagggaaaaaaaaacttactacaaatgttttcgtaccgtttagactgctaataattggaacaaaccctcaacgttcatgcgtgcaacctcctcacttttaaggtcttgtttagttagagaaaataaaatttttggatgtcatatcagaagtttgaccggatgttagtaagggttttcggacacgaatgaaaaatttaatttcataactcgcttagaaaccacgagacaaatttattaagcctaattaatctgtcactagcatatatgggttattataacatttatggctaatcatatactaattaggcttgagatttatctcacgatttctatataaactctgcaattagtttttctttttatcttcttatttgccatcgataacacatacagtcggcatgagggtcacatgcaggccacagacgggcagacgaacagagattcgattctgcaggaggaagccaacctcctgggccttctggcaaaaagacgacgccgagctcggtgtgttggcacatctgcgtttgtaattgaaaacgtacatatgtcctccaatccttatccaacctgacacacagtaactatggagcggtctcaacatctaggggtgggcaaaataagaccgaacgaaaaaaccgaaccgaaaagaccgagaccgaaaccgaaaagaccgagaccgagaaatttgggtagtaattcggtctcagcatgtcaaagaccgaaagttgttcgggtaattcggttattgggatcggttaaccgaattaaccgagaaaaccgaattgtggcctaataggtccaggaggcccaataggcccaatacaccactaaaccctaaagacaacccgtaggctgcatccccatccatccagccatcgcgccaccctcccttccatccccatccccatcgcgccgccctcccttccatcccgcgtgagcacgcctcctccgcctccatcgcgtcgcgctgccgtcgccgcctccattgcaccgcgtcgcgccgcgccgccgcctccacatcgtcggcgccgtctgcgccctccgcctccacgccgcctcgccggtcgcgccgggccaccggattcatcacgccgcaccaccacctccgcccttcgccctccacatcgtcggcgccatgtcagccttcacgctgtctcgccggtcgcgcgggccgccggcagccagatccatcgcgccgcgccgcgccgccacctccgccctccgcctccacatcaccggcgacgtctccgccctccgcctccacgccagtcgcgtgggccgccggccgccggatccatcgggccgcaccgccacctccgccctccgcctccacatcgccggtgtcgtctccacccttcgcctccacgccgcctcgccggtcacgcgggccgccggatccatcagaccatcacgctatgccaccgcctccgccctccgcctcgacatcgccagcgtcgtctccgccctccggctcggctcctccaaattcagtctgaccgagaccgaaaaaaccgagaccgaatttatcggtcttgatttttttggatgaaattcggtcctgacttttcaaaaaccgaattgaccgaaaaaccgaagaccgagatcgaaattttcgggtagaccaaacgcccacccctatcaacatcaacaggttatggacttatggtatccagctgtacattgtacatatctcaggttgtatacgttcctgaataaaatttatttttaagtaatcattattttggagtttataaaagcaagaagaaacaattatatccgtactaaaaatgagatataattgtattgatttttgtattggtatgtacatacggagtagtatgtaattagtgaaaaacaaacttattttatttcggaaccgagggagtaaagctgccatcgtgagttcgacagcgaatcttccatatcgtcatgacgttcttcttttgcatgccaagccaatcagctcaccaatttgacgggcacactagtagtgccagtacacattttgaccatgggtccatggcatcgcaaaccgcaaagcaacaaccactctgacgtggcagcagatagagtcattcttaacataaacgctagccatcaaacttacacacactcaggtacgtgctgcagagtgcagactgcaattgatgattacaagcataaacacacacctaattaaacaacatatcctaataaggccctaagcttgcatatccaggagattaccaacagagactgattaattaattaagcatccaccgcttaaaccctaattaaccaaactaccaacacgacgaatgactaaaactagctagtagatctgcagcatagatagcttagggtaggtaggtaggtagagtcttctccgctcattcaggtcgacctcctcgccgccggccggccgtccgccggcggcgcggtcacgccctccagcggcgggggcgcatctgggcccgcgcgacggtgaccttgcggccgccgatgtcctggccgttcatgccgtggatggcggcgttcaccgactcgttgtcctcgaagttgacgaacccgaacccgcgtggcctccccatctcactgtcccaagcgatctgcaacccaaaacaattaacacaccaaatcaccagatcaattcataaagatttcacaattagttgcagatttacaaggacggacggccaaaacgttaaaacgtgcatatataatacagtgatgaaccaaaacagatggatagcaaatacacccatcaatataaaagaaatcaatggaaacccaacccccatccaaaatctctacaaagccgacggggaaacaacagcagcacaggtccatcagaaaagcttccaacttaattagcgaagcacaaacgacacaacccaattaaccggaagagaacggaaagggaagcaggagcaagagcaaggcacctcggcactgatggcgccgtagtcggcgaagtagtccatgagggtttgctcgtcgacggagtagggcaggttgccgacgtacacgcggtactccagcgaggagcggtccttgtactccgagtcccaccacggcgccgccatagcccttcccttcctttccctctctaaaccctagtaatcaacacctctctaaaccctagtaataacacctaattcttctttggatgccaaacgagagctgaggacttgacgaggtcacgaggaagacgaccggagtgcctgaccaaccgcatatatatgtataggtcctccctgggtttcggctgcgggccgggccgggccgggacgggtgccggacgaatgggttggtcaaaaggcgctttccgcgaaatgggccggtaaaagatcgggaaatgggaaccaagcttcagcaccgatcatgggaggaaaaactttttgtggctgtgtgcctgtgttttttagttggtggtgggagctatgcacacttaaaacggattatctcattaacgggttatctcattaatatcaatatgaatgaggaaaatgtcagaataacttatatagttatgttttaaaaaataaattaatatgatttctgaaagcaatttttttgtatttttttttaaaatgcaatgtttattagtttgcaaacttgtgtgcgaaaaagagaaaaaaaaaagagtctgagaaagtagagggaggaatacaacctatgactctctttctataaaaccgagtatatcgcttcctcgagtattaaaaccggtgtattttcagcggctttaaggagccctactttggcttcgatcacacattgtacaccaactttggtgtggagtgagccactcgtacgtgccaccgatcacgcatagaaatatactgtagcgtgcagacccacatgcaagggcacagactaacccacacatttctgcagaaacccaccatgccttctggcaaagaccacgcgagctcagcttgccgttttggcacatctgcaccgtacgtgaaaaagtaacaacgtgtccaccattcttagggtctgtttggtttacagagacttatttcaagtctctgtcatatcggatgtttagacactaatttagagtattaaacatacactaattacaaaactcattccataatcttagactaattcgcgagacgaatcttttgagtctaattacgccatgattttgacaatgtgatgctacagtaaacttttaataattatgaattaattaggcttaaaaaattcatctcgcggattagctctcatttataaaattagtttttttactagtctatgtttaatactccaaattagagtccaaacatccgatgtgacatgggctaaaaagttttagccccatctaaacacccctttatcctccaacctccaacactttgtactggagcgctcaactactactactcgactcgtgagcgaatctccttcgtacggaacacatcatacggaacacatctctcgtgctccgcttttggcaccacaccttcttcatattgaaagggtctttaattatgttaaaatataagtaaaaatcatcgaataaataaagccatgaagtcgaacttatagttttctaaattcactaaaaaaaattactcgagattggtataaatatgaaatcttaagtctaaacttaatttcgtttgggaggaaagaaagaaagaaaaagacaaatttcactagaatagagaatgtatttcatgcttataactatctctagtaaatttttttatgaatttataaaactttgaaattcggtttctacagattttcacttattggagcgttttcatcgcacgcgggagaagacagcacagcggtgtgctttctatgctgaggaggagtaggcgaaggcctggccagtgccgcactcttaagcaagcagagggagaagggagagagagtgtgtgtgggtgattgaggaaaacatgggagagagagagagagtgtgtagatgtgactatgtgaagggaaaaaagttgggtgagaatgggtctgactgatttttttttataaaaaactactaactgaattgtcatgtaggactaaaactactttgaattgagtcgggaagttatttgtcctatttaaatattcgagtttataggatacttcagtctaatgtggactttttccttttatgtgctttgtgcttcttaattactccctctgtttcatactatgagtcattttgattttttttcttagtcaaacatttctaagtttgactaagtttatatgaaaatatagtaacatctatcacaccaaattagtttcattaaatgtaacactgaatatattttggtacgtttgttttgcgttgagaatgttgcgttgaaaaaagtcagaacgacttataatatgaatatttaattacacataaactatttgtgttaagtgagttctttattagttagtgtttattattatgtttatatatgataaaatggtacaactgaaattataaattacgaaagtagtataaatatgtcaacgaacctaacgaacttaacaaatcacctcgagagtctagccgagctaggcctagctcgttagagttaacaagccgagttgtgttgttaagattacgagccgaggtcattatccacctataatttcatgattaacttcagtacttaaatatttcatcatattaaatcatcgtattaaatgaatttttattaagctattttagatggataaacctaaggtggaaagatgtaattaggaaaaaaaaaggtcaaataaacaatattcaggatgtgacatcttccccccttcctaaccctcatcccctaccttaatttggcgcaaaaaaaacctaacttgtcaggcttcccactcctacgacctaatccttaccttattgggttactggtgatcgtccgagctgaaggagtgcctcacgaattgtggttcaatccaatggtagaggattcgacggaaatccaccacaaatttacgtgtctcgtttaggtaggtaggaaatgttactcccttgtcctaaatataacaacttcttactttcaaaatttattaaaaatattacttcttcccctacatcttcttcttaaccaataagaaacttacaccattaaaaatttctacacactccatcgttttacttatcggtaggacaagcgaaacgtcatatttgcaaaccaaaaataattataaataaaacttttatatacgtgttgttagcgatcagctatacttatctactcttctcaacaaatcataccatttttccatttaatttcaccaactttttagtacatggcaatttaaatggtactaaattcaaaaactaaatttagtacatttgccgcttgcaacgctaggtactgtagagctgcgataatttcactagatacaaaagcttagatttaggggcgtaaagttttagcgtgtcacatcgggtataatatagggtgtcatggagggttcgagcactaataaaaaaactaattacagaatccgtgagtaaaccacgagacgaatttattaagcctaattaatctattattagcaaatgtttactgtagcaccacattgtcaaatcttggagcaattaggcttaaaatattcatttcgtaaattagtcacaacatgtacaattagttatttttaaacctatatttaatatttttatgtgttcaaacgttcaatgtgatagaataaaaaattttaaaatgagatctaaataaggccttgtttagtaacaagaaacacacccctgctcgtggcggacaggcgcgcggtggagtgggtggactcagccatcgatcgccacaaagcaggggggaccacatgcaaggcagagagacggggcaggtcaggtcgtcagagtcgattcttcatttgcagccttgcagcaagccaccaccatgttctgggccgtctggcaaagaccacgcgacctccctgttttggcacgtctgcattttgtacgtgagaaagtaacgctatactaccatatttctcgtgagcgaatccttatgcctacttggttctcaaaaacattatattgaatctttgcgcacatatatagagtattaaaatagataaaaagaaaaactaattacatagtttgcatgtaaatcgtgagataatcttttaagtatcctaattaggccataattagctacaagtgctacagtaaattacatgtgctaataacatattaattaggatcaaaagattagtatcgcgatttccaggcaagttacgaaacttcttccaacatcaagtcaaacgtcccatgtaacacccaaaattttcaccaccaaccaattacatggcacatcgtaaccaccgaagaaaaagcaccaagcaaaaaatcactcgcaccgtcgtacgtgccagccagtagaaacagagagagatcaatagttgatgagacagatagcaaacacgtctttaatttaaagatcatgcatatggtgctgccgactgccgtcgacgacaaaaggattcatatccaggaggttaccaacagagcctgacaattaaccatcccatccatctcttaaaccctagtacattgaccaaactaccaacgagagattaccaacagagcctgataattaaccacccatatctcttattaaacccaaactacgaaggagattaccaacagagcctcattggcatcaatctcttaaaccctactacattaattaaccaaactacgaacacgaacgcgactctgaaactgaaactgatagtagcacaactagtagcagtatctagataggtaggcttgagcgcgtagtcttcacgccggcggctggtccgccggcgccgtgcgctcagcggcgggagcgcggctgggcctcctggacgatgacgttgcggccgccgatgtcctggccgttcatgcccttgatggcgtcgctcgccgacttgctgtcctggaagctcacgaacccgaacccgcgggacctccccgtctcacggtccacagcgatctgcaacccaaaaccagcaacagcaagtcaccaaaccaatctatctatgtattggagtacgtactagctatagttcatgaagattaaagagatatttactgatctgcatatgaaaacgcacaaagatgaaccaagaaatgtgtgtataaattggcccggcgaattgggcaaatattagatgagatcccaagaaagtggcgaatcttccgaactaagaaaagaaaaagacgatgttgggaatatggaaatgggggcacttcagaacagatgtgacggataacgtgtatcaaatcggccaatcaaagctcgggaaagacgaacaaaaatcaacaaaaacgacgcgaaatggcactgatcatagatccatcacagaaaatcgtcaaacctgcagatgaacagaaaagacagaccgaccggaacgggcggaataatggagcaagcgcagacaaatccacacataccgaaaaaaaaaacgtcaagcttagcgacgaacaaccgagacgacccaaccggaacggaagcaggaggagcgaagaagaagggaaggggctatatatatactgacctcggagctgacggcgccgtagttggagaaggagtccttgagggagcgctcgtcggcgcggtacggcaggttgccgacgtacacgcggctctcctgcccttcgagtcggagccggtgcggccattgtagtcgttgtcccaccacggcgcagacatatccttccctttcccttaattccctctcgaaaccccaactcttccctttttcttcggatgcgaaacgagcgagagaggaagtggagagagatgatcttggacgaaaatggagagatgatcccgggtataaataggctgggaatgggatacatatccaacctgatctgatcaccacgtacggcgcaggtagattagagaggtagggccgaatcgatcggcttcttgttttgtgagatatggccgatcagttttggtagcattatcgagttcttgggctgggtcatatgggatgtttgctttgggccgtgaagaatatgtgaggcaaaggattaagttcactttgaatccctcattttgtcgccaagtccaaaattcatctatggactgcaaaaccggatccctcaacttacaaaattagtaacaaggtctcccgttttagctgttttcaacttacaaaattagtaacaaggtctcctgttttagctgacgtggctcttttgactatgttttcgtcccatgtagtattggcgtggcgtttacgtggcaattccatccgggaaaatctgtgggacccaaatgtaagttacacacaaaataataataaatgagatattagggggggtgagaataggggtggataggctcggctcggtctagctcgttaggataacgagctggctcggctcggctcgtttgaaagctcgagccagctcgttagactcgtgagccaatccaacaagacagcaagctccggaggaggggacatgtgagtgcgccttctccggcgatggcggtggcggcggctggcagcgacggcggcggcggccctagcgccggctggggaagtgcggctggcggcggcggcggcggccctagcgcctactggggaagtgcggctggcagcggcggcggctagggaggtgtgacggcaacggcggctctagcggcttgcagcggcggcggcggcccaagcgcctggcgaccacgtcggcgcggtctcgtacggcggagcgattccgatgtggatgtgcggtctcgactctcgtctcgtactctcgtgtggtgcggctgccgccaggactaggagtgaccaagccaggactagggttttgcttttgctgttgtattgggcttgggcctttgctattgtattgggctgggcctttacggttgtctgattaagtcctggctcgttaaggctcgcgagccagctcgagctggctcgttatccctaacgagctaaaatgccagctcggctcgttagcaaaatcaaacgagccgagccgagtcgagcctgtcacaagtcgagcgagctaatccacccctaggtgagaatctacatggaatggaaaaggccaaccaatgccacgcatagctatcatctttttcaatggaggaataatatttggtccactaggaagtgatagaaaaagccaaaacccccacaagaacgtgaataaatgacacaagcttagtctgtccagttcacaccaaaggaatctatgcaaagatcaataatttcttcttattttaaatgaatatactatccgctttaaaatataagtatttctacaacataaactttatagtacatatcaaattacaagcatttctaaacactcattttagtgcgtgtaaatccaagcattttcaatcaattggaagtttccaaatggaacctaagggttcattccgaacgctacattttcggaacatagggataggaaaatgttgtactcgagtgccttggcacctttaaattctattgaaaaaaaacacagaaaatacaagaataaccattttaatggagacaaagaaaactgtagaaatcagaaaagagcgatagtcatattaaaaatcatccaaaattcatatgatttgaggcaatcttctaaatttgaaaggaatttgggagatttacttccttgtttaaaggacaatatgaattctttccacacgaatccaattctttaaaattcctttgttttcttgactaggggtgacaatgggacaggctggggtcgggttggataggaatgtcgccctcgctccatgcattctcctctgcccccagcgccgcagagctaactgggtggaaaatgtcacccatcatgtcctcgcagttcaccccggtgcttgagggtgaattagcgaaattggctgctacgacggcttggggccagcaacgactagtcgattactgaaggcgcaaatgataggtcgacggttggaaagggcttcgatgatggctaggggcggtgataatgggtcaatggttggggatgaccgggtggggatttgacgatgaagacagcatttgtcacccccagaaattctcgaaccagaatttctaagctgaatgtgcattaaatccctgtccaggaccagccagggtacacaaacgacaattgttgacatacagacccacgtcttacaaaaatataaaagattacaaatgcagcgggaaagataaaagcgagctaaaccgggaagcttgacttcagcagcgggcgactccactccacaggcaaaccttgacggcagcgacgaaaccaacctctctgagacggctccaactgagaagaacttcaactctggtgtgggggaaaagagagcaagactgagtactacccactgtactcagcaagtcataccggaagagaaggtatgatgcaggatataaccaaaggaagctaggggttcttttgcataaagcaggcatttcaaagtagtagttgaaagcagtaaaacagctgtagtaattaatcaatattaaccaatcactgtccaacgctacaccacgttgcaacaggcccaaccaaccacctgtactacaccagttcaataagctaaactaggggtgagactaatcacggtgaatctggttgatcgcccataaccgcgggcacggctattcgaatagttttactctggccagagatgtacaactgtacccacaagacacgattccacacatgtcgccatgccccgaagtatcaccatgatactgcaaagggggaaatcgtgacaagaccttccacataaccctcccctaaccatccacaccacgctaaggtttcacccccacccctcaaaaggcagtgggcggtcccctcttgcgtcgcggtgaatccggcagctggacaaccgaacacctcggccgacccaactccatcacgcccaccctcgccaccggtgcctaggtaagggtcgagctgtacttcagatcaagcagttacccactcccgcttgtggtaagcacggtaagtctcccagggtttcccatgaaccggtccttaactgccatgggtgcaaccagcaaaaccatgcactcacagcccgccattcagaatattttaattaactgacacccttgcggtggcaccaatctaaagctatgccaatagtcagagtctatgtaataatgtgatccccatttgtgtcctagttgaactaagcatggctaagcatttcctaagccaacatctagtcattttgatacccaagttatcaatggcataaggtaaccaatatgtggctgaggaataggacccatcccacattacattgtaaaagaatgcaacatttaatagaaatgcgggatattggtaaattgggtacaatatgatcaaacgtattgcatgacttgccttgctctcgaactgatgagacctcaacaacgtcttcgagaaactgcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactatgtttttactaataaagaaaaagtccttaattaattattgcgcaataatacccagggctgacgtcatccgagggggggcggcgccgacaggcggggcccacgggtcagcggctcaaaggggagaggaagggggcgccggcatgtgggccccacgggcagtggctcaaggtggccggtctaccgtggaccgggaccacgcgggtggtccaccgccggtccacgggaccgacggtccggatcggccgggaggccgatcggacggcacggcggcggctaggcacggctcggctcagcttcaaaaccggccggccggccatggcaaccggcggcgacgcgcacggtcgccggcgacggcaatcggcggcgcgggaagcgacggcggacggggtacaggacggcggcgtcgaccgtaggcgacggcgagcgtgtggagagaggcggcgcaaacgagagagaggggaagagggaggaggggggatcctcaccggcgagtatggcggccggagcggaggatgaaggtggcggcgacgacctggcgacgaggaggggcggacgggcggcggcggcacctatggagggagttgagaaggattaggagtagagagagtgaccacggcggccaccattgttggccggagacgaaggagaatggatagctcaccggtgtgcgaggagaaccggctccggtggggtttagcggaaaccgagcggcggccgaggtggctcacgcggcggcaatgctaatggcggcggcggcttggcgcggcggcggctctagcggctgcggcgcgcgaccggaggtggcggcaagcggcggcgctagtggcgagcggcgcggcggcggtaggaggcacggaagagcgcggcgaaaaggggaaaagggagagggagatgcggggaagctttataggggctcgagaggggcggacatggccgggaaaccccccgatttggccggcgacgtgggggggagagagagagagtgggggggattcaaatcgaatcccgcccatttgcgggcgcgcgtgcaggcgggaatggcggggagggcggcgacgtggggacgcggagtgggggcgcggcgtggagcggagaaggcggcggcgcggacggtttcggcggcggttgccgtcgtggggcgggcgactagaggaaggggacgacctgacaggtgggccccacctgtcagcgttccggagagaagggataggggaacgggccggcccaaaggaaggaggccgagcgcgggagggagtgggccgacggcccaatagagaaaaaagaatgaaaagaaaaagaaaaagaagaaaggatttttcctgggatttaaaattgcactttggtgatttttaattggttaaaattatttccaaggctctgaaaattccactaaaaatcttgttaatgcattggagcatggggaactcaagaaaaattccaccacgctatttctgattattaattgcatttattaactagggatttagctctaggttaattaagataatttcttcgggcaatttatttaaccaatttttaaagcaagaaaaggggggaaacttcatggtgtgacagcattgcagacgaacgatgaggcagcgcggtgagggtcgttgacgatgagagatgaggttgtgtgtggttgattgatgagtagcgtggcggcacagcaaggagcagcgaggtggcccagagaagcagccgtcagcggtgtccttgctagcgttacatgcctaccgagagctgcggcggctgcggggttaggtgagagacctgaaccccgctaggtcacgcgtagcttagttagaatccatgctcccacctctatccccataaattaatttgcggggtcatgccccactcacccacgagtgagaattccccatggccctagccctagcttcgtaggtaggtcctagctccaatggaagaagtgatgcaaaactagaagtgcatactgcagagtaaggccgtgtttagttcatgtgccaaaatatttttgaagtatacagacacacatttgaagtattaaatgtagactaataacaaaacaaattataaattccacctgtaaactgcgagacgaatttattaagcctaattaatccgtcattagcaaatgtttactatagcatcacattgtcaaatcatgggataattaggctcaaaagatcacaattagtaactcgtaataattttggagagttttatcaatttaattaattgttgcttagtggcgtttatattttcttctgaatctgattttattagcatcgagaatgcttgttgataggttttaacgctgaaactgaaggcgaggatcttgacaatgaggttgatgatggggttgatgatgaggatggagaagttgccaatgtaattggtgcaggttcggtgaaggtaaaagaaagtttaggtcaaaggcttggcgggagtatgtgtcaatttatgaagatggagaaattacagaaggagagtgaatgcattgcactacttaattggtgccaatagcggagcaggaactagcgttttgcggaatcatttaaagagatgcaaaataaggattgagaaggttagagtggtggatcagctcattgctactcttatgtcgcctaattgagttagtatggggaagtggacttttgaccaagaagtatcacgaagagagttggtaagaatgattgtgctgcatgagctaccttttagcactgtggagtatgatggctttcaaaagtttgtctcaagcttaaatccactctttaggatgatatcaacaagtacaatgagaaatgattatatgaaaatgtttgaggaccaaaagaatgttctcaaggaagaactcaaaatgttcaaaatcaaggatgtcccttaccatggatttatggacatccaaccatactttgagatacatgtgcatcacatgtcattacattgatgctgattgaaagctgtaaaaaaagattatcaagttctctgtcttggagacgccacacactggtgtagtgattttcaatgctgttctcaaatgcattcaagagtggaacttggaaaacaaactatttgcaataacattggacaatgttagcaactatggttcgatggcaaaggtactgagagagaatttgctagctaagggagtaatagttggtcaagggaagtttttgcatcaacgttgtgcagcacatattctaaatctcatatgtcaagctggattgaagttcattaaaggcactgttactaagatacgggagagtgctaaatacgtccgtagttcgtacggtcaaaaagaggagttcaatgagattgttacatagcagggtattacttgcagcaaacatcgatgttgtgatcagatggaattcgacatatctaatacttgacgtaacacagcaatacataacaacatttgatgctctagctttggaagatctgttgtacaaatttaggcctacacctcaagaatgggaaaaagtagatctagtttgtagattattgaaggtgttctatgatgctactaacgtgatatcagccacaaagtaccctacctcaaatctatacttccataaaatttggcaagtcatgcagaccttggaaaatgaattatcagaagaaaaaaaatgaaggatatgcttactgacatgaaggacaaattcgataaatactggaaattatcatggatggcactatgtattcctatcatcttgtacccacggttcacgttatcctttcttgagtttcactttggccctgcctttgggaaacgtgctaaacctaggcttgaaagattaaagacaaccctcgagggcatgttcaatgaatatgctcagcaaacgatcaaccttggttctgcgcaacaatggggtggtaatgttgagataggtagttgtgatgaattggcttattgggatcaacacgtgagcctcactgccccaccaaggattgtggcatcatcaaaattaaagaattatctgttaaagcctccactccctcgaggtgaaccctttaatatcttaaaatggtggcaagcaaattttattgagttccccgtacttggtcggatggctcgagacattttagctgtacctgctaaacttgagagactatactaaactctagagactatactaaacttgagagaatgtatgaagcttcttgcttgaggtgtgtcttgaaatggaggatgagagctcctttttatagcttcccaatgacggttgtggtggttggaatggtcggaaataccctccaatagtcattgggatgcaatcctggacgtccatgccgaaccctggcctcaaccgtggagatgggggttcagccgaaccagggggttcggccgaaccatgggctggcccaatccagcccattttcagctggcgacctcttattcttcttttctacgtagacttgtgaatgttggctgttttggtcgtgtcaattcgatgtttcgaacccacttgtccgtaagtctgattctcgatagcgttcgattgattgatcgtccgtgttgctgtcgattcttctccattttgtgtttatgctttgcaagaggttagaatcctagtgctagtggaatatatgttattttgacacatatgcattgtaagcataacttgttctccttaattttagtaatattgacaggtgaaactgatcactaatggccgtcaacagtgatcttactgcaactctgctcttttatggtgaattggctgtgtaattagccatgtgatgtgatgtactcctttgcatatacgtagccctaggattccttgcgttttatatgtgtggccccatgaatctgtgaattaactattatctgctaggttcaataggttaaccttttgctccattggataacctatttatttaatggaatcattaagggatgccctaattgaaccatggatcagcatgatcacgtgaaatggtttaggttcaatccagaacctaaccattcccatcctgagtggagagggagccatcccatagcagcgctgtgatgggactgtagcactgccagagaaaggatgcgtaggtggcagcgacgcgtcaattcagcattgacgccgaggaggaggcactagagctgggctggaaggtcgtgccgagggagctcatggcggaagtgctacgccgactggggccaggggcgtcatggctgacaccgcggtcagccatggctagctcaaatgaggggaagggggggtggcgcgcagtggaggagctacgtctccgcgccactagcatcagcctcattggcgctgctaccacggtgacccatgctctcgcgtctgaggggggtggagagagagagagagcaatcccgttggaacgatatcccgtcccatagcatttctaaaaaatgtgaatggcttggtgactatatagcaagctgcatcttcagccatgagatcgcgggtttgatccctgcatcacatgatcgttgctgaattttttaattcttccgcaccttgcacaaatatcaatatcaatatgatggctgataaatgaaattttttttggaaaaatgccatcgacaattatatactccctccgtccgtaaatataagcgaccttatatttagggacggagggagtaggaatcctgatttttatttttattttttttaaaaaaaccctcaaaccagcggcccagcgttacagcgtgatccaaaattccacgttaattttatataaaaaagaaatccccaccaatcagctgttggctgttccgtctcgtccatgcgatcccaacgcggttcagaccgcgtgaacagatctgtcactctctcatgcacaaccaatggacgcaaccaccacccacaagtgatacggtcggcgcacacctttcgtctccgtctccccaccacgcaaccccccatctaatcaccccgtacacaataccctgacgtggtggtcctgcccccgccgagccgatccttctgggccccacgtatcagtcgcccccgcctccccccccccccccccggggtgcggcctgcgacgatttttcggtcgcttccgatgcttccgtcacgagacgggggtttccccggtgctacgtgcgcaccacccgttgttctactcgcaccaggtaacctatcactgacttgtgagccccaccggtctgtagctctgtaaaccccgcgtgtcggtgtcggtgggcggggattcgcggtagtggtggaatcacgcgtagcttcgccgctacgtggcctcgcgcacgttacgcggaataaaaaggtggaggaggaagacgacggagacgggagaccgaggcgagagggaagagcacatggcgagcggcgaggaggagggggtggggtggcgtcgccgacgccggcgaaggtggagggcggcggaggaggaggaggaggggggccggggatgccgatggcggagctggagcaggtgttccggcggtacgacgcgaacggcgacgggaagatctcggcggaggagctggcgtccgtgctgcgggcactgggggcgcccctcggtcccggcgaggtgcggcgcatgatggacgagatggactccgaccgcgacggcttcgtcgacctctccgagttcgccgccttccactgcggccccacgccggcgcacggcggcaagggcggcgacgccaaggaccaggaggccgcgtcggaggcggagctgagggaggcgttccggatgtacgacgccgacagcaacgggaagatctcggcgcgggagctccaccgcgtgctccgccagctcggcgacaagtgctccgtcgccgactgctcccggatgatccggtccgtcgacgccgacggcgatggctgcgtcaacttcgacgagttcaagaagatgatgggcggcggcggcggccggcggtaggctggaggggactgactccgtatggttgcccggtcaaagttttatctgttcttgcatggtttccgtaattagaagcttataaatcaagcctaatatttagcatgtgaacaactttttaagtagattttaaaaaagccccccactgatttgatgggtagtgatgtaatcatgcaaaggtagtggagtgacatgctgtattactgtttctgatatatactgtacaacttgactaatgttcaaactgatgggtgtataaacaagcttgggcaaagggattgccgtccagcctgggcaaagaatgtcgagttttatagcattgtttgtttaatatttgtaacaccagtaaaaactcggcaaaaattctaggatatattttgaatggacgactcctaatttatgggacaatgtttggaagatgaaaatgaaatctttgtttcactttcaacagaaatggtatctttattaggtgctcagaataagcttaactttttttcaatgataagtttgttttttttctgcttcggttttttcaaaatatgtttattttttcatattcattgcatcggagtttatgaaaataaatacgatatagatatgttacgagtagataaaagaggtttaataattatactgatatttgataaagtaaggatattttaattttttttaaataaaagtaaacttatttcgaactagaggttcaccaaatgttacacacaacctcaccaaagtgccattacaaccataaaagacatgtcaacatttattcctgatatagtatgcagttagtggctttactctatgatcaatcacatgtcacatgttcgacaagtgtcaaatcttacatgtgctactctctaaaaaaagcacatgctaaggctgtgtttagtttctgaaattggagagaagtttggggaaagttggtagtttcgataaaaagttgggagtttatgtgtgggaaagttttaaatgtgatgtgatggaaagttggaagtttacgggaagtttggtgtgaactaaacaggtctaaggccgagtttaattccaaactttttcttcaaacttccaacttttccatcacatcaaaacttttctacacatgcaaactactaacttttccgtcacatcgttccaatttcaaccaaacttccaattttagtgtgaactaaacacatccatagtgttggaattaatagatgggctaaggcccattcgaagattaattctttggaaaatcacaaaagcccacctcatgggatggcatgcatgtgaagtttagtaccatcttgcttattctagaagagggggacctccttaaaagggaggatgccctcctagccacttgaagcatgtgtggtggagagaagaggggaaacacagtaaccgaaccggataagtcgcgtgcacgacgtacgcgtcgaatggttcgcaaaattggttcctcacccttgcacagatgcagcctccttttgcagttttgttttgctgcgggaaattcggatttgttttgttttggaaacattccgaaaaatccggtgcgtgaaaacggcgtggagtccggataagttacgcgcgacttatccggttcggttacgcgaagtggagatcatgcgggcaccctgatcaagcgacctatctctatataaaccgagccgccgccatcatgcaccacaagcgaaatcaatcttgggtttgcctcctactctgtactacgccgtcgctcatagactactcaatcccacttgccggcatgcaccggcgatcgggagagcaggtctccggaacctctgccttcgacgtcctgcaccgggagaaggcggcaataaggtttttgggaagcgcttcgcgcgactactccctgttcgcccgcgacggctcgtcttcctctccactcgcgtgctgcgcgccttcgtcgacgcccgcaaccgcgagtagtttctgccgagcaaccggtctttccgccacctcggtacgtgttcgatatgttacgtatatttgatctgttcatgttttactgcttagtttacatgtgtagatctaatgatgtgttcatgctagtttacatctgcaatgtcatgatttatttatgtaataaattaaatcattatgtgcttataatttcaacaatccaagaaccttattataggcgctatgattttactatggctggttttgccgatgcactgaggccggataaattcaccggtgtgcactttaagagatggcagatcagggtcactctgtggctgacagatatgaaatgcttctgggtgagtactagcaaacctgaaggaattcttactgctgatcagtagaagcaattcgaggaagctcctcgaaggagtaagagacaaaggacggctaagtcctttggcgatgatttcgctgtgtacctcgtggatgacactccttagtcaatttcagaagcatatgcatctcctaatacagactactggaaggaggctgtccgtagtgaaatggattccattatcactaacgggacttgggaggtgacagagctaccctatgggtgtaaacctgtggggtgcaagtgggtgttcaagaagaagcttaggcctgacggtactattgaaaagtacaaggttcggcttgttgctaagggctatactcagaaagaagtgaaaatttctttgacacttactcaccagttgctagattgaccacaattcatgtgctactttccctagcagcctcacatggtcttctcgttcatcaaatggacgttaagacagcttttcttaatagagagctggatgaggagatatatatggatcaacctgatgggtttgtagttgaaggtcaagaaggcaaagtgtgcaaattgttgaagtctttgtatggtttgaaacaagctcctaagcaatggcatgagaaatttgacaaaacgttgacatctacaggctttgcagtcaatgaggtagataaatgtgtgtactatcgtcatggtgggggtgagggagttattctgtgcttgtatgttgatgacatactgatatttggaacaaaccttgaggtgataaatgaggtcaaatcattcttgtctcaaaattttgatatgaaggatttgggagtagctgatgttatcttaaacattaagctaattagatttgagaatgagattacactcttgcagtcccattatatggagaagatcttgaatcgctttggctacattgatagtaagccttctccaacaccttatgatcctagcttgttgcttcgcaagaacaagagaattgctaggaatgcaccggaatactcccaaatcattggctcgctgatgtacctggctagtgcaactaggcctgatatctcctttgctgtgagcaagttgagccggtttacctctaatccgggagatgatcattggcgtgcgcttgagcgagtaatgcgctatctgaaaggtactatggaattggggcttcactattctgggtatcatgcggtactggagggatatagtgattctaactggatctctgatgtggatgagatcaaagccactagttgatatgttttcacactaggtggtggtgctgtttcgtggagatcttgcaaacagaccattttgacgaggtcaaccatggaagcagagttgacggcactgaatactgctactgttgaggcagaatggctgcgtgatctattaatggatgtgcctattgttgaaaaaccaatgctggctatccttataaactgtgacaatcaaacggtaattgtcaaagcgaatagttctaaggataatatgaaatcatctagacatgtgaaaagactattgaagtctgtcaggaaattgagaaactccggagttataacattggattacatccaaatagctagaaacctggcagatcccttcacgaagggcctatcacgaaatgtgatagacaatgcatcgaaggatatgggtttgagacccatgtgagttttactatggtggtaacctaatctatatgatcggagatcccgtgaattagaatctgggaagaacaaaccattagtaaactagaggagagtgccaatctataccctctctaagtgaagatgcatgtactctcgtgagctgcaaggcaggttggctatgccttaatgagttctgttggctttaattagcgaagatgctgtcctgcagagcattcttgaaagaacccacctttgtgagcttgactgttggtcgcagtctatggagattttgggtgaatcttctaggaagcttactaaagacctaggagtatgacttatacgctccacccgaggggtagtctacagacggtctagtatcagataagactcttagtgaaacttgcttgcataaaacttgcaattcaaggcagagtccattgttcaagttgtgagtaagtgtagcttggagttctaggtggatgttcaaccttaatatgtctccatcgaaccattggtatataaacagtacattggaaaaggcaaatctcagtgggattttaagatttggtgggggattgttggaattaatagatgggctatggcccattcgaagattaattctttggaaaatcacaaaagcccacctcatgggatggcatgcatgtggagtttagtaccaccttgcttattctaggagagggggacctccttaaaagggaggatgccgtcctagcctcttgaagcatgtgtggtaaagagaagaggggaaatacacgcgagcgctcgctcgcctcgcctggcctggcctggcaggcggcgcgcgcacgatgtacgcgtcgaatggtccgcaaaattggctcctcacccttgcgcagatgcagcctccttttgcagttttgttttgctgcgagaaatacattccgaaaaatccggtgcgtgaaaacggcgtggagtccggataagttactgttgacagaaaacacgaggcctgggagatctgcttaactccagtgcaggtccaaaactcgccttcggatgtgtgagcgtgccagttgatttgatcctgcaatcaacaagaaataaagacaaaagaaccgtggttaaacttataaatgatagccgatcggccagaggccgatgacacatcatttatatctaagccgatgtcatctgtgcatcgatcggcagtcatgaataagtaaagaatgactaaatctacttgatcagctatagatattaacgatatataccccttatatcgatatatacttaaatcaagtgattgggatagatcggtcatcatgccgagacagtataaaccacttagatcaaaatatatatcaataacaggactatatatgttgatagcgtagccgatcagatagatctagtatgtatcggctaatactctgatactactctatgttaggatattaaagcaagaataatatatcgaacaagagcctaatatacttagactcagcaatatcttgatataaagggcagatttaacgtatcaatgaagcacatagaacaaataaagttaaatcagatatgatcggctgaaaccccgatgctattctaatcggcaactagatagcagggtagaaatcaatattctaagtacgacttaatagatcaaactcaattgatgcagcattaagtatgaaaagaagaacaatatctagacaatcaagccgctagaagattcatagaatggtagatatcttatataatctggatcaacatcaagatctaacctaatcggctgccttctgcacacagatgttggccggtagtagattagataacaatattgctgaagattatataagatatatgataacttgacgaattatataaataagattagagtgtcataaagatgtaagcactaatcctaagaacacgattcgtgatgacgaattttacctcttgttgaagatcgaaaccgatgcagctcaacccgaaagtaagaactcgtcgaaataaaagcaaaaggtggcgatgcgccggaattgtattgaatgtgtctcttttttttgttacatagggctcggggtctatttatacccgaggattacaagatatgcccataccggacacgaccattatctctaacaaactctaaaatatcacaagtctttgcggcagacttttgcccacacttatctataaggaatttacataaaatttcctaattaatagatacaatttccttcccaggactctatccatgcgtggcaatcatattgaagtatatcaacttgagcctgacgtcgtgcacaagtcgtattgtcagaatcggctatatcggcttatttagctcaactcaatctcagccgatcctagccgtagccgatccggactccagccgattcctgctctgttccagaactcgatctccgcctccaactcttctttgatcaaatcccctttcctgatacaaatgttaccaaatttggttgttaacacttacgcgcgacttatccggttcagttatgtggagtggagatcatgcgggcgccctgatcaagcgacctatctctatataaaccgagccgccgccttcacgcaacacacgcgaaatcaatctagggtttgcctcctactctgtactgcgccgtcgctcgtagactactccatcccgctcgccagcgtgcaccggcgatcgggaaagcaggtctccggaacctctgccttcgacgtcctgcaccgggagaaggcggcaataaggtttttgggaagcgcttcgcatgactgctccctgttcgtccgcgacggctcgccttcctctctgctcacgtgctgcgcgccttcgtcgacgcccgcaaccgcgagtagttcctgccgagcaaccggtctttccgccacctcggtacgtgttcgatatgttacgcatatttgatctgttcatgttttactgcttagtttacatgtgtagatctaatgatgcgttcatgctactttacatttgcaatgttatgatttacttatggaataaattaaatcattacgtgcttataatttcaacacatagagcttgattatcaatcctagtacaagagattaggtgttttttttacctaggggatccaagatgtctttaaatttgatgtatgtatgtatgtatgtatgtattattacattcatcctaaaatataataaatttgaagcatgtatgtggatcctaaaatataaacttttaagcatgtatgtagatccgtgcctatctaaatgtatgtaaatattatatatttaggtgtcgtattttttttaaaaaaagaacaaataaaggagtaccacatcaatatcttcattagcagcgaacatttaatgtaaagctcatcgagcaaaagggctgcagctacacaccatgtgaccatgtggagataaagggcaacagtaacgcgaaagaatgtaggtgtcaccgcgggagaacaaggcagcatggcgtggccgaatgggccataaatacgtaggttttcattgaatccagggttataattggattgaggggatatttggttgatatctaaccttaccataactaagtttaggctagttatgctatagtggcacaagtatggcttacaaatagttggccacaagtgtggtcactactatagaaaagtccaaagtaccggttcctaaaggctcataggtgccggtttttcatccgacactaaattggtcggcaccaataatagcaaccgacacctataacaaaaatagaaccggcacctttaccattgctcgagccaaaaaaaaaaacgagagccggctcaaatccgagccgaactcaccaagcggcgccgtcaccgggcatgcgccccaaaccccaaaatcatccacaaatcatcaccaaaataaaataaatcacataatgaacatatttaacaataaattcacacaaacatcaacaaattctgccacccgctgccttccccccgtcgggcaccatcgcaacccgtcgcccgccgcccgccgcctcccctcccgccggatctggcggaggggagaccgccgccgccgccggtcgcccgccgcctctcctcctgccggatccggcggaagggaggccgccgcctgtcgcccgccacgatgcgccgccgcctgccgcacctcccctcccgccggaggagaggccgccactacccgccgccgcccgccgccgtcgccacccctcgcacgctgtcgcccgccacaatgcgccgccgcctgccgcgcctcccctccgacggatctgggagaggggaggccgccgtcaccgcccgttgctcgccgcctccccttcagccaccgcctcgcgctgagatttttttgagagagccgaaagcgagagagagaggcaagagagagacagacaagagagatgggagaggggataaggctctcatataggccgatgtgtcactcactcgtccgtcggctagattggctcggcggctcggcttggtttggataggtgttggtttttcaaaaaaaacacctataatttattataggtgtcggttaactaaaaccggtacctataatatattaaaggtgcctatattatctatactataggtgtcggtttttctttagaactaacacctatagttgcttaaaggtgtcagttttatatgttctcagcctgtggacgtggtaaaatcactatagatgccggttagttgttccggcacctatagtgccgatctttatgggctttttttttagtagtggacaagcttagctctaaatttgagagcatgacgtgggtcccaaagttaaaaaagtgtggcataacacaattatagcaacgaaccaaacagacgcctaagaaactgtggcatgactaaagtgtggtatgacaaagtgtggcaactaaccaaacaacccctgaatgcgtctgagtagttcatctgtaatctttattttgtgatgcaggggagtacatactaaagagtactgtaatctttgagcgagcaattttgtgattttatcttgattattaaaatgtgcaaatggtgaactaattagaacttacagggttcctttagaatagaggaaaaacataggataaatgcccctttaatttgtaggattttaatcctacatgaaaagttcgtaagaaggcttctgaaacataggattgaatcctatagtttccttttaaaggacattccagatttctatgaaagttaacagtaactccaaagttttgacaaattttcttggagtatatatctctcattaccatagaaaaagtttgcctagatgatacataagctatttacacgtgttttccgctttgcctgcaaccaagggcctatggaaatcgtggatttttgcgggtgcatcaagaactgccggagaaaatatatttacgcagtcggacatcttcagtctttgcctatgaaatacgttttgtacgggctgttactgaagtctgaagacatttaacagtggaaacacttttcaccaggcggatctaaacgcttgcattgttgtattataacaaaaataaaaaaataaaaatctagctgctatggagcaattcatgcccatgcaaaactagcatatttcttttcagtatgtggggacacaaattagtagccacattcacgttcactgaacattcaaatagataaagagatagtacttctaattaagttggtcatacacattatattatacacatcaatacttggaagcaagatatatattgacatagacagttttaagtcatactccctccgtttcaaaatgtttgacactg

SEQ ID NO: 46138 - DNA, 13746 bp, Oryza sativa
cattttgaaacggagggagtactaatttagggtctgtttggggaagtttctagctgctgcaacttctcccagaatcagaagatctccgaatagtcaaggttttggtacatattctgagaagttatagttgtagaatctagaaaatgaactagaagtcagaagctaagaaatccagcttttctaaattcttagaagctggctacgaaccagctgcttctccgaatcttaagctcctcaaatagaccctcaatctgcatccctgaatcgtataagatataaagtgtaattactatctacgatgtcaacttaaaaaatgtcctcaacagttagtaatatgcatgtatgagagcaacttttgcttcaacataccgatcctttacatctctgaaaactgtaaattggtggtaatccaaattaaaatagatttacgactagagcttgtagtcaaccaaatagggataagctagagtgaatatagccaagctcattcatcacctgacatgagatgtattgcaagctagtttctgttagcaccttaagagcttcaccctagctacacataggacaaatacaattactagtactatcaatacaattcgaaagaatgcaacacgtattcctcatcaattaagatgtcggccattctaaaaagtaagcaaaaacaaatagtatgaagcaattttgttagtgcatcgtactctacaatatgtgataatttgataattaatcaactaacattgtcaaaaaaaataacgtaattctaggtcaacgacatcttctaaaactatatcgtccaaaccacgtggagatgttcgtgactactattatgtcataatttgaaaaaaaaaaccctcatattgtatgcatgctcctatgtagtgaacataaacttcctgagtgaaccccgctctaccaaaaattaacacaattccagttcaacatgatcttgttgcatcttagttggttagtataggcactaaaccgtccaagtttgacaaaataatcaactaataatgtatacaagccattgcatgtcaaaactctaaaccttaggaaacaaaccgagtagatctattggcaccccatatactgacagcggaaaccctaaacactgaggaaaaaagagtatcgaaacccaaagaaccatcctcatacaatctagagaggtccactctatcacagtgtaggtcaaaaccttaccttagacaagaaaccaagtagatttgttgccaaacaatatatcctgccatcggaaaccctaaaccttgaactaaaaaccaagtagatctactgccacaccctacacacatgctgctagccaaaccctacaacagtcactatagaccgagttgatgtactaagaccccaaaatgaactacaaagcaactaaaccggatggtgtaagcgggacgatgtacctggataatgagccggtggagggcactaacgacgatggttgtctcaaatctgtgcatgggtgctggagacccacatggagcctaggggcatgggggcaacgacgagtttggcctcccctctgacgaaggtcgggtgagctcgagctcggatgggctcgctagccgcctcccccttcctctcccgccttcctcgcgtggaggccgggcaaagctcgagtttagatgggcttgttggctgcctccccctccctccaaggctcgccggctgcctctccctccctctctcgcctccaccttcctagaggccgggcgagctcaagcttgtacatgctcgctatccgcctccctcgttgacaacacctgagctgcgtgcgtggttcgaaagaaaaggaaagaaagaagtgggcgctaacacacgggccctgcatattttttcttctcacttgcacatgggccccatattttttttattttctttttactaactaggatgccatatcaacaaaaatagatatccatgctaccatgggacccaatttaacttggttttataagttaaggggttataaaatttctagtattgtgctttaggaatgtcgattaaactcggtgtaaagataaggaagggcaagtagacttatctccttacaggtgtaaccaacaatttagtactgtatagtccaaacggccgattgctacagctgacatataaacaggggctagcccaaaacgagtccatctacacatgaaaacctgtggcaaccgaacggtatatgtctgtaggaaaaagtacaccgaagatacctcaacttgtcatcgaattacaaaatcatccttgaaccgtgaaaccggatacaacgcttccctcaacttacaaaaccagtataaactaggtccctcggcggttttgactccggttttatccgacgtggtagctgactcagcgtgggacccacgtgggccccacactcagggtgaccacatcatcatgtctttcctttcttctctcttagttttctcctcatcccggccgcctggtggggcgatgtgggacagggaggccagcgacgggcggtgcggtggcgtggcgacgcggcggcggcgggccgggagcaggcgggggaagagctgtgcgtgggcgacgggcgacggaggaggagcggcagaaggcggagcgtaccccggcctgtgctgctgcttgtctctccctcttgaccgcatttctctctggctcacggtgtcgctgctgttgcaggtggcggagcagctacgggcggtgactgcgcatcgccggaagacggagcgtgccgagggggaggtgctcgccatcctggagtcctagggcctcgcccacttctccgacgccgcggattccggttcaggttccgacgatgaggacgacttctagtctgccgagagcggcggcaaggctcgcggggaagcggaggatggatgccggggtctgaacttggaagcagtgctactgcggaggcggcggccagggggctgtcgtggaagggccgcgccgcgagccacgagtcgcagaggcggcagcagcagcaactgcgtcgataatgatgccgccaccacgagaaagggcatggtctcggcttcatttccggtttgtccgtctagctaagaagctcatcaacggctgcaacggtgcgctcacttgcgcccagctgcaacggtgcgtccatcgcctgtagccactgcgccaaactcatagtgttgtcacggtgcgtccacctctgcgtagtgcctacccaattattgatgcaaaaagtacacactggcctaggagatctgcttagctccaatgcaggtccaaaggttgatgagatgcgggcgtgccagtcagtttgatcctgcaactgacaagatatacaaacaacagatcaataagccgattagctgtcaagccgatagagtaattccaaccgataccgataccagccgatagcaataggatttcgagctatcgaccatatgtccaatgtatattccgacacttgatgtaaataccaataaaaaggcaatcggctgatgataatataatataacaacaatataatccagtagaaaccaatcggctaaaaatgacatgatagaataagcactgatccgaaggttaaagcatacatcggctagaggtccgatgtcataaaatccacaagattagattaaacagtaaaatctttattgccattggctaaatccaatttgtatgtaatccttgtaagccgatgcaatatccagataacttatcggctgaaaccccaatgaaacctttattagcagtcaagaagcaggctagagattatggttctaaacacgacttagtatatcaaacttaactgatgtaacactaagtatgaaaagaaacacaatatctagacaattaagccgttgactaattttcagggtggtagataccttatctaatttaatctagtaaaacaaattagtcgataccagcagaaaccctaaagcaagaggcaaccgatagagctaaattgagatactaagactagattaactaaaacatatgataaataggcagacaaatatatcatccaaactagagcaatccaagaggtcgaatgtactgatgcagccttgaacgacggcaacatagactatacaattgcctgggccggcggaacattggacttacccttcgtcggagatcgaaaagcgatgcagccccgcgtcaggtgccaagtcccgtcggacgataaaataaagtagaaaaggtaaaacatagcgatgcgccgaattgtattgatcgtggagatatatatcgtttacaatgaacccgtgtgtacatatttatacccatggagagatactagtccttgtaggacaagaaagaaactttcctaaagacaaaaggaaaacataaagtctttataggacactaaacacactttgctaaagataaaaggaaactaataaactattcctaattaatagataacttgccatgccgcatccttcttgaactcggccacttctagataagctttctttaatagattaatttccttcaccgaatatagcaggaacccgactattgacgatgtgataattctcttaggggcttatcaaatttcactgttaacaccaatcccaaagtaatacgacgattaagcaattcgttgtctgcgtggtcaaaagctcgggctttatgagcatacacgaacttgtggatagtccatcaaattgaattaatcggaggaagggggaagaaaaattaggggcggaaggagaaagagagagagagcgagctatactcgactatggagaggagcggcgatgatgcggtcggtggaggtcgggatccagtgcagcgcggacggccacgccctcccccacctcgaccccgccccgggcgtcgcctccgctaacgccgtggcggtggcggcggctgtggatatcctcgtcttcgccgtcacggccgcggcggctgctcggtgcatgcaagattctcgaattttccctccctcactccctcgatcggtctctcacccttcttctcgcggagttcttggtggctttgccgccggcagaatcgagcctcgccagccgcccagtggctcccccgccgctcgcgcgctgcgcctcctcccgccgcgcaccgcccgcctgctcctggcccgccgccgctgtgtcgccccttctcccgcgtcgccgcgccaccacaccgccgggcggcatgaggagaaaactgagaaagagaagagaaacagagagaagagaagaggggaaagagatgatgactaggtctgacgtatggggtccacgctgagtcagctgccacgtcaaataaaaccggagtcaaaaccgctaaggaatctagtttgtactagttttgtaagttgggggatgccttgttagttttgtaagttgggggatgccttgtatccggttttacggtttaaggatgattttgtaattcgatgacaagttgagggaccttcggtgtactttttccatgtctgtatgtatagtctcggccggccgacatcgggagctggcaacagacggttgccctcacgcgcgaattcacgtgcgcgcggcttctctgcagcctgcatgcaggtactcgccgtactgcatctcttggagtcatgggcttggcctccaccagatcgtcgcgcggccacccgaggcctcggccggccgcgttgctggaattatagatggaaaatgatacgaaaaatttccgaccatatcaatactgttttcgtttccgtaaacaacaataataaccaactaataatagttttttattgtttttactgtaaaatttatttatttttcctctgcatcatattgaaattataactaaatatctgataccacttctataaaaaaaataaaaataaataatgtcatttccgacgttttcatccatagcttgattggaaaggttgggttcagctgacctgagctcaacactattagtagtggttttagtttcacggattgttaatttacccaggcttccgtgtgttgattcatctgatcgatcgctacctctttcgctgtactccgtcagtaccctgcatatgcatgttccagagctggctgtaataccatgcatcccatatcgtgcatgaatgtcgcgcaaccatgaagtcacgcagagacagatctacagcatatgcattggtgtcaggcgacaccgatgactttcaacaaaatcatacttaaactgcttatccatatattataacactatcatctaaatataattagcacactatgataccactaaacatattatgacaccaacaaactaattttctggatccgtcgtcggagtcacgcaaatgcatgcagataggcctggaaattcctccatgctattgaaacagaaaatgaaaatatttgagagaattgaagccattaagttacatttatgtgttgccgctgctgcgttgggaatttgggaccgtggcgatggacacgacggccgacgttcgtacggcgcatgggtgggcagccggccggcgatgggcacgtacgtggggatggggacggatccagagcatatgccacgtcgtcggcatatgcctgcagcctgaatactgctggatgaacatgcatagtatgatgcagcatgggcggactgctgcatctgtaaagtttgtcaaaactttggtttggcaaaaagtttaatgttgtcaaaagtacgataagaaacgaagaattagcttcaatccaaacgagccctaaatataatcaaaagcatacagagcagcaggatctgcttactgaccccgttttcggtagctgcttccagtatgttcagtagtttatttttgtcctccgttgccctggggttggttggaccgttttatcaatgctgtctactaatttttttccctcttggctgatgttctctttataattcttaacgttttaaattatgatatgatctttaaaatatattttaatacattttcccattaatatatatatatataataataaatttttatttttattatagtatttcataaaagaatctatatatgtttctagtgtcattatactaaatattttgaaaactattgatagtcaaagttaaaaagaaattgatctcgatcaagattacccaaaacaacaaaaattataaaattagatggattagcttattagctccagcaaaaaaaattaactttaaaattgaatttagagttcttccattgtaatttatttttcaacattcgcttttaaacatctaataacacggatacaaatgttttacctcaagactgaaaataaatgcaagttcttcggttggctcatggtccatagaaagattctcacagcggacaagctcctcctccacggctgggataacagccacatttgcctactctgtggagtggagccagagaccgccactcatctactcatggattgcgccttttacaaaactggtctggagatccatatggcagaaagccgggcttcatatgcctatggcttcctcctttaatggggatatgcttagctggtggacagcgtgcagaagagaaatgatcaaggatcaaagaagaagttttgatggccttttcatctacacagcctggggaatttggcttcaacaaaatgcaaggatcttcaatggtgcctacagcacactaccgcaagtcgttgactctatcatcgccatgcgcaaagcctacaacggagctcatagtttagatgactagtacccggttcctctttttggttgctatgcattgcctgaaaatcctcccatccgttttttcttgtttcccgggggatctatggtttcctcttgttttccatagtttgtaaaaactatatatctcttcttcttcttctataatgaaattggcagagctcttgccgtttaccctaaaaaaatgttttacctccaagttttatgactttacccctaaaattgctctagcatttttatgacttattatcagtcacatctcaaatgatctatttttcaactagtattgtctatcaaaaatctttataatataaaacaactattgtagatacaaaagcctctgcagaaacaggtaggaggtcaaagcctaattaattaagcttggcaaccatcaaattaaaccaaaccggaaccgaaagcaacaaagctatctactgacatgactaacacaacctctagaacgagtagagtttagctggagaagaaattaaggacctgtttagtcccacctgaaaattttttatcctcacatggaacgtttgaacatattaaatataggctaaaaaataactaattgtatagattgcgactaatttgcaagatgattcttttaagtctaattgcttcataatttgacaatgtggtgctacagtaaatttatttgcttaataaattcgtctcgcggtttactaacggattctataattagttttcttattagtgtccaaacacccacacgacaccctatgtaatatctgatgtgacacgataaaactttacacctctatatctaaacacccctaaaatagctgcgcatatctgcaccagttgagacgaccatacaaaaattagcttattggtagtacgtactattaccaataagctagctacgtactccctccatattttaaattttaatgtataacgacgttgactttttaaccaacgtttgaccactcgtcttattcaaaatttttatacaaatataaaaatacttatgtcatgcttaaagaacatttgatgataaattaaatcacaataaaataaattataattacataaattttttgaataagacgaaatgtcaaacgtttgttaaaaagtcaacggcgtcatacattaaaatacggagggagtacaagacggcgttatacattaaaatacggaggtatacattaaaatacggagggagtacaaatatctctctccctttctgcatgatgcaattacttctatcaacaacatctatactcgcagcctatcatcagtcgcctcagtcgttgttaataaagcctggaagctgggaaacgtactacactatctcgaaaagcatttgtacaaccacacacatacgacacgtctcattcgatcgtggttgcgagcattgtgacagttggttaggcgttgtgcggcggccagctagaccgaatttagagccccagagacaagggcatcgctcacattgattttgggacttaatcgagcacaattgctagccccctcttcgctcgtgcctattatttctatgttcttggtcccaaccgtgctctcattggtaggaccaatgttaaggacgacgttgatggccatctgtgtgttcttcagtttaattaattaactgtgtgtttttaatgatttcgatagacataagtacataaccatataatctgacattacttgaaaaagcaattttcccaaacagccttttcatttctctactattataaaaattgaagatgtttttgtcggtattttggtacgtcgtccgagcatgagtcggtttttaaatttgttcgtttttgaacatacatatccgtatttgagtcggtttttaagatcatttgcttttgtaaatacagaaggaatcgtataagaaatctcttttaaaaaactagcatgctaacttaagatgaccgcacttctaattgcagctcatgatttattaaaaatatatatatgcaaacgagtttccacggtagatttcaccataactaaaacgtataacaaaagaaaagacctaaagaaaagaactacgccatgagctagctagctccatttatgcaaggaaggaccgaaaggaggtagctagtgagcactaaccagtgacagtgtgacgacttctacagtgaggctgtgctggtgcacgtactacggctttagctcctggctcgatcgtgttgtgatcaacttaactcgggctggctttgcagatactcctgcctttggccggcgacaataatgccgcccatattctgttcgtgcaaccaccgcgtcggggcgatcctattacatggccccatgtcgttgaggcacagcttgtgatttctgaatgactctgttgtttgtttgttagtagctataacgtacggcaagaaggtgaatccgccgcatatactgatcgatgtggaggttggacagatcgatcactatggatcaaacctgatttaacttattcgaacccgcagaattcttcttggcaacaacatggtctcatcgaaaatcaatctcttttcagttttcaccatgtcttcagcttttggacacgagatgtgtctgtagtctggagtgtgaccacacttgccagtacagctacatttacatagcgttgtgccgctacggtgagggccacctatctgacgagcatctgagggagcttgctaggggcagaacagtgcacaccaagaggagaggctccctcaccctctcaaccctaaacaccagcctgttccgctgtagcatttgtcgtcggtcatgtccctgccatgggtgcacactactgtatacgacaccctggaaggatttgaacttctagttgttttagcttatatgaactataattaagtagagtactaggtagcctataggcatgttttgatatgtttaggacgtcatctttgctattcatccgtcgatgaaatttggggtgctcattctctccatcttagatggcgtgtatgtgggtgaggcaagaagacaggagatcacaaagggaggaagatggaggcctcacaggcgatggtgatggcaaaaccgagcattggtgctgatgagactcctgttagagtttgtgtcgaataaaactagtcatttgagttgtgtagatccagaatctaaagttgtgattttggttgggtctatggtggagcaggtccaatgtgactagggtggtcttccgttggtgggtttggctgtgcattctaacaaatggtatcaaaacctgcaggagatccattgatagaggcgtgatgaggtgccccacagtgcgccgctcgcaggttatgcccagggagggacatgtgcacaaggtggagcacgtcggcggatctgtggatcgaatacttcaggtggcgatttgaaccgttcaatggctgccttcaagcttttaacagtgagatgactagaagcaattgatgacacagaagcaattggcaaactgttgatgtgaaaaacacacactggcctgggagatctgcttaactccagtgcaggtcgaaaggttgatgagatgcaggagtgccagtcagtttgatcctacaactgacaagatatgtaaacagtagatcaaatagccgatcggctgaaaagctgatgtagtagttccagccgatatctgataatagccgatgccgataccagcctatagcgatagggtttaagcaatcggttgtatgtccaatgtagatactgatataaaggcaatcggctgatgatgatgtaataaaataacaatataatctagtaaaaccaatcggcttagcaatatgatataatagaacaagcactgatccgacggttaaagcatacatcggctggaggtccgatgtcataaaatccataagattagattaaatagtgaaacctttgttgcgatcggctaaacccaatatgtatgcaatcctcgtaagccgatgcaacgtctagataactcattggctgaaacccttattggcaatcaagaagcaggctagagattatggttctaaacacgacttagtagatcaaacttaactgatgcagcactaagtatgaaaagaaacataatatctagacaatcaaaccgttgactgatttttcagggaggtagatgcctaagctaatctaatctagcaatacgatttagccgatactagcagaaaccctaaagcaagaagcaaccgatagaggtaaattgatatgctaagattagattaacatagacatatgataaaataagtagacaaatatatcgtccaaaccggagcaatccaagagatcgaatgtactgatgtagccttgaacgacgctgatgtagatgagacaattgcctgggccgacggaacgtaggacttaccccttcgccgaagatcgaaagccaatgcagccccgcatcaggtgccaggttccgtcggatgataagtaaaaacctcggtaaagagggtggcgaggcgctgagagtagttgtattgatcgatagattgatagattacaatgaccccgggtgtacatatttatactcatagggagatactagtccttgtcggacaagaaagaaactaaggataaaaggaatagataaagtccttataggacactaaacacactttcctaaagataaaaggaaactaacaaactgttcataattaatagataacttgccatgccgcattctctttgaactcggtctcttctggataagctttctttagtagatcaatttccttaaccgaatatagcaagaatccgacaactgacgacttgataactctcattggctaatcttaggacttcgaagccgatgctgactctaagtcgatgattactttgggtttaccaaatttcactgttaacacaaaccattcggtggaatttgacactttcgacaagtggcttgaattttttggtgagctactcccaataggatggcgtgtagccacatcctcaggtcaactgaagctaaaggaggtcggcgctctcgattggtggaatcaaatgctccggattgggtggcccgggcgctttcggtgaactgtgttcgatagggagatgactagacatagcacttgggtcgttcggtggctgggaagatgacatgcgatttgtcagcttcagctcgtgactagattcattgcgttcaattggaagtcagagcaggtggttcgtagaggctggtttggaggtgttgacgaggtatttgtgtgatggactactacagagaaagcgtacatatgacaagaggcaaaatcaagctaaggatagccaattcagaccatcaaagtacaagttcaatcatgttaacacaacaacttgcattggttgcaataaaccgatggtattcattgatggtgagattggacggagttaccgggtggctgcattgcactagaggtcgtacaagtgcgtggaggctgaggaggtcatgagaggtggcagtgtgcatggtcgcatgtcaaagccaaagaccatagagatgactagagtctagaggtagcagaatgactctgttcgagtcaggattttgtaggagattgactcggcttgtgcaggcacagggaatagactcggacctcgagtcctaccagccatatgcatggaggaagcaaagtcggggacctaattcaacatgaaattgggaggacatggttttgttttggactctaaatcgaaccaatctcccaaaccctatcttcctatatagttggaacccactaaggggcatctactcctataaagcaagaatgcaggaagccacattatcaataattttaagccattagatcatattagtataaagataataaccattggatcaagaagctacttattcatccaattcaatcatttattagttatccattcacctccctttgctctacctcactgtcacacatagcactgttacatattttgtgcataacaccatgttttctgaatacaactcaaattattgtttattatgtgattattgtttaatatgtgtgttttgttttattatgcatgataagatagcatataattattaggtatcgttacctgaatctattttcagaaaaaacttgagtgaagtagagaaatgcaaattgtctacctataacgaaaccatattgtgtatgaaaataatattcatat

SEQ ID NO: 46139 - DNA, 4141 bp, Oryza sativa
  unsure (1)..(4141): unsure at all n locations
nnnnnnnnnnnnnnnnnnnnnnnnnnnnnnnnnnnnnnnnnnnnnnnnnnnnnnnnnnnnnnnnnnnnnnnnacgcatggaatatcaacaagggcagcaggaccacgaggattaatatcaatgctaccaaaagtacaataccaatagcaaacttccacctgtccatgaaaaataaccaatatactcagatgagatgtctggcgaatcaaactggagaccaactaaaaggcacaactgaaaaatctttgtgcatatagggtctaaaaggggtaaaatacataccaggatacaacgatgcccaaataaaagaactgaatgtagaaagcaacagtccagacagttaaaactgtttgttcgaatatgtaccacctgaaaaacattaatatgtcctgaggatagctgccaagactttcgatgagtcatataatagaacaacattagattgttatatgtacatttcaatgaggcatgttagctccttttttttttccatttaggatgcctaagaattaagactaacatgatccctgaccaacctcctcaagaaaatgtaacacaataacaagcatcagacttctagaattctggactatggaagatgggaggtataggttgaatgaattgctgggaacacacagtcctgctaattcctactagatcaatattaaaggaaaggcatggcaatgatttagcacagcttccgtgcacagttaattgcagccaaataaatccttgataagaatcaagatgaagaaagtgtgagggcatggtttgataattaggcaaaaggcatataaccgttataacctggtatcttcatacaggttttctcgatctacagttctgccacagagacttggagtacaaaaattaagacaagacacaaattgactacctaaagaaataatggatggatgagcacacaaataattgatttctcacaataaacacatgttaactgaagcaggacactcgggtgcttatgtagagattgcatgacatacaccacacaggatattatgctgcacctgagaagcatatgttcaaactaagctgcacaatatataaattcagaactcaccaaaatctgcagtagttccttttagcaatgcatgttccaagccaaacacaatgatgatcaaattggaggacacatttatcacagtcatgacagtgcttggtgcgtggaggctgcaaaaggtagtagacaggacaaaaaacttcagacacgctagtatgaatgaaatttgtagtaactaaaaaatatggataatgcatacaaatgtgagcagttacaaagttaattgagaagaacaacgagcatagcacggtgtgttcatgaaggaaaagaagttcagtgtgtccttctctctttttcagatagtgtctacctttttctaattagatagattgtgactggtgatggttatgacttctcaaaaatcaagccagagaaactctcattatcgtttggactttggaaagcataaggggtcttaagactggacacactgatgagaaaggatgctagtagtcataactggtcatgtcatacattggcagaccaacattcaacttagtagatacaaaaaaaatagggcgattggcacatgccataatctaagatacactggtcctgtcattcagtacattggcataacacaagactaatcaccataataagcatacctcctacaaaatgcagattgttagtttgttacatccttgaaagacctacattatgtcaagtcaaattatctttgtttttgtatatttttggagcactgtattcagttaatactatctctggatgccaaatttggaaaaccaaagatacctggatgagccggcagtaagagcatgtgaaatccctaaaataaaatggaggcatacaactgtatcacaggacagaaattacatgacaaaagatattgaatattacacttcagcagcataaattccaaacataaacaggtgtacctggtggatgtcccaggaggatatagatccatcgtctgctgtagtaacaaagctgtagtggattgtggattttgctgatctattttgctgcgactcatggcagagtttaagcttccacttttggaattggcctgccttttcttaatcacaaaggcatttaatttagcataaataagtggtgtacgatactcaggctcagcacttaaaatacatatatatcataaggcaaaacaacataaagtaagacattactttgagagagttgttgtattaataaaggttgcatgcatccttgagccagctgtcaacatatcaggtaaatatctaacagcacaagagtcaagtaaacgcaacgtataagtgtcatcatctagggaaaacttcaacatccgcaaggatcaattaccctggagaagaagtggctgtatataggtattgtaccaaggtaagtaaaaccagcaacccatatagaattatgtacctgccatcaaagcagattgtagaataagattaaatagaggggtgatggaatttcttctagatatacatataaacagagaaatgacacaatagtgttttcagtttccaaataggctggacagcatcagctgacattcagctgtagtatatataatatacaatagttagtgaaaggccttttagaggtgctaagataaaaatagaaaaaaaaactacatattacatataagagttggtcaaaggccttttagaagtgctaagaaaagagagaagaatcacgaattctcacaaaaaaggaaaaaaaaacatctggccattgattcagtggaccctcattgaaaatatgtgtcaataaagcataactgctggtttttaaaacttcaaaagctggctaacacgggtctcatgagaactgagcacatacacgtggacctgctagaagaagaagtacgtgcatgtggattataggaaaggggcaaaggtctgctgatgccatcatcatgtcagcactggttgttaaacatacatgttcccttttttaaatataggcacaacttttgatccgatgctctattttcacatatagctcaaggacaacaagatgaacaaagaaatatgcacatggtctatggactatataatattttaaataaacacgtttttcatcaacttttaacagtaaaaagtgatttgtggttccgataataccttggtagcttgataaggaaggaagggagcaacacattgtatctattgaattattgatcaataggcatttataattcacttatgttctagtagcatagttattcagttcctatgaaggtcactttgtccaagtcataaaatgtgcactagaacatctgagacaacaatctctaaattacaaacaaaaaccatcagtttccatcaggtgtatgcggtatgctttatggcttatactatcttagtttggaatatcgaattgttatctaagtaacaaaatatgttgtttttagttttcaaggtcaataacatgccgctttatccattaatattattataaagttcatgatataatgctactgcagcattgttcgaagcagatttaccctggcatgtccatagtaaactacaaattttagacaacatatttggtgaaaatcatacggcaatcatgttgttccatttaaaacttctattaattcaggtgttgaataggatgaacgaaacaaatgagtgccaagcaatatgcccttagcccccatgtcaccatttgcgggacaccatgctaattgtccaaacatgtcacgcaatccttctttttctatatcaaacttaaatacaatttacactattataacatgctggaaggctctcagcccagtaatttcacgacatcatcctcacagacggcattgcagatagaaggcatacataaaaaccatgcttgctctcaactaaagcaggctgcgacctgacacaagccaattgccaattacgacccgacgaaatgttgcccatgtaaagagccctagttgccacccgaagctaggagcaaatcgactccatatagctcaaacagaaaccaataacacgaactccgacggaaacatttcggagaaatttcaagggggggggggggggggggcgtactcgtaccacttggccttgtggatttgcctctggagcgccggatcga

SEQ ID NO: 46140 - DNA, 8201 bp, Oryza sativa
ccacagcgaaatcggaaccacagccaaaatcgaaccaaacaacggtagcgcgcaccgtggcgttgcggctgggatagggcccggatccacacgcagggacctccggctccgcagcgtggcatcgtcgccccctccgccgccgcaccctacggccgtagggaggacgaggaggaggcggatgcagcggcgacgacggacgagcagcgcgcggtggcgacttcgcgggaggcgagaaagctcggcggggggtcggtggagtcgggaaggagaggcggagcgctgtcgtgtggggacgacctgggcccaccggacagcgagagggggagggagagaggctttgccgcgagagcgagtgacgcgcgtgctttgtagcccgtgggctgcttttgcggtgcagctccggcccatttggacgatctcatggtgaagtgcccaagagttttaccagtttttctttcaagtcaaaaatactagctatgatagtccgcgttgctggcaaatacggattcaaaatttgccttgtaaatttaccagttgatcggtggctacaactgtcttgtatttttttttaaccttgccttccaagttgagatcggtggtaatactgccttgtaatgcagtcaacaatgagcacaaacgtacgtgttcctttcctttacgcatacatatgagtacacgcgcggtctgtaaattaatcacaactttgtcacaaaacttattccggaccagtttaatttaggtcgtatcaatgctggacatgtagaagagatatccataaaactgttccgcgttgaaaatataaggacatgaacaaaaccggacaaacaaagggcagataagacattggaacttggaagttcgtctatccccaaaggcatcagctaagatgaacagaaacaccacgaattttacgaccgtccatcgctccatagacataccacaaattctgttaccaatccccttgtaatatcttatctcttttgtaacagaattaaaattcctcctaaactaaaccaccctgcctaaactcaataacgatgatttttttcacgtacatcgatgctgttgcggttgcgtcccagtagatctcatctataaaatgtgcgacgtacgggacccggagcagagtccacagcaggcgccgcgcgcgctatcgatctccgccgcctgaccgccgtaccaccgtctcccggcagctagcgtcgaccggcgtcatgtcgtcacggcgaagcatgggagccctggccgctgtctgcgtctgcatgttcgtcttcgtctcctccgcacgggcagaagatccgtatagatttttcgattgggaggttactactgggaacatcaatcctctcggcgtccagcagcaggtgtagattttgatggatctgttctgctgttcatctttggtcagggttgatgtgtacgctgtttctctaattcttttagtacttgtttgtgtgtgtttttttcttcatgtagggtattctgatcaatgggcaatttccggggccggagattgactgccagacgaatgataacttgatcgtcaacgtgcacaaccgtttgtcggagccgtttcttctgtcatggcaagttcactttacacagaaacgctctcaagcgttgcacccagtcaatctgcgttcttgctcattttcatcattagtttgtacaaattatgtgcactattctgtagatgaacttatctttggtttgattgaatatactgctaaacatcaactaggctagatttgtcatggggaacccaaaacgtggaagtttgttttggaacgcattttgcgtgcagattaggttgattacatgattagctagcttttgtagtcgcgtccgtgcatctaatacaccacaaacttagagagagagtttagttattgccttaggctgtgtttagttccttccaaagttggaagtttgggttaaaattggtacgatgtgactgaaaaattgtgtgtgtatgacaggttgatgtgatggaaaaagttggaagtttggatccaaaatttgaatctacacacagccttgttggcatacgtttccactttgtttccgtttttgttatgtatgctagttttagatcacctccgacgtttattttcggtcctgaaatacaatcttagatcacgcatatgtgcattatttcaaacatgccatccctcacaattacatcgattctttaccgtaactacaaaaatcaaaaatgcaaagtcacaaacaattgcaggaacgggcttcagcacaggaagaactcgtggcaggacggcgtgtccggcacgaactgcccgatcccgccgggccagaacttcacctaccaaatgcaggccaaggaccagatcggcagcttcttctacttcccgtcgctcgccttccacaaggccgccggcggctttggcgccatccgcatccgcagccgcccgctgatccccgtccccttcgatccgccggccggcgagtacaccatgctgatcggcgactggtacaagaccagccacaaggcatggcattgcagttacactaatttcatcaacagtagatggatccttgtactaagtgattgttttgctgttgctgcttaggctctgcaagccatgctggacagtggaaagcagctgccttcccctgatggcatcctgattaacggcaaaggtccaaatggcgcaagcttcaccgttgagcaaggtgaggccttttgcctttacgtagaacacaactattttcgagtgaccttgaccaatctgatcataccgtgagattttcaagcacgggtaatgtgtacttttttttttctttttgcagggaagacgtacagattgcgcgtctccaacgtcggcctgcagagcacgctcaatttgaggatccaagaccacaacatgacgctggtcgaggtggagggcacgcacacggtgcagaacacctacagctccctctacgtccacgccggccagtcgctgtccgtgctgttcacggccaaccgcccgcccggcgtctaccaaatcaccgtctccacccgcttcgccaagcgtgcactcaactcgtccgccgtcctgcgctacgccggctcgagcgccaccatctcctcaccgccgccaccggctggcctcgccgacgacatcgacttctcgctcgaccaggctcgctccatcaggttcgccgcatcgcctcatcctgaccgtccgtttctcgcgatggacggcagatgctggtactgaccggtgggtttcttttgatgttttcccaatcccaggacgaacctgacggcgagcgggccacggccgaacccgcagggctcgtaccactacggctcgatcaacgtgacacgcacaatccggctcgccaactcggcggggcgcgtcgccggcaagcagcggtacgccgtgaacggcgtgtcgttcgtggaggccgacacgccgctcaagctggccgactactacaggatcagcgacgtgttccggctcggcggcatcccggacgcgccgcccgcgggcgccgcggcggctccgcggagcgaggcggccgtgatggactccgactaccggtcattcctcgagatcgtgttcgagaacagcgaggacagcgtccagatctggcacctcgacggctacagcttgttcgtagttgggtacggcccacgttacatgcctcctgactaatgcagcccgcaccatctggtctcatctgttcgctgattttggcattgtcgcaggatggacaggggagtgtggagcgagcagagcaggaagagctacaacctcgtcgacgcagtctcccggtgcacggttcaggtaacacacgcagccacgtttcactcgacgcgggcgccgagcagtgcggatatacacgaaaacgaattgcggactggctaaattgctcgcttgatggcgctgtgcaggtgtacccgagggcgtggacggcggtgttggtggcgctggacaatgtggggatgtggaacctcaggtcggaggactgggcgcgcaggtatcagggccagcagttctacctccgcgtgtacacgccgtcgcactcgttccgcgacgagctccccatcccgagcaacgcgctccgctgcggccgcgccaccaacgcgagcggcagaagccgaaccctgtcgcggtactagttgacaaaccggctggtgcttgtcaacgaccctaacacaacaccaggagttactcggccatgacaagtttggccaggtatatataccgtatacgcaaatgcatcaaagttttactcggccatatcacaagtttggctggttgggtttatttagcgtgagttcagtttgtaaggcgtaaatgaactccatataaacaaggggtgggaccaaagtgtagcctatatgccttttcttactcgccaatgcacattgccaggtttaatttgcaaatcccccgaaatcaagatttaacagcgctattcttttctttctatctagttattatacaaccaagctcaacatgtggcaagctaaaaaataaaagttgagatctctcccgttttttatatcaaccgtccatgcattgcacaattatcattctccagtaaatatgcacttcagcttatttataaattagttattgttaagtgtttttgcttatttgttttttaaaaaaatcatcctgattatacctactcggaaaaaagtcatagtaacgtgcagcgtcatcaacttgattggactcggaaaaaagtcgattctgcctccctttactattagtctgagtagtctgaaaatgggcgggctactgtagttgggccaggagggatttacccaagttttggcccaggtcacttgcgtaatcgtcgcaattactcatctgtaattcgtgtttctcactctggtgcctgccgcggcctgccaatctgccatcggaccggaagttacgctagtaagctagttccttgttttctcaaatcgctggcacgtacagcggtacagagaaccgatctgtacttctgtagtggtgtagttttgcgggcgcttggacactggaaacaggccaaccacctgaaacagaaccaggtttcgaacttcgttgacatgagccgtacgtgcatgtcagcgtgtacatttgtcgtccacttgcccaagcgagcatggtatggtcgccgtccagatcaattccagattccgtgatgctgtctgcagtgaacagacgccttcagttagtatcaacagttaatgcagcatgcccgtctgttgctgccgaacatgaagttcgaagcgaagatccggtttcttaatcgatctctttccacacgcttctccgcatcggatagcgatgctcatgtgctcgtctacgcaaatgaaaaaacaccatggatgcggacaatagtctacgatgtgaaatgtatgcatatgagcagccagccaccaggtatagcgaaatttgctatttatttcaagtggaccaacaaatgcttatgaattatgaaatcagtgtatcttttctaataatataagaaagtcaatatatttaaccaattatttcagtggagtaataattactgaaagtgtttttttatataaaaagtcataatcatctagcttattccctcggttttaattgaccattgctggattagtcgattggtatacctaacaggctaacatgaactgctggattcagtatacctaacatgaacaggcgattcctctaattgtttagtcttaactagtagcgtacgtatttagatgcgtatgaaatactgatgtcgattgtgtcctgttcgtcgctgatatattctatgcttttgcgatgcggaagtgcctacgtactgaaaacggatttatattgtcctataccgacgggatgtacgtagcgtcgctagtttgcaacggaaaacggatttacggactgaaatccaaaccataatcccgtactctgacattctgccttgcgctggcacagcacgtttcagtccagatatgcgctctcttttcacagccacaatgtcaaattggcaagttgaagttgcattgcttcgttgccttttttttttaatcgtcgacgtgatcaaggaacacgaagcattaaggtacaaggaggatatcctttggtgttattaaccgcggcgagggattcgaagatagtgacattggcctgctgctgttcaggctcgtcccagttcatgcattgctgacacacgatctttcgatctcttctcttgtcacgttcttcgccacgcatgctatatataagtgcacgttgacgagctctgcaagtctacactgccaagtcggccgcgcgccatcgcagtgaagaagcacagcgagagtcatagagaatcgatcgctgtgatggccagccgccgcggagcattcgcgctcgtggcggcgctgtgcttgctcgagctcgcgcggcgcgggctcgccgaggagcccgcggtgccggccatgttcgtgttcggggactccacggtggacgtcggcaacaacaacttcctggcgaactgcaaggccaactgcaaggcaaactacccgaggtacggcgtcgactacccgttccagtcgccgaccgggcggttcagcaatggatacaacttggccgaccagctcggtatgtagctgaaatcgagaagaaacgtttgcttttattttctagcattccctagtaagatttggagataatgtcactgaccgggcggtttgatcgttgcatcgatgagcagctcaaaaacttggcttcgacaagagcccgccaccgtacctctccctgccggacgtgaccatcatttcacagatgagcaaaggtatcaacttcgcgtcaggaggatcagggctgatagatagcacgggttggaaagtggtacgtgcactgactcgtcttttttttgtccgcttaattgttggtgtgtgtcacactgacatggcttttgtctgagcagtgcacggaagtgttcaacatgagtgcccaggtgcagagcttcacgtcggccgttcagaagatggggaacgggacggccgatctcatctcgagatccctcatcttcatcaacaccggcagcaacgacctattcgagtacaccgacttcccgtcgaacaccacccgcaacgacaccgaattcttgcagagcctcgtcgcctcctacaagggccacctcaaggtgcagagctgtatatccaatgctccaaaacgaaccctctaaaagttatgcaagaaatctgaacaagatgagaaacggtggctgcaggacctgtacggtgccggggcgaggaaattcagcgtggtgagcccgtcgctggtggggtgctgcccgtcgcagagggcggtcgcgcacgacacgaacgacctcgacttccacggctgctcccgcgcggcgaacggcctctccaggcagctgtacccgatgctgggctcgatgctgcgcggcctcgctgccgacctgcccggcatgcactactccctcggcgactcggtcggcatggccgagctcgtcctcaacggcacggtcctacctggcgcgagtacgtcctctcatctcgctgcaccagtggctgggcatacgaaaacgttgcagggtccctgacggtgtagcgatttttctgcagattttacggtgctggacaggccgtgctgcggcggcggcgttggcgggtgcaacgggacggcgccgctgtgcctggatcgggggagttacctcttctgggacaacttccacccgacggccgccgcgtcgaacgtcttcgcgcgcgagctcttcttcgaccccggggcgttcgtccacccgatgaacgtgcacgagctggcggagctgcggccgtagaagggcacatcgtacgtgtgcttggattggcaaagtgttagtgctggtactaataagtggtggtgtctcacggtactatctccgtttttaataaatgacaccgttagctttttgtcgtacgtttgatcattcgttttattcgaaaaatttacataattataatttattttgttgagagttgttttatgacttaatgtattttaagcataatttaaagcttatatatacatttacatgaaaattttaaataagacgaatggttaaatatgtctaaaagttaacggtgtcatctattaaaaacagatggtgtattatatagagtgcaattcagcaggtttcgcacatcggcgtgcctgtcgtgcgagattcttcacgtactgtctttttgtcaggattggttatgaacaacattggcaagt

SEQ ID NO: 46141 - DNA, 1745 bp, Oryza sativa
gctgttgtgttgaatgcacccttctcctcgctctgctctgacctttacgaccggtgctggtggccgccggtaggcggcgagcagcaaggaggggggaagaagaagggtgaaattttgagaggtttgtttgctttgagattagtgttaaatcaggtggcccaagttcagatgaaggaaggaggtctctctctccataggactagtctgaactagaggggattaactagggtttaatcaaccgcgtcgaggaccatggcggccgcagcggaggtggatgcggaggcgaggagcatcctcgaacgcgcagcggcgtcctccttcccaccgctccacgccatccaccacctcctctccgtcggggttcgtcttctcagtcatgccctctgctgcacacttttcactatccaatccatgttcaacttcccccaattccgatttcacctattacggaaatatttttggatagcgtactgggtgttacgtattgttcgtgtattactacgattatgttgtgggatccatttcctcccctttactgaatgaacatttcgatgccatgctgaacccaatgatttttcagtttcacacacggagaaatttgtcaacatttttgcacaatatttgcaggtctgtgtgcggtgcatctttcggttctttggagcctttagttatgcagcaccatgcctttctcttacggcatcagttctgcattcgtttcttgaagagcatgacgattccgcaaaaagtgggtcttgttcatgtttgtcaaaagatgaggcgtactgctctatttgctttggagtgttactgcccacctgctatcaagatgatggtgtagaaccactccgtagtgtttctcctatcgataatgttacttcaattatatctgaagcagtccagagagagggtcaccaagtcgatgagttctccctagaaatttcactgcctgcagttatagcagctaatgatcgtgccattaggtaaccatctgcacctaagaatttttgcctcacttttttatacagcaccatgaattggtttgtgactgaagggggtgccacatattaatcatttttaaaagctaaaattatgtaagtggtgatatataatgcaaccatttgtaagtgaaaggtatttacatttttttaattagcaaaaaattcagagaaatgaagtatattcagtcttgatggataataattatacttcaacaatttactgtgtttgttctcaaccacagatggaactttctgttgtgtgcttatattaaatctatgatgacactgcactggcattttcataacgtgctggcatttgtgtctttaataggttatatatgaaagagaaatatggcagtgcaaattggttcgatgaaaaaatattttctcaacagacaatgtcagtgaaggaggccttgagaatattgctagtaccgtcagtagaaaaacaaatggtaaatgcctttttctgataatatctcctgaaatcaagcattgcttgtttacttatctcaaaacggttgactaatttcgtgcagaatgtgaaacatggtaataattcatttcgaattcgcttaacttatactcatgatgaaggttcacaaaagcttctaaggcttctgccaaatgaccgtggtcgtaaaagaaaaacaggtatagaaattaatgaagaaagactgcattgttgatgggcggtcatttttcaacattttattttattgttttgtctgatgtctcaacagaatc

SEQ ID NO: 46142 - DNA, 4011 bp, Oryza sativa
gggattcgatttggaaggaatggcattcggaaatgaactcgacgatagatcggagatttagatcttgagatggcacggacactagacaacaatcaaagaaaccaatttcgcaattagggtttttaagagataattttcccgctaggcgccacgacggaacgggcgctacaattccttaatcagaaaacaacactgccgcatatagttacttggtttactcgttgttaaaatgatgaaaggaggaggaaaacaaatgaagggaagacagaagaggagaaaaagaaagtcaccagaattctctcttccgtcagtctcagcgcggtcgatcgtccggagatgcgacggcgttttcacgatgtaacctgcctaatttctcgagaaccttcgctcaatcattcaccgggactacgtcgatgagtcgatcgactctgcacgcctatctcgggccttacagattgcaccgtgtgcatacgatcgcctgtacatatagtgggggcctgattaggatgctggaggagatatatgcactgcagttttgaacagttgcacagggccttcaaatttgagaagactcttcagcaaatcaagcggttctaccgtgcaccgtgctcttttgacagggagctccaggcgatattttctttttcagaagtactaagatctattatactgactctagtacaaagtgttcgtactacactagtactactgccaattgtcttgcacaaatggtccattgcagctcactctgccatgctacgtacggaatagtaacatgttattcacgcacttttcacatgtatggcacgtacaatgtgtcaaatttcaggtacagataacttactgagaaatttgtatatacctgttatatgaactcatctatatcacatttgttaggaaaccctcataatcttagtcaccttttttttttacaaaacctactatacaccttcccaacgtgagcgccgcaaacatcaacaccatcgctgccaccgcctccttacccctagtgtgtcgccacacggtctcacctgctggttggaagacaccaatggcattggcaaggcccctcggctggtttcctccctatctccactctctgactctgccctcccctgccctatgttccttctcaagccggcggcaataaggtgcccctgctccaccatcttccatgtctctagtggctatctgtcgttggatccgtcaccccccgattgccgcctcctaaccagtgggtttgttttgcccctgtcagtcatcctccgtcacacacggttatctctctaagctttgggaaaacccttcctcttcctcctcctcctaccccctcccatcccaaaaataacctagaaccctaactgatggggggacgttgctgccttgctagagctagaggagaagaaagccgacacaaatcttggcatggaccctatggtctgaaattcgacgaaaatctttccaaatttctgccatatgaaggttagcgattccgtaaaaattatgaatgagcctgtacaatttacctaaatggatggtccggatttggaacttatctacccttaaggatggtcaaaattctcatggttacacgaagaatgtcaaatacactcacacatctcgctaaggaaaaacagaacagccaatcagagcataaatttcaaacttttcttgaaaactcaagcaatttttcactgatattggacaattttttttatcaaccataatcactagtgtcacaaacaccttgaaattcaaatacattcaaaacttttgtccaaaagcacatccgaccgggggacctcaagatagaaccgaaatttcaaattttcaaccgaaatttatgaactagatgagagtgatgcgtaagggggaccatcagggagcaaacaaccgtgaccgaattgcataggagttatggctgatcacttgagaaattaaccatccattcccggtttccctccaatattgcacccatccatcatccaccagggatgataccgttgccgttgctctaaaaaacgttaaaacagcggcaggcaacacgacagcacatcgcatcgtacgtacgtcgttcgtcccgctctcctccgtcgtcctccctgcccaccgtccccacacccactccccgccgtcacgtccttccagaaccacctccacgactcttccaatcccccgctataagacgcttctccactcaccactgcaaccctcacccagccagctcgagcgagcgaagccagcagcagaagcagtagagagaaagtagagagatggaggggaaggaggaggatgtccggctgggagccaacaagttctcggagaggcagccgatcggcacggcggcgcagggctccgacgacaaggactacaaggagccgccgccggcgccgctgttcgagccaggggagctcaagtcgtggtccttctaccgcgcagggatcgccgagttcatggccaccttcctcttcctttacatcaccgtcctcaccgtcatgggggtcaacaactccacctccaagtgcgccaccgtcggcatccagggcatcgcctggtccttcggcggcatgatcttcgccctcgtctactgcaccgccggcatctccggcggccacatcaacccggccgtcaccttcggcctcttcctcgccaggaagctgtccctcaccagggccctcttctacatggtgatgcagtgcctcggcgccatctgtggcgccggcgtcgtcaagggcttccagaagggcctgtacgagaccaccggcggcggcgccaacgtcgtcgcgcccggctacaccaagggcgacggcctcggcgccgagatcgtcggcaccttcatcctcgtctacaccgtcttctccgccaccgacgccaagaggaacgccagggactcccacgttccggttagtataccaactactactgcagtaaagattcagagatggaagtatttttactgttttctgagtgattgatttttgttttaatttgcgcgatcttccacagatccttgccccactgccaatcgggtttgcggtgttcttggttcacctggccaccatccccatcaccggcaccggcatcaacccagcgaggagccttggcgctgccatcatctacaacagggaccatgcctgggatgaccatgtgagtttaaattcactgaaaccaacccctttctccctccttacatgtagaaatatatatatatatatatatatatatatatatatatatatatatatatatatatttgacagttcgatttgcatcatctgttaatgcgcagtaacttaaaattgatgcacaaaggtattctaggaatatataggatagctggttgtagtaaaagaagaaccttgtatctgataactgatgccatatccccatgttgaaattatatgtgatattacttaactgctagcaataattcagtagctctgtagctgtagctgacttctataggtgcaagcatggtgaggtagcatttgttgcttatttaattatagataggcttagcttaacaccctcatctgaagggaaatgttgagggactagtttcagtgtagcaggcaactgctaccatctctgacaatgactcaattggctattactgtatgataagtctacatcattagtgaggacatgattgagcaatggcacttaattacaagcactaactcccgctgcaatttgctggttctgcagtggatcttctgggttggccccttcattggcgctgcccttgctgccatctaccaccaggtggtcatcagggcaattccattcaagagcaggtcgtaacctgcatcagctattatcactgtcaagatgccaatccagaccagctgtttctgatgggcgcggctgtttcccgctgcctgctttgttagtaattattgtggagtcgacgttcctcttcaagtttgttgtactactgtttttatctgaacacagacttgtaatttcagtactcagttgtgtatccctcttttactatgtgcaaattaa

SEQ ID NO: 46143 - DNA, 5306 bp, Oryza sativa
catcgagatcgtgatgctattcagcctactccaatctgccagcacacctgggctgtggttggcagcttgtggatggagtaacatctcggcgaattgaggttggtggtgacggccgagaggacaatgatgtgagtcattgcccgttggcaattggggttggggctgtgtgtgtgggcgctctggtcctaaacgcaacactacaaaaacttacaccgtggcacatgccgtgctgattgtttggttcttgcaaacagcctagctgcggaagatctctccccctttttaccttcccctttgtttacattttggttcatgtttgcggccactgcacggtggcttggtacgatgaacccccccgtgtgcccacagacagaccgcactgatttggccggaacctgaagaggaggtattgcgttgtttgcaaggtttcgctggctggacctctgtcttctggggaccgctccaatgccagcaaacggctcagtgaagaggaccagatcaccgatccaacataaattgcaagagataccgcctcgtctctgtgcatgtgggcttcacggatcatcaattcaccatgacctgatgatgataagcagctgctacattgttagctgcacggttcaagcttgtaagaactaagcatacaagtctcagtaacaactgcaagaaagtctacacattaattaggtaatggttatagtcttatagatagctcacggtgcagatctgaagaacatgtacatgcgggagaagctagtttaaccaaggatctgattctttgtataaatttccagagtaactggtacagtgaataagttggctcattggctgagttctgctacaaaatactttcagtatgcagtttgacttgcagcagtagtttcaacctcaggtgagatattgtgtgagagaggatactgaatggctggactgtttctcctgtgcaaaatcttggctcttagttgaggttcctctgtacaatggcatcaggacgccaagaagaaaatagaaaattaagttacatataaaggcaagaggagtatacatgcggcgaactactacttcggaggtccttcaatctgtagggtaccaatatacagtcttgtcatttgacagatgttagtacgccaattgtagtatgcttccgggagttctgcctaacaggaatggacgatatctgctatttacattgaacaaaattagtaagagctattggtcaagacaaacttcagtgtcctgaaaataaatataacgactgaagcaaaaggttcaaatgtggattctgaactctcaaagtgcctgattcacctgagattctataagctgctaacaggtgaagtgcttcagaactacaccgaacaaagattatacacagcaaggcagcaagataatagacagcaaggcagcaagccccatgccagcaattaggaaaaaaatgtcactagccagtagtgctaccatctgagctgggatcagagtttttcttttcttttcttttggccacgttgagtttacaagctcaggaaacaacattgtgagccatgttgctttgacgtttaaagggagtgaatctagcaactagaatgccaataaaccagttcttaatctaatagtaagtgactaaagctgcaaatgatgtaggacagtcttgacttaacgtataatagaaagttatgaattgtgacaagtgaccatgcatacctttgccaacttgaattgtgttgatgacaacaaagattccatccattgccaactttagcttctacagacattagtgattttcttttcctcatactatgatacacttcaagccatcggatggctaaaaagcagccaaaccaccagttacctttcgaagctccaaaaaatgccatctgaatactgattcttgatattagttaccatgcttgagtccaaggtgtggagatccagacgtcaagtctaatgaaggatttagtttcacatgatccacaaaggcatgatgtgtgaaacgttcagatggtgacagcttatcacgcaaatcaaaaacatttccaagtctctttccaaactgagggcttagaatgtcagcttcagataccaccctctcctgaagcccctgagagacttgatgcactcgaataaattgcccaagatcaggatctgtaggccggctggcaaagagatcatccgggcttcttgatgggattgcaaatccctcgttgctgtaggttgattgcttcagatggttaaaaggaatagcaccattaccaccagacagaggcgtggaggtgcctgaagtagttctggggcttgaaataggagaaggtgacattctgccattggaatgttgtggggaccttgattttagcaaaggacttccacatggagaaactggacaagatatattgcttcgtatacggatatcactgtaaagttatttaaggattagaggctgcacatatatagggaagttcaccgcaaatcattttccaggtaagactgagtttcactgaagagaacacaagttactaccatatggctagtggtgagatactcattcatactagtgctaggatactcattcaacttagattagccatttttttaacagataatactttgtacttgctttattgcacacattgtttggacttaggactaatactattaataaacacaaattgggaaatgatgtacctgtgttttgaagaaaattttgcacctcttctctggtaaattgtctgaccctccaatcccaatgaggaaatatttcttgtatgcgcagccatctgaaaactcaaataataccaagcaaagtgaacaggccatgaattatccatgtaaccatgttatgtcagttatggcagtattcaagtggtaccttggcgctcgatctacaagatataacagccaaatgttccaatggttcagaaagaacagatttctctagtgatactgctttttgaacaaatgggtgctgcaaaagctccattgcagtgggacgttgagaaggatcacgttgcaggcactttctgatgaagtccttgcctggctctgaaaggtgatctggtattggtggaagttccttgctatttccgatcttgaacattgcagcaatctgcaggaaagaaaagaggggaaatgttcatgccaaagttgcttcggtgaaacttccaagtctcattacgagtcaaaagaaggaagtctttacatttcaagcacctttcataaaattgcatgcaagtaaatgatctttcaacattctacatcagacagtgataaattcttaaagaattcatgaaaagaacatttccatatcccattcactcatggcgaaaatcaccataattaggttatctatattatagaacaaataaactgtgcctcagaagtataatactaaccccttcatactggctccatggcggtttcgatgtagccatctccaggacagtgcatcccaaactccatatgtcaacagctaggttgcacccatttgagttttttataacctgcgtatgtgttgcatagtatgtgatgtacagaaatggcaataagatatgcatgaaacaaaaaattaacaagtaaagattttcagtgatacctctggagccatccaatatggactacccttaaaggagaaaggacactgctgcccattgatctgcataaagacacatttaatacgtattaatgagtaaaatacttccacattatacaaaaggcattttgtaacttatcaggagtgagggggctagcaaggtttcaagcacccttaacagcagtactcaatcaatgcattaaccagtgacaggagctacaagatcaagttgatatagatactgctatatattttttgaagagctcgatataattcaaacagttgtgactatgatatgaggcatagatgcagaaatggaatgacacggaaaataaagttcaattgacaaaagtcattttcaaaaaattaaagtgggcagaaaaacttacatgttttgccattccaaaatctgcaagcttaacacgaccactaggatctactagtatatttgcacctttaatatccctgcaaaattgtgatgaacaggacttataattacaccataattccaccgatacaaacaaaccaaagaaaagagagaaaaccaaagaaattgctacctatggactgtattcttcgcatgcaaataagccaaccctgaaagtatctgctgtgtgtagctgcgtattgcttgttcaccaagctgtccatactcttgtagaagtttatggatagatccaccagatacatactccaagtatatataaagcttatcatcaacctgtattggggcacaaataataagtgaagccaaaaaagaaaatcaaaagtggtacataaataactcattaatgaaatcctagatgctatcatgcaacttcttgttacccttggtaaagggaggaaaaaaataattatataatgaccaaacaggaaacaataattgagttaatggttccaagcaaaggaaaacctagcctatgtaaacagactgaaggcagcatttataccgtttctgatccatagtattgtacgatatttggatgctgtaggcggctcaatagtgatatttcctgagaaacaaaaaaagaaaaacagggaatcatatattgaacaggaaaagacataatctgaacttcttttgcaactgtaggttaaagcacaatcaacagactatacctgccccaactgctttgcactttcctttgatttaggatcatccaagaatagggtaacttctttcatcgcacacatttcaccactatcactgatataaatggtaaaaccacattaggaggacaaatcattgtggggacaccgaagttacatggccccaatcccctcccccagaatagagaacagtaagatagccaaaatagagctatattccgagttacatggtgtcttagctaagatcttacaaaaattccaagatgcttagtatattcatagtacgtcatatgattttttaaaaaaaaatgaaatttcaaagttaggaatattcttacctgttaaagccaacatatacatgaccaaatgttccacggccaattagcttccccttcttccatcgtgacccaggacttggtggattctcagttctaccagggctgcgaggtactgaaataggactagttggagtggagttatttggatgaaatgaactgtgagagatgctcagtggtggtaggggaagtttgtgagtttgcttcttcttcccatcatcatgacggtttgttggagattcaggggccatccctccagaccttggatgcaatggtga

SEQ ID NO: 46144 - DNA, 7647 bp, Oryza sativa
atcatttccaacaggactctgaagctgagaatccccatgatcatcactatcagaacagttactagagggagaagcaaccactatttctgaaacaacctcactatttccatgcctcctcggaggccggttgggtttagggagtggtagaagcagtggtggcttgccacgtttttccaatatgggctttgattcagtgatatcagaaacagtccgagtcactggaggacgtactccaggaatagggaggggatgggcatgtggtctatcagctgaaaagctttggcagcgagaaacttcttttgacggtgaagtaggacgtgacactgtggtagatcggcagcttttttcaacagatgaatcattgccacgtctacaactccgtttcgacttcgtgcttcccttttgatcatttggacttatcaaccgatgaaatgtatcgatgaggttttcttttgtggttttcttagcatcttttgagaaagacttcccccaccatggtggcatattgaatatgaaataatttgtggtatgtctaattggctaggtactaatcacggtgttattcaagctgataattaccatattctgccaatcagattaacatgtgtagcgcacgattttcttaacaacccatatagaacccccagcttccgcaatgcactggcaatggagctagaagcagacaaattgatgaccacaaggtggtgtcaggcaccttctttacccccaaaaggctgaaatacatatggtaacagacattttagcatttactattaatgaaaaaattgcaggataaaaacaatgggttattccatttatgtttttcctaggtaattagtgtgattcaacaccagaaacagactgcccatagcattatgagtgttttatgattattctttcaactcaatctttaatcagtaaaagcaaccattgcaaactcaatgcaaaatgaactacaattataagaagaatcttttttattgcttaaccacaccaatcgcttatttaagccagtcataaattagataaagaaattatctccactgccatcaatcatccatgggagtgcaatatatcaagtatgttttggttgaatggcataacactgtgctagaaataaataatgtttcaaacttcactcaaggagttgtcaaggtcacagttttcagtaaaacacaacggcataatcggtggtgcctcctagaacttcaaatgtatcaccaatagtgatagcctgcgtgcatggttcagtcgctcattcacatgggaaggatcacatgcatattgtacaaggcaacatatacacctaaacctaaagtaggttctgttttttttttcttgaatacacaagagagttgcatatcatttcattaagagagaagaggaaacacgggatgggagctgaaacgcccccactcaccacaaacacatacaacgcttacatttaaatgacaccttacccaaccggggttagcgacctaagaaactcactgagtttagaggttccagccatgtaccaaagaccacactcatttgccaccgattggatgatagccaaagtaggttctgtttggaattacacattacattctataaagccccccagtatactgcataacctaaagtttcgtggcgatacatacaaaatacaccactcgtgatagagcaccaggtttctgggtgtaaggtgaacttttgcagctgaattacaatcaacgaaacccagtgttctgtttggccatgtgtactattgagctttgatgctgagagaattccatgcttacctgaaccccagttgattgcactacagtctaacgaactaacagcgacttaaggcctgatagttaacatccgcagaagaatcggcacccgtccacaagtcaaaccacagcagtcgcaatcgtaaactcccagcaattccatcgcacgagagctaagtccaagctaactctagtaccctcgagacgaacctacataagcgcagccagttaccacctctcgggagcaatcgattttgccctccaaccgcgcgctcagatctcagcacaaatccacacgcctcagatccacggcgagcaccccctttcacccacgaaatttaccatcccagcttcccagcccagcgcgagcagcagcgtccacaaccagaacccaccccccaaaaaacgaagcgagcagagcggaatggcaggaggaggaaggaggcgagcataccttaccggcgcgccaccacggcgaggcgagctcgccggcgggggggagatccgacaggcggagggaaagccggaggggaatctggaggcggtggtggtggtgatggtgcgggcaaaaggagaggaggagctcgcggaaagtgggggaatcggaaaggggaggggggagaggagggtagcaacggaaaaaggcccaggccgacgaggtgaggagaggaggaggcggttttgttcgaggagagtggtgttggcttgtgctgctcgctcggagaggagaaaggagggggaggcgacggtggaggtggaggtggaggtgggatcgggtgcggcacgggattccctgtggccggtctcccgccgtccgctaggacgatgtggtggggcgcagaagatcccgctggcgctttggggatttattctcctgtcgcctttaaaatttgtttttcgaaagctttttgcggatttatttcggcgcatcggggtagcaacggttctttttttccccctgtgttctgtgttcccaggcgtgctaccgcagtaccgagtacgcttcgagcctcgatatggaggggatgtatataaggcgccgttgctacggactacggtagcttcatcgagacggtccgtttctggatctaatggttccttgacctcgtctattttgatcgtatagaatttgatattttttttatacagagggaatacacatgtacggcgatcgctaatcggcgcgcgcgccggcggcgcgtgtttcaggcccatggggcccagcaccgggcgcgcgcccctccttcgacgttttttttccgtttttatgtagcgatttttttcgttttcttttccacttttttctgattatttttttaatctttagcatgatttgagtttgaaagttttaaaattttgagttgaaaatttttaaatctgaacttgaaagttttcaaatctcgatttgaatttttaaaaaattttcaaatctggacttgaaagtttttaaatctagacttgaaagtttttgaatctcgagttgaaagttttcaaatctgaaattgaaagttttcaaattttttaaatctggacttgaaagtttttgaatctcgagttgaaagttttcaaatctgaaattgaaagttttcaaatctcgagttgaaagttttcgaatctgagttgaaagttttcaaaatttgactttaaagtttaaaactaaaatcgaaaattttcaaatctaacttaaaaaaatttcaatctgttagtaaaaaattctcccaaaaaatctccaaaatcttttctaattactatcattagtgttaagtgtattaactgatagaggtagttaagtatactaactagaagtgttaatagagtaggttaataggcgaggagtgctcgctagccgcgcgcacgcgttagctaggaggcccccacatgtacaatgccatcagcatgcctatcgttactattatttgtgtatgagaaatgtttctaatatttttgtgttttaatacctttgttctaaatagacctttcacaattgtacgacggcaaacattttagattaactttttaacaaaatgtcaaagagcaattatgatgaactcctctataaatttttttgttggatctataaaatctaaaaaaaataaaaagagttgaatttaattggtgattcggtgtacaattaaaccgagtatagacgaaactagtagttggattatggatagtcatgcaaaagagtataactgattcaccggttttaaaatatcaacacgtggtagcataaccatgtaaggttatagctacatggtgcaataaaattggttcattgatttacggtgtgtttagttcacgctaaaattggaagtttggttgaaattggaacgatgtgacggaaaagttaaaagtttgtgtgtgtaggaaagttttgatgcgatggaaaaattgatagtttgaagaaaaagtttggaactaaactcagccttagagaacctaagtcagcaaagttcaagtcgccaagtgatggatcaaaataatcataacatctacaaaacttgcgccatggtatttgatgttctactccattgattatttaatgatggagatcacaaaacttacgcttatcttcttctcacttagtaactccagcgtagagcactagagccttagatgatcacgttgtgttttaggcaatcgtgttacactacaccatctatctctcacacatctacattctatcattgtagcgttgccatatacttagggtttgttcgttttagggaaaaaaacagaggatttgaattcctagggattaattcatgtgagtgtcgttcggtttatagcattaaagtataggaaaaccaaagaaaaatttacttttctacaagttgtatagaggaaacatggaaatttttccatacactcaaacttcttataaaaattcctatggattgatgtgcgcaaacatttatattctttcacttttcatgttccttcaaaccgaataagtcctcagcattgagaatgtaatattactaatggagaacttttgaagtactacactttcactcgctacacaaaagaaaagggatgtcatttcatcattcatcgatttaaaaaagacgcgaatattagagaatgatataatatcaaataattagaagggatgaggtttttaacccagatcatctagccaccatcttttggagctagttggaaaacactagacgtttcctccatcgttcgtcgatctcgccgtgatattttggctaaagataatggtttcattcaatacactaattaactactcctgtgtatttgcatgtactccgcgcgacagcaacgtcaggcgtacacatccaaatacccaatgaaagatggggaacggcactacggcagagaaggatatttttaaggtacccttagagtaatactggccgtccactcttatcgatctaatggacctgatcttcttctactgtcagtagtagtatgtgcagtagaaaccacgtggagggcaaaaccgtaaagaaaaaaacacagtaatattacgctttatcggtgattagatggaatgggctcgaaatgtgcggtgagaaggcggcggcggcgaaggcaggatgtgatgagatcggcatctatgtcgccgtatggtggccgtcgctcttccggccttcctctactgccatatacagatttaattttgatgcttgcactcgctggttcagcgcattgtggctgtgtcgcgcaagcccagccagacgaggtcagaagctgcccggccaggagccgttttaatccgcacaagctaactcgattgtaattagattcacatgccgttaatgaagacttaatcttgattcatgagtgatggagttctattacggagtaccagttaattcgtccgattttgctagatatttgtcatcaaatttctccccctaatatttgtcagatgtaattacagtacaatcgtagtgtaattacactgtaacttgcatgtaattacactgtaactataatgtaacttgtatgtaactttcaagaatctctcggtaacatgttatttcagtaaaatagaggtcgtgggaacaaattctttcatatatgtgtgtgatgtgatttttttcttcctccatagaacaaatcttgtaatagatctaacgattcaaaattacgtgaaacttacatataagttacactgtagttacatacaagttacagtgtaattacatacaagttacattgtaattacactacgattatactataattacatctgttatatttttagtagaaaatttgtcgacaaatgtataggtggtcccaattcgtctccgcgatggccaaaaattatcagacggcagctggaccagtcttcgatgcggcagtaattcgccggcagagcacacacaagaaatgtggccagcataatcggcgatgccgacgccgtccaacgggtcgcacaaatgggaggttgacccttccgggtttctcggcggctacaccggcgatataactttctctaatagataaatggtcagaaatacccttacaatttacaggataaagtaaaaattatcgtataaatcaacggtcagttttgatttatactaccctactgccatcgctagtaaaaggtactgtaaaatgacccgcagagaaagagctgtcaagcgacatcgccatcagcagatttcatgatcagccagtttattcattgaaacttggcaagttggtattgcaggtagctcaccagtgaagacggtgcagacagcagcagcattgaaacgccgattgcaaaaatgattagatcgacgaaatgccaaatgcatcgaagaaagtcctgagcgatctttagggtgtgtttaacgtcaaaattaaaagttgggttgaaattgaaacgatgcgacggaaaagttaaaagtttgtgtgtaggaaagttttgatgtgatggaaaagttgaaagtttagagaaaaaatttagagtgtttacatggaaagcgactgctgtactgctcatgttcatcgacatggtcgatcgatcgagacttccatcgagagagaggaagctagaaccgtgaacacccactacatgcatgcaatgaagtgtttgacgagtagctatcaacaattaaaatgcccaaaattaagagagattaaccaattgatcgacatgtttcagctctctgaacaagcaaccatccaacaacaattggcggcacattaacacaaaccgcccagacgaatttggacttgccagtttgggttacacacaggagattaattattaattattgctccttaattttggtggctgcacaaccaaaatcatagtactacatgatctaagaatcttaggtttggagttttctttagacatttcctctatcgactggtaatgaactgtaaaagcaagtgatttaaatgacctcaccaaccatacaaaccctttagtaattactatcttggactctcatctatctacatatttttttgccatttccaattgacttcgtccaacgcccgggatcttctaagcgcaggccgcggtggcgcgcgccgcggcggcgtactccccggcgccgcggagctcgtcgacgatcggggcgaggtcgcgcgggcgcacctccatccggagcccgtgcttcatgaacagcgtgagcgacatcttctgctcgacgcggtggcccggcgccacggccaggcggtggcggaggagcacgctgccggcgatgttcctcatctgcaggtacgcgaggtccttcccgaggcaaatgcgtggcccggcgttgaacgccacgaacctgaacgagtcgtgcggctcgaacttcgtgccgtcggccgacagccaccgctccggccggaactccaggcagtcgtcgccccacaccgtcttcatgcgccccgcggagtagatggagtacgtgaccgacgaccc

SEQ ID NO: 46145 - DNA, 1498 bp, Oryza sativa
tcgacggtggcgccgccgccaccgccaccggccgcggcggcgtcggacaggatgggcagcaggcggctgtggatggaccgcgacacccaccgcgacatggcggtgcgcagcgtgcgcgtggtgaactccagcgccgccgtcttccgctgcgccacccacgtctccccgtcggagttgaagatgccgtcgccgaggaggtccccgaacacgccgtgccagaaggggcccttggggtagttgtcgaaccgggacttgaggacgtgctccaggttcctcgggtcgcacgtcaccgtgaccagcccgccgcggcgcgccagcccgggcacggcgaagatgcacgtctggtaggtgccccgcgtgcggcggaggttggcggcgatccactcgtgcatgtcctccgcgtgccgcaccagccccggcaggctccccaccaccggccacaccctcggcccgctcagcccgcgcgacatcctccagaaccacgccatgtacgcggccacggccgccacgaccaccgcccacgtccccgcctccatcaccaccaccaccaccaagctaggctatggcgatcgatctataataagtgagctcacatgcatgggccggggcaagcagcgatagatagctagcagcaaggacgagagagtgtgtgtgtgtgtgactgtgtgagtcgccagtggccagctagcgcccctgacctgagatcgagagagagaagcgagacgatatataggagtagaacctgcccgagaagcaatgcgatggatggcaattaatatacagaagggaaaaatatatatatacagagttgccaggatgccactctactccagctgcaagtgcatgctcggtacagtatatatcgagcgtccgggcggaccataaatcgccggcaggggccgttgggtggccgtcgatcgatcgaaggcgcggcgcggccagtgcgcgcgcgtcgcttgcctgcctgccggtcgctgcggctctcacctacgccattcaatgcatcggcgggcggcacaccgaattgaagccgtgatttcaatggcgcgcgtacggccgccggttgtttgctagtagctcgacgcattttaaccgcgccaagttttaaaaggatcagccagtagatcgacctgttttacgacgctttccactgcgatttggtgatagtaatatgctctgaggtgccagtatcatgcagatgacggcagggccggatgcgagtagatggccggggggagtgaaactggccaactgaccaacggtttctcggactgtctgggctagttttgggactttgggggtgtgaggtggttttgacgaaggcaaaggatagggatatcatggtcgcctttggagcgtcagcaagcggaggcgtgtgatcgtgtcaagcaccagctagcacccgggttgacgatggtttggaggggttgggtcaccgaacgaccaacgtcccaacctttcacaaaagcgtatagctcccagatcgtacagaatgtcg

SEQ ID NO: 46146 - DNA, 795 bp, Oryza sativa
tcctgcagccccaccaaaaatgacagagaagctgccaaattccaaatctggttgcctaaacaagtccatgagtagagcagcacaggcctgtgtatttgttgatggacctttttcaactttgctctttgctgctcgggcattggcatggagaggatatttgcagcctcccgcagaccactgatgaaagcaccatgcattgttgctggataacgtctcgtggtggcctctccagcgaaaaacaaccgcccatctccaacactttcagctagtatgtcatagtcatctccagatgctccaacagcaacatgagaatacgaacctagactgaaggagtctgtgccccatctagtacaaacactctgcagaggatctgggacctcaataccttgaggttcatagatacctgagatacacaacattcaccttttagacaaaaaaccaaggttttaagcagtcgaacctattgtaacaacatactacatacatgtctacatatatttcagtgcagttgcagaggtatgaggttaatggaacaaagagtctgttgcaacttgcaaagagtcacttgggtgaggcatattgaagtaccaccttatgcatatagtcatatagtgatctaaaatacgatgatagattttacatcgctagatgaccatttacataaggtagtaaaaaattctgatggtagcgtattaaaaaaaaactgatgataggagataaaggtcttacctctcagtatcttgagaacagaactgacagcatcagtagggggtgtggtttcaaagttgtgggcag

SEQ ID NO: 46147 - DNA, 1829 bp, Oryza sativa
atctgctcttgcaccgtcaatagatagcttcagaaattgaccttcgacaactggaaattgaaacagcctcttgtaaccaattgttgtgccttcaacaattgtttgccacaattcatccaccaagatttccacacggaacttgattacacgttgtcccatctggataggctcctgaagctggatcacattgaatgaagcagattgtccgagatcaaagagcatttcccaggagctctgcccttcctctggagcccagtaagagtatatgctttcctgaagaacattggagggtgcaaactgctgattgccaaggccaccgcgcacggtgcttgctgtgacagtggcatttgcagcaaaattctgagagaaaattgtctgccgaatctcagtaaattcctgaaggacttgcatatcttcagtagaaattaagccagacgaatttggggggacattcaatatgagtaggcagtttctaccaactgatttgtagtatatgtcaagcagagttgtggcattttttggtttctctgaggcatgccaaaaccaaccaggcctgatagaaacatcacattctgcaggaacccagtcttgcccaaaaggatcaccacagcgtgaatatctgataatgaagttagcatcttagtaaatagactgttgaattctgaaatgtaggatgcttgtcaataacaagcaaatctctacctcatcaaaagtttatcaaatccaaaatagtccaggctgtagaattttcatatgagatgtaaattccaaaataaagatgaagcacaaaatatatctcatactagaaaaatgtaagtccatcactgctataattagttaatgagccaagggcaccattctaatttctgtactgcacaaggattcattgaactctgtggacattcttgtggctaattccattctctaagggaatgtaacatctaaagtctaaaccacataccactgaaactattgattgcactgtaaattttccttattgatgaggctacacaagaaattaatttttacaggctttgcaatagtagtctcttactcatgctgtcgctgtcacgcatgcacactaaaataatgctgaatagtagcactctaatcaaataatttcaacagcctattgtcatgagtaatcttccttaacttcaaagagaagaaaaccacattgtttgagtgttacaattagttactcatttgagaggtcatcattaggtacttttgcaaggacatcagtaattgcttaaactttaaacttatcacggcagacagttggaaggaatgcttggagttttggtcctatgcatgatacaattttatcttcccacaagtaaaaagttgtcttgttcccaaaaaatatttgcattacataattgaaatttccattgatgtgatttgggagaacaatttagataactagaaaagccttttaagaagttaggtactctgcagacctattagagttacttaattccaattctagcatttttatccaggggactagggatatgattgattaggatcttaatagaagtaaacagcactctgttttttccccagctcaataatactgttacttactcaggaatgatgtgcccaatcgtcaccgtgctcttattgaaaggagaccagcaagtataacctgcgacccctgcctcatctcctacccatcttgtatctggtccagcatctgagaagatgacaaccctttgctggagctgatggataagtgcaaaccaggcatcaaacatgtaatccatgtccttgccctctccctttgcaccatcaagccaaacttcctccacatctccatacctgca

SEQ ID NO: 46148 - DNA, 4735 bp, Oryza sativa
tcctgcagcccggaggccgacaagcaacccaagaagaagaagaagaatggtcgccattgtcactcggtgatccctcgatgagggtgttcagttcacctcagcgtggcgtagagttgactgctctatagtttctgttgttgccaacggctgattattgaagaattaagaacaccgtcaagaaatgattagctataagcaagaaaaaatcaggggaaatcttgtaaataatctgaaaacatggacacgagtaggggaatgaataattgtgtgtgatgtctagccggatttttaatgatgtgaagttaagaaagaaaaagaaaaagaaaaagaagaaaataatgcaatgggttaattaacagatgatctaatagatcacatacagtatatcactgcatataataccatccataacactaaatcattaattatttactattattacggataaatcgttatatcagctacatgtacattatattgatatgatgtggaacgattatataaaccataacccattgaaccattgttcaagtcaacttatgaaagaacatggagtacaaatagattagagaataatgctatatttttatattgtgggaaaaagaacaaatatattagagaacgttgctacagagtatttgttaatcgggttgttcactgcataacttaatattttcttcgagtaaaaatgttgctacagggtgataaatgatttaacttattctaggataacaattatggacaaaaattatattctattatcttaaaaaaattatggagagaaatttcaaatgatgtcgtcgttgacatatgaatcccatgcgatttacacattatatataaaactagaatattaattatacaaatctatctgaaataattatgttgattatctatatgccacaatttagtattaccgattactaatcgccttgcataccaaattgttcttggaaagtccaattatctgttacaaatatatgcataaacggaaatatatgttcactttccgtggggcacacagacgaacacatcgcgggggattaaccaggccactcgttcgctcgctcccaggagctcctccactcctcgattcccgaatcttcccgccgaaggaatgtgctggtgtgcgcctatcgccaccgcgcccgtcgccggcggccggttccctccgccctctctccgctgccgccgtcgtcgagggagatcggtccgcgcggacgcctccccggagcccgtcgacacgcagcggaagaaggtcgccgtcgccggggccggctgggcaggcctcgccgccgcgcatcacctcgtcaaacaggtctgctctcgctgctccgtggcgccggattgctcctgctgcattcgcgttctcgattcgtagcgggcaccgcgctcgttcgcattatccgctcgtgtgggcgcactcgcggcggcggaattttctcccaaaatttgtttccttcgccgtctcttttgaaacagcagtgacaaatacgcatctgccagtacgtggagcagagaagttttggtgggttttgttcttcatcactgtactttccattgatcagggatacgaggtcacgcttctgggggccgagagcggcccaaccgaggagattggtctcagaggtaaaattttcttcagctttcagtttacaactgttaaaacttggtgtgccagttctgattcagtaatccttgaatcgtggcattgcacatagggttttggtacccataccgtaacattttctcgttggtggatgagctcgggatctcgcctttcacagggtggactaaagctgcatactactcttcacaagggcttgcagtacctctctctctatgttttacttgcgaaatcgttttttcttcagcttgaatgccctcaaaattgtgatgtgcatggatttacctagtttgattacgaaacaaactagtatttttctctgtatattttagtagctttctgataagattgtaaaatctgaattacagaaggaataattttcttctaccatgtgcatattgaatttagccttatatttttgtggtaggtttattttgttagttttcttttctttcaaaattcctcataactatttggataacatgcacaaaattagaggatagcatgccatgttgtaacaatccatccccatgtatcatgttgtttcacgccgaactttgctctgaatttaaatgatctgagggacattattcttcctttaactctgatagcattgcattgttctgaccacttgcaggtggaatttcccatttttcatgaccagccccgattaccagctccctttggaatgttaacatatccagaagtatgatttattccgtctggatgtgttcgctgctacctatctctccagtcccaaccaccccatattctcatactatcctaatttttctttgttacagttcccaagtcttcctttaattgataggttgacatcgattcctgtcatggctgcaggtatgcacgtccatctgtccaggttctgtctttaaatgctaatggcctcagttctaaccacttatttgttgctttgatctagtcattgacttcaacaacacagacactgcttggatgaaatatgatgcaagtgaggaaatttagtacatattgcacaatttataagagttgacagctatagttatagtagatcatttcttcctcatgtcttattgtcatatttcctgcagtgagtgcaagagatctgtttaagatgttcggttgctctcaaaaactctacaaggaaatttttcaaccagcaattcaggccgccctgtttgctccaggtgagcaatgcagtgcagctgcaacactggggatgttgtattactatatgctctctcatcaggttctctgttctgtcttgcccttactttttaccccttttctttcttcttatcttcattcaaatttacgttgatcaacaaagctctttccaatgatttctcagaaattcccaaatttacaggaaaactctgattttttgttgtgccgtggggaagtggaagacataattttctctccttggttgaaatcactggaactgcaaggcttaaaattccatggaaacagagtgccaacaagtttggccataaataaggacactgcatgtatctctggaattgtctgtggagaggaggtacatgaggcagatgcatttgttttggctaatggactctcttcgctacaatatatcatcaagaacaggtatatacaagttacagaggtagtcactgcaagaatcttgggcctgtttcaccactaattactctcagtaacttggaagctaagattgctatagaaatacgtactgcttgaggaacagcacttttcttcacttgaaacatgtcttattttcatatatttgagtgcttctctgactattgaatttcttctatggagtagtccgtttctacagtctcggcaagaatttgttaatcttcttcatctgtccacgattgatgtggtctctataaagttatggtttgataagaaggtaatcgcaagtgacaaaatatacttcatttgccaagaagtaatacacattgttctcacatattttgtttttggtgatatgaaatgccagatcacaattccaaaggttgccaatgtttgttctggttttgatgatccatctaggtggacattctttgaccttacttcaatatatgatgattatgctgacaaatcaacaacaattgtggaggctgaatttgtatgtttcaactttaaatcaactaccccataacaaattaaagcacttccttccaggaggtatcttactgttatcaatctcttgttgcagtacaatgctagccatttgctgccactgaatgatgagcagatcgtttctgaggcttcatcacaccttatcaaatgcatacaggattttgaggaggctaccgtgatccaacaattggtcagaagatctcctaaatctacaatgcacttccttccaggtaaagtcaaactttaaccttattgcagtacaagtgcctacaggaatattgctcttgatgctctttcttcgtgggaacgacccgtgatgacaagacttacacccgtgctagctcgttaaactgcatcatgcttgataaaaataatcaagcattggttgtaaaatgattatgtgatagggttccataatcagaacatacacttgtgatctctttcagtgcacagttgtacactagcatctttagtatttataaaataacgctctaatttaccttacactgtctttcttgcctcttcgaaatacctactgtgatgcatatgccataaaaattacattacatgcaggttcttacaagtacacagtgcgaggatcaactaccttaccaaatttgtttattgctggtgattggatagtgaaccgacatgggtccttttcaaaggtgaccgagtaatatgtcacacaatgctttggagtcattacaaatttattcatgaatttagaacttttatgtaggaaaaggcatatgtgactggactcgaagctgctaatagggtggtggactattttggtgatggcgactttgcgaaaataattgcagttgaagaagacgagcctcatatagagacagcacggaatctcaatagaagagccaacgaattaaagactcagattcctttctcggagttctttctctaatcacataactgggagcttttcagtatgaccatgagatttatgctctacaactcatt

SEQ ID NO: 46149 - DNA, 8800 bp, Oryza sativa
  unsure (1)..(8800): unsure at all n locations
tgcttgcagcatatactcgaacatgtctatacaaatttattcacaaagagaccagagagtttcctcaggtttgtattcctttcctcatcatttccacaaactcttcatagtcaattctcccgtcctgtgaattcgatggaggaaataattaaatccatgggaatgaccctaattagtgaaaataaaatactttaggtatgctttaccttgtctttgtcaacttcatccagtacttgtttaatgtttgcttcatcacccattccgtactctgccatggcttgttccagttcatctcttgttatgtacctggaattgtttttcatggtctcttgttaatatatactgattttttaacaaacgagtttatagcaagaaaaatatgatgcaaggaaagcatgtgttagacatcgttacacaatgaacatgattgttgcgcagaacaagttccagtgttggtcaatttagagctctttattcatggtgctgaacgagataaaaggatgtgcattggctaacaaaatttattttacccgctgttatctttgtcaaaatgttgaaatgcacgaagtaaatcctcctccttttccagtttatgcttatttatcatagctgtgaggaactccgagtaatcaatgctgccactcttgtctacgtcaacctgtaccacagtatcactagtaaaatccttttgtaaactaaacctgcagcgaagagttagcaaaagcaaatgatcttactgcttccataagcttctgaacctcggcttcactaattcttgatcctagctttgtcagaccaaccttcagttcttcaaccgtgattgtgccacttctgtctgtatccatgttattgaacatctgtttcaagcccttgatttcctctggtgataggttctctgcaattaccttgagatgaaaggaggcagcgtgtcaatttgattttagccaaagcatagtagttatccctgttaaggaggattctcaccttaagagctaattgctttaacttgttcattgccttgaattgcttcattcttgataggactgcgctatcgataggtctgtcagatgcaccgccttctttgagccatcgatgttctgcagcatggagacatccatttaaagagttggctacactgtatgtatatatacagttgcagataaattttacattcataaccgcagattagaatagcgaaacacaattcaggtgtgctacctaaggcctgcgatgcagtaatcctcttctggggatctctatgtaacatttgtctgataagatcctttgcactttcagatatcgaaggccacgggctggtactgaaatcaacttggttgaccagtatagcatcgaatatgcctttctctgtctctgcgcagatattcaaatttgacaattatctccacgatatacttgatagaatgtagcaaaattagccaaagagtaaatatgtactatggatatttacctgcccagaatgggggcgtcccgcatagaaggatatacaatatcaccccagcgctccagatgtcggcttctttcccataatttcgttgtaacacttctggcgccacataataagcacttccgacaatgtccttgtacactttacctgcatttgttgttttgttgttggggaaattttaccttagcttgtacatatcttgttatggcgagctaaggtacgtgcattatctctcgcaagatctttcaacatgcatgatcgatgcatttctgcatctgctttgatattgtacgtttctactctttagacccgtgcatttctaacagccaaattaactcatggtgttgataaaggggggaaaagaaagaaagaaagaggtagtgtagcttatgtgtgatatcgcgaccctgaccttcttcgatgaagacggagagtccgaagtcgatggccttgagcggcgcgtcgtcgtcggcgctggcgagcaggaagttctccggcttgaggtcgcggtgtatgacccccatgaagtggcagacgtgaacgacggtgaggatgtcccggcacacggcagcggcctgccgctcggagtagctccccttggccgtgatgcggtcgaacagctcgccgccggagcagaactccatgacgaggtgcacgtggtcgttgtcctcgtacgcgcccctgaactccgcgatgttgggctgcccgctgaggtgctgcaggatggtgatctcccggcgcacgtcgtccacgtcggtgcgccgcaccagcttccgcttcgacaccgacttgcacgcgtaccggttccccgtcgcgcgctccgtgcacaggtacgtcgtcccgaactgcccgctccccagcttccggtccagctggtacagcgaccgcacgctcaccatcgccctctgcagcacggggcccatctccccgccgccgccggacgccctccgggacagcgcccccgccgccgaagacgagcccgtcggcggccggtgcggcggggccccgtgcctcgggaagctcggccgccgccacgtccccggctcatcgccgccacgcgccttgctgcgctccgcggtcgacgccggccgccgcatcgtgcccgacgtgatgggtatctcgtacgtcttggtgaagcagttgcccattgcaaagcctcctcgtttcctttccttctcctggggtggcgccgagacgaagcgagggtggaatggtgagttgggtttgggagaacgaggagccgaggttttgaagggtttctctttctctgcgcgggcggtgggcggcgggagcggagttgcttgacgtgatgccctaccccttcgtttcgctgtttgcttttggtccgggctttgagctttatgccttgtttggttatctccggagggaaaggaagattcaaagaaagcctcgggatcacgctatctcaccttatgcaggcagtacaatatacttgcggcggtgcgacagccgattttattcggctttggaggtgtagaaacacatagcactacgtgcttttattgatctagcaatagccattttacttgagggatatgctgtactagctttcggtaacatcgtcagaatcaggcgcaggcagcactaacaaagtacgccccttttcagaacggaatcaacagtgggccggagtaatgtgacgagccaagccggcccagaagatattccggcttacaaaactcagagcggaatcaactatgggctggaggtaatgacctggtaagtctatcttgactcaaaaagacgttttattaacatggtggcatgtgctttcacggcttctggcctcagcaagcggtgacgcgcgctctggcaatcgctaacacccggagccgcctcgcccgccgcccgccggtggcgccccgcgtcgatcggctaggggcgaggggctcagctgatgtctacgctacgcgagagagcgggcggatgccacctcttccactactaatctctttcagcggcgcgtggcctgagcagggagagtagcagacgcagcagcgccaacctgccccgtgacgggcaccgcgcaccatttcggaccgatatgccgtgacgggacgccgcattgcgcttctgataaagcatccggagagtcaaactcgattcggaagttcagtgtacttcgtcgcccacacggatgggttgggggcatgaatccgaagtgagatcatttccatgggaaaagaggccaaaaagataaactaaggaaatagtccattcatgtgtttctctccaatatacgtcataaaacctttttttcttctctttacggatatcaatatacaaaagttcctttgaaggctagcatatgtgtggtgtttgcagtccaaggtaagaaagtacagtaataagtacccttggtgaccgaccggtacagttcttcagttatcaattcttctcagattaaacagctgtggttgtatataacaagtaaactggttttcagaattgcagcactagagtggtgtgaaggcctgaatgggttcatcatgattcttgatgcaaactcagtctaggtctttctttgtccttaattaatatatatttgtgaagacctaacttcgagtccagaaaacaaaaggagcttttcgttgtttcttttgaagcctagtaacaaaaacgaaggaacactgtgttaaaccaaaactaaaaaggaagaatatgtgaaccttttgtatgccggtaaggccgtatggaatttcaactgcactcgttttcaaattaatagatgtggttgactaagtagaaaaaagaaatactagtatgctgatgcaagctagtgtgatccaggggttcgttttgtttcttgacacacgcttgagtcttattctttattaccccaaagcaccttcctaatcctacctattactttggttaactttagaagacactgactctaccaactaacatgtaagcaaacactagttgcataaccgttggttgagaagagtagacgagaagggacccagtctagtagtattcctctagaagattaggttgctgtagccatgactgtgagttgtgactaggttttttcagtgggcaaggcaacaccctacacatgaagccttgaagagttggtgtatatatatcagatgaccctgttgagcctgaacttacaatttagaaagaacaaggaagacagcaggtgacacctttgcggacacaccaaaactgccggccatagcccatattcccacaagaagatggcgatcccggtttacagcatcacaagggcagagatcgaggagttctggaggagaaaggagatggaagaagaggagcagcgcctcaccgccgagaaggaagctgcaagaatcaaagccaagacacttatggtcagttcttcttcttattgatcaatcgtaatttgttgtattaccaatcactatctcgtcctctgatcttctttaccagctcaggttcagtatggttcttagtcaaaaaaaagttcagtatggtatttagcatagcagataaatcgacgcatgtaaggcaataaaaatctgcgatgcagatacaggccaaattatcctaccatgaatttggagttcaaaaatactgtgacttgtggtgtctgaattgtttgaaaagcagattgaagattatgcgatcttcgagcaaatgataagggagattcttgaggagggtatcaaaggtgacagcgcaagggcggagagagacatcaccacgaacggcgccgctgccaccaagagcactgagggaaggattggcatcaaagattggtaaccgttctttctgcaaatttcctagagttatgctatccgttctttctgcaaatttcctgaagttgatatagcagagtgcgtccctttctaaatagtgcgtttccacatcctctttggaagttggataatggtccaatgtggaaaacaatctgtatcccactttccatccatttccacggttggatttcctgttacaattctatagtggaatttatagtcaagaagaattatatggatgtgagaattaagaacctaacaagctcaacgtgtagttagtcaaaataagaagcaacgcgttaagatttttttgtaacagttctaaggatcaagacggctattttcgtgtgcatgtgcaatcgcttaaaattctggtgcaattacgaccttagcatcctatcagaagtaatcttaattacttagtcttcaaaaaagaattaattaaatagctgtggatatgactgaccaccatcttgcctccctgggtgcaggtggagaaaaagcacttatgcttatctgaatgaaccagcaatgacatccacggatgagaacggcagaaggaagcacgccatcaaatacatcccacaggagagatgcatgaacttcttctcatcgattccaagtcaacataatactactacttttgcaatcttctaaatgggcaagccaatgataagctgaggcatattggcaaattagaaaatatgcaagtggtatatgcatcagcaatgctatgggtggaataaactacattgtttttaagtgtataagtatgtccaaactgaatggtactttaaagttaatcattttgtaaccttgttgccttgcgtggtatagaaagcaggccattttaacttattattcattgtaaaaaaaacaattttagttggtgcttgcaatgatatatcagaagctattgccaacacttctgtgatggtatcacgaatgttattcggcattatactgttcagcacacgtaacaatcttcttgcatatacactcttatctgtttgaattgattaaccttgcaacatcttatgtatacatcagttgtgcactgtatcttcaaatgtacaaaatatggccttcttgaacattgtttttattttttaaaaaaggctagttcctcttagagtaagtttaatagtatagcccactactagctccaaatcatctatagccaattcatacaatagttgcttactatactattaatactcggtcccacctgtcattgacatattacgacttagagtccgtgctgcagctggctacagatctgtagcctgctgctcttctctatcttccttttatctctttaaaatatgtttatagttggcatatagcctgctattgtacatgctcttaagtattactctatcttttttccccttcctgtacttgcttgaagtgtccagaggcaaccaagttctgtgaatacgagggatcaaacaaacaagaaacaggtaaaagaaaacaagtgtaagaaaacgaccttacaactaaaaactgatgttacatatctttgtcctcacttttgctaagataaagaaacagttctacctggaaactatccaagggataaaaaacaagttttctacacaagagtcatcgctagcatacaacaaaaagagtgtcgcctttgttattttgcagcgtactcggatgctgacatgttgttggctaagaaagtgcatagataacttcattagttccactaaattagattaccttggtggatgcttgagcaggtaggtagatagcagcaatcaaaggtgtctgctctgctctcctctgcttggcagaatttcattctgaattttcgctctgaagttagcagtgaccaaagcggagtagagggagctccacttcattttttttaacagatcaatattacaatttgaccaaactgaacctgtttgcccaaattggcctgttgcccgagcgtttctctcgaggaataagttcactttgggtccctctatttgtcgcccagtccgattttcatcccttgaccacgaaaccggatgcgacccgtcctccaacttacgaaaaccgggcaaacaaggtccctcggcggttttggctgacatggcgcctacgtggctaatttgactcagtcttcatctgacgtggcacttacgtggcaattcgatccggaaaaataataaagcccatgggacccacatgtcattttcacatataaaataataaaaaaaaatagtgggacccatgtgggccccacatgtcatactcatcccccctcatcttcttcctccctctccctctcccctctctccagcctccaggcgccacggctcacgaggtcacggggaggtccggtggtggcagctggcgacgcgacagccgccgccgccggcgagctccacctctcggcgcaaccgtgcagccgcgtgcgtttctgatcccgcgcgcgcgtggctgtctgacggcgtgggtggcacagatggattcatggatctatccgtagcgcccccctcccccccctcccgcgcgatgcgacggccaacgacgtcgctctgatgccggcgagagagagagagtacatcttcaactgccagcattaatttgcatcgagagagaaaattagcagtagcatcaaataatatcatttcagtttcatcgcaattaagctagctagccatgtgaggagtcagttcgatgcctcgatcgatcgtcggcgtcgaagaggggtcaagaactcaagattaggcgatcgattccatctgacacatcggctgaatcatacgagctaccgtcaattgagtactcgtactaacgtacgcgtgtaaatgctactgactgcatgagagaaactgtacaagtcctgtgcttacacaatgtactacggcctagccatgatctatatgatgcagcacaataccttttaattaattagtcgatcgacaagcgatccatgcatgcatgggagtaatttacaggcttcgagttcatacactgttgcattgcaacttgcgaaaaacacagtgctacactgagaatcaatgatggccatccgcagctaagtgatgatctgtgagcaattagcaattaccagttactgacgagaggtgagtaggtaaaggcattactagcaagaactgcatcggaacaaagttcattccggtggtcaaaactcaaaaccccagcgagctgaggcatgagagcgacgtcgccagccgtcgccgcctcgccgtcgtgtcgcggcggggggggggggggggagtncncacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46150 - DNA, 10680 bp, Oryza sativa
atcaatggatcgtggtctttttttatagctcacatcgtttgtaactttgtatcacttgttggaccggagcaaattctttttttataaaagagattttttagggtctaataggatggtgcggtaccgaatatggacaattgaatctccaatggattaaaaatggtggtactgtgaggtaccatcgaggtcaacgggtcgtaccacggttgaacaagtaagtgcaaagggcatcaacgtaattttgcatgggagtatagactggatcaacttgagtgcggcaactgcaaaaatctgaaacctaagtcgtcacttttgaccgtgcttgccctcttgtcaccgccgcaatccttaggtttagggcaccgccaccaccctttctgtactcctcacaagagtccttttcaccacaacaatattcgatgctgcagagctcatcgcatgtatcttcgtgatatcatcgcatttgtggcgctcctcggcggcgctcttctcgctacaacggtcatcgatgccacgaatctcactgcctgtctcttcaacggcgagcccgttggcacagtggaccattgcagaggaggtggggagatgtttcctttccagacatggcactggtgaagcccttgctacccctacgtcagcgaagtctttggagaacgataatggggttgacgactgtcgatgctacccatcctgtccatcacaaatggacggttagattcgatttggtacctcaaggtaccacttgttggacctatagatgatcataaggcctaaggccccacggcccgggccaagcacggcatggcatgactggtgttgggcccgtgtcggccagccgacagttggcccgtgcttgggccgatgcctttgcacggtgggccggctcggcacggaacgatcaaagaaaaatagttgaagcatccaaaatagacttaaatcaaacatataaggcatggtccaaagagaagagggatgcatcatagacttattccagccatatagacaacccaaaagagataagggacttattccattgagaagcaggatgggttgtcatgcttttgggccggccgggcacggcccggctgacctcggcccaggttcagttatgcctgggccctgtagggccgggcggcccgtttggctatctatagttggaccggagcaaattccctcacaaagaggaaaggagaatagtggtaatctcagaattctctatagaagtagtaatatctcccacggtaggatggcggaactcaagtcttgttgtgggtttccgtgtgtcgacggtgggtacccgtagaccggatatagagggtattggggtacactggtacgaggatctacgtagtacgacatcaaggaaacaagagacatagattatactggttcaggcccctcaataggtaatagccctaatccagttaatatgggattatatggagagaaccacaaattacaaagggaataaatggaactcgacgatacccacgagatcgtagtcgagttgattcgactagatcacccggcgacttggctcctgtaggctccggcttcgtaggctgtggtcgttgtgttggctataagattcgatgccttaggtcctcccaggggtcccttttatatcgcagatcaggtggtctccaagtaggacttggagacatcggaccctgcatgatatagtgatgacccagtcctatacgggtaggaacctttccattagtggacttcgtgatggatttccttagcgtatatagagaacgtccgtacgcgcgcagatgtaccatattaccgtatagcgtacatccaaaggtagagggtatagtttatccgtaatcctgacaccgtgtccaatgtatgactgttcgtcttattaaaaaaattaaaaaaataagttaggtataaagtattattcatgctttatcatgtaaaaacaataaaaataatattcatgataaaattttaaataaaacgtatagttaaacgttggacgtaaaaaatcacaaatacacttaaaactggacatatggagtcaaattttcgacacattttgctatcagcaacgggtttccggaggatctctgccccagaagtgggtcaaacgcacgtgagatcccgcgaagcacatcaatggaagaacgaaagcccctctccctttttcttttttcccttttccttttcttttcaagccgtaatgaagagatcgagcgagaggcccaaaatgaccagcacagtgcgccgccgctggtcgcggagatcacttccctccttccgagttccgagcagtctccggcccggcgcatgcatgccccgctcccccccacgcatatataatcctcgcccgcgacgctcccgcgcccgggtagcttagacgaccactgctcatcaccccgttgctctcgcgccgccctccccgccgagccaaaaagccttcctcctcgaaatagcacacctctcgccgccgctggtgcgtgcgtgcgtcgacgcgcgcgatcgatcgatgcctgtgtccctccggcgcgtccacccacgccagccggcgagcctcgtcggcgagtttcgggggcgctgattagatttgcccggtctcgatcgattgatcggtctcgccttcccgccgcgcgatggatccgcgggggaagggcagcatcacgtcgcatgcgtcggacaagtcgtcgcggtcgggctcgttcgacttcgagcacgaccaggacccggaccgcgaccgccgccacgacgacgcccaccgccgcgaggtcgtcgtcaagatcgagcccgaggcccacgtgccggtggacctccacgccggcggcagccacgccgccaacgcgccgggcgctggcggcgtggcggtggggggcgtggtcccggggtccgggtcggtgtcgagcgcgtcgtcctcgccaggcggtgggggcaacggcgagtcgttcagcttcaagaaccggccgccgcagtcgcccgcgtctccggcgatgagcgtcggcggggagggcagcgacgacccgcccacgcgtctcattggcagcttcttgcgcaagcaggcggcggccggcggcgagctggcgctcgaccctgacctggagatggaggagatgaggaggccgccgcgcgcgcccacgtccatgaacgcctccagggagctccgcgtctcgttccaagacccgcacaagcggttctccccgtcgacgtcgtcggcctccacctcctcctacgccggcgacagcaggaaccaggcttgcagcacagcggaggcggccgaggtgatccgctgcacgtcgatgtccaccggaaacaacctgttggcgcggagcaagacgcgttcccggctaatggatcccccgccgccgacgatcagtcaccccaccgaggcggagcgcaacgaccgcaagtcgttcgtcggcaaggggccgcccaagtcagggcagctccggtcgggcctcatcggcaagtcggggctcatcggcttgtcaggccccatcgggaagcccggcgccttcgacgacgacgacgacgacccgttcgtggacgagggcctcgccgccgacctcaagcgcgacacggtcgactgcctcctcatcctggaatgggtcggcctcatcgtcatcatgggcgcgctcgtctgcagcctcagcattcgcagcctcgccaacaagaagctctcgggtctccacctctggaagtgggagctcctggtgttcgtcctcatctgcggccgcctcgtctccggctgggtgatccgcatctgcgtcttcttcgtggagcgcaacttcctgctgcggaagaaggtgctctacttcgtctacggcgtgcgccgcgccgtgcgcaacgtgctctggctcggcctcgcgctcatctcgtggcacctcctcttcgataaggacgccaagcgtgattcccacacgctggtgctcccttacgtcaccaaggtgctctgctgcctcctcgtcgccaccgtgatccgcctcgtcaagacgctgctgctcaaggtgctcgcctcctccttccacgtctccacctacttcgaccggatccaggacgcactcttcaaccagtacgtcatcgagacgctctccggcccgccgctggtcgacgagagccgcatgctcgccgaggtgcagaggctgcagagcgccgggatcaacatccccagcgagctcgaagcaacggccatgccgagcaagccgcccatgccggccaagagcgggcgcctcacggtgaacccgtcgaagcgaggaggagcaggaggtggggccaacaagcagctgcagaagcagaaatccgaccgccattgcgacgacgggatcacgatcgaccagcttcacaggcttagccagaagaacatctcagcttggagcatgaagaggttgatgaagattgttcgttacggggcgctgaccaccatggacgagcagatcaagcatgcaaccggagaggacgagctggccacgcagatacacagcgagtacgaggccaaggttgctgccaagaggattttccacaatgtcgccaagcctcactccaagtgagtagcagcgcaccagtgctacacctgtttttcatgtacaaaatcttgttatcaaatttcatggctatatgcctatccattcctgaaatgtcaacgtgttgcaggcacatatacttgtcggatttgatgcgtttcatgaggcaggaggaagctctgaaagcaatggatctttttgaaggcgcacaggagcacaacagggtcagcaagaggtcactcaagaactgggtggtaatgatattgtcaatcttgacacagtcacagctccttttaatctgagagacacaaaatgttatgcttaatctgtcatgtgaactatgcaggtaagcgcgttcagagagcgcaaagctcttgctctaacgctcaacgacacaaaaactgcagtgaacaagctccaccagatggccaatgttgttgttgtggttattgtgattgcactatggctttccattctagggatcgcgacgtcacgcttcttcgtcttcatcagctcgcagcttcttgttgcggttttcatgtttggcaacactctgaagaccatctttgaggcgattgtgttcttgtttgtgatgcatccttttgatgttggcgatcgttgtgaagttgatgggatgcaggttacaattcttttcattgttctatctgcattgtatgattgcttcacactgtctgacttggttctaaactgttgcgaaattcaggtagtcgtcgaggaaatgaacatcatgacgacaatcttcctccgatacgacaacctgaaggtctattatccgaacagccagctcgccatccaaccaatcatgaattactacaggagtcctgatatgggagatgcagtcgatttctctgttcatgtcgctacgcctgtggagaaactggccctgatgaaggaaagactaatgcagtaagtatcaatgcattaacctcagtttttattgtcttaaatcatttttctcctgaacattccatgcacaagaatgtactacattgactgctttagggttatcaatcatgtcatttgaaatttcagttaccttgacaacaagaaagaacattggtaccctggatccatggttgttctccgtgacgtggatgacacaaacaagctaaaggtatccatatggtgccgtcacacgatcaacttccaagacatggggatgagattcgagaggagggagctattgctccaagaaatgatcaagatcttgaaagatctagacatcgaataccggatgttgccactcgacatcaacgttcggaatgcgccaatgatccagtctttgaggatgccatcaacatggataacgtattaattcttcttgaaatgcagtaccaagttaaacatgcctgatcagttcagtgatgagattatggtttgaagttgctaggtaggcagccgtatttcttgagtaaggtgacgtagtactgtaactgaagtgcccttctcctttcctccatctccttcttgccaagggcatattcggttgagtggattgagctgtgacagcttgccaaaatagcaagaggccgtcttactgtccttgcagccaccgcttgtgctttcctgtaactgtagtgttatgtgtttgggtacttcttatgagaactttagacatgttgctacttaataattttgatgacttaatgcatcaaaagatgaatgcaattttgacagcaaaatacaagaatatcgatctaaatatctaatgttagcttgcagcatacagtactagatctcattttacctggaatttttatgctctctggataggttaagcaggcattggcctgtcttaacaaaagaaggcagatgcttttgtttcctgtttttgccctggtatttgcttcgcctagaataaggttgagaaggatttggcatttgcatttacaaataggcatgcacttctttgtttctcgaataaaaaaaaccagttgaaactgggcagcatacatcatagtgctggaaaaggggaggcaaccgtagtaaaaatagataaatttaagatgaaatggttcatttacaaaggcgacctggacactgacaaaaatgaaacttttttattaatattgtttcggggaaacaaaaaatgagcgttctgtcgttcgacacaagaaaacagagaccagaaggtccagaacaggtgttaccattgaactctagacaagttcgttcaaagttcaaacaaaataaataaatctctagacatggaaggctcgacgctattaaattccacctactgatccttggacctgtggagaagttgccgggcgcggacgcgtacctgaagccgcacgagcaccttcatgaaccggatggcgacgcccgcctgcttccgcacgtacgagccccgcgcgagcgcctgcagcttcaccaggctcctcagcgcgcgaaacgcccgcctcgcctgaaatgaacggacacgcctttctgaatcatcgtggcagcctttgcagaaatgcagcggtaaatgcggccgggttaacgtgcgcgcgtaccaggtgaccgcggaagccggcctggatggtggccgccgcggcctcctctcttgagatctcctcacggttgttgacacctccgtcgcgcgctcctttccccacacgacgcgcagccgtctgacgccttggttcgacgacgacgatgccggagtcgggtgccacggccgtctggccgcacggaggagaccgaccgaagacacgcttcatcccgctcatcaaccggcgtaggcgaggccgaggcgtgggccgcgtctggcgttgccgagcattatcttcacgccgcgtgccgaggcagcagaggaggttgctcctggccatgttcatgtggttgagatggcggcgatgctttggtggagacgaaggtgtgcagtgtggttttgggccatttttggaggtgctccaaagacacccgagtcttggtggaaagttctcaaacaacgtggcgggatgaatcccaaccgacgaatcgcgtgcatcttgatttcttgaaccggatcttttctcatgccgtattattttagcgcaaaaataagttcccgagaatctgacaaaactcggaccatttcatcttatcattcgcgcacttcccgccaacactccgatttgtacagactttccagttcccaggtacaccaaaacagagcagctataatggtcatcgaaaccagagcaactaccggtggccgcgactgacgaccggtgcccactaggaggcgcagcgcagcgaatgcagtgacgcggtggtgtccatggacgcggcgtcgaacacgccgcaccgttcgctcgcctcgatgccgtagtccatgagcggccgttgctcgagctcgtcgtcgtgccggcgcaccgcctccgggacgtccagctcccccttgcgcacgtgcgcccacaggtactccaaccggctcacgtacctcagcttcccatacaatcttcaggaaaaaaaaacaataacacaaaaatcgcttagtaagcaaatcgatactccctccggttttattttaattgacgatttagacaatgatactctctacaagatatacctttcccttatttttctattataatatatacaataaataaatgcatgtttatttttatatagtattttgaaagacaaatctatatatgtttttctagtttttttaaactaaatattttgacagttattgatgatcaatattataaaagtttaacctcaatcttgtccaaaacgtcaattaatatagaaccagagtgagtaatctctagtacggcctaacatcgcgcgtaacgtatgtaccctgagctgaagaggaaccggccaagggtggagaagaagaggcgggactggagccccgggtgaaggaagtacacggcgtgtagcctctccctgacagccgccggcatggactcgtacgccgtccggaccgcgccgacgccggggaagttctcgcggcgatccacgccggagtgcatgtacaccaccacgaactccgcgtccccgatcgccggcgtcacccgcctccgcacgtaccccttcagcgccgcctccgcgtgcccgccgccgcccagctcccgcgctgcaacgccaacaaaaacgaaacacccgctcgcgtcacgagcccaacacgaacgtactggcgtgtgtgacgtgtttctgccaccgtaccagggaagttcttgccgacgatgcggacgatgggccggccggccttgtcgcggccctggacggtgatcacccgcttcttctcgagcaaaatctcctgcttggtcatggcgtccatatcctctctggactgttctgctcgagattttcgcttcgtaaaactttcgtacgagcgagtatgatgccgtgatggtacgagcgttgttggggttaaataggtcagcgtgcggtgtggggacgatcagatcgagagctgttggatcagggtgaggtttggggacgggagacggacggccaggatggcttgcggtgttgggaacgcgtgccggcgtatggggtgggggccgcgggatccggcagaatatgcggaggatccgtttcggctgcggcgcggtctgcgtctcggcacggcgcgcgggagcggggcgtctggccacgtcgcggtgcacccaggtctcggcgttcggacgcgagcggggggccgggggctcggtttttcgcggcgaaaccgcgaaaacgctatatttaagttctgggtgtcaaattttccgctacagctccacatcttcttttcttgaaaaaacaaacactgcagtgtgtatatactcactcctataaacgcatatacgcacactttacccctaagtactcgttgtcgatgggtatgtcaaccactgaaaaattaattaactgtaaatacgatcacccgtgtaaaatatagtatttaaacccgggtggattggttccactgcaaagaaattaaccagttgagataggctcacttcgctaactccatctcttttaatagtgaagcccaaccaaacgatttcagctccacctaaaaaggtgaaccaggttgaaatactctcacaaaatgagttaaagttatagagttgtttttaggctgcttcacaatttcactttagacccagctcctaaaactaaatttagaagttaaagtcctaccgaaagagtccttagctgtcagttgccaatcacttttgagagtccatgtgtacgtacgaactcgtgtatacatataaagtttatacacgtatgtatgtgtaaagtatatatatgtatatataaaatattttttataggtctaaagtgtacacatacatgtgtgtgtaaaatttatgaatgaattttagaaaacttcacgttttatatggtaaaagttaaaaaaaacactgcacgtattataacacgtggtagatttttaactccaaaccctcttgggccatctcacagctagctattcgatgagggcctttgcggcccatataagcgatccgatggtgaatagtttgtggaccccacatgtcatgcacgtgataggttgcgttggcttttatatgggacgtaaactttcatccccgcctcgtttcctcgccgatgggcgatggccatggctgacggcgccttctgaaccattaaccaaccggttccacctcatcttggaaagaacgtgcagagcccgttcgttcacattggcagcctagcaggcaatggaagtcgccggcgatgtgtggttccctacctcctcagattgtgcgttccatggcatcgatcattctacggcggcaacggacacatggagcagtcaccacctgctatacagcgatgcggccagtacttgaggggaacagagcggatcagcggatagaaggtggcagactggctgtcaggatgcgacggcgctgcggtcaagcacgtcatgaagtggcggcggtgttcttgtaatcgacggcgatccatgccatgtcgcatccggacgccggcgccaacgacccctccccgtcccccaccccggccgcgaggtcgtctctgtcgtggatcttcgtgggacgccgacgacacgcggggtggacgacggcgagggcgcacggggtggcctctctctccctctcccgctcgcgtctgtccctccctctctctcccgttgctggcggccgcgaggtcgtagctgtcgcagatctttgcggggccgctatcgcagatctctggagtg

SEQ ID NO: 46151 - DNA, 3376 bp, Oryza sativa
  unsure (1)..(3376): unsure at all n locations
ccgccaccactccggctaccgcccgccgccgctgccaccgtagccgtctccgctgccactgccgcctcctctttcgcctccatccgcgccagcaccaccccaaagtgcctccccaccctctctcccgatgccaccactccgcccccgtccgccgctccatcacccgccaccaccgctccaatcccattcctcgcagacgaccgacgggaagagaaagagagagacataaggggagagtgggagaaagaagaagggttggagagatgatgaccatgtggccccacggtcagtgggtccattgtattttttacgtgtaaatgacaaatgggtcccgcatatctatttttaattctaatattacataagcgccacgttaacaccacgtgggacgaaggctaagttaacaccgccacgtcagcgaaaccaccctctaaaaccactagtgcagtcaaattacaccggtttcaatagatcggggagtcttcttatccggtttatggttaaggggtacgaattagattcagtttacttttaagagagtcaaagtcagtcgactttttccttgtttttaactccgaacctccttgtgccatcttacagccgttcgatcagagcctttgcggcccagattagggcaaattgagttttgggcttgaagttaaactgtctcggtaaacactgggccgggagagggcgctagtcaccaaacaccaggctgtgtcatagctcacgtgcctctgttacatgtagggcaaattttgctacaggacattatgacttcgtagttttagctccaggacaccacacaaagtcacttttggggtaaaacactctcaaaacatgttatttgccaacagacaccgcgtccattaaaataataatttctggttaaagaggagagagaaatcgcgtgaaatgtcaaaattacccttgggcccacatgtcagctctcttatctctcttcactctttctccctctccctctcccctcccctctcttcaccgacagggagccgaagctcctctctccctcaacctgcaggccgaggaggccatgtccacaccgtccccacacgagcggcaactgtagatacagccagtagcggcggcagcaacagcagcggaagcagcaaagagcggcggcaacgacagtagcaagagcagcagcggcggcggcgcgacgagggtggcgctggcataggcggcgcgacggcggaggacggagtcgagcatctcgtgtcggagcatggggatgggggcgctgggtggtagcgcgtaggagaagtcggcggcgaggttggatggcgagaggacgcgcatgcgggtgacaaagtggttgacatggacatgcgggatggcgaactcgttgagcatgcaaagcgggatggcgccgccgcagggcttggcgccagacgagttgcgctcgaggaggaacgcctagtctcccacgaacgccaacgcctctggcgctgacgtgccggcgtggtcgccacccaccacggccatgcgcagcgggcaacacaggtgtggtggagctcgagcaggagatcacgaggcgacgtcggcgtaggtcggctcgagcaaatcgtactcgagcacgcgcgaggttgcgcgtggtggtgacggaacatctccttgtcgagttcgagctacgcgagcacgttcgttgctgatggttgttgccgatgcagcatagttgatgcccagcaacgtcgacgacgtcgcgtcggccatgtcgggagcagcagcgaaaacatggctccggcctccacgcnccgcctcgccttgtagacaaagagctaacatggaaggaggaagatacaaagagaaaagaagagagataagtgttgacagaaaacacgaggcctgggagatctgcttaactccagtgcaggtccaaagctcgccttcgagtgttagcgtgccagttgatttgatcctgtaatcaacaagaaatagaagcaaagaaatcgcgattaaatctataaatgatagtcgatcggctaggtgccgatgacatatcatttatctttgagccgatgacacatatgtatcgatcggcattcatgaataaataagaaggaactaaatctaatcgatcggctgtagataataacaatatatactccttatatcgatatatacttaaatcaagtgattgggatagatcggtcgccatgccgagacaatataaatcacttagatcgaaatatatattaataatgggactatatatgttcatagcatagtcgatcagatagatctagcatgtatcggctaataccccgataccactctatactaagatattaaagcaggtagaatacatcaaacaaaagcttaatatacttaaatgcattaagatcctaaaataaacggtagatttaacatgtcaataaagcatatagggcaaatatagttaaatcaggtaaaatcggatgaaactccaatactaccctaatcggcaaccaaaaggcatgctatagattgatattctaagcacgacttaatagatcaaactaaactgatacagcattaagtatgaaaagaagaacaatatctagacaatcaagccgttggaagtttcatagagtggtagatatcttatataatctaaatcaacgtcgcaatctaacctaatcggctgccctctaccgacagatgttagccgattgtagattaaatagcggtattgccggagattatgtaagatatatgataactcgacgaattacagaaacgagatcagagtatcataaagatggaagcactaatcccgagaatacaagtcgtcataacaagttttaccttttgttgaagatcgaaaccgatgcagttcaacccgaaatcaagaactcgtcgaaataaaactaaagcaaaaagggtggcgatgcgccgaaattgtattgagcgtgtgtgtgttcgtcccaagttacatagggctcgggtctatttatacccgagaattacaagatacgtccataacggacacgactattatctctaacaaactctaagataccataagtctttgcggcagagtcttgcccaaacatatctctaaggaaattacttaaaacatcttaattaatagatacaattgcctcctcaggactctatccatgtgcggcaatcaccttgaagcacctcaactcaacccgatgatgtgcaccgagtcgtattcttggaatcagctgtatcggctagccctgtctgactcgaactctgccgatcctgaccgtagccgattcagattgtagccgatttttgctctgtttccacaacgatcttcgtcttcgatttcgcttcgatctaatattcttttccgatgctgatattaccaaatttggtcgttaacatgtggtcccaagggtag

SEQ ID NO: 46152 - DNA, 2252 bp, Oryza sativa
gcctgatgaacgtgtgttttactagtagttctaattgtaacccgtagatcctcttcctctaaacgaaaagctccttaagaaactccctaacacttgggtgcatgtaccgcaagtccagaactaaacaaaaatgacgggggatagtgcacgatttgtcaccttcctctaagcctgacaaaaagttctgcataccagataaatcagctaaacaattagataccccaaatctcaaacgcagttgatgatgaggtgaaaacgagagagattctcactgtacatcagtacatcctgccgagaatcttgacagtaaaatgtatggctgcgaagcccgaaggaggtaataacaaaactagtaatcccaacaaggccctgacgcctgacttttcattgagccgtggtctccgcggtgaaagcgacgactccttttggtatggcaacattcttacacccctatggcgacatcctttgtagcaagtctgcaggagtgtgtggtctcgcactctggcctcggcctgtacaacgtatcatttatctcccttttttttagagcaaatcgaatcctttttttcctgcccacagattcgcacagctaaaagcgaaagatgatgtataaattacttagtacgaaactctgtctgtcatttggaaatactacttttttctttctttctctcgctctatctgcaattcctgcatttatcaaactgcctaacctctttacgtgcagagaaaaagaaaatgccccccacgtgatcacatcctgcactctatattgacggcattatatcaaacatcctgtacttcgttgtcatcgtgcgacttcttcgcgttgtgagttgtgacccgtgaagaccgctatatatacacacgctactagcccctgttgcattgtatacacatattcattgcctcattggtactttggtagctatgggctccctacccgccgccgacaagccgttgccggcgctccggtaccctccggctcgccgcgacgacgacattgtcgacgactaccatggagttaccgtgccggacccctacagatggtgagtgtcttgtcgacggctgtttccgttcctctgtaatcgattctgtcctgttttgagaggcactctgtttgttacgttatgttatgcacatctgctttttctgaattttaccctttttacccggcttgaaccatttctctgttcgtgcaacatgaaaaaacatagttcctaaattcatggaaagaagtactgcttcaggataagagtgttagaattcctgaggttcagtttttttttaatctcatttcttaataaacttcggccggcttagggcctggcgaaacagttttttttatataaaaatattcattagattattgacatgtattatctactttattgtaggataaattaaatattttttataaacaagttgtctaaataatacttcctccgtttcactatgtaaatcttttttttttgcggggcactatatatgtctaaatttattaacgttaatacgaatgtgaaaaatgttagaatgatttacattattaaacggagggagtacagtagaagagattttcttttgaaaagaatgtaagtattttagcatatggtgtgcagtaagaatgtaagacgcattcccttgtataccgcagtcaaaacacttggtaaatcccagaatgattgcgtttggaataccactatatagtgcagacgaaatgcaaatcgaagcagagttgaacacttgaacacgattcttcccgtacgttctcagtccatccgatcgaaacaaagcatgagtaattttgttcttattattgttggaccgtgcgtggttgatgatcgctgatgtattgtaaaattgaccgcgagtgaaggatggaggagctggagtcggaggaggtgaaggggttcgtggacgcgcaggcggccgtggccgaggcggtgctctccacctgcgacgaccaccgcgtccgcctgcgcgggcagctcaccgcgctcttcgaccacccgcgctaccgcgccccgttcaagcgcgccggcagctacttctacctccacaaccccggcctccagcctcacagcgccctctacgtccaggtcaatcaaagccccccacgcgaatctcgaggccacccagcagagtccgagagagacgctagctttctgcaatctgaaccgtcgcttttgttgttggagttgttgcagcacgggctggggggcggggaggaacctgacgtgttgctggaccca

SEQ ID NO: 46153 - DNA, 1107 bp, Oryza sativa
tctattaccactttcttgaacccgatcagtcagaggacctgttgtgctgggaggaccctgaccatcccaagtacatttacacccctgaagtttcagaagatggcaaggtatgcagctatggccatgagtcgatcaacttaggacgaagttttgtacaactctgaatcttttctaagcattgacaaacatgagctactcctgagctgatatctcatcacttcacttgttgcagtatgtgattctgtcagtcgcagaaacttcagaaccggtaaacaagttgtactactgtgacctctcggctctccctgacggcctggaaggcatgaagggaaaccatggcaatgccatgcttccttttgttaagcttgtggatgaatttgaagcatactacgcactcatcgccaatgacgacactcaattcacatttctcactaacaagaatgctccaaagtacaagctgtcgaggattgatgtcaacgagccacactcatggatggatattctccctgaagacgagaaggctgtcctagagtcggcttgtgcagtccatggtgataagcttctggtaaactacctgtcggatgtcaagtatgtcttgcagatgaggagcttggttaccggggagttgctccatgacatacccattgacattggcagcgtcaatgggatctctggcagacgtgacaattcagaggtgttcatcgagtttgctagcttccttactcccggaatcatctataggtgtgatgtcagcaaggagactcccgagatgaacatatacagagaaatctcggttggtggttttgatcgcacagattttgaagcaaagcaggtaattttcaatagcattacgagctcttagcacgatacctgaactttgtagaagtacaatgcattttcagagttgcacaattcctgtttgtaattcagctagcatttctccctatttttttcctctccatttttttcaggtgttctaccctagcaaggatggaaccaagatcccaatgttcatcgtgtcgaagaaaagcatcgttcttgatggatctcacccgactctgctgtacggctacggtggcttcggcatgaacatgacgccccatttca

SEQ ID NO: 46154 - DNA, 4591 bp, Oryza sativa
atctttgctcgtctgtgtgtgtcacgtttttttctgctgatttaactgaattttgctccgtccgtgggtggcagatcgacgaagctgcggacaggtatgcgttcgcggcaaagacgatggggatctcttggatcgactgaacaagcctccgagcagttggtgccttggtgggtgctaatgggtttaacttcttatagcatataaccctataaaatttgagagttggatctagaatgagatgaacacaacttctgtatatttttggcttaaaaatatttatgggctagatatggttgtgaaaaaaatccatgggtctcaccaatatttagagattggttagttggctatggtcattagataggtgtctaaaaaaaccgtgatgtgagaaggataaaatttattccctcttacactcgccataagaaggtgagactcaaacctgggtgaatgtattcacaaatatgtgcgctcaccacggtttttttttttagaattacacagtacaacacaggtagtcataacgcacgcacgcaaactttacccctacgagcatcttcgaagattgggccgacaaatccatcttggagattgacgaagtcaccacagaatttgtaatgtaattggttgggtttttatagtgattggcatggtaactttgcatcttctatcttcttatgtagttcgttgaaaaaaaatagtgattggcatggttgatactcgatatgtacatatattacggatttcatcacctattcctagatggaaaacagttgtgaaactatgaatgtataaaaggagcttgatcatgattttctacccatatctgggagtgccgaagtttctctaatattttgaagacgtattcattctcctcccaatcctaacctaccatgcgcagcgtgagaaaaccatgtaaaaaaccaaaccagcccacccactgcaccccctaggctcccttccccgactgtgtgagagaaaaaaaactaacagcgccttatcgttggcatattttctgatatttgcaaacgaaaatcaatttgtgaataaaactttttatatatatgtgtgttcttagcgatctaaaagtaaaggctgaaaaataaacttcgataaaaaaaatctcaaaatcagctccaaatttaaagttgaaaattcaaattttggctgataagcatatgaatatgcgagcccataaagcaccatgtcttcttctcgctagaaaaaccatagtttaaataaccaacagaaataccgcctaaaaagcaatccaatagtcccaccgggaatagacatctaaaatcagtttgggcctaaaagacaagtatgacagttgattttatgggtctattgcaatgcaggtccatttaactagtggggagaaggagaaagagagaagggtgtgttcaaagtaaaacaaaagaaaagtggccaaattgcgagcataattattcaaagctagattaaatcatactatttcatatggtaactgtagttgatatacaaccctcgctagagttatggtaggcaagattaccactattttttatatagatcaatatcaataaagtataattgtattcgatatacaacactcacttatatggtttaaaagtacaaatgtattttgtatatacattttatataccaatcaatcaatttcaatcaatcaatttctgttgttataatctaatagactactactgcatctatttcaaaatataataatttttagctatatatctagataagaatataattggatggacaatttattactatattttaggatattttaggatgtatgtagtaacttatattggatggatgatttcaggtgaacttgaacatataaacattgctcaaagggcactaccgtataaaccgaaacttggagatgcccagctcaatatgcaattcaggttctcaaaataaaagaaaatgcaattcagtggaaaagatctagaaaagtggtaaccggcacgcgaccacgcgtacagagtaagctgatcgcacgcgtacactatccgggcaccaaaaccgctgctcaaaccaacaaaccctcccggccccggaaatcccacgaatccgcaaaccagttcgccccccaaatccgaccgccgctcaagccccacgccgcgccaccggccgccaccgccgccgcggacagccgcgatgccgaagaagatgggcgtcaactccaaggcggaggcggcccgcgagcgccgctccgtcgcggaggccgaccgccgggaccgcgtcgagcgcgccaaggaggaggagtactggcgcgaggccgagggccccaagtcccgcgccgcgcgccgccgggaggaggacgccgagaagcgcgccgaggccgccgcccgcaaggccgagaaccgccgcctcgcggaggccgaggccgcctccgcctccgcctccgcgccgtccaagacggccgcccgcaaggcctcccgcgtcggcgccccggcgcccaaggtcaccgaggccgagctcgcgcgccgccgcgagaacgagcggctccgcgtggagcgcgaggcagaggccgccaataagcgcgccgcgcgcaccgccgaggaggaggagtacgagcgcgtcgtcttggtcgccaacaccaacagggacgactccatcatcgaggcgaggtcggtcgacgaggccatcgcgcggatgtcgctggttgactcagagggagccttgcccgccgacaagcaccctgagcgtcgcctgaaggcatcattcaaggtatagtgaccaaactttgtgcttattttaactcaattgctgcccgatagtgtggaatcgtgtttacttctcaaaatatgttgcttgaagacaatgaattgagcacctcactactaccatgtatgcatatgatacaatggtagtcgttggttgtagacttgtagtttctactttctactgtgattgtaaatcacaacaaaaatgggaaaaaaatcacaacagattgaagtctgaatgcaggttagtatggcatgtattatttttcctctccactttgtgtcgtaacttaattatggaaattgacatgttatcccattttgtaatagaatgacaactgctaatatggtacttcattagacaatcttaagtttgatgtagcacaaactcggttagatttgattttcccatatgattatttcattatttgacttactaggatgtttgatgtgcaacgattgaacattcggcgtttgaatttatttgtgataatcttgatgataggcatttgaagaagcagaactccctaagttgaaggaagaaaagccaggcctaacactgaatcagtacaaagacatgatatggaagctatggaagaagtctccagacaaccctcttaaccaggtttgctcacataaagatatttaatttagcttgttcctgcttacacataatccttgcacattctaggttattgttgtgtattttaatctgcatgctctaccactaaaacattttattcaaaattatgttcccttaatgttgtgaactcaaaaagggttacgattgtcaattgtggtggtctactcgaatgtacgaagaatggatgcaatatgggtatcgcattaaagttaaggttttcacttaacaccacatgtttttacattggattgggctgttctgctggcttacgatcatcctagaggcgagtaggcagcagcctgcagcttctcttaagcaccggcattcatgaccccgccggagttgttgcgatggtgcagaacatgggcaggcaacaaccaaggaaagagggacctagggcaggcatgtgtggtgaaggcaaagtgttggtgagcagcatgtccatgcatgaggagaagaagagcggctccggggtgaattgtcatggatggtgggaatgtgcagagacgttggtgatgacggtggctaggacgcggacagggtgaatcctcgacggtggcagtggtggtggctggattgtgattttctgacacgaaggttagtgacggtggcagtcaggaagcgggcgtggcggcagcagcgtggacacagggaaggactgagaagatggccagttcatgcttgcttgcgttgttgcgttgatgggttggcccaaataaccaaacccctggccccgtccaaggtgcaatggaatgcaaaatatgtggtgttaagtgggaatctctagctagacctagtccagtgttaaacttaggttaaaaagatggcccagtgtgaaatttactctttctaatatttgctttaactaaggaaatcagaagtactatgattcttagatacttgtatcaattgtccatcatctgactggtatttatatttaggctgcagagtgatgatgcattcctgctgaattgtagaatttccaaggtaagttttcatggcatgaccagacacacattttactgtcaacaattttcttgaacaataatgcactaaaacacactttttcttgatgtgcagacttccaaatgggtcagaacttcatcagatgctcatggactgaatgtgtgggagatgatcagcttctcggctaataatttacaaagtgatgcagtatatatcatgtgagctcgtttttgttagagat

SEQ ID NO: 46155 - DNA, 21253 bp, Oryza sativa
  unsure (1)..(21253): unsure at all n locations
gcatatatatatatatatatatatatatatatatatatatatatatatatatatatatatatatttctactctcttgttttacaatttatatataatgactgtattgtcatttataaggtacttcctccgtttcacaatgtaaatgtaagacttacattgtgaaacggagggagtacggtataaggaggtgtttttttcccgtataagctttaatatcatttgcttcaaatgtagtactccgtacatttcagtatgaatagtaaatcttctcctacgtactggagtagtaaagaagccttcaagtcaatcttccaaaagccttttggcccaaaagagtatcaccctggttactgggcactatactgtgttgggatttcggtattaccggttttgtaaatcaaggtatacgttacatgtattgtgatttagggacgaattttaaactagcacaagataaagaacataaaatgaacttattccttaatttatcgtgtaatggaccgatgatctcgactcaggtggcccattgaagaatagaagtctgatgagtcgcctggcctcctcggctcctcgcacacggcctagaaaacaaataaaaagcccagcctaagtttaccctgacagatgggccccaccgaccccccgagcccttatcccatcgtggaaacctgcgacgtatgcggtccacggcacgtccaggtcagagactcagaaacaacggtcgccgtcgccgccgccgcatgttttaaggccggatttctcccaccgacagcctgggcccacgcaccccccgagagaggggtgggccccgcgtctccacctcccggagccaatggcaacccaagccgccggctcggtcggtcgccccgccggcgttcctcctccccaccagctcagccctcagccaccaaccacgcgcgcgcgccgccgtctcgtctccggtcccctcggcgcgcgaccacccaaccacctcgaccctcggcggcgcgcaagggcggcggcggcggcggcaggcggctgaccgcgaatggagctcctcccgcgtgtgggtgtggccgcccccggtcccggacgcggcggcgcgtcgccgtccccgacgcgccgtcatcgcgcgccctctcaccccgtgagcacctcttccgcgagagcgcgagattgatcggtggatgatgctaggggctacagtcagcgggagtggaagggcacggtgtgttcgatacggtgctaatggttgacgctgcctgcagattctgaagcgatcggcggcggtttgcggcgcagtcgccgtctgcagaggaggggctgtcgccaggaggagccggtggtcaactctggtgaccgcagcatattagtaagcatgacaaactgagttctatcacggtttaccttttttttttcgctgtactgttacagtcttagtggttagaacaggaaaaaggtttcaaatcctgtagaaggatattgattcacactgtgcttgtcctgctactcaagacaagattaggcgagacttatatgcgggttaacgaaaagaggctgttgaatccagtccactattagcttgatggaacatttaggatttgacagtccatctattcaggtgcgctccgattagcattcgggtgtcccattgacatgtgggcggaaaaagaggaatcataacggctaaacaattgtagcaaacagtttctgaacttgttgtcctttgcctgacccatcatcacattacgggcagtgcctgtttttgttggattatctgttcattgtgagcttcatgcttcagcacaggaactgctgaactggtcgactttaactgggaaactcttgggtttcaacccgtgccgactgactttatgtatgtgatgagatgttccgaggaaggggtgttcaccaagggtgaattggtgccatatgggccaatagaactgaacccagcagctggagtgttgaattatggtcaggttagttgagctcttaattctaccttgaagaatcactatctgattgttgagcagagctgtactaaatgagccttgtccatttattctgctccattttgtttgaaaagctctaatgcacttgtaaaatttctatagggtttacttgaaggtctgcgagcacatagaaaagaggatggatcagtccttctatttcgtcctgatgaaaatgctttacggatgagagtaggcgcagaccggttatgtatgcctgcaccaagtgtagagcagttcctagaagctataaagctaacaattttagcaaacaagcgctgggtaaggacattttgtttcttcaacagtgataggcgccgtggtgcgcacatctttctcatgagctatgcgctccgttgcaggtaccccctactggcaaaggttctttatatatcagaccgctgctgattggaagtggggctatcctcggtgttgcaccagccccagagtacacatttgttgtctttgcttgcccagttgggcactattttaaggttggcagcgttgacttaactttcctgcatattcattttatctggttatagttgcaagattactgtcttgtttacattcaggatggcttatctccaatcagcttgttaaccgaggaagaatatcagtgtgcggcaccaggtggaactggtgatataaagactatcggaaattatgcttcagtaattaccttttcttttctacaagctgagtctctactttatcatctgattcctcatagaggacacagtacactattccatatctttactctacgggcatggttctcccaatttgagtttggctgccaatgtatatttttatgtctgaaatcaaattcttgttcttcattttcatttgacatctgtatacaggccgtttatgctaaagaaagagctaaggagagaggtcattctgatgttctttacttggatccagtgcataaaaagtttgttgaggaactttcgtcctgtaatatattcatggtgaaggtatgtgtacatatgtactggatttgttcaaattgacttcctttgcaagtctatctaggaaaataccagtgtaaagcagttccaagtatagctcaatgatgtctcttgcaatgatgttgtaacttgtcagcatactttttggatttcgttgaacgggctgaataattttatggcacataaattatcatttgatagacatggcattagcttatcttcaaacttgttaggagtagcaaggaatgatgtgttaagttcagaatcctccaaattatcagatgctacattgtcagataatttttatattactatattttgttctgagagctaaacaatgtagcattgcctttttgctggcaggacaacattatttctactccactattaacgggaacagttcttcctggcatcacaagaagaagtataattgaatacgcccgtagccttggatttcaggtaacctaaacatgaatgcccatcctctgctaacactgcctctgtaaccatggttcagaatatttgtatcttggaagttggaacattctgcacaccaccttttctttccatattggccaaaatattcagacttgtttgaaatttttgaaacttcgttcagaattcaaatgtgttttgaaagatcttgatgagatctcagaaggtcctgaaattttttgagatctcgagggtcctgaattttattgaaactcaagcatggaaactggtgtcaacaatatgagatatgaacccaatcttgttcgctgatatattttttttcaggttgaagagtgtcttattacaatagatgagttgcttgacgctgatgaagttttctgtactggaacttctgtggtactatcctctgttggttgcatagtgtaccaggggagaaggtaagtacttcagtaattcacaacctcagcctttgaagatattctagctggaatctttgagatgttgaattaatcataagagcttgtgaagctagtagacattccatacagtgaaaatgtacacctgtagtactatcaacagagtacaatgtcgtctcataaaaggaaaaaaaaagagtaaagtaaccggtagcatatttcatggggactgtgttagtataccagtttcactaaatggaaaaacttagcatatgtatccaccaaattattctcctatttttctttatcagtgatccatgtcatacaaattctgcaaatacgaacaaatgcagcattgagaaagggctcctccgttctattaaataattgttactctatattaaaaaaaaaatcagttctcatgcatccgctatccattacagagtggagtatgggaaccagaagttcagaactgtgtctcagcaactctattcagcacttacggctatccagaaaggcctcgtggaggacagtatgggatggactgtgcaactgaattagtagcctggtcgttatggacggtcttaaggttcttcctgtcaaatagtgctttcttgtttgaagcagcaataaagaaattcaccgaattttctcatttcaggcagtatagaatagagaatcacctcttgtgcatatgcaggtacacacagtatacaaataatctggggcccagagatagagaagcatgaactgtttcttctgactctattacctttcttactgaccatacttccagtgtaaataagtgctccttgcttatccgaggccatattccgtgcatcaattcggcccataactttgtcgtcagcttgtctcatgtgtattcaggacaaaattattggcactatttattggacaattaggtgtgtgcgtatggaacattgcttgattatattttgtcaggtggcatcacggcaggcatgaaaccatgcttgccaagttgccgataatgaatttaatgactacagctcacttgcacattttgcaacagcatgccatgcactgttactctgaaaaagaaaaccctacaataccagtctatttcccccctgattccttgcccttttggttagtttagtttgagagttactatctcatcatgagcaagacatgaaaaaaagctggaaagaattaatttatatgtactcactgcagctctagataaccactgccgaaccgttcgcaaggatacatcatgccataagacaaaattagctcacctgctgcgtgctcttgacttgtgaaaggagattggcagttgcatggggtcggtttggacttacatactgcaagtcagccaagcctgcaacgctaacaccctaacaaccagttccactcttaagcacggaaatacagatggtgacaatcttgtccttggtaatggccggctggtgagatgttcatttccaaagtacagattaacggaggggaaatttcctacccagataggtgcgtgaccttgtagcgtaaacattggctcacgggcaaggggcaacatcacaaagccacttttagattattctttgtaataaataggtaagaatattttttagggaataccgttcggctagttctattgatatgattatatcgtttatcaacatatatacttatgataaagccagagggttcacttacccaaatacatgaattttcagaaataaacaggtcagagtttgcaaacaagttagcctaggatgtatttgcaacctcttctcccaacccatcttcctcgttttctgcgcgcatccttttcaaactgttaaacgatgtgtttttttaaaaaaatttctatacgagagttgcttaaaaaattaaattaatctatttttttttaaaaattagctaatacataattaatcatgcgctaatggaccgctccgtttttcgtgcggagggaaaagttcccatcgagctcatgcgaacatagccttagtattttttttaatcatgctgtagttttgtaatttgcggttatatgttcatcatgtaacaaccggttgtaaagtaaataccggaatgaaatttattataaaaacaaattagccttgtgttctcaccgatcaagcatgcgttcgtggaggaggaagaaacgtcgcacgaaagcataatgatacgagaaggaaattttatgcaattccgggttgttgagtcgagtgatggatggattgaataacaacgacacgacatcacgatcgcatttcgtgtgctgttgcatcggcgtggttgggagccgcgatgtgaaccgatcgtctaccggagagacaccggccgcggccgtcgccgtcgcacgctcgcactccggcacggaaggcttcgtttccttcgcgtgggttcgtctgcttctgcatgcaacagcggaacggcacgcgaacgtacagtgaccggtggccacgaagccggcgtatttgtctatgcgccacgccacgcatgcattccacggaggaaattcctgacctgatgtaagctgctgtgtatgatatgcatcatccatcacgcacttgctgattccgctgctcgttcctattttattccggcttacgcctgacaaaagcccctgaacagaaattcagaacatactgaacaatcacaccgcggtgtcatatactgtcatcactatatagcatgtgtgtactttgaaagaaaaatgatatgtatgcaccaactaatatagtacgttgtaattattctagttggatgcaaccacacggaacaaaatattgcaccaggcgtcgatctctgacgaaatttgtcaatgaatttagaagacgaataattcaaggcgggcatggtatacaaaaccgaccgaacttcacggcttaggaacacaagcaacaaacaactcggtttctcagtcaagtttgaaagaaaattcttacatttctgacagaatttgatcgaatttcactggtagtcaaccggttttgtgtgtgggtgaggggtggtggtgttgggggttgacactggccggggaggttgaagcgtccatggcggcacgcgagagacgcgaaaaccaccagccgacacgagtgcacacacgaaaacgacggctactggcagtccagagaacgtcgccctgaaccagtacatcctgctctcatcagatggctgatcggacggctctctgatctcctcgctacttcctccgtttcatattataagactttctaacattgtccatattcatatagatgttaatgaatctagacatatctatatgaatgtggataatgctaaaaagtcttataacctgaatctggtacatttttcttcccgtctctgtcaccgagctaaatgtatgttcctttcagatttacacgtacatgtatcggttttgcaattgtgtgtgtaatacgaggaccattgtttgttttcgtttgggtagacagctgaacaaaccgaaaaaaaatggacgctactgtagttggaagagacccaataattgagcgatgttgtctctgagacatgccatggaaatgtttagtcgtttgttattcatcctaatccaaccgatttccggcgaatcttctattagttggtttgtcacaatccttgaaattaaagaattggatatgacggctgttgctgttgtgcagtaatgccggaaaaatatttctagtggccactcgtttcaaacttctaattttcttctttttttaaaaaaaaaaaatcaatgacttccaacgctgccttcctgtcggcaggcttcaaatgttgttaatccacgtacatgtacgccccatttcaaaccgggcaacaattaaagttgatataatctcgaaaggataacaagatatggaacagggaatagaatatttatctattctaaaagtgttcattgcaatcaggtgtagccatatatgatacccatagaaggacatctcgtgatacttcaactgttgaaagcgtgtgcttctaaaaagaacagaacacactgtgcaatgagggcgaaatgcagttacattacctatttcaagcatctacacgatgcctaagttagacatatttagaaattattcgttcgtcatatataggttcccaatttaaaatttccaccataataaagatactaccatgaaagggcatagcggtataagtttaacatgagcatatttgctatataaaaaccacagcacacatattggatttgtaatggaagcgtgttactttggaactagtacattgatttaagtcctggttttgtgatagtttcgaattatgtgaactttacttatgaaataaatatagtttgctttctgcaaactaatatcagtaaatattagtagctcagttactgtggcgcaagagaaggaaataaacatcattcgattggaaacctaaagaaactatctaaaaaaatatacaagcaaagtagtattgctcacttgaaattttttgctaatgatttatctcttcgcatttcaatatttttccctcactgatttgaaaaaaaatttatgatacttagttatgtcatgcatacgtcaaaccaatggcagagacaggttctcaacccggtgggatcaaaatacataaatatgtaaccatgtgggatcaatccatacaaaatttcattgttttatgtactttttttgctagttttcacatggtcaaggtgtatcttgcaaaaacatgtggggttagccgacgccacaattttactctggccctgccattgcgtcaaaccaatcgcaagaaatgtgcgttcaggaattaaaatatgtgttattagttattgagcatccataatcagaggtcacgtttatgacgaaaaatggttgaaaaaaaatcatgaaatagtttgtgtgagttattggacacctcctacaaattctaagtacatgcaaattattggtgtgtcataagtgtaacatttttaatgtgcatgctggtttcgaacccttgcctttgggcataagagtaaagtttgccgttcgtcaatcacaagcgtccattttatacctacgattagattttgctggcccgtgcatgcctcctaacattcatcttaagagaaaattagttgaatttcccacgcaaaagctaagatagaattattttttgccatgcaacgtctctagtttaaaaacacaattgtactattcccaataatttgtactacaccttatcaatctaccggtataattcgatcccacatcacaatgaatatttcagatatggtagtaaattttagcccttattggatgagatcaattatctattaaatatagactaataaaaaatataattctactttcaaaactacccttgtatgccatgtgttctttattctactggtacaagacggagagcctaagatagagacaagaatcaaattcttttattatttttttctccggcgaaaaatcaaatccttattcttttcttttcttttcttttttcctttcccatccactacgtgttgagcttgatcaagcttctctgacgtagaaaaagagggagatgccaagatagagacagatatcaaagtccaatgcggcaatgcccccctccattaatctgcgaaaaaaacctgaaaagtacaaagcaaaccaccctccgaatcctaccttctccttcctggagaggaaggaagagagataatcggagcatatgatgaggagatggtggtagcaggagcagtggttggcggcttggcgcggccacagaggcatcccattcccacgcggcctcgcccaagaatcctcctctccggcctcgacgcatgctcctgtttttggaaggaaacgaagtgaagaaaaagatcagaaaaggcaactagaattccaacagcctgttcattgttctgtgaaaaaggggcagttcttttgcagtgtgtatccatttattcgctgtttcttttggtggtttttttggaggcggaaaaaaaattctgttcgggtgcctgttcctgcgtgtttcgagggtttgctcagaggaagcagaggatcgaagggggaaagattgtctctctttcttttttttttcgcatttgggttctgagattgttccgcaacagggacctttcttgcctgtgagattctgaatcgcccgaggctggaaagattgaaacttcacggcgaggtctgcatgtttggctgaagacggagggggataaaggaagcagagggtcggtctgatgatgcagttccgcaatcttctttccttttgcgtgttcaggtcttgatgagatatattccttcctgtcaagtttctcaattttgacgtgaattccgagtccggggcatcttgaggaaaccgaggaagcacggcagatacaagggtttctgttggggctatcggatcatttctcatctgtttctgcttatcttctcttggttcgcgattgctcgagattcaaagattgggttttgattgtctggagattgaagaagctagtaccattgttgggtacttgggttcacggctcaagggtcaaagaaaaggggcagacatggctgttcagatgatttagcaggtcattgtgtaggaacagttgtcaggcgccaccttgctttttcctgtattcatctggtctgggttcttcgaactaaggtaacataagcattacccaatatcaaccttttgttcatctgggtgattgtgttatactgtggttgacatactccaatagggattactgagctgttttaggcattagccagcgcctgcagatactatacaatgcaatttggacatttagtagccgttctttgcatatggggaagtggaactattcttaatcctaggattctgggttcaccgacaggacaactgttcctttcttgacaaggaaaagagaggaaataactttcaaatcttcagagtttcgtcatttggcatttttgcctctttgtatggccacaagaagtttttgtctctctaatttaattaggtttcattaaattcttatagcatgtttctcgttagaaagcaattagatgtaatgccgtaatgcggtgaactttacatgtttgcatttgtggggtccaatgtggtttctgtctcttctttctttcaaattttacctctctttttttttttactttggttttacaattagtcttggacaactgtattagttatgtaagtagattctgcaaccattcagaagttggtaagagatcatgaccaactatgagtagttgatagggtggaagctctttcgccatttgcatgtctaatttgtactgtttaccaattctaacatggttttctatgttttgatattcaggttgtaaacttgcctggtgattaaacgaatctgtctgacaatgttctcctctatcatggcaaagaagagttacaaacagcggtgcaaatctgagaaggtccatatgggctgtatgtcgggcctcatccacatgtttgacttccgtcgcagtccaaaacttatttcagatgggacgattaggaggagttcaggtgaggaatttaagtggaatgcaatgtcatctgaacaaaaagaatgatgtaagctgcagtgtaatgatattgcttatgataaattctgtgcttcatgcagtcagaagtgacctgaaaggttctgaagatttccatggaatcatcttttctgatgtaagtcatccatatatacctatttcatctgttttttgtatctgaaagttcaaagtcacatgtctgtttcacagagacaaaaaacatgcgtttgcgctagcaaaactgattagaaaggaaacaaagactgaagtttagttcccaaatttaacttactgttgctttttacttgttggacaatttgtttttcatcattatgttacttgttctacaagtgtacagtgttacaattgcttgattcctatgggcaaaatgttgattgtcatcaacattcttgaatacttgtaatgttgatgtactaataacagatgcttctgctggcaactggagtaaatagtactgttaaagcattgatatgaaaagctttagtatatgtacaaagcttttcaagacatttttacgaatatttaagtgtgattagctgaattacctacagaatctcatggctggatttgaaaacaactgtattttctatgagactcgagtgccaccgattgaaacatatagtaacatattcactttgttttagcaattgcaaacagctttattagcttttattatattacagatgaaatagtttctattgccaaatatattaattagaattctcacagaaaaggttacaaataaaaaatatttgtcgtattagttttatggaggattaaatatgcataagtatttgtatccagaaatatttgtaggcatttgaagataacatctgaatatagaaaaccaaatttatttgcttgtcaggaggacaaagactatggggttaaaacaattcatgccagcaggccaagtattaaagcactgatggaagaagagatggccagtggaacgcagatcttgaaggaaacacaaaggaacatatttgggatacgttctgatgatttgaagtctgtgaacctgcaggaaggatctgatgttgacctagacttggctacaagtctcatggaattatacagaaatcataatggcagtcgcgatattatcacttcggaagtatcagatcactcttccagtttgattgacaaagagcacaatactgatgctagtactcatcctaaacaaatctcctgtagtatagagaaagcacttgaagctgtggctgaagcagtaataacccatcaatctgcaaacgggaaatacacaagcagcagctacgaagctaggcccaatgaatttcttgatgcattacaattgctgagcgcaaacgaagagttctttctgatgcttctgaaagacccaagctctaggatgttgcaatgcctgcagaacctgtacacggcactaggaaatcccatgttagaactggcagaagatgacaaacaaacaaagtcgaaagttaccattaacagtctagagcagtctgaggtttcgaaatacagcgtgcaaaaaacacataattttttcttgaaggaggataagctagtcatgaggagaccaccaaaactgaatgatagtcctcgtggcgttagcagaatagtaatattgaagccaagtcctggaagaagtcagactagtctgatttcaagtagtgcaatgtcgtcaccagtacaaactcgtgctgatttgcaaggtcaggaacaaagtgacaaatatgctcgccatttctcacttagagagcttaaaaggaggctaaggcttgccattagtaacaatcgaaaggatgtcatgagtagtactttccagaaagatgattcaacacaacagttcattctcgagagtatgtcgacaagtatggactcttctgaatgtgaaaaggctgagaaaccctcaatagttgacaagaaaacaatccctgaagatagtggaagtggcatggggaatgatgccactcattgtgctagctctttcttctacgaaaaagctaagaagcatctaatcgagaggctagacaatcaaaagaatgacacttctcagatcgtacacaaatcagaaccctttgggaaattactttcatattcggagaatgatacgttttctcaaactgattgtcctcaagaggatgttaaactgtcagaggattcgactgcttcatcagcattactgacgactgaacaagaggatatttcatcaaattctgacccaccaatgaagtttggggagctaataccattggacaccagcacatcggctaacacacagctggatgaatttaagacagaccatgccagtcatccagtcaaagagggcactatctcgcaggagttaactagtgaaggtatattgttgtcctcctgtttatctttttagttttctacttccttgttttcatctaatatatacaccaaatgtttgcagggattgacagcatgaatgatgcaacagataccccccaagtctctattcagatcgaaacttcaactgaaagcttggaacaaataaataccgaccaagtaagccatatgtttttgcaaattgtacaaaaagttaagttagtaattaattttgcgtctaacttttcttttactcccccgtgttgaagtgcttcgcagaagagtcacaaaccatgaatgcattaccagaagtatccctgcacactccagaaaaagttaacgagcaattcaatcatagtccatcggcagttgttggattaaccaagccatccatcttgacattttcttgctccccggagaatgcagatgacaaagaggagagactgagccctcaatctgttctagattctttcctgggagatggtatcagccccagccacaaaactcgaacgcaaggtattgaattcaaaataagaacttccccttttgaatttcccttttttaagatagtggaagtacccttttgtattttcttgaaaaatccatggtaaagtagcacaattttattgtgctttatgcagatgaattgtccatgccaagcacaaggattctgtttaaagaggatgacactccctcgggaaccccaactttgcaaaacacaccacaagaagctattttggatgataaacaggcaaggctttccttcataaaggttgtgcttgaggcttcagacttcttgtctgaggaaagttcagagatatggtatgtggacggatcactgcttgacacatctgtattggctgaagtaggaactttgtactgcctgacagacgatgcggtgtttctctttgattgtgtggaagaagctctttgcaagatcagggataacttttttggttgtgacccttgggtagcttatctgaaacacagtgtgaggccagctccggtaggaacagggctcattcaagaggtggataattgcatcgattctcttgtcagtgatgaggttccaagtacattagatcgggtggtgctgaaagacctggagagtggatcatggatggaccttcgggttgatactgaagaagttgctatagaggtgtgggatactttgcttgatgatttactggaggaaatggtgtttgacttgtggctttaagattgttttgttgccatccgatggaaactgatagagtttatagttcggcacttcggcaggattttattcaccaaaaaccatagtacaaaaagctttgaaaaagtgagtgtgacagatttaaacagagtgtatacagcgcagtagagttaggcttgcctgactgtttgcatcatactataaatcttgactatatgtggctcctaacactaggaatttttcttcttattaatgcttcttctatcatttctgttctctgtacaggtgtgaaagtaggaagaataagttcagttgtatatgtactgcctaattatagttttttttttcctcatgaaagtaaaacaatttcccttgtttatcagatacaccatagtgctgctccattttaagcattgcttgcatatactctggtgaatcatctcagctgtcatcacagttggtaagtaccaattgtgatcacactcatggcagacaattgaagggaccctcgcaataaagtatgaaacacccaaacattgcttgctactacttgctagcttagctaggcccatagagtactgtgctttccttgtgctagtatcttccattagtcctacatggctacattgtaaaagggggttaaaatttttgggccataatgtacatattgtgggatttggccatggacccttatattttgatatcccggaccaaggcaaggcaggatgaacaaatgatgatgatcatcagatcttccttgcagactcatcggcgaaaagaacgtcgtctatacacgtcactatgttgtaagccaggctctccagcaccctggagtagccctccaggatggcttgcccaacgtcctgcacggagaacagcagcagcagcagcttcgtgttagtgttcgtccatggcgatgatgtcgcgacacgtcgttgctggtgatgggttggtgtggttaccttgttgtactggatcttgctggcgtccagggtggtctgggagaggccggggaagcgctgcttgaggcagagcaggacgtcgccggcgcggctcgccagcatcacgttcttgtcggactccatgagctccttgacggcgctccacggcgacctggagtgcccctggctcgccttccgccgccacacgtgcatcgccgcctcgacgcggtcggccgcctcgagggcgtcgtgctccgacgagatctccagccggtccaggaggtactccggcgagaacttgcccgggaacgacatgtgccggtagatcaggtcgcccacgctcgcccgcccgcactgcacaggatcagaattcagattcttgggagaaatcctcgaattggaagatttgaagctcttgtatcgagaaagagaaggggggagagagagagagagagagagagatttttgatgttgctgtaccttgggaagcgtttgcttgtacagctcagggatgcgaatctccgcaagaacgccattgttgatggccatggccgccttgtggatctggctcgcacagtcgtgcttctgccgcaggtctctccgcgccgactccgtcagcccgggcttggtgacgcacggcacgggcagccaccacttgtcaccgtcgcggtggctcaccggacggcacggcgccgcggcggcggcggcgcagctatccttctgacccttgtcgttcacgtaccagaattcagtcttctggaagctgtccagaatctcctgcacggcaacaagcaaagcaatttcacgatgaacaagaagccaatccatggagtcatggagatgaacatagcgcgagcagaatcgggtcttacgagaagcatgtcgtcgagcttctcgagggcggggaggttgacgtagatgtcggacctcggcctggtcgccatcacctgagacgaaagaggcgggaatgcgtccatggattagtgacgcgcaagagagcttttgccttgaagaacatggacgaacacctgcaaattctcacctcccgcacggtgccgtcgggcatgatctccttggaagggaagagctcgacgatgtagtcgcacaccgagaggaggcagtccatctcccgccgccacatcgacctcttctccgccagcaggggctccagccggtggcagccgccgaacacggtcgctgcgaacagaggaagcaacagattgacattgagcacgctcgtgttctactctgttcctagctgccgctgaagatttcatctctgaaaacgagattacgcgtaccgaccatagaggttggtgatggcattggagatggcgacggcggtggagacccccttgccgctcccggacatgtcctcgccgagcagaagcttcgagaacctctccttgatcagctgcaactctgccaattcaacccatctatagcgcattagggagaatatccaagccaagaaagcagcagagatctttgccagcctcaatgcgggtggtaggaggacgtaccgccgtcgccggccttgcggtcacggcccgcgccgcgccgcgccgcgccgagcttctgcagcagcggcggcggcggcgccttcgctatgctgcacacgggccaccgcgggtacggcgaaccgtacgggctcccgggctcgccgctgcactcggacgacacgtccgacgaggcctcccgccggtggcggccgcgccgccgctccacgtcgtcgatgtccccgtagtcgtcgcgcgcgtcgacctccgagctctcgtcgcacgtcgtcgacggcgtgtccatcctcgcatcgaccgatcggcacaccgagtgcgctcgcggtggcgaggcacaggccgcaggcaagcgagtgcgctgctgcgctgggtgcagtggagagtcagcggctgtcgactgcggaagaagtggccggcaaggggagaagcgtactacgtcgtgccgtggcgtggcgtggcgtggcgtggtgaggccccacgatgacggcgatgaggtaaacgggtcgggcgcgctttatgccaagaaaagagtgcgattcctccccctcgctttccnnnaagccccccccccccccccccctcctcttcgcgcgtaaattcccttcgaaaatgcgtaaacaccgaaaagaaatgtgcactgcagtgcagatcactgcactccctgacgctaataccaggagcactgaagcagcagaatttttacagagctctgccgacagatgatcatactcctactaatgacgctgcaagcacacactaatgacaaaatcgacgccaccatttgtctcccttaaccagcgcagctacttagagcaagtttaatattataatcaattattggcttcaaattatctataatcgattaaatagccaattcatacgattacctataaacatatactatataattgtttggtcccacatattatacacgtatatattttggagcttgtgctatagctggctataaatttaaagctcgttacttttctcttttctcttttatcttttttaagtatgtttattagcgggctcatagtctgctattgtactgtcttagtagtacggtacttgtcactaagctaattatgcctgccggctcaccaatggctgaacaaagcatggggactcaacactaatcctggcgctttgagcagcagcacgcgttcgtctcgcagctaaactaaacacagccatgtggccgcgcgggggcaaggattagatagcacggatgtcatgtcactcacaagcgggcctcctcctttatctgacacaaagtggcgagcatgccggtcagaataatggcgacattacggacggcaaaggcgaggtgaaggcccccccccccccccccttccgtctccggctccggtgcctttccgatcatgacaccggcagttgcttgccccgaggaggtgagttgcccgatcgaattgccctcgcaaagtctccattttactgccacttttgcatctccgtctccattgaaaaccttctttcctgttactgcactctctcttgcagataactcaggagatctctgcgtaattcaggagtacaagtgttacagcgaagcaggcagggtatttcttggttgtcacaagctgtaacaggggagtagtggggagagttcatgcagaggagaggacgaataaagcagagttttttttttttagcttggtctgcttggggtgtgctcggctggtgagcttaattagctcgaggaggttaggatagtttaggattatcgtaagcacgcttatgccaactcttgattgggctgtatggcgcatgatgagcctacgatatagcgccacgtgcctatggtcgttagctgctaatgacatgcgtgtgtgtgtgctaatgaaatggaatgaaatgtgtgctcaactttggctggctttctctctgaattgtgctgtctgtttgtggaacctagtagtaggttgtagataaacttgattaggcaggattgaattgtttacttgtaatatatgtttacaacttaaaattcctactgatcaggcatggaaatgatccgatgaaaaatcaaaaacatcatcctttgatgtactttataatgattcctgggcagagctttactttagccttttcacctaaacaatattgagtgttcaaaaaaaaactcactaacttaatttaaaaaagacaaacttacttgcaaattaaaccacacaaattatatcattaaatctagaataagtagttgggtaagtggatacagtcacgttagtcgatccatttgtaatacacaaaaggctacatgtgtgaagttcgacatttatcttgcttaattatagtagtcgtggcaaggtttaatttaatttgcaagcatgccgacacatataatcagacttagatctaagttttcattataaaataaataacaataacaataatgtactgtctatccatgtcaggagaaatcctgatgtcacatgtgtggtaatgtggttgagatttctatctaaaatatttgggtctcgatctgccctgtgaagtgcacacacacaatcatatttgtatgtaattacatagctgagatgagatgacaggatgaaagataccatgcaccatgggtatgactgcgtggagcgtggattccatgattagttctcaatcttattattagtattctggggaggtattcatgttttcttgttattcgttagtacaagccttgctaaacttaaagtagagttcagatcgaaaaggcatagacgtatgatagggcgcccacatgtgtatgagcgtaagtttagtgtgtgtgcattgttcggaaactataggcaaacaaacgataaaaaataataaataatagatcaatcacaaaaagacacgagatttaacgtggaaaactctctcaaagcaggagagaaaaaaccacaggcgctagccagcaaaatatcttcactatatcagggtaaggttacaacgccgcacgatggtttacaagatgtatatatatggtggaactctaaaagggatgatgattcatacccaatcctaccggcgacgggcctccgctccactatggcagaagctagtctttattaagtgtaaatgaatttggatccataactcaacatgcatcgcatttgtactcgaaaaaaaatgagagatcgaaaaagtttagaccaagcatcagggaattctaagaccctctttgtttagtcttataagctaacttataagtcaaaatgtctaaacctaaacaaacaagcggctttttcatttggctttttttaagccataagccactctaacactattaaaccaaaaactaggttggagaagcttttttggcttatgtgaaatagatgcatgactctaccattaaacttagaacattaaatctaccagcttataaatcatataagccaataagctaacttaaaaatctaaaccaataaacctaagcccaaacaaagagggtctaaataacctcttcctaattatcgtggaaatcaaatttattgtttttgtttatttcttgatcgacaaagctcctacctttctctttaaaaagattgattcttatgaatctcctactttccaacataacttaggtggtgtttgaatccagggacttaactttagtctccatatttatacactaatttagagtatcaaatatagactacttacaaaactaattacataaatgaaaactaatttgcgagacaaattttttaagcctaattaatctataattagagaatgtttactgtaggatcacataggctaatcattgattaattaggctcaatagattcgtctcgcgaattagtccaagattatggatgggttttattaatagtctacgtttaatatttataattagtgtccaaacatccgatgtgatagggacttaaacgttt

SEQ ID NO: 46156 - DNA, 3090 bp, Oryza sativa
ggccgccgaccctggcctggtctacgacattgctccttgcgactacgtcggctacctctgcggcctgtacacgagccaggaggtctcggtgatcgcgcgccggccggtgaactgctccgccgtcgcggcgatcccggagcaccagctgaactacccgtcgatctcggtcaggttcccgcgggcgtggaactcgtcggagccggtgctcgtgaggcgcacggcgaagaacgtcggggaggtgccatcggagtactacgcggcggtcgacatgctggacacaaccgtgaccgtccgcgtgttcccgaggacattgcggttcaccggagtgaaccaggagaaggatttcacggtggtcgtgtggccggggcagggcggcgcaagggtggtgcagggcgcagtgcggtgggtttcggagacgcacaccgtacggagcccggtctctgtcaccttcgcctgatcatatatcagagattcagagacggtaatacttcatccgtcctaaaataagtatagccatggttttccacgtccaactttaaccgttcgtcttattttaaaaaattttaaaaaaatttaaaaacataagtcacaagtaaagtcttattcatgttttatcatctcataacaataaaaatgctaattataaaaaaattttaaataagacggacgatcaaatttggacgcaaaaactcattgctgcacttattatgagacagaggtattatcacgcgttacgcgcattgtgatttctcggtcaattgggatccttcttacttacagtacttattgttgaaattttaaacttacagttctggtgttgaaataccaaattgtagtcatctttggattcttagtttgttttgttggtatagccgtatagtaattccgaaatcgaaattaataaatatagttaagtactatactatactattaaggttcatccccacacgggtctccttttaatatgagcggttataatttggtatcttttttattaaaatgtgactttacttctcagctacattccaaatagccctgaaaaattatgaaaagaattggcaggataagatacaagagtagtattttctgtacaaactacaaagaaagaacaaacaatataaacttacgaggtgttcatgattttcatttattgagttttactcaagatcaagaatggggacggaaaaagattttttttaaaaaaaagtaaaaaaaaaacatgtcaactcaagaaatccttattaggctccgtttggcattagcggtggattttggtaatctcatttggttcaatatatagtttttaacatgttggtgtctttttttttagataatggataaaattcggcctctatatccaaagtggatatacacaatcaaagtttacacgagtgcatacattctaaaactcataattgagaaacatgaaaaagaacaaccgaaaagaaaaactagaagactagctctaatcttttcttcccaggttcaaacttaaaatagatgcggagctagcccgcccttccacatgttggtgtcttggcaaattgcttcagctcaagatactccctccattccaaaatataagggacaaccacccttaacccaaagaccaagaaataattattatcatattgtagcttggatcatcctaataaatattaatgcatgcatccaatatgattagataacttgagagtggatgatttaaaaaagtaataatttaatgtagaagatatcatagttaattgcatgtttgcatgtatgtctattatgaaacatgtaataaaaatagttgtgccttatattatggaatggagggagtacttattaggctccggtccgtttggcatttgggatggatcctggaacctcatttggtccaacagctttattttagtattttggtgtcttggcaaactgcttcaactcaagatccttattaagctccacttggcattcgtgatgttgcaaacagtaatattatgaaaaatataaacaataggagaaataatgaaagttggataatatattttctctattcgtaattcaattggcaaaataaactacaataatgattatatgttttaaattttcacatcaactttaaaatataatcacagcatatatagcatatataacacaccagcatctatttgagaggagtgtcacgtctgcatctatttgagaaacaggaaaaaaagaataaatgaacatatatcatgattaaggggccggggatgaaatcacatctcgtcccctggagtacaaaatcaatgaatggtcaagatcagccgcgtgcactagtggtaaaaacagcaagaaaaacccgtcaccccacttccgcggaggaaaggattaattcgctagcctccacatacatgagcctaaacctaccgagcgaagagtaaagcaccatcaaacgttaacacgcgtggcaatctagtaatcatcatcaagctgctatctcttaggctccgctcgaccagtgctctacgccggtgcagcccccatggaggcggcgctcttgccgccggtgccggcacagacgaggatcgggctgcgcaccacgtactttttccccgacacccacttcagctgcccctcgatcgtgctggccggcgccttgccggaggccgtcttgacggtgaccgtgtagttcagcacctcgttcagcgccctgaactccagcttcgccgggttcacctccaccgccagcgtcgccggcacgtccacctccacggcgtacgtcgaggtggccgccccgacgttcgtcgccgaccggttgatgctcacctcgtacggctccatgtccaggacggccgtgatggacgggtagttgagatccttctgatcgaccttgggcatcttggcgcactccaccgccggcccgggtggatgatcgagttcaccttctggtccttgtacccgagcccgcagaggtaggggatgtagtccagcgacgacaggtgtacacgagccccgggtcgatggctttccgcgcgttcacgtagcccgcgccgatggcgtagtaggtcgccggcgcgccgtccacgtcggttatcggcttccggaggttgtcggtgtaatcgg
